United States Patent 7,868,149 (PLANT GENOME SEQUENCE AND USES THEREOF) - sequence listing, part 58

SEQ ID NO: 31398 - DNA, 5813 bp, Oryza sativa
  unsure (1)..(5813): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttttttgttgccctccgctcgctctcatctttcgtgattcccggcgttcacgatggaaaactaaagttggcacccgtgttttccttttctgattatatgaggatttcgagaattctcttcccattgtattgtcactttcttgtctgctttccttcatcttttgggttgaatcgatcagttgatgtcgtgaaatggacggcatgaaaaacatcaatattttgtagaaaccagcatcaggcatcaggcatagcatcaagtgcacattctaagaaatttttgagaattctcctcccatggtcttgtcacttgctctgctttccttttatctttggttgaatggaacagtcgatatggtgaaatggacgccataaaacacaccaatagtttgtagagaccaagcatcaggcatagtaataagtgcactgcagattggttcaaactgacgatatctctgcacgaacatacagaatagctcaaggttctgatatgtacaactttcgatggcgtcaacgggtaaaggggaaatggggaactgtaaatgaggaaacaacagttatacaacattcctctttcgatgcagatgatattgttggtacaccactgatgatatcgtttaatccagaaggcggttctctgaataatatgtgcatgagcatcccgtcgcttgctttcacgcaactgttttacacattctgaagggaactctggtggccataggactggagccctggaggtgatctttctaacgattgattggttgcaccttacttgttcagaaaggccttcaaagaaaatggcgggtaagaatcctgctccaagagttgaaatgtcatgtatgcatcatgatgttaaagcacaccaatagttaaatagaagtttaagtggactgtagtaacttatgattatggaaaaacatgcaccccaataaaagaaatagcaataattaagatagataagaacaaaaaaaaagatgttcaacaagatacgatgcagccgtacagaatcatgattgatcgtgagatgaagaaaaagatagagatgttaccttgccaacttcctgctgtaggtattgtctaaccacagttgcttgctgtatcactctctccaatgatgaatatgctggtcgattagcatgtgctgtcattgatcatgagacaaagatcacaatcgtgtcatcagcggatgagaccacagcaaatagtatcttagaacataccaagaacaatatcttagaacataccaagaacagcccgattcaagctatctgcaacattctgcctgtactctgggcttagtagatgaaacataggtgacttctcaggctcttcataagctaggagggccataaagtcctatacatataaaacaaaagttaacttttcatagtattccaagcatagcattacaaagcagccaatcataagttcaatacacaaaaagtatgtcaccatatgttccatatttattttgttaagcggcacctctacttcaaacgttttcaccatattttgcatttaataaatataatacccaatggccggcgttgataatgatggactacctagcatcggtacttggataggacagtatagcaccagcaattactaaacaaatgcaatacaaaaaccgcgctgccatttaaatctgatgtatttaataaagataacaaaatacatgatagcccagaaaacaggctgacataactttgatgacaaatcagatctacaaggcggcaacatagggcaaatgaaggtgtgccaggtaccaatactgttttgcaagtagctaagtacttgaatagaaatctatatctcatgcatagtgataaactagattcaccatactgaaagttttttcaagaccaatatttttgttttgcctcttttgtatgggtaacaaatggtagtgaagttctttaacatcattgccagttctctaaattgatggcctgacaagaagacagaatttgcatgacctgaaaactgtctaatataagcatatgtaggtttaggaaaagttacctctagtttctcaacgtacttgggcactttcccaaatggcgtcaactttttctgaccaaactcaagagcttctgtgctgtcagtcaaaacatccagattaatccaaaatacatggcacagttattttttttccaaaaataaagctacttaccattttctagaacgaactaactcaatgaagtgaagacttaaaagatcaaaatgcaaatccatatcattctctagcaagttaggtgccaactcttctgtcaggtctatagccttcagggcattgccttccaacacaaaactaaaaatcgctgaaagaaaccaaaacaaaagcgttagatgcaagtgcatgcgactagacaaatggaatgcagatgcattttttaatactggcacagtgtacatgttcatgatagattagatacaatccatattatctgctttaaccaccaactatttcaaatgaagttacaaattccatccaagataacagagcatcggaaatttccagaaaccccataattattaatttattatttctaagggctatatttaatcctaaatccatgttgcacaagaaagttaggtatccttgtatgaggagtatagaggtaacagcacagtaaagagtcataccatgaaataaaccctatattaatggcatgctattagaaaaaaacctatcttacactttgtacggaaaaggtactaaagaataatatagctatacacaattctattacttcataacatgtgtaacttatgtagtaagtgttcaataaaacttgcatttgcaattatgtgcaacagagatcacatccaacaagttcagtaatgattgacaacaaacaagtaaacaaaaactgcatctatactgaactgaaatgactccatgtcccactagctaaattatgctgcaattccattgatgggttgattttacaaagattatttcagctaatgaacggtgtcgttagcacagcctttttgtccctaaaacaagtgagctgagagcacatcttttattagcatgaaacttgaaagggaagctgctaaggattgtgtagacaaacaaaaacatgagcattcataaaaagatacaaatgaactaacataacaatataaagtgcttatgcagcaattttacaagtgttgaacatccaaagaaagatacaagattcagtgttgatatgtgaataaatacctttacgcttatctacatctacagtgtaatcaacaggcagttccaaaccagtgctggataagaatgtctcagcagtctccttaaaacagttgtgcataagataagacaacactatgttgcggacatcgttatcactcacggactggaaaaaatgaaaatttagtgtcaatagcagtatataccttcaataaatacgaaggtaaacatagacatccagtgttagccgaaatttagaacaagaaaactttcaagcctcgacaaatgacagttataagtaggttctgtttatggaaaatatcagcagtgatattattatatacttgcttaatgaacacagctacatttatgatctatgcaaacaaaaaaatatggcatattcatgcaactagcattgtcaataatgatttgatgctaatcgagcgatgataaatgcagaagtatctatgagcagatagcacagaccagcatctgattttagggcaacaacagaaaagacttcaacaccacgttttcgctagctttggtgtcacatcaatttgtggaaaaatatcaggcataccccttttacctagattttaccaaatgggcactactgtctaaaatgctccagtatcccaaggtcttattcaacaaatacatgacagagaaacatgtgcactggtggttcaaactttacactcagcacaacctgttcaacaaggatttccccctggagtattgccgaagagaatgatacgttaagctgtggttgctggcatggcatggcatgcccgctaagtcataaccagtagaatgcccattcattctgctggatttcagcgcttatgcccattaaattccgcccgatttcaggaaaaatcctaatcttttcttgcactagaagccccacataatgaagaaaggtcctgatttgaccaccttaacctacctcattgtgggagtaccgatttttttgcactgcaagcaccttatcaacaaattcccgatcttttttcaccaaaagccctagcatgagcacccccaaacaaccaaactaaccatcgcatcctccccactaaacggatcccatctacacaagaaagccgaattcgcacccagacggagaaaagatcaagcaggggcacataatggcagcgctcgaagcaaacaagattcgctaaagcacctactttgcccccctcctccagcaacagcagagatgggttcctagaaaacctacctactaaccaacaaggaatacttaaagcaatcgagttgcgagaggtaatcaaagatgaggtggggaggaagggcgcagggtgcgtaagtagaatgagagcttacgacgttctcgtagaggcggggatccaggtccatcatggcgggagaggcggagatccgcggcggatgcgaggtaaaggggggacgcgggcagcatgaggaggaggggagagaggctgccgtgccgccgcgctgcctgcctgccgctggggaggccgaagattcccaaaaggggattttaacgaatttgctaaactacactatttaagttacacgagtgcattatttttctctccttctgtcttgggagagtctcttcaggttattaacgacttttcttttcgacgacttgaaaaaaaaaagagatttggagtttaagaaaaaaaaaccacacacctcttgccactatcctattctctctttctacaacttaagacgggccaacagaaaataatactacgaccaaagaaataagtccatttaataatctcatgaattttatttgtttaaaacatactccacctttttttactttatagaagactatccaacccaaaaacttttaatttatatcccttcatctaaatcggaatgatttccacttacgtgaaactaatcttacagtctagcaaagttttttaagaaaatgacaagccgacaaatcaggactatcttatatactccccatttaccagctaacttacttattgactatatcagccgccggtaagggcagttctttaaactccagtgcctcatgcttcatagactccgcataggtgagattgagttctaataacgtgttaagctcctttcgtcgagtttcatggttctaatcattgtcttatcattgcagataagctccagatccactatgtcttcttgttgagcttctatcgttaagctccatatgaactctctacatcctcgaactccatcacctcctcctccacaagctcgcagaggtgagctcgcaagctcaagcatctcttacatcgag

SEQ ID NO: 31399 - DNA, 885 bp, Oryza sativa
tttgccgggctaattctaacatttgcatcagtcaggctctggaatggcacagctatcataaatgtgaaattcttttgtatggaggtgatcaatgctgaaactctgaactattcaggatttttaggtcctcaactgagaagagcagaggatagcacacaggacaacacagtaacttgaaaaaggagaaaaaaaaacccaatcaacacacattcacgcgctgagctgggcgcaccactgcaccagggcttgtctcaggtacttcatgaagccattaggctcgtctcctccacgcgccgagctgggcccaccagcgcgacgtctggaccggcagctggccgcgggccgcctccacgctcctccggccgtggcggcacggcagggcctggccccggcctagcgcggagatcgcctagtcccctccccactcacggtgagcccggcggtctggcgcctttccagtcacggcggcgacgagcctcccagctggctcccggcgacggccggacgcgggtgaggcgagcgtcgggcgcctcgcgcggtggtcaccccgtcccctccccactcgcggcgagcccggcgctccagtaacggcggcggcgcgtgctcccagttggctcgtggcggcggccgaacgagcgcactgctccacgcgttcaatggatggattggggctgggggagccgtctcccgtcgggatggatggattggggaataatttcgacctgcaggcgggcccaagcgccatctccgttggatttattttggatggtccagatcttcccaatgtcacgctgtgacttgccttcgcaatgtcacccaagctgagtcctgcttaaggtgaggggtaggtgaggaaaataaatttggggtcgcgtcctgtgtcct

SEQ ID NO: 31400 - DNA, 3330 bp, Oryza sativa
  unsure (1)..(3330): unsure at all n locations
aaaataatattagcgtgtagacaaagcaagtgcttccatttttgctcatgacatatatattcaataatagatcaggcatatgctccatgcatacatgagctgcacacatataattttgtcatagaacgtgcaacatataatacatgctggtgacatgtaatgagaggttgctagttagatcatgtctgtttgtgtgtgtgtctattccactttttaggtaattgtgtttcttaattactgacggttgcgtgttttaacctgcagttcgattaccaattaaactagaggaatcaaagcattccaaggagatactcccaatacatgttcattgatctgtgatctaatcattctggttacataaaaagtcacaagcttcaaatcaattataatatataaatggaagatcctctccatgcatgagctatatatcaaattaattaaatgctgacagtaacgttacatgatgcattatatttgcatgaccaacaaggcttagcatcacacaattaatcaaaactaaagttcacattgtggggataaatcagatgaaaattcaaggcatatatttgatgcattctttgatccttaacaattaaattagtactatattccgaggaggcaagggtggccatgcccatggctccttgttttactctcaagttagttattgcgtctgcatgtggccccaatataatcgatcaacatatatatatgtttttatgacacggttgtatgttgggctcagtgttcatggggtcactgataggtaaggctctccgacaccatcaatcatatttccacatcgatttgatcatgcatctcatcttctttttccagtttccactaatatcaatgtaagaccaggaagaaatctattcccttcgtttcattttatcgagtcaaattttttcatgtttgactaagtttgtaaaattaaaatttagtatcatttactgaaaaaaaaatataatattatattaaaatgtattcaatgctagatttaataaaaacttatttggtgttgtagttgcttctatattttctctaaacttgatcaataaattgcacttaggacaaactcaaacatcttataatatgaaacatgggaagtgctagctagataattaaggttagtttcacttacatggtctatacttttttatttgttatcattccaaagttaattagtaattaaatttgtctggttttcagttttctttcagaaaagttttcataatttttctatcatcatctactgctttccttcacatattaatatatgtagctagattgcacgccatatataccatacatgaaacaaaactcagggtcctcaactagctctgatgattcttaagaactagctaagctagctagcttcttcattctaatatatatgtcttgttcttcttggtaattttcagattagtcagtacgtgggtatatattccagtgctgttatgatcattgctcaaacggacaacgaagaggtagagaattattgcctattagtggccacatgcacaatctatggtctaagattcagcattgaagcgtatatacagtatgttcgacccaattccgacagaaacctgaaagaggctgatcaacatgtacatgacgatggcatgaatgctcggtaattcatcagtgaaaagaaagaactctacatgcccttgacaatgtgttcaatccaaatggcttgaatttttcatgcattttgcaaatcagtgagtaataatatatactccctttagatgcatgcatgcctacattatttcccttgtacatgattgaacttggtgtgtatgaaattaacaaattaatatccaacatgtacagatcgccaatgcatgtgaataattcagagatatgtacttaattatatgttcatgatcagtactactggcagtgcaggtaaagctagccagctgcagtgatactgtgcaacaccaaacgatccagctgaccggggaacagtagctatagcttagagtcttttgccacaccacaaagaaatctttccatgcaaaaccaaatcaagggctagctggaatatgtgtttcaggaaagaaaccaagagagatggagatggagatgcagatggtgatccatctcctgtagttttcagctctggccctctctctctccatcttatattagcttgccaccagtatatgtttttgctgtgactgtagttgttgaggtggttggatcaatcagtccttgaaaagggaacagaggaaagaaagattaaaaaaagtgaaattataggtaagttgtgtgtgattcatacaagtgtggagaaagagagaaattaaagtatttccatttttctctttgagagagagagagagagtgatgctgatgagagttgagacttccttcatatgtaatgagtagctctagcttgttttaacttttaaggtttagggtcactggccggcacactgcctccatccataggaaaaagtttgctctctgctagtactcctctaaactatttcgacggaacacataattaaccctgacctttttggctcacttgaccaaacacactgtttaaaacgaaccactttactttgtaccgacatttcttttgtttctcacaattaacacacgacccatagttctatcactagtgagtgaagttgggtaattttttattatagtttaacggctaaaacactttaacgtaatagtttcaagtactagaataaacttttcggttcacaaatattatttactagtatttatttccttaagaaattttacgactattaattaaggagaaaccgagaggtagtaggagatataaaatttacatttaaaagattactctaaaggatgttaacatagtcaagactagttcatcaactcaaaacaatatcccatctctcacctctcctctccatcccctccaccatggcaggcgctacctccatgtcaacattgtcgttgctgactcaaagtcaagagctagctagccttgctgcggcgcaccactcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 31401 - DNA, 808 bp, Oryza sativa
ttggcaaggggatgaccataagaaaaaaatacaggctcactaggtgggatgttgtttgtcaacccaaggaccaggggggtcttgggattcataatttggagatacaaaataaatgtcttttaagtaaatggttgtttaagttaattaatgcggatggggtttggcatgatttattgaagaggaaatatctttataataaatctataacccaagttgacaggaaacaaggtgattcccatttttggtctggtcttatgaatgtcaaaagtactttcttaaatatgggttcttggattgtcaataatggggaacaaatcagattttgggaagatagatggattggtaacttggcttttaaggataaatatccatctttgtacgcaattgttcggaggaaaacatcttctattgccactgttatgggatatgttccgcttaatgtttctttcaggagagctttagttggtcagaatcttgtttgttggcatcagttgtgtgcctctatagtacatattcagttgaatgatttgtctgatagttttagatggaatttccatcagaatggcttgttctcggtgaggtctatgtacctagctttaattaataatggctatatcgagagaaacaagtgtatttggaagcttaagttgccacttaagattaaaattttcatgtggtacctgcttaaaggggttgtgttaactaaggataatttggcaaggcgtaactagaatggcagcttgaggtgttctttttgtttgaagaatgagtcctatccaaccatctctttatggattgtcattttgcg

SEQ ID NO: 31402 - DNA, 5744 bp, Oryza sativa
ttctctacacactttaaatcttctataacattattgagaataacatttttatttgaaggaatcacacctagattattaagggaagcagaaatttgatcatttgtaaattgtaaaaaagaaacattaacatccatattacctttagcatggggtttctccaagttcttttccgccttcaacctttcagctctttcaaggacaagctgatcactatcagaagctctccttttgcttttcctggatggagaaattaacgcctcgggaatagcagagatttttccaaccagtttttcttgctcaaccaacacggtctcctcatccaacccgtcaaaatcttcgtcagacgcagtcaaaccttctgactccggtatcaaactcaactgagaagaggtaaaagaaggaccacccctctcagtaagattactatcagtagccatactcacatcagagacacccagtccagacttctttcccatgtccttgtcattttccccatcgtcatttctcttcccatcaccatccccaaaattatccatatccaaaggaacaggatccccagcaccaatatctgactccactttaaaagacagctcatacaaatgatcaccaatggccacatcaacaacatcagggattagagatgggtcaaggaccaaaacttgtaaacgagctatctcataccttctagtaaataacatatcaacagctttagtaatcccaagaatagaaccaactgcccaaataattaaatattccctcaacccagaaggaagccccttacactgaacccaaacttttggaatgacatatttcacctcattcccaacacctctttctatgatctccatctgagcctcaccaactttagtgtgcacctttccccattccaccatgcgattcagctcagcagcagaaggaaagatggtatgaaaagtgttatcaccattgtcatgtaccacccacctccatttaccaggaattaacctctccaattcagatacaacagctttaactgtcatctgaccattagatattttaaccaaggccgccctagggtcatgcctaatcctttgtccagctgggagggggatatgaaaaaatcccaaaccatcacccccataaccacataactgagcagtaggtttcacagctgatctaaaaacaggacaccgggtagcaatgtgatccacactttcacaaatttcacaataaaattttgatgaacactcctgaagagtatgccccttagtcaaacacctatagcagtaaggtttacccaatcccttagtgtctgcctttgatttacctttctctgaatcagtggcgcaaacaagcaacccttgttgtacgggttcagcacccaccgccggggtaacagatgcgatgacatcacccgttttagcagcagcaacaagagtaccacccacagcaaccgatccactaactgacccagaggtatttgcagctaaacccgtagaaccactagccgaagttcttccaaaactcggtatcacaccaactgaattaactgcagaagtcccaacaatcttacccacatgtccactcggcgtcaaacctgcaggtagcactagcgatgctgacacagaggtagcagtggctccctgaccaccaccacccagcggaagaccagctgcaggaactccacccgggtataaaccacccggcggcccaaaagcacctgccggcggcgccataccacctgccggcacaccactagatccacccgtcgctgcaaattgaccaccaaacgacggcacaccgaagaactgtgacccagatgcatcacttgccggccggccaaaagagcccaaagggaaccctaaaccggaattgaagccagttggcccagcattctgtccaaacccaccgttccaaccttgtcctcctccaaagttgccatgccatctaccactgttgccgtgagagaagtcatggcgattgttgtgaccgccaaactttccacgaccccgtccccttcctcctctaccatctctgccttgctgtggaaaaccacctccggaacccggatgaaaaccccgagcaaagccaccgccatgcccgccagcaccgaaaccctagcgattgtttctctccattggcgaagaactagcgacagcggcgtaggagcgagcgcgagaaggagatcgatctcccaccaaacacctgcgcctcacggtaccagttttcgcaaaaagagcaactaacccgggtatgggcctataggggatagcgggctttggataaggggtacattgtggacttacgttaattgattcagattttgtaacctccggaagtttgggaaattccaaattcgtcaccgtcggatgaagtggaaacctcaccgaatcggaagacttcaccggagaaaaatcggacttttgaaaccgcatcttccccaccagaggagattgaaatctcgccggggtagaaccagaaacggtcgccgggaaaacggatgataccttcccttgcagcgctgaatagatagcctcaccaacagttctcggcggagacttcctcggcgacggcagcggcccactccatggctttgatgcgcactccagagaagatgacaccaacggccaagactcctcaccatgcaaagcctgcaaaactgaaaaacgagaaccagaagactcaccgattccattttcctgatgatcaacagcagcaactgagacatgcacaggcttcggcctcaacgccgaggccgccgcgacctcagccacatggcgtagccgaagacgatacttgcaaatacctcctttgttccaaaataggtgacatttaagaatatatgtagctgaatctctaaatcttaacttggtaataaatacacaatgttgaaatttggagtacatcagttgatcagtagtacacatgtgatgaaaaatatatgagaaagcttccatatggctgaatttttaaaactactactcacatcgttccaaaataagatcatctttgcctccttttaattgtcaaaaataaattcatctttgagcaattattacattgaaatatgtaaaaggggaaaataattgtattgggatttcataaaatgaagcgttttttttcttttgtgatagtatgggcgtgatgggtgaaaaagaaagttattttatgattaggcgagcgtttgaaagggtgataaaatttcctcgttttccacgtgcatgtttcctagactactaaacgatgtgttttgtttcaaaagaaattctattggaaagctcctttaaaaatcatattaatccatttttgaagtttaaaatcatacaatagtgggtcactgggtcaccacattttatgtatcttcttgtttcccctcctctaaggcaacagaggagattcactggtggagaaaccatctttggtcggtcaacccaaatccacaatagtcccggttccattaaaaaccgggactaaaaacgatttttagtcccggtttataagcgtaacaggactagatcatctttattcccggttggggttaccaaccgggactaaagatcatctttagtcctctttagtcccggttggtaacaccaactgggaataaagatgatctttagtcccggttgtctataagtcagaccatgtcaggcggctaggatctttagtcccggttggtaacaccaaccgggactaaagatctaactttattcccggttggagttactaaccgggaataaaaatcaacacgtactatataatccctattacttatcctcttttcccgtccacacaacgaactctttctctatctcttttttcctctctaactccctatccttattatttcttctaccttcttccttagttcttcttcttccttagcccgcttggatcggagcgagagaggccagccacttggagcgagagcaggccgagcggcagccggcgcggcggcgcggagggacgggcggcggtggccggccggcgcggaggggaagccggcgcgcagcagcgcggagggccgcggcggcggcgcgggggccggccggcgctgaggggaggcggcatggaggcgggcagcgccgcggcggcggcgcggcgtcgggcagcgccgcgggggccagccggcgcggaggggaggcggcacggcggcgcggcagcaggcgggcggcgcgatggcaggcgggcggcgcggcggtggccggccggccggcgtggaggctaggcggcagcggccggccggctcctctgttgtttttttttttaagaatttgtgatttattgcagcatcatgtgatgaatttgatttgtatgtgatgtgaacttgtgatgtatttgtgatgaattttgtagaaacttgtgatgtaatttgatttgtgtgtaattttttttaggatttgtgatgtatttgatttgtgatgtaattttttagaactttaaaatttgtaatgtggacttaggatcttacttcgatttgggatatgcataccacctatattagggagaaaataaataaaggatatgcataccacccagattcggaagaaaataaaaaaggaaaaaaaaacctggctatcctctttagtcccggttggtaacaacaaccgggactaaagataccctatctttagtcctggttggtgttacgaaccgggactaaagataccccatctttagtctccgattgctactcctggttgaaaacccgggactaaagggggttcccaaccgggagtaaaaagggtttttctacctgtgattgtccgtatgaaaaaaaaagaagcttcaaaagaaagaaaggaaggaagacaacaagatcaggaaggtagaactgtactacagctagcaaatggatttctgaaggaggtcacacgcaacaaaggtcttgttaaaatcagtttgattttaagaaatagcttgtcagaagtcggtttctaataatttggagaagttgatattcagttcattttatgatttctgtaactaaagcttctcaaaatctgaacgaacaacataatcgtttaatttgaggagaagttgtagctatctatgagaatctcgtcaaacatacgcagggtaccatcggtaagactacaacatttagggcatctacaatgcaagacacccatatagtgtcctcactaactgaatacacccatatggacattcgtctcacaatggaggccacaactagatgggtttctcaaaatctatgggtatccctaccaaaaagtcaccgcattaaatttcctcatctaccctcctcggcaactcctccctctctctcgtcgctcccctttctcccaatctcacgcgtcgagcccctccccaaccgccgccgcgcctccctcctcgccctccccagcaaccgccgctgcgcctccctcctctcccttcccagctgctaccaccgctgccgctttctcccgcgagatttggatgtggggagccacggtgctgcctcctactcccagcccagcgcgtcggcggctcggcgagcaacgcgcggatccgtcgtcgccgccggcatcgtctccaggtcatcgccggcttcgtctccctctccctctcgccgccaactctcacctctctctccctccctctctctctctctccctcgccgccgccgctggcctctctctcccgtcaccggcggccgtgagggcgatgagtgagaggggcgaggggtggaaggggaaattttttgtgggaacggtgtccacaagccacgctcgcgtccaacgtgccccctcggctgcgtt

SEQ ID NO: 31403 - DNA, 5039 bp, Oryza sativa
  unsure (1)..(5039): unsure at all n locations
gggggggggcggacggaaaggctaacgaacgttgctaggggcacggatcgaagctacgcattggtgatggccttatcggttttgtttagggaaaccataaccctactgttttagtaagatgacaaagaatcagttggtctacttctctactactagtggagagtggagtgtaggcagctgcggcgtggtgggggcggtgtgtttgggggtagtggtgggcgcccgccactggtggtgtgtgcctccggcaagccggcagtcacgtgaacgtcaattccatccactcactgccccaccccaccctccctcacatgcgttgccacgctcatctctattgctactactgctaccaacattgttcgacagaaaacgaaatattttcaagtagtaatatcttttggaacaaaaggaatttcgcaaaaacgatagagaaatcaaaccaatctctactagtactcacaaacactggcgtgtatatgtagttgctgctggtcgttgcatgcacgtacgagctcgttcgttttgacttgggatgcatgattggtagcactagtacggtgtactccaaaaatagccgttgcattgcatgtccggattcgttatccagatctatacgattataactacttatcgatctcacttatatcacttggactttagctactaagtaggagtatcagtgtatcactcactctctcccggtcggataacacaaaaacctctctgttttctccgacacgtacgcccaatcatcaacacagctacaactatatctagctatccaaggaatctttcatgcatcctcttcttgtgtagctctagtccaactacagatcacaatgtcaagagaaaccaatcttaacttaacattataccctacccgtatctatctaaccacataccaccaaaaaaaacacctaaattctattccaatgatttcatactagacatttccaaaaactatcagccgctgactacctaatatttataactatactagtaataatttattttttgcagcagcaacagcgctagtactagtgcagtagggttgttaaaccactctcactcatggtggaagacggcaaaagtgaaaaggcgccttcactgcccaacgcacgtaaaagcaaatgtagcctttcccgaactccaacccaattccaactaaccacctacgctttccagttactctccagcctttccctacgtcaccgacacgtgggccccacccacgctctctccctcagttctgacaccaaaaaagccatggatgaattacgaggtcgtggtaaaaaaaaaaacattacagcgaacacctcacgggcattacatcgaacacctcgccgacgccggcggcggattaacgaagccagcggcggaggtcggtggtggatgacggagagaccacgtccccgccgaggctctccgcgcaggacgacgacacgttcgaccgctgctccgacgagaacctccccgccgcgctcttgaagctcgggctccgcaggctctgcgcgtacgcgccgtacgggtcgatggggacggggaacgacagccgcttcttcgctccgccgccgccgccgccgccgccgaatgacatcctgtcgcgctccggcgtcgccgggcgctgccgcggcgcgctctgggaacgcacccgcgccttggcggactccgtcgccgccatgtagttcggcaccgccgccgcgccgcccgacgacgcgtggtggcggtgcgagtgaaggctcggggtgtagctccctcccccgccgccgccgcgctccacgcgcgggcttgccgaccgcacctggatcggcggccgcgccttggatggcgacggcgtgaccggcgagtggtggtgcgcgcggtgcatcggcgacgacgacgcgtggtacgacgcgttgccgtgccggcgtggcgtggagtaggagaagggccgcgcggtgtcgatctccagcgtcttgacctggtcgcggtggtcggtggacgcgcgcccaggcgccgccgctgcggaggcgcggacggtgctcctgctggtgtcgaacgacgcgcgcgacgccatccacctctccgcccacctcggctgcccatcgacgtccatctcctccaccgacggcgccgggttcctccaaatctaccacattacaccaccaccaatgaaatcgaccacgaacaccactcgtttgcggaaatgacaggaagagaaactgtcatattacttgatgggagaaggcgtaggagagcgccctctcacgcttgagcgcggcgtccttcctcgtctgcagcatcgcctggatctcctctatcgtccgcggccggtcgtcccagtcgtcgccggcggcgaagctgctgccgtctcgcgaccgctcctgcaaacaaacaaaccaatgagaagcttgcaatgtgaggacgaggacggggcaaagaaagtgggaggagaagtggaactgacgatggagcggcggtcggcagcggcgaagtcgtgggtgtacttggaatcccagaaggtggaggtgtcgacgctgtaggaggacttgctgctgccgcatggcgcggcggaggcggcggcggcggacaaggagatggagtcctgggagaggcgcatccgctggtcgcggacgcgggcctggacgcgcaccagcgcctgcatgcagcggagcgtcatgttggcctgcttccgcacgttgtggccgcgcaccagcgcctgcagcttcacgagccccttgagcgcccggagcgcgcgccgcgccaggtacccgcggaacgcggtctggaccacgatggcggcgtagtgctcgcggacgaagctggagctcggacgcgtcagccggaccacctccgccgccgcctgcgccgtcgccaccgccgcctccgcggtcgccgccgtcgccacggcgagcgcgatggcgtgccgctgctcctccgtcacggccgccgccctcgattgctgctgctgctgctgtggcggcggcggtgtcggaggcgcgggagacggcgacgaggacttcctgaagagccatctgcggcgctccctcttgccctggacagagagaagaggagagaagtgagcgaagagaaggtgttcgacgaaatgcgagtaggcgggtggtggcggaccttgtcgtcgtcggtgtcgtcgcggaggcgggcggccttgttgggggagtcgtccttagagggggagcggaaggcgcgcttgacggcggtgagccaggaggaggtggtgccggccttcttccccatcaatggcggccacgggcattgacgtacgggaggtgtcgcaacgggcggcacgaggtgaggtgtatgagtattattgcagctggggtagcagtgacagtggctctcatggctcacgcgctgctgccgcgccttttatgtggtggaggagccattaaagtaaggttngntggggggnagggtggagaaagtnagagngagagagtgggggagggagaagaagaaagggtaaagggggggngggaggggggggccanggttgtaaaaacaatnnnnnnnnnggggggggggagtgagtgggtgaacgttgcgttgccttccattattccgttcgtccggtatgatgattcatgaaccgctgcgcacctgcaatctctgcatctcatcctgatgatgtgatttcaagtttcaatcgctttctctcatttatgtttggttcacatcaaaattaatagtttggtattaaaaatttacgtgtgtagaaaaattttgatgcgatagaaaagttaaaagtttaaataattaagccctaggacactaggaagctggctagggctgcctagggatggagaagtggaaggcccgtgaagtggtgaaccctcagaccgttcacaatgcaggtactcgtagtgatacctaaggtagtgtttggttgcaaggatgggatgggacgaacccacttttaaaggtgttcggtttaagggtggatgggatgggttggtccctggaaaggaataatcctctcagatccgggaccaaccgatccgccaaaaactggcggacaaactcgtcccacctgggacgagagacggggtcaccgcgccatccaccaccttcgcgagctccgccgggcgcccacgagcgtcgccgcttggtccacacccgccgccacctccgcacgtccttctccgccgccgccgcctccttgagcgccgccgcctctgcctcgtccgcgaccgccgccgcctccatgagcgccgccgcttgcccgcgaccaccacctccgcgcgtccacgagcgccgcctcgcctccgcggccgccgcagccgcctccacgagctccgccgctcgtccgcgaccactacctctgcgagcaccgccgccacctccgcgcgtccacgagcgccgcctcgcctccacggccgccgccgccgcctccacgagtgccgccgctcatccgcgaccgccacctccgctagcaccgccgccgctccactcagatccagccgccgcctcgcctccgcgcccggcgcctcctccgcttcgtccatgactgccgccacctccacgagcaccgcgaccgccatctccacaaactccgccacctctgcctcgtctacgaccgtcgccgccaccttcgcaagcgccgccgccggtcctctcagatccgggcgccgccgagtgcctccgcccctagacggcactaacggtgagtacaaatccatccatcccatcccacctcaatctcttctaccaaacaaaaaactataaccatcccataccataaaccaaacagacaactggaaccatcccatcccacaaaactaggataggtctgacccatcccacttcgtccccaaaccaaacactacctaagagaaacggtgagccggatcccaagttaatcgctcgaaccttcacgtgaggacgcgcgcgcacgccctacctgcgcgagacactcctccgtgcctatgttggctaggtcgcctcctcacgtttaattacatctggtcgtcccctcatgtttcatctggtccggctagccctattcagatgttgccatgatcgagtttgatactagggtt

SEQ ID NO: 31404 - DNA, 4560 bp, Oryza sativa
atatacccttttttaaaaattgtcttcataaaactgcccacgcatctgcgcgggctttctttctagttaattaaataagtatattaattacaaattaattgagcttgtaattgattagtttttagttagctggccaaaatacagtgatatatataaatgggttaggtcatgtgcttagtctcgggtgtgtggcatatatttatgcaaacgacgtctttttgatcaaaactactaacgaccctatcgtttggctgattataagcataagcgaaataatatatttacaaattacaaataacttgtgattaaaatttttatatacgtgtaattaacgatattaaagcaaaggctgaaaaataaaatacgacgaaaaaaaatctcaaaataaacgtaactccaaattaaatttaaagttaaaaatttaaattttggctgataagcataatctaagcgaaaagatgggggccgtaagaccatagaagaggacctgcgagctagagcacaagaaatattaaacaaacaagagacaacacttcctctcttttctcttttctgatcatctcttttcaactttttcgatccaattccatcattcaaacagaaaggaatggctcacaaaggacgccttttatgaccgagatcgaaggaaaaagtgcttttaatttctatctgacgcttatatgttaaaaagaacaaataatgtcaccattatagtcagtgaggtgtgacttagaacatatataaaaggccagcatgttttcctcgagggcacatacatacgacagcgccagttaagtgcactaacgattaattatgcgctctaaattaaattaattaatcttgagaatatttttattttgcccttcttttatgaggcgatccatatatatatatcacagatctatagatggatgtgaatcgatgttcattgtgtctttcttttttgtgataatttttagtttattacctatagtgtcatcagggatatttcattatactagttattgccctgaaactcttgtgcaacagttgcaggttaactatgggccagtagccagcatttgaatttcttttttggaatgcgcaaaaggtttgcgaatccgtatattatatctgagttacacaacgcaaaaggctatacatgctcttgtcgggtacatggtagagatcttaggaagagtaagcggaaaaaaaaaagaaaaaaaaagctaaatagtccgtccacaaagaaatggttgatgttatcacctttttggctttttcacggtcttctgggtatgatttcgcccacaattttatattcaaataagtttataaaatctaataagtttatgagattaaaagggcattttccaagaaaaatatatacacatcaatttttttgaagtttaaatctaaatatctgaaaagtaattggtagtaaaagttttaaagtttacctgaagacaggcacccggatttaaagttaatcatatccgttagatttaagtgcctcaaaatttgtaaattttaatttatctaaaatgcacctttctaagcctaaaattacattgttatgtgatgtacaattttagtccatgttaactgtaattttgctttcatatctcatctatggttttactttgtgttataagattaatttttttgcatgtgacgccagtctctcctcacgtctcacgtcgcttgctcttccccatgtttttagccgacgttactttctccatctcaaaaaaaaaaaaaactcaacctcatactatgatgtgatacatcttattacaatgaatctagacatactttacgtctagatttattgtcctagtactatgttgtctttttttataaaaagcgttgttatgcaaaacttttttcaattccatctcttctctctcctgcatatcaccaaattggcttaaatggcaataaaggtacccggataataatacccatggtatatctaataggatctatccacaccctacataattaaaaagactagcttaatacatcatcagtacgctctaccttttaagttatgatccgcataatcaattatcactatcagattaaatccaccaatgacatcatcaaaccacgtcatccttattacataaattgcatcattaattgcatctcctagagaaagaaatgtaaagaaagagcttcaaagaaggaaccgcctggggtgtttttcatgttttagtattttatttttactagaaaaaatacccgtgcattgcacggataatgattttttaagtgatatattaaaagaataagagctaagcaataaatagaaatattaggatcactatacattataattgaaaaggataatgaaaattgtaacactgggatcgctatacatagattataattaaaaaaaagttaatgaaaatattttccgggttttgggccgaaagctttcctttcttttcagccctaggccagtccactacctctctctgtttggcatgcttcccttcgagccagggacaagtagagccgtaagccccgctcgcaccgtccaataccatcttcaaccttccgaagatagtcccgtacccgtacagttgccagagcaaatcttctcatcaaattcgatcgaatctttctcgatcacttaaaattggttgaggattttttatccactcgttctgctctttcctttttcccaataaggatgaagcaaacgatgatcaattagtaattaatatacaagaaacaaacgatgatcagtctcctctctctcccctcccccattaattcttcctatccatggcagccggggtggccggtctcagagcatctataatgtttgaactagaagatgcaaaaaaaaaaaaagtcatcttctgtagcaaagattaaggtctcaactcttaatccccaaacatagcaaaattagggcttttcccttgagagacttgagcggagtgatggagcggcagcactaggcggatctggcacgtactggtaaatctcgagcaaagcgctggccatgaattctcctcccaaacacatgatttgttaaaaatgttttatttttcacgaacacgtaaaagaattgcacgttaatacattagaggaaatattaaaaatgttcggattttcatgcatcggaattattctcctcccaaacacattatttgttaaaattgttcggatttccgtgcattgaaaatcagcgcatgcactatatacaatttaaatatagatatacgtacatttaaaaatggagagagtagtataaatttctactcccatatttcaatataattgtcgttttaggattggtgagctattagctgaagatgaaaattactaagttatcctcaaattattactagtaccagttgcatgtggtcatttcaacaagagaattaacacaaacagcactagccacacaagaaatattttaagcatagaattaagtagtgtcacatagaacagtcccaacccatagtgtccataagtagtgtctatatagtgccatgtcaataagacatcataatagaaactacactcgacagcccatgatttcttaaagtgggccattaataaatacatcatctctcttctctaccaatcatatttattcttcatctattatgaagacattattctatcctaatgtaaaacttgatagtatctagtgcataggttctcatgttgaagctgtgtcttgcatgagacccagtttcttcttggcttcactctctcttaattaatatagtaccacattagcttaaagttctattttggcatggtattaatggcattaaaccctattctaaatgaagggtgggaactgccttattccaagtaatactagtgctactttactgtcaaaacgtacaaaacgtcaagtgctcagagacaaatgttaggggggtacgtaaaacgtcgaagtaatctgggacagtatgtgccctccatggcactattgcatatgcatgcatctgttgggactttatgatcgaactgcaattaatctatcagttgctatttgattctgcgttgcagggtgtgaatttaattaattaaggtgcagatcgagacgacagtgtggtcatctctgttcgatctgatgcgatgcgatgcgatgcatgggcatcaggagcaacatgccacatgtactgctattgcaactctgccaacggtagctggcggtgaaccgatcaatgcatgccaggtacatagtactccctccatcctataatatagtaatctagtaccggatgtgatattttatagtataataaatctggacacctttctgtccagattcgttatactataaaatgtctcatccggtactaagttactatattatgagacggagggagtacgtcctttaattttggttgtcaactcaacgtagtactagctatgatcatttcagatcgatcgatgcagatggagtgccagttatcgatcgatatcacttaattatgctaatcacaatgcataatatatagtactttctagctgatagcattttctctcttgcttgttgcatcgcttgcaagtgttgcttaataataattagtttttgataat

SEQ ID NO: 31405 - DNA, 30408 bp, Oryza sativa
gtatgctttcaacactctaactgtgccttctctaacggtacaaggcctccgtaagaacggagaaatttcagagtaatttcagagatatcatacatcgatcgagcaaataattgatcgataacttggctggccgattaattagcagcacctttaagctcaagagagagaaagagagtcaagactataccatatactccctccgtcccatgatataaaggattttgagtctttgttatcctatttgaccactcttcttattcaaaaaattttggaattattatttttttttgatttactttattatccaaagtactttaaagtacaacttttcattttttatatttgcataaattttttgaataagacgagtgatcaaacactacaatcaaaaactcaaaatcccttatattatgggacagatggagtattgtactactacctccatcccaaaatgtttgacgccgttgacttttaaaaaaatatttgaccgttcgtcttattcaaaaaatttaagtaattgttaattctttttctatcatttgatttattgttaaatatacttttatgtatacatatagttttacacatatcacaaaagtttttgaataaaacaaatggtcaaacatgtttaaaaaagtcaacggtgtcaaacatctagagaaggagggagtatatgcttcaacgctctaattgcctctccaacgggacaaggcctcctttagaacggaaaaatttccaagtaatttcggagatactgatcatataaattcaatggaaaatttatctgtaagatgcagagaaatgacaggttatatttctctaacaccaaagacacaaaagcacttctgaaaggctctgatcagttaagctacgatcataaagtgaggtaaacaaaacagagcaaaacaacttagaaatactccctccgtctctaaatacaagatattttggttagatgtgacacattctagtacaacgaatctgaatataaagtctatctaaattcgttgtactgggataagtcacatctaaccaaaatcccttatatttagagaagagagagtaatttgtaaaagcaaaggctgaatcatagacatgattaaaatagaccctaaaattaatctaccatgaagttttaaaatttaaattttgcaatgacacaagcggatgaaagaaagaaaaaacagagatattaaatactgtgcaatatggagcaacacgtgtggcagataggcgatcacgtcggcggatcgtcggagcacccaaccaacacaaatccgtggtgcaccccacagtgggggcacaaagaaattaacctaccactcgtaggatttgctcctaaaagccatggaaacacacacataatataatcagattaaaattaattaaccaactactagaaaaactagctatatatagctaggtgactatatcatcatcattatcatcagcttctgtttctcaatcgatatcgaaatgtgacaacctagatgacagtacatatatgcatccatccattagccatgcatgcatcatcctcttgagtttctcctttgtgcattgacttgggagagacagagctaaaaagtctaactaaaaagctatctattgatctatagatgcagatagagggtgtcacctgatcattttccctgctcctccctgtcccagcactgcagtatcagcctatttaggcagttaagaaggtcaaatcagatatcctgcaagtcgtaataaattggcaccaaatccccttaattcaatgtgggttagttcaaatagtggtaataagttatccatcaatttttagaccagtatggaacttttacctctttgtgcaaaatttactcctgtatgagaagccaatgtgaagccagttttttttttcctttttggctcctgtatgagaagccaaagtatatatagtcatctgtagctaattgatgttaaatttactcaaccaaactgtagaaataatcaatgtggctatatattgtagcagtgcatatatggggtgttggtgtgtatgaattaattagtagggtatctattaaataaaagataaaggttttatgatatggtgtgggtgagaggggcatgaatcatgccagcaaaggtattgtattactgtgcagtatagtagtgttactgtatgtgtacaggtgaagccgctgtacatggaagaagccagcagacatgccatgctcaagctatgcaggctagtgacacgcatgctactactatatagtgtacttacctgcttttgatctgcttttgactcctgctatagtgctgtgaaggctatcccatctataaagcatttcatactgtcaccagaagcaacatgtttttctcacatgggaattttccttgttttatactccctccgtcaaaaaaaaaaagacaaaccctggtttccgtgcctaatgtttgaccgcccgtcttatttgaaaaaattatgaaaaaaattaaaaagataagtcacgcacaaagtattaatcatgttttatcatctaacaacaataaaaatacgaattataaaaaaatttcatataagacggacagtcaaagttggacacggaaacacagggttcgccttttttgggacagagggagtactctccttcacagatacttgttcaaacactatttatattgaactttgaccatttgtctttttctataaattttcttttataatacttagaaaattcagtattaccaaaatgttaatcctaaatataagtattaaactttcattcatgtatctttgtttaacaagctaactagaaactgtaggtttggtaatctactaaatttaaatcataatgtgctaagaatatagatcacccttatgcaggatttggggatcaccgaccgtctcttctagaaccggattggaagtagaatacaaagtccatcgaactgctccggtgatcatcggtgtagggaaagtagtcatggtagtggtgcggacgaagtggttgccgacttgatcccgaaggggtcactggcgatgaactgcaggatagcgtcgtgccatcgtccttcgaggcgccacctacactaacttagtcctttgaataccctccaacgcttaggtcaattttcccatccgaaactaaacaatgccaatcaaatcatcagtgacaagtattttgaaacggagaaagtattttatatgtctgtaaatatttttacaacattgacataaggtagcagagagtgaggaaaggagtcataaacagtgagaccatggacttattggaagtgccatacatgtgtggtggtacgtatgactacgaaagaaaaggaaagaaacaaaggaccggccagcctcatggtgaagcccaatctgagagtaacaatttttatttcaagtggattagagcagtttgtgtagatgggcttgcctagatttgcaggcaggcagccatacatatatgagtaaatttcactaaactacatatactctggtcaaattatcacaaaactacagatttaaggagatgtatcacaaaactacagatttagcactaaatttctcaaagaactacagatttaagatggagtatcacaaaactacagatttagtaacaaaattatcacaaaactacaggtttagtgtcaattcaatcacaaaacttatgcatttataactcaaatataacactagtgctaaggatttaaattccaatatatgtagttttgtgataactttgttattaaatctgtagttttgcgatactccaccttaaatctgtagttctctgagaaatttagtgttaaatctgtagttttgtgatacatctccttaaatctgtagttttgtgagaatttgactaaagtatttgtagttttgtgaaatttactctacatatattgattgggtcatagattttcagcccaaataatgaatgcttatcttggcaatttcattagtagtttggccagacaggttgggcttaagtttcagaaaacagaaagctgcttgggcttgcagcatctgggaatttttttagtgcagataaaggaaaaggtacaccgaaggtccctcaacttgtcatccagataaaaaaacgtcctcgaaccacaaaaccagatatgcggggtcccttaactatacaaaaccggtcacccgagatcctccagtggttttgaccctggttttagcctatgtggggtgtgggacccatgtgggccccacatgtcagcgtgccacgtcatcaccatccctctctttccctttgtcctctcaggcgacgcgatggtagcgacgacgcgggagcagggaaagaggaggccggcggggggacctcccatcccgacagccaacgcctcgctcttctttacctacgacgaggccacgcacctgctcacgccgccgacctcctctatttgtgtttggcgagtggtgtttgatcgacgtcggtgtttggtggatgccgtgcaggccgagcggatgcgcgcggggctggaggaagcgcagcgacggcacgtccgggcgttggtggcggctgtggcgtgcgccacgatggggagggtgcgtgcggcggaggccaagctggatcgcgcacgctgccacaactcggagctggaggagaagctccgccagattagtgcggaggggcaggcgtggatgggcgtcgccaagagccatgaggccgtcgccgctggcctccgcgccacgctcgactagctcctccagtccccctgtgccgtgactgccgtcgccgccgccacgaggaagggcgacgccaaggacgcgcagtcgtgctgcttcaagaccccaggcggcgccgccgccgccactgccgccgacgcggtgtccggggcgacgtcgtgcaaggcctgccatgtcacggaggcatccgtgccgctgctcccatgcctatgcgacgcctgcgaggccgccgccgccgcttgccccgtctgcaccgccaccaagaacgcctctgtccatgtcctcctctcctgaagtcactcacacgtgctacaccagccagccactgcatggagtaggagattttgatagcgcaacagctatggccagaccgaaaccgggcatccgtcagccaactccggtgtcaagcaaaaagctaacaacaatcatcctgtcccaagttacatggaaattcatgctagggaagccacggttctgtgcatctgtgcatcagtgatctccgggccatgcgagttttgtcagtggaaacaacagttttcggtgcggtggattgaatggttgattgccaatctcatctgccgcaggtaccattgcttcaaatatttggcagcccaggtcggcacgtatgccgccccgtctccccgccggccgctgctcgtcagttgtcctccccatcggctgccgcccgtcccggcacccgttctccccgccggtccccacctgttgacgatgtcccagcgccactccccatccgctggccaccgcgcgctcacccgcctgccgccactaccgctccgcgcctccgccgtccgccgctcagcctccctcgccgcccggtcgtctgctccctacccgtcggccggcctgcaagagaagagtgcgagagagagaggggggagagagagagagaggggaccaggggaggaagggagagaagaataggggaaaggggagttgacgtggaacgctgacatgtggagcccacgtgggtcccacgcgccatgtaggctaaaactgagtcaaaaccaccgaaagatcttgggtgactggttttgtatagttaaggaacctcgcatatctgtttttgcggtttgaggatgttttttatcccgatggcaagttgagggaccttcggtgtactttttccgcagataaacaacaggggatttacatgatgggcctccatttgcaagcccacaaaaatctagtctcaaattaattgctctcactcacacagagagacagtgaggcctcagacctcagttttactcactccgtactaaaataagttaatctcgtacaagagaatgtgtcacatacactagattcaaaacatacattggtaaatgagcagaagcaaaagggtactttaaataaaattgcctggataagaattgggctaagctcaaggaaaaacacgatcgtcatatgctagctctctcctcaactgcatacatatattgacatttactccctccatcccaaaatgtttgacgccgttgacttttttaaaaatatttgaccgttcgtcttattcaaaaaatttaagtaattattaattcttttcctatcatttgatttattgttaaatatacttttatgtatacatatagttttacacatttcacaaaagttttgaataagacgaacggtcaaatatgttttagaaagtcaacggcatcaaacatttagggaaggagtgagtactagataatttgtttgtatgtgttgtagattaatatgccaagtaattgtagtgattaaatactagccagcatcactacgaccaagaggattgtatcaaaataaatgtgaaagatatgcagcaaatcttcaataatttcaggacttatcaaataaaaaatccaccatttatcaggtcattctactaaaatctacgattgcaaaaaatcgtaagacttcattacttgtatttatttgccactccatacatagttcacactacagcttcagcattgaattctcacgtcatatacagcagtgaaatttgaaaatatcgatctgaaccgatgtttaatacaaggttttgagaaaaataaacaagcggaataagtttgttgccggctgattccctcatgaaagtccacctgaaatttaggaaaacaccaaaagtgtggcgatatatatagtcatgggtaatgtgtttgaaaatttcatccaccaggaatttgcactcgaccttcgtatctttgattatgtgtcttacatgtgttccgcaggtgtgtgagtgtcatacatgtttattttcttgtaatgaaaaaataagacaatgtaggattcaatttccaacaaaaaggtaacattattcatagatttgccaaattcaagtgtttttctttttttttaaaaaaaaaggcagatgtgctactaccaaacggatacgcatatgcacgataagcttgcccggtagtacgactcactaattcaatggtaattttgtcgccaactaagctgcaaccctgtacattgctcatttgtcctatctatctttacacacaaatcgcttactataactacaaattaattatatttgcaattgagcatcggttgcaaccctttacctaactcatttcccctacgccggcaaggcccacggcgtccacttcgagatgaagggaaatggacaattttaaattcaaatatagtacacaattgcaaatgtaaatatttcaaacgaaaactcatatttgaaaatgcgatcgattggtataactaaaacaaaatgcatgtccccgtttacaattccaaaactgcccaacaacttggaccgaattattcaacaaaaattattaaacaaaaatgtttagaccgatcgagctttttttttcccacaagtttgaataaattatgagagagaatttggcgaaatcaggctaaccaaacatgtttagcgtgacagacttctcctccctccggttcatgatcaacgagccgagcgcgatgagatggcttgcaaacttgatcccttgctcaagcggtgccaccatggctactggggcgcggaacaaagagcctacacgagccaactccggcagcagctccgccgaggtggccatccttactgccttggaccacctgagcacagcgagcctgactgctctgacgcggaacatgagcttcttgacatcggcgagcctcatggcaccaccaaactcctcgcttagcatctggagagtcacctcaccgagccgccccttgagacggaggtacctcctcacgacacgggcagtgaagtggtcctcattcggtgcagaaacatcgccgtcgctagtgctatcgacggtgacctcatggcgctcgcctgtgatggggtggacggcaagcacgttaactatgcagccatgtcgttggtggacgtcccgagcatccttgagcagttgctcatagtcctctttgaatggcttgatgctcttgacaatcttcaccatggcgtcctttttcccggactatttcatctcaaaaaacaaataaataaattagctaaaaaaggttattatgagatgcacattagttgcaactgaaataagtgtttttgctcattacttacgtttctaactagtgacatgtacacatatattctctcaataaaaaaatggacacatatattttgcataagtgttctactcattacttactttgctaactagtggcatgtacacatctgttctctcaataaaaaaaattggactcatatatttcataaggatgcaaatggattggccgtactttaccaattgtcatgtcaatcactacattagtaataatattataataaagaccttggtatagtgaccagcaatttagcagtttttctacttgctattattattctagaataaaatcatagatctgcggattgcatccaagaatcgatcaacttctcactagccatgaaaagaatattttaactcgtaacgactccacagtgcctcttgccagctttgtttcaaaattaggtaaagctatatatatatatatatatatatatatatatatatatatatagacacacacacaattgcatgaatgatgttcaaggaagcgccagtaccaatctacgctattgatgcactgacaaatgtttagagacaattgagaaactacattacgataaaagtttgagggcgaacatacctagcgatgtgaggagagatggaggagccgtaggtcgaagattttacaaggcaagatcaataaaaaagaattgacaatgcaatgagttgtgaggagagtggaagagaatttatagcgagggagaatagaaaagggttgacgcaccaccgaaaaagacaaaactagttaattgaatttaaaatcaaatctaattcgaaaaaaaatcaaaaccatttaatatgatttaaaatcaaatccgattcaaatctgatatttaaatatacaatatggaatagttttaattttcatacatatagataatgtgatatcctgagcaccgcggtaccacacaagggttggggtaagatggagaaaaggctaaacgacttcataatatcatatctacttctcatagcaatggacggtggatgaacatgttacagaaatggtccagagctagagaaacataatagaaaactaattctatgacattcgtgccacgatagtcaatggctcccgtgacatgaagtggatgtggaaatggagccagatctagaacaatacgtccggctcaaatgccaagggttgtccttcctcggcacaaccagcgacggtcgtgccatcgtctttggcaacatcgtgccaccaacatggaccatgggagataccttccaaggcaatggccaattacatattacagtacagccagtacacaattacaaatgtaatcattccaataaatttcatagttgaaaatgtgatcaattatttgtaataactaagatgtaatcactgtctccgcttgcaattctaaaaccgtccattaacttggaccgaattattcaacaaaaatttattaaaacaaaaatgtttcacccaatcgagcattagagctatgatgaatttccctcaagttcgacgaaacaatgcgataaaattttgtgaaatcaggctaaccaaacatggttagcataacattcttctcctccctccagtattcatgattgacaagccaagtgtgccaagatggcttgaaaacatgaccccttgctcacgtggcgcctccatggccgccagaactcggaagaaagagcctaggcaagccaactcaggcacagcttccgccacggtggccatctttgactgccctgacacatagcttcttgatatcagtgagcctcatggtacttcgtcgagctcctcacttagcaactggagagtcacctcaccaagctgcgccttgaggaagaggaacctcctcactatatgggtggtgaagtggtcatctctattggcgctgacacataatagttgttggtgttgtcgacgataacctcgtggcacttgccggtgatggggtggatggcaagcgcgttgactatgcagccggttcgctggggaatgtcttgggcatccttgagcagctgctcatagtcctctttgaatgacttactgctctaaacggtcttatgtgcgcattaaatgtaacagagcactaacaattttactcattattattcttactaatcatgtatgtatgtatgtatgcatctcatgtataacacataatccatcatctaaaaaaatgtatagcacataaattggtacttttattctgattgcgaaaaaatagactaccaattcgattcaccaataactatactagaagggagtgtataacacattatttattatcttaaaaaaatgtatagcacataaagagatactttttattttgattaaaaaggaatgtatgacacataatccactatatttaaaaaaaatgtgtagcacataaagaaatatcttttattctaacaagaaaaaataatagattgccaattcaattcaccaataattatcctcagtatgacaactagagatatagtaggctttcttgttgtagtcatttttttcaagctatttttttctcattgctctgcccgattgcatggaaataatcattgttgaattgattgactaatttggccggtaattaccatgaaccaataataaatagcacggcggtgcgtgcttggccaacgtatttctgaaaatgggtcatgttataactcgttcttcattacttggaataaataagttttagttttaggtattctctaattaatccgaagtatcccctaaaatgctatatatggtcctggatatgaatggtaaatttgcaaacgactttcgaatggtatttagcttggcgatctgactgtcgaatgatttttacacttccgttggctaattaatccgaattatctcacctatgaatggaaatttgctaaacgtttaaattttaaaattgacaatttaaccatgtttatgccattagtgaacataaagatgcacgggctactgatggattaacggaaccaaaggttgtcaactctcatttcctttactagtaacaaaaaggcatgttaatttggattggtgctaatatgtgccatatcaatattttgctagtttcaatagtaatttattggcatttggattgaagccatttttttaccaagctataggtctatagctagtagcaaatctacactcctaggtagtgccaaaacttctgcttttggcactaccaatattttggtgggggcctcaaaccaacaagcccaaatagccaaataattttgctaaaaacataccaccatattttcaatagttgattttagtaaattatgttctttgtcattattgctatcttctcttatatgtatgtaaatatgtttatatctctgatatcttttctttcaaatatgtaatgaattatttttatcctaattctcccttgcatagtgtgtattggaatatgtagtgcgcattgcaaatgtttgctatatatttacattgtaaaagaaatataacagctttgtaatgcaaaatgcaacgtagctacaaatatagttagtccccaagctacctcaacaacaacaaaaagggatttccacgcttgaatatacttatatactaaaacgttgaactgggctttaaataatttgggtgaaactacttatgcatcccaccctcttcaaactgcagcgcaggacaacgatatacatagaccgagttgaaacaaaacaggttgaacacttagtaaatttgcagaagaagtggaatttgttttgaaacaaaacaggttgaacgctttgtaaatttgcacaagaagtggaattcgttttttctgcagcagagctagctttgcatgcataatggaacgtactgtaggcgcaatgcaatcatggattagctctttgtgtgtcttcgtcgaattttggccgaagcttgtagtacagttttaaggctcccactaataaggtctgatcctggacatagttaaatttatagactgtaaattttaaaattgacataaatatttgagaaagattatttttttagaactacacagtgctttttttttcaattgcggtagaccatgctaaaattttccaatatatattatcgaacgttgtcgttcactacagacctacaagagaatatataagggccaattccctatatgcccatgtaatttcacccaatcccttctacgcccctgaaatttgtttgatctcttatatacccctgagtttttatttggatcccttacatacccattccgttagttgaccattagtttgaccgttagttattgtagaaattactttattgtccttgttatattgttaaaagctagaaatgttttatgtgtaaattatttgagttgtgaaaaccaataaggaataaattactaaatatttgtgatgaatttttgaaaataaaacattatttcattaaaataaaaaaagatttattgtaaaaaaaagttctgcataagatttgaaaattacttttcaacaaatatttagtgaaaaaagattcgttgtgaaaaaacaaaggggatataattagtttatcacaaattagaaaacaaatttaaaatttttaaataaatttcagatcaaatttgatgaatttcgtatatcttcccaaaaatttaaacctaaataacatttagtttttgctcttaattttctagtgaaactaatgtatggatttaatcataatttttaaaaaataaaaaataataagttttattttttaagttgggcattaaatgattatattgcttgtattttgtataagtttatttttcatatgaaaatttattgggtaggtaccacacatatgtataggatgggtaatatagtcattttaaaatatttaacggtcaactaatggtcaactaacggagatgggtatagaggagatcaaaatgaaaactcaggggtatataagggataatgtcaaattcaggggtattgaagggattgagtaaattttcaggggtatatagggaattttctcaatatataatgggccaacgaaatcgagggctctagtttcctctgacaaataggacgcgtacttagctaaactaggaaggtagcccgcgcagttgcgcgtgcactttatttgatattgcttgaacttttattacgtactttttataattgattgtttaagggttctacttttttctttaaaaaaatctccaaagccaatattgtttaataaacatgctctatttgcacaataaagctagtgccctctaattggttaggcttttgttgcatacttatcgcagtgtaatcatctaagaactcaaaaatgatgcaatgctcttatgctaatggttgttgtagtttaagtgaaagataagaacctatttcttctatgaattttataaggtttttatataattagttctctttactccctattaagttttgtattttctattttattttatataatattattttcagctcaaattttgtgagatgataggatagtgacagagcatgataccttatatgtcaacctattttaaaaatatgaatcaacttttgtgtaaacatctaatactaaaataggttatcgtagtttatttattcatggattgaggggatccaaaactatgttaaatacatattcttgtagagtccaattctattgtgcagtgttggagacaacccatatgggataatttcatgcaagtgtgcgaggctagcgagaacacaattggatggcaaaatataacaacgaacatatcattatttttggaatgccattttttatgattgttcccatgatttcattttttataaaatttatagttaaatattaggaattatgtaataaaaagtaactaacccacaaatattatgttttgctagcctgcattgggcatgaattaagtacaattagattttataatcgtttatctgaaacctataatgtctatccacttgtcataattatcacatattctataaagttgtaaaagaccctagaaaatatgtgtttaaagatcagataaattatttgaaagctttttgcatttctagcatggaatttgtttggttactatacaattcacttgcaccttctaccgaatatgccatatgatgacaaaaagtaaggcctagctggacttaataggactcctcttatccttttttgatgcattattcttatctcattaagactggtctatcactctctccatggttggctttctctctaattatagtccgcgcaagaaaatttttgggttccaaagtctaaacaaatacagtgtaaaattcgtctatgtctagtagacgacaattgtttggtgataatggttttcttgcacctccaagtcatcatgttacatggttgtaaaacttgtatagatgttgagacatggaggttgccatatgatccattgcagtggtgtttacagtttcgatcaagtttagttaatctttcttttcatgtctcggtgtatcgtaacatataaatggattccaaacttaattcttcaagttaatatatgaacagcgacatgtttatagcaagttaatgtccatatatagggatgacaagatatttttaatggtttgtgcacagagaaaacatacatttgttttcttacccggaaggtatggaatagaagcacatagccaccggccgtatatctatgtaccatatactaaaagaccgttaaataccttctaataaagtcatttaaatggtaccatagaatatattatagagcacttacgtggaagatcgtttggcactcttagattatttattatttgagcacattttagaaaattcacgaagtaattggattgtttcctctaactgttagcgcttcatttttcaatcaatcacaaataaagagatagaattataattgttgtggtagctagagccaaaagctgacctaacccaaatatatcattctggatatgtattggcagtgaaaacataaattaaaccaaatatgttattctggatatgtattggtagtgaaaacatatattaaacaacgattgtgccaatataaagcccaaggactattgaatgtatgtacatacgtacaccatcgccaaaccatccaccccctccgccctcattcacgccctccccctcctattgtctctcatgttttcatcatcttttagttaggagcaataattttattataatcgtttaaaataaatagctattttttatcgccttatgtcgttggacccacattaacaatatttcaacttctaaaataaatatgttattttaggtttatattcttgtcgacatttgatgtcgcaattctggtatttgcatagtatgaggatcgtcggtgctaggatatacgtgagactgaggtaaaagagatggggacgaggatttttatacaggttcgggcccctaaattatcaggtaataaccctacatcctgttggccggagccgaagttgcttttattcaccataatcacaccagtacaatatgtggggtagcctatctaactgttgtcgatatggcggtctgacgatctgactcgtagtcgacaacagggtagccttcctcctcgagctcgcacccgacgaaattagagacagtgctagatccctgcggccggcctctgaaggtaccggatagggtcgatccaggcgtatctctgatgtcaatatccggcggcttgtcttgtcgtatgtaggcttctatgttgattgtgttgggagttgattgtctcgtggtgggtgtgtgtccccctgtccttctaggggagcttgtatttatacccataggtgtccccttgtccaagtagaactagggaaaccaatatggatacaatccgagtagttcttgtcgtttccatgtagaactctggttgtctttccttatccggaactccctcctatatccgtaggttgtttccgtataggacatggtatgtggtgggtcctgccgagatttagtcaactactattaggtatgtggtatccataaccctgacaattctgacttttttcatatcatgtaaacaattattaaaaaatgtgaaaaaaaaaccaatgatatatattttactggttgaaaatatttttggtgaattttcttcccacctatgtataatgtaggctttattactattgaaataccaaccaaatagcttcaaaaaattccaaaatgatttgagaatgttaatctcacacgaattaaaataaattggatctacttttaaaaaacacaactaaattacgtggtttgaatttttacatagttcaaattacctttgttaattgttaagtaatatttgataacataaagtatacagactgatgtgattatttttgaaaaattgttatggaattaattaatgcatgtcgtttgataacataaagtatatagactgagaaagtatatagactgaggtgattatttttgaaaaattgttatgaaattaattaatgcatgtcgatgtcatctgccacaatgtattttgtgctaaaatatagccaacataattacgtatttttattagtaagatgaataaagtcaatagcaaaaaatattaatataaaaatactgtaggggtatcctaggtaaagaaaataaaagtgaataggaagtgaaaaggggggtggggtacgtactacctacctacacacgtacgtgtgtgagggagggaggagtaggtacgtgtacctaggaagggaggagtatgtacgtgcagggagaggagaggaattataaacggttgttttcaatctaatctagtggtgtaaaataatggacccaccagtgtaaatgaaaatcgagggttggatgtttcccgtctattaaaaggacacgtggcggtttaagaacgtttgtaagggtgccacgtggcagtttaaaagcgtttgtaagggtgccacgtggcggcttaagaatgtttgtaggaagtttaatggacttttaatttataatagatagatagatagattgatagatagattaggccgtgccatcacagcaaaacagatggattttcgcacttgaatacaatgcaaaaactctgacctgttttgtgctttaacgaaagaaaaaaaaactgtacgtgcaattcaatgtatagccaagcccaacaaaacaaagttcccgtgaataataacatggagaaaattagcagcacttgtactacgttcgtggcagagagtattcatgcgtgcttcatgccaagctagctgctgcatccaactaacctatgtatatatctctcctcttatatatgtcgaatcagttcaggtaatgtttcaggaaataatctgctagtctcaaatcatcaatcgccgtctggctgaaagtagggtagaactattatactggtaaatcgtgaaggaaaatgcagctaagccaatctgcgaaggtgagtgagatttttggagaaaaacaaactaattatgccgtgcagggacggcctagtggatgttggtggcgcttcacggtggaggttccgcgacaaccctaatgccaggatctcgacgaccctaatgccagggtctgagaaaccgtcaatgtaatatagtaattgattagattagattagattagagtgtttcttgtccaatttctgctgacgctatagcctttccttatcgaacatctcctcgtgatgacaatatgctcactagtgaaaattcgcatgctttactagtgcgccttgaacattcgcatgctttattagtgcgcatttgtcctcaacatagattaactaacaaagtgtattaactaattggtgcgctacgagcatggtatcaccaacataccaaaatggtgtgagctaatgtatttattaattaattggattgataaaccatgtgataaattgtcctatgttttgatactgagggtaaatttcaaacattttaaattgacaaaaatttctctattttttctgaggactcagttacaaaaacaacggtaactacaccgactgggcttgccgatagtacgaaacagccaaggcaatccactctcgactaatctttactgtcgaaccaacttcagttgtcaccgaccaatcttctgatccttatgattgatagtcaccacccgcgtagcatagcagccatcatctaatcgccaatggctaagaccaaaagcaaaacaaaagagctagcatccatagttggtgaagcactaatcacatctattcgacagatcgacgctggagttttaatttgacaggaacattagaagagacttgaatttgttttgttagagagtttgcatgcatgaaaagataccgaacatgcagtgttgtgtgctagtactactagctaatatctatatagtggactggaaactatgtatgcagccatgccatgcccagcaaaaacaaagttcccgtgaataataacatggagaaagcaacactcgtactgtacatgatcagaagtattctcatgcaaatgcaattgcaaatttgaaatgcatcaatctgcatgaaactaattagcctatatatatcttctcgtatcttatcttctcttctctaatcgatcttctgtcgaatcagttcaggtcaggtcttgaaatctaccatctcacggcccgcatcccgctcgccgtctggctgaaatagattagcactgttaggtctgctgaagaaaccgagtgagatttttgaaagaaaatgagtgagattttttaagggccgcaaaatggttaggcaacgtggtcagtgtgctcattgaaagaaaatgatttttggagatgaacgaaccacttacaagcataaacttcttttatcgaccatctccttgactacggcgtcagtgtgctaattggtgaagactcgcatactgtgttagtataactttgtttggaactccacgaacgtggcattgccaacactctaaaatggtgttagctaatgtatttattaattaattggattaaaacattgttctttctcgctcgctaaataatttcgtatgtaacatgcatatatttacaaatagctaggtcttgatatagagtataaatttgaaacaatttaaaattggcaactatttgagcaaaatttatcggtttttctaaggactccatttaccaataaaccggcactaaaccgggctccaaacgtaacatatttcctgaatacacactgttgttcacaaccttaactagggaatccacactgttggatttgatgaatgaggaatgtaacatgtaagactgtgttggtgaactcaatacaaaccacatatgtactggaaactaccgttaaatccaaaaatgaacatctaagatttgttcacgtcacccagagtaaaattttacttctggtaaaagttttactaatggttgaacctgagagtttttttttttttactctgcatgacatggatccaacaatatgtgatttgcattccagattttcattccatatgtaatttgcactgtatattttccccccttaactaggccactagagtataatgggccgggatactgcacgaaggacttgctattgatgggctaacgtaatcgatagctctcttgtttcctccgacaaactagccaaatatttcatgccaatacagtaggggattgtctatatatttatcgataaattttcttctaaaagtttgtcagatgtaaatatagtataattacattgtatcttacatataattataatgtaattggtatgtaactttcgtgtaatttttaaactgttagatttactttcatgtaatttcatgcaaaaggggaagaaaaaagtcacaactcacacaaaagtgaggggatttggtctcgtgacctccgcttcatgaaaatagcatcttatcgtaagatttttcaaagttacatataagttgtattatagttacatgcaagttacgatgtaattacactacgattacactatatttatatctgtcaaatttatttttgagaaaaaatttgtcgacaaatgtatagcaaaactggcacagtagaaggattaattttcacacttgagtatactaaatcgctgatcactatgtcttaaagaattttggtgaaattcacgcgagcgtcaaccctgttcaacgtggtgcagtgcaggaagatgtacatatataggctgagatgtaacggaataggttgatgctagagttaatttgacaggaacagtagaagagactagaatttgttttgtttctattctatgcgacagagtttgcaagcataaaagagacgtgcctagtggaaactatgtatgcggccatgccatgcccaacaaaacaaagttctcgtgaataacatggagagagcaacactcgtaccatagcagaagtattctcatgcaaatgcaatgcatcgatctgcatacaactaattagctagcctagctatatatatcttctctgctcgatcttttatctaatcagttgagatctcacgaaatctacgatccaaggcaggccgcccaattgtagtttggctgaaatagtgtagtgttgttagttactggcttacccgttgggatagtgagtgagatttttggagggaaacgaaatggttaagcagaccggtggcagtgttgatgtgggtgtcatggtgctcggcagtgtaagagcaacccaataactctctgtttggctcttcaaattaaaatttaactaacacagagaaaaagggagttccaacagcctctccatccgaatgaccgagccatccggatggccaaattgtttctccggttggccaaatgtagccagcctcctccactggccaaaggtgtgtcccaccaccactcccatccccatccactctctttgccggtgacgaaccgaaccgagggcacgccggccacgagcgcctgttaagattaagaattgactacaaaacggcatcggcagtcgctcaaatcggctacggtgatatcgactactgcatatctgttgagcgctggcctactgcatatctgctgagcgctggccatctcgaggaaggtggaccctcaatcgtcgccgggtcagattaaggccttcatagctattgccacataaggattggagttcggcaattgtacctattaattagggcattttctaatttccttagagatatattagagatatattggtaaaggcccacctgaaagggtcattcgtattttaagttatgttaagagataagagtcgtgtccagcaaggatataccatgtacttcgggtataaatatggcccgaccccatgtaatcaaacaacgtcagtttaatacacctcggcgcatcgccacccttttacttctcattgttctcgacgagtttttcttttgagttgggctgcatcaggttcgatctccgacgaaatggtaaatcttgtcatggcggcttgcgctctcgggattagcgcttacatctttatgacactctaatcctgtcttcgcaagcctccgagttatcatatgtatcgcataatctagatcgatctcgtcatctgagcttcatcgtctagcctctaccatctcgaatgagctttcaacggtttgactagatctcttgcctctcttcacgcttaatgctgcattggttaggttcgatctattaagtattgtcctgaggcttttcatctaatcttttctttgacggctaatagagatagtatctgggtttcagccgatcttaccagatttagtcgttttacattcctttttggttataaatcatctagatctgccccttatatcaagatcccatcctcttgaagtagatcaagctcttgttgatgcgaaaaacatacactggcctggaagatctgcttaacttcagtgcaggtccaaaatcttgcttttaggttcgtgagcgtgccagttgatttgatcctgcaatcaacaagaaataaagacaggaaaacagcggttaaatctataaacgatagccgatcggccagtcgccgatgacgtaacatttatctttgagccgatgtcatatttaagtcgatcggcagtcataaataaataagaaagaactaaatctattcgatcggctgcaggtattaacggtatataatctttatgtcgatatatatttaaatcaagtgattgggatagatcggtcgtcatgccaagacagtataaaccacttagattgaaatatatattaacgagaggattataaacattcataacatagacaatcagatagatctagcatttaccgactaatactctgataccactctatattaagatattaaagcaggcaaaatatatcaaacaggaagcctaacatacctagatgcaacaagatcttaatataaagggtagatctagcatgtcaattaagcatataagatataaggctaaattaggtaagattggctgaaaccctgatactaccctaatcggcaaccaaagacaggctagagattaagattctaatcacgacttataaggtcaaacttaactgatgcagctataagtatgaaaagaagaacaatatctagataataaagtcgttggatgtttcatagggtagtggatatcctatataatctaaatcaacgttgatatttaacctaatcagttgccttccaacgatagatgttagccgattgaaggttaagcagcaatattgtcgaagattatataagatatatggtaactcgacgaattacataaacaagattagagtatcataaagatggaagcactaatcccgagaacgcaagccgtcataacaagttttacctctgattgaagatcgaaaccgatgcagctcaacccgaaagcaagaactcgtcgaaagtaaatgaaaataaaagggtggcgatgcgccgagattgtattgaacgtgtgttgtttgattacatgggttcgggccatatttatacccgagatacaaaatatgtccttgtcggacacgactcttatctctaacaaactctaagataccaaaagtctttgtggtagacttttgcccaaacgtatctctaaggaaattacataaaatatcctaattaatagatacaattgccttttcaggactcaatccgtgcgtggcaatccaattgaagcacattaatgcaacccaacaacgtgtaccgagtcacattatcgggatcggcttaatcggctaaccttgtccgactcgaactctgccaatcctggtcgcagctgattcggactttagccgattcttgcactgtttccggaacgatctctatcttggattccgcttcggctttatctctatctccaatacttgaattaccaaatttggttgttaacagctccctagtctctagattatattgggccaggattcctatatttcatctgtgcttatctcggtataaggtggtatcggagtattagccgatacaggttgggttcgctccatcggctatgctgtgagcgtgcataatcccttcgttggagcatgtttagatatggagcgatttatactgtctcgatgccaccaccgatctatctcagtcgctcgatctaagcatgtcccgtctaatggattacgtgtcgctgatatctacagccgattgagtacaccgaacaatctacaagtttttacttgcccccgccgatgcgatccgacttgagttgcatcggcgtggcccccaacgatatgtcatcggcaattatgccgatcggctatcgttgacagatttaactctttgttgtttccagtcttgttggttgcaggatcaaaccatctggcacgctcagaacctgaaggcaagtttcctggacctgcactggagttaagcatatctcctagggcgctgcgtgttgatttttcgagtcaacagcgccccaccaatgtcgtcgtctaggccaccgtctgccgtcgcagtcatcgttgtcgccgtcgcgccacggtcacgcacgagctgttgccgccgcggggagccgtcaccatctgcatcgccactgccgcgcggggagccaccgctaccgtcgcctccgccgctgtcgccgcccgcctcgcgcgctggagccaccgccaccaccgctagatcgatgggccaatgcggccatgcgggagaaaagaaagggcaagagaaagagaaagaagaggaagaagaagggaatggagatgggaggatgacatgtggatccctttgtgattttggagatgtaaatagagagactgttggagtgcacacctagtttgacttcccaaatcagttggagagttggttaaataggtattcggagagtttaatttggagatgctctaagctaactaagctatgactcaacttacctgtggattgaaccagaaaacgagcctaactacatgtgcttcttaaattatcgcgcatatgcatcttagctactcatcatctctttgacgtgctatttatgtgattttttatggtgcagagttagtttgtaatggagatgcctcttgctatacagagccctttatgtgattttttttgggcagagttagtttctaatgaggatgacctcttgccatagagagctagtcaaaccaagaattgctaaatagtattgtatagggttaattcaaaaacgaaaagtccatgttttaattcgttttttatactcaatgtaatttactccagccatattttctattcaatatgagatgttcccattgataaggctatgctatagctcctgcacattgttaaattaacaaaccgtgtaaattttaaaattgacataaatatttgaatgtttgagaaagattgttttctccattttttggagaactcagtgctaatttaaaacctacaaaatccgtccccatcgaaagctgttgttctgtaacagacttgcaaatataaagaatataatgggctgatattagcttggtattgggctaacgaaatcaaagtgctatcttaattatgaatatacgaaaacgcgcttaaattatgaagacaaagtccgagacctaatgttacaggtttgacacttagtttgacaggaaccgcagaaacatagtagaatttgttattgtgcggcggaacttgcactatgtcttgatattgctccgataaaaaaaaaaacagtgcactgatattaactactgagggagccaatatatctggttttaccggtaagggaaacaaattagattcggtgtataattcaaggagccaaaatggactttttgcatggactggctgctacagaatataatgggccagaattgacttgttattgggctaccaatgaaacaaaatcaaggtagtcctctgacaaatactagctaataattatatagttatagtactcctagctaaataaccaaataggccgtgccatcacagcaaaacagatggatttttcacacttgaatactacctccgtcccaaaataagtgcagccatgagtttacgcgctcaactttgatcgtccatcttatttgaaattttttataattagcatttttgttgttatgagatgataaaatatgaatagtactttactcgtgacttatgtttttaatttttttcaaaaaaatttaaataagacgaatggtcaaagttgggcgcggaaaaccatagctacacttcttttgtgacagagggtgtactatatacgaaaacggtggaccacatcaactaaagtgatttaacgaaagaagaatttgggtgaaactcatgcgtacgtccagtccaaatttaactcctaaaatcatgcacagtttggtttgcccccttgtacctgcatctgcatgcactacactacaggagatcgagggtagacaaaggccgacatggaaaggaacagctagttgacatgacttaatttgacaggaaccaacagaaagagagtggaatttgtttttgttcgacagaagagagagctctcacgcattgcataaaagagaggccgtacgtactgtatgtatacgtgtagtagtgtagtgtactcccttagtagtatttcctccgtttcacaatacaagtcgttctaacattttctatatttatattaatgttaataaatctatatagatatatgtctagattcattaacattaatatgaacgtgaaaaatgttagaatgatttacattatgaaacgagggagtactactgtatgcttttggcatggcatgtgcaacaaagctaagttcccgtgagtggcatgcatggaatggatgcagtggcacggtcacatcatcacttcacgccaaccatgcatctgctagccgctggctgctgcatgaaatgcaactaacctttgaatcatcagttggggtcaggtctcacaaaagctaccccttggctcgccgcccaaacgcctcgccggccggcttagctaaaatagtacctactcctgctggaatgtacactaaccatatatcctaagggtgagttttcctaagggtgagtttgagaggagaggaaaagagaaaattgaaaagatacgtaaaacaaggtgagccattagtacatgattaattaagtataaactattttaaatttcaaaaatagattgatatgattttttaaagcaactttcatatagaaaatttttgcaaaaaatacaccgtttaatagttcgggaagcgtgcgcgcagaaaacgaaacaaactaactcacaaacttctcccgccgaacgctccctaatactataaatataaacaaaagacttagggatttggttcatggttacactttatcacactactcttttacctaccacaatgttttcttaggtatgtgtttgttttattgtcacagtagtggcttattaccatgtttttttcaataatatgtttgtcacgtcatagttttaattttctcgtcaactttgttacaccctgtggctcgtaatttataacttatctattcttagttgtgatttataatactacgatatactatcaaattctatattagattagtagtcctgtactaatggtaaaacaaatggtggaggcacatggagctgagtgacctcgtggtgctggcagcagagcagctgcatgcatctgctggtggtggtgcagaaagtgagagattttttaatttgggagggaaacaaaatggttaggtttgaccggacagaccggccggcagatcaaggttggagcgtgcctgggtgttggagccaacaaattaagcagaaaatggagtccccaacaacggaatcaatcggaatcccaacgcaagtgatggagcaacagtggcagtgtgcattgtctgtctctgctgcaggctgcacgatgacaccaatgccatcaagcgatatccaatccacgattttgtgtgatttaatatcgtgccaacacagagggaccagcttactgtggagtagttttctttttctttttaagccagcaaatacaactctactcgtattcttatagttgtcacgtgtactctctccgtcgcaaaaaaaataatttaagtgagaatttgacgcaatctaaaacaacgttagacaggttgtcttttttcagacagatggaatacttcatccgtactaaaataaaaataaattagtaatttatctaagaatagaaataatcaaaaccaggatatgagtgtgttttgattgaaattttgcaggcgtaatgagctgtagatggtgactagagtttatattactggttgaccactaaatttcgaatcccatcagtatcacggttttcaataaatttcgaccaaatctactgtttaagtgtctgtttggtacagctccaactcctaaatttagctccagtagttgagtttaaagtggagttgtggagctgtctaaacccagctcacaactctagtacattttgtgagagagctccatccaactccactccgagttttagtggagctgaaactgtttggctgagctccagctgaaactttagctgtgacaaatagtctctaacttttaaaattccaatcgaacaaaacttcgaaatttcgcagaatttgaccggttcaccggaatcgtgaaccctgaggagagtagtagtactccgatagcggtgaatacagtgggatgattgaggtggttggattggacgagacaatgacaatgagacggacggccacgtcagacgcgtgatcgagtctggctgcaaccacaatgccaagttggcggcagtcaggcggtcggctaccgtacgtcgtcgtcgtcgtcgatccccgcgccgccatcaatcttttgcctcgtttgccgcgtcgccaacgcatgctattgctacggagtactccctccctccgtagtaaaaaaataaataaataaactctagtttccgtttccaacgtttgaccgtccgttttatttggaaaaaatatgaaaaaaaaattaaaaagacaagtcacgcataaaatattaatcatgttttatcatctaacaacaataaaaatataaattataaaaagttttcatataagacggacagtcaaagttggacacataaacccagagtttgtcttttattggaacggagggaggagtagtagagtaattgagtttaattttttcgcgaatacgcaaaagaattgtcacgagtacgtttaattaagtgatcactactgtattatcgagcatatatgcaccagctggtgagtcaactgtcaacgtgtagggggccaaataaagcagtctctccctttttgcatgctttgtttgtttcagctagcctaatgacaatggataggagacatactaggatttggattgattagtttttgttggattactccctactctgtagcgagagtgtgagtggagtactagtgtactccctccatatgacacactatccgtatgacacccacttttctttgctcaaaactggactggagcaagttccccacatgatcgatctactgcatcatccatatccatatccatcattaaactcccagccggccccatcgtatcattaaccacgctagctgtagtacaaatgccacgtgagtcgctgcaaaacatgcgacactacccacagccgtccggccgggccaccactggtctggccacacactctgcatcgatcgatcgcccatgcttgatgcttcaattcccagctaagttacccagatacggggatacgcgatacatcggtacagagatacggtattttcctaaaaacaaggatacagggatacgcttatatatatatatattaaaaacacacaaaaaattaaggaaattgtatttatatatattaaaaatacaaaaaaatcaaggaacttttgtaaagaaatagcgatataatactagtattagtgtagccgattccatatcaatattctgcaattttctcttctataagcaattcaaattaagaagcgattaagatccccaaaaccaaagattaatagtatatttcttgatgactttgcatcaacattagcagccgcactaaccagtaaccactaggattgctagatgcactaccacttgtatctaacaaaaacggtagtactttgtcctaaggaaaacaagaaaggcacagcagattcaagcatgaaacttttgaagagaatggattacccagccaggcggtcaagcgaagaaagaaaaagttttgccgtcgaggttggcggcgaaagaggtgcgccgccgcccagcagtggcggctctgccgtctcgcggaggggacgttgtggccccacgcgcggctgcagccggcgtccggcggcaacgccgggcacgcacgagagacatcagccatcaggttgggccggatctcgtgcggcggcgcatcccagatgtgagcgaagacggaggaaggtcgtgggtgtatcgctggcgtatctcgatttatttatttttttggaaatcgcaaaaatatggggatacgtatgggatacgtatcagagcgtatccgatacgtatccgtaaccgttgccgtatccgatacggatacgcaactatgcaggcgtatcagggtaacccagattcccagtggcatatgcatgtgctgatatgaccataataatatccatctcctgtccttttttctctcttcaagcgggcgggacgtacatatcaccaccaaacattgctacgcgctactcttttcatatgaaaagaaatcgaaaataagatttaacgttattatctaatacaataaatctggataaatccatataactgaataactgcatatagtacggtagctgccccaccatctccattcgcctcaaccagtacagtcccatcgatcgtccatccgatgttttctcttgctacggaagatcgatcggctgcgatatatatactcctactagg

SEQ ID NO: 31406 - DNA, 706 bp, Oryza sativa
ccaagctggatcgcgcacgctgccacaactcggagctggaggagaagctccgccagattagtgcggaggggcaggcgtggatgggcgtcgccaagagccatgaggccgtcgccgctggcctccgcgccacgctcgactagctcctccagtccccctgtgccgtgactgccgtcgccgccgccacgaggaagggcgacgccaaggacgcgcagtcgtgctgcttcaagaccccaggcggcgccgccgccgccactgccgccgacgcggtgtccggggcgacgtcgtgcaaggcctgccatgtcacggaggcatccgtgccgctgctcccatgcctatgcgacgcctgcgaggccgccgccgccgcttgccccgtctgcaccgccaccaagaacgcctctgtccatgtcctcctctcctgaagtcactcacacgtgctacaccagccagccactgcatggagtaggagattttgatagcgcaacagctatggccagaccgaaaccgggcatccgtcagccaactccggtgtcaagcaaaaagctaacaacaatcatcctgtcccaagttacatggaaattcatgctagggaagccacggttctgtgcatctgtgcatcagtgatctccgggccatgcgagttttgtcagtggaaacaacagttttcggtgcggtggattgaatggttgattgccaatctcatctgccg

SEQ ID NO: 31407 - DNA, 1332 bp, Oryza sativa
cctgcagcccaagttggaggcgctggataaaaaggcagagactgttctcctgtctcaagaggaagttgatattagatggtttttcaggagtaggttatctgtcattctaagggaagaagaaattaaatggtatcagcgggctaagactaaggatattttagagggtgactctaatacaaagtattttcatttagtggcaaatggaaaacataggaaaactagaatttatcaattacaggagggtgatcatttaataagtggtgatgccaatttaaagtcgcatattaccacttgttataaaggtctttttggccctcctgatgagtctgaccttcagtttgatgagaattatgttgctgacattcctcaagtttcatatttagagaatgaagccttaactaaggaattttctgaaaatgaggttaaggatgctattttccaaatggaacataacaaagctccgggcccagatggatttcctgctgagttttaccaagttttctggaatgtcattaaatttgaccttttagagctatttaaggactttcattctgggagtttgcctttatattcgcttaactttggtactatcattcttttgcctaagtgtgctgaggctttaaagattcaacagtatagacctatatgcctacttaatgttagctttaagatttttaccaaagttgctacaaatagaataatggatgtcgctcaaaaggtaattagtcctactcaaactgcgtttattcctgggagaaatattatggaaggggtggttattttacatgagactttacatgaattacatcgcaaagataaaagtggtgtaatttttaagattgattttgagaaagcttatgataaagttaaatggccttttgtacaacaaactttgagaatgaaaggcttttctcctagatggtgtgaatggatagcttcttttgttcaaggtggtcatgttggtataaaagttaacgatcaaattggtaattgttttcaaacttacaaaggacttaggcaaggggatcctttatcccctattctttttaatatagtagctgacatgcttactctattgattaagagggctaaagaggcgggactcttgaatggggttattcctcatcttgttgatgatggtgtgtctatcttgcaatacgcagatgatactattatctttttggagcatgacttgcaacagacaaagaatttgaaactgattttatcggtatttgaaaagttatctggcctaaaaataaattttcacaagagtgaattattttgctttggtcaggcaaaggaatgttatgaacactattctgatatttttgg

SEQ ID NO: 31408 - DNA, 8452 bp, Oryza sativa
caccacacaaaatttttttaaaaaaataaaaagttagaaaaatttatgtatagaaatactatatataaaaaatttgattcaaattcaaatttgaatcgggtatgtaaactttttgacttataaactttgggtatataaactttagatgtatagaaatactatatatagaaaatatttgaattcaaattcaaatttgaatcagatataattcaaattcaaatttgaatcgggtatgtaaacttttgactaataaactttgggtctataaactttaggtgtataaactttaggtgcatagaaatactatatatagaaaatatttgaattcaaattcaaatttgaaacaggtatataaacttttgacttataaactttaggtctataaactaactttaggtgtataaactttagatgtatagaaatactatacataaaaaatatttgaattcaaattcaaatttgaatcggatatataaacttttgacttataaactttgggtctctaaactttagatgtgtaaacttgaggtgtttaaactttaggtgtataaatttactaaaataggaaagtaatgcggcgcccaacagacaggcacgggacgggcggcgggaagggcggcggcggcatgtggttgtagacggagccgaggaagacggcgtcgacgtctcccccagcctcagccaccggggaaggagctgggcacgggtggcaaccgtcgagggcgtcatggcttcggtcctcgagcgctgtcatggcgtcgcagtcgtcgccgcgttcctcccgccttgccgccaccgccaagccgacgccgatgcgttccacctacctcgtcgccaccgcccagccgacgagctcgccggccgcgcgtgtggctccaactcggccgccgcggtcgctgtaacgtcccgcctctcccaggctgggtccgcttacatctggcagctttcataggtcatagactgtcctcacagaccaacacaagtcttttctgcacactttgtcctcactcgtgcgcacccgggaagaatttcccaattggtcacccatcctaaaattactctaggccaagcacgcttaaccctggagttctttggagatcggcttccggaaaagaagttgcaacttgttggaacgtcccctctcggccacgtccgtgtgtccacccatcccaaaattactctaggccaagcacgcttaaccctggagttctttggagatcggcttccggaaaagaagttgcaacttgttggaacatcccctctcggccacgtccgtgtgtccagtgccagcgcatggccacccccggtccacaccagccatgcgcaccatgcctgcgcaactgcgacacacgcgcccgtgaaaccgcgagagtcggctctgataccattttgtaacgtcccacctctcccaggccgggcccgcttacatctggcagctttcataggtcatagactgccctcacagaccaacacaagtcttttctgtacactttgtcctcactcgtgcgcacccgggaagaatttcccaatcggtcacccatccctaaattactttggagatcggctttcggaaaagaagttacaacttgttgatatgagtattctattaatcctattaagccctaggctaggatgtcacagtcggccgccgctcctcctcgtcggcgagcacggagaggaagcagatgccgctgccttgctcccctcaccgccgccaccgccgccttgctcccttgagccaacaccaacgcattcctccaacctgacgccgacgctggtctccccgtgcctccacgccgtcgtcaccgcgttcctcccgccttgccgccggatttggacttgggaggagctcaccggcctccccgcgcctccgccgattctgcctccgccggccgcgcgtgtggctctagctccgccgctgctcctcctctccgccgcttcttcctcgtcggccgcgccgaccctctttcccaccgcgtcggtgacgccgccgccgcatcggccctcctctccgcgtcaattatgatggccacagccgcgcgccgccatcgccgaccgcacgagggggacggggaggccaacgagctcgcaccgccctgagcccgcgcgccgccacccaggagctgccgtcgctggcagcaccaccctttggccacgcgcgccgccgcttgtgcgagagtagagagcgagaggaaggagagaaatagagaaagagagagagggtgctgacgtggcttactgacatgtggggctcacgtgggtcccacgctgagtcagccgccacatgggacaaaatcagggtgaaaactgccgagggatctattgtgaccggttttgtaagttgggggacgccggatgtctggttttgcggttgagggacgattttgtatctggctaacaagttgagggaccttgcgtgtacttttcccttaggaaattacctatttcctgaaacacggcccaataacacagttacacgcattgttttgtccaacaaggcaatcggataaagttcattgatcatagtccagctaaattgctaactagtcaattgggaggttaattggtcaaaaaaattccttttttaaatgaaaatattagaaaacccatatttctgagttttgacccttccaatattccatccctgctgccgcggttttgtaaaattatagtatgcattcagcaacaattaactgctgcaacttgatacttcccctacatttcaacaggaacatgcacatatgctactgcatttttttgaccggcacatatatatattatacatgtgctacatttgaatacaggctacagctagttttgctttattactacgcttaattaattaattatcacaaacatgtgcgttagtttcaatttatttgcagtactatatcatctccaaatttgtctgctagctcacgtgcggttgcttcgctagctagtttaattggttcagacttaatttaattatattagctcgatgaccgaccggctaagtgccttgtcagagatattgaaaatacaacatacatgcagaataatccaccaatcgatatgatcaacgactctcccgcgatcgtgtatcggccggtgagagagagaaaaatggatcccgttttatgttaatctcagctggtcgtgatctgattcgtagacctaattagttgacgagaagatatatattgtgcaagtaatcatgcatatccctttaatttggatattttagcttagcatgcatacataaagtaggttggccgttttcttctaattgtaaggcagcattgcaattgacttctggccgggataagagattagctgtatgtgactggccaaattaagccgtttgtccatatatataacaatttggtaataatgtttagaaaacaattactccctacatttcatattatataagatattctagcgctgcccatatttatatatatatgctaatactgtttagattcattaacatctatataaatataaacaatgctaaaaagtcttataatataaaacggaggaagtagcaattaagtctccgtccgaattggaagagaaacctgcaagctggtggatatacggtgatagcttcatctttgaacaatcgatagatgacaaaagttcaaatagtatactgctacatcgatccatttaaaaataactttatttttcactcatcccatgtatacatataataaaaaaaatacaagaatatatatcctccagtttatcaaatcctaatatagtcgatctccactttaattatctgatcctaatataataattgttttttttcgccttagtagactgtgttttattttatgtttgttctttttcccgtaaaagactttgttgcgttcgtttgggcttggttaccaagctgggtaatgaaagttgactgttgtaaaaaaaaatctttaaagataaagttatttagagataaataagatggcataaaaatgaagttattttaggaacatggatagtactttgtactccctccgtcccaacaaaagacaaaccatgagtttctgtgtccaactttgactgtccgtcttatatgaaatttttttataattcgtatttttattgttgttagatgataaaacatgattaatattttatgtgtgacttgtctttttaatttttttcataatttttttaaataagacggacggtcaaacgttgggcacggaaaccagtgtttgtcttttttttgggacggagggagtaagaggcaacatgaaagtcttgaaaggtaaacgcgcgtatatgacaagtaattcggactaactgccggcggctagttagttctcaagttattcttttctttttctgcgagagagaatatagcttcgaatgtttcctatatgttatttttaaggtaatacagtatgtttatagaagatgaagctctacgcttgctgattgttcggtctatagaaatttagatgataaattaggttccacacacggctaggcctcatgtatttcctttcactataaaaaatgaccgtgcgttgcaacgggtgaagtctattttaatcttattattattacatggtttagttaagatgaaattcactgtgggagtttgcttggatatatatatttttagaaaatcatgagctgcaattagaagttcgatcgtctcaagttagcatgcgagtttttttaaacagatttcttatatgattccttctgtattaccatgggtgaacgatcttaaaaacgactcaaatacggatatgtatttctaaaagcaaacgaacttaaaaaaccgactcatacatgaatgacgtaccaaaatatttaatatcgtcaaaaatatcttcaatgtttataataagtagagaagagatatagattacaaccaaaacataaaattaaaactgactcaaacacggatgatgaaccacggaaacatcttcaatttttataaccgactcaagcacggataacgaatcacgaaaacatcttcaatttttattttatatatatatatatatatatatatatatatatatatatatatatatatatatatatatatatatatataatagtagagatagagatttgtacaaatttgctgcacccctctataaaggcaaaacgtacgtaatgtgttgttcaaagttaccaattaatccttcatgatggatgatgtccctattagtataatttaataagctttccgggtagatcatttttgttgttttagaaaatatacgtgtaacattatttattaaaatccacgcaacaagacacgtccctttgtcacgtattattttggaagtttttttatccattagtgtatttttatgaattaatgtcaataaactctgcatatatgtatgtgatggtttatgcttaacgatgcttctttttagcctacttggttaggacttagtaccttcttctgggaatatgaaggaatctacacactagtagctatcaccatctgggcgacctaccccaattaagacgagtttatgatttgatattatatttttctagtgtaaaatttggcatgttttatcttgcgtatatgatgtgacaatattttgactagaaattttaatttcttctggtactttaaaaaacagtaaaattttgcacgcatattcaattctaattcagataacttagctactgtatgcatatatgacgcgtaggaataaaaaactgaacttaatcattcgtgagatctatctttatatatgcggcgacgttgtgatatacttttcttgagaaagacttgaccaaatgcagaagccattgtccaacgcgattagattgaaattagagatatctatctatctatctatctatctatctatctatctatctatctatctatctatatatatatatatatatatatatatatatatatatatatatatatatatatatatatatatatatatatatatatatcgtttcacagtatagtaattaaccagtacagtatctcacaagatagtaactaaccagtacagtattttagggcctgtttagggagcttctaactgctacagcttctcccataatcagaagctcccttaaacagtctatcttttggtacagattccgagaaactgttattttagaatctataaaatgaactgaaaccagaaactgtgaaaccaaattttttcagattctcataaactggttaccaaccagctgcttcttagaatcttaacctggaattgagaccaagtacgtagtggacacggccggcctggctaaataattatcaaaattaacttgatttgacacaagctactgaaaccgccgtgtttctattaaagaaagttcgtactgtctagcttaattagatgctttcagaatcgctacgttacaatgaaaagaaagccacattcacgtgatcaaattgaatatatcctgacatcgctacatatcgttttccagctcgttgcgtataaacatctgaattaattttgctccaagacagtaatgtatgtctacagatgaacttgactatttagcaatagtagctaccagtagtaattaattttgtggcccggaaaaatggactaggcaataaagagcgaataggtaatcgtcattattatgttttttcattaggtcattaattgtcttatgttgaccaatagtatattatgccggctgagtgatatatcctctctctctctctctctctctctctctctctctctctctctctctctctataaaaatactagtaacttgaattatgcagaatatatatatatatatatatatatatatatatatatatatatatatatatatatatatatgagatactctagggctatttggggagcttctaattgctgcagcttctccagaattagaatctcccccaaacagtacagcttttaatccagattctaagaagctgtagttgtagaatccaggaaataaactagaagccagaagctgggaaacccagcttttctagattctgaggagctggctaccaatcagctgtttcttacaatcttaagctcccctaaataagaaagacaagagagaaaaaaaagatcattaatatttcagcaatcaagatccaactatccagccatacgtgcatgcataaatattactacatctgtcccaaaatataacaacctttcaacaaatgtttagattcgtattattatgatgtgtcccatccgtttaaaggttattatattttgagacggatgaagtaactgatatagtcctcattaagttgcaattttatcttggttagtagacgatgcattaaaacctttttgggtgtatttgtaaatttgccaccggttttttcaattttgtaaggatgccatttgaatgacagttccagtggtatttttgtaattttatagtaacagttttgcaataacgattcaaagtagtggtaaatttgcaattgcctaacctttttcaatagaaagttgctccaactaatatcaaataaatttattttttaagtatataataattaaaactcaattactcgtgtgctaacgattttcttgttctgtgtgttcttactacatcttcattcgccgttatgttgaacgggaccatatatatagtgtcgacacataattaatatatatagtattctttttaatccagactgaaatgtagtctcttgcatacacacacttagcttgcaatcgtgtgcgtgtggtaccaatatatacacgtcatcgatcgagaaatgagaacgagatggatacctccaaattaaatgtcatcatcacattcacatccatagacagatagattattacagtaattaatttgcttctggtgcaactattgatcagtttggtcagttggctgaaaatcttagtagatgactttctctgatcagaagataagaacgcgcgcatacacgcgcagtcatcatccgatgtaggagtagtatataggagtaaatctgaggcgcctctactaactatagtactataattttatggttcaagattagaaccgcatgtccatgagacctggccaaagtcttccataacaattaattacatacaaatgaatgtttaggaaaatgtacatagcgagtaaattaacctagtggaattaatactaggaaggtacgtattaaacttaagttacgaggcagctgacagacaatagtgatctttgaacattgactatgatcactataaagggtactctccctttgtgtcaaaataacttcatttttaccatatattgtttatctaaaaataaattaatattttagaaatcattatattataatttgataaagtgaagagtactctttttttaagacaaaagtgaagagtattctagtctttttcttttgtattggtatgtgtgaaatggatgatgaacattaaaataaatttattttaggattgaggtagtaattcttagtttaagatgtaattatctatca

SEQ ID NO: 31409 - DNA, 27874 bp, Oryza sativa
  unsure (1)..(27874): unsure at all n locations
aaatatagattttttaaaaaaactaattgcacgattagggaggaaatcgcgagacgaatattttgagtctaattagtccataattagccataagtgctacagtaacccacatgtactaatgacggattaattaggctcaaaaaattcgtctcgcggtttctaggtgagttatgaaattagttttttttattcgtgtccgaaaaccctttccgatatccggtcaaacgttcgatgtgacactcaaaaaatattttttcgtgaactaaacaggccctaagttggcgaaattggcccatacgacgaatacagtaacgcatgtttttttatgaagttcaattcggcgatacgtctacgcccaagagttggatcaataccgaaagtcgttgctcaatttcttacgtgcttacaataaatctagctaaacaaatactcaattataatgcggccggggagaagttatgatgctgaattataaagctgatcatgccacatcgtagcagggtcgatttgtctaccctagttggtaggaaaaaagtgtatcttagttgacagcaatgcaaattttatagtcgagataatatcatgcccatgccttagctactcgctggcaataaagaccttagctactcgctagctagcaatcgttttcgcgctcgaataatgcgtttgaacatcgcaattaagatccagttaatctcatttagttactgatgacgccctgttgttcgagatctgttcaaagctctgaaacctcgacctggcgaaaaagttcagaaacatctctagtcaatccaaaccgtgacgaccttagagacagaaaaggggaaaaattagcatacgtacaactgggttagctcaacattatgctagcttagccttgccattcaaacctgattttgacagtacacaaacacaattcaaaacgggccgtgtcttctattgaaaaagaagttgaaaataaatgcatatcgatcgattgatctgtacgtgcgctttcaggttaatttgttcaacgacacatgcagtatacgcacgtcatttcgatggaatatgtggggttgaatttgttttgaaatttccgcatagatgttgagccacattttgacacagcgccgtgaaaactactaattattattaaataattcgcatgtgcatgtcataaattccacttgatcgcacaagaaaattgtggtgctaaggatcgagcaagtcgcgccatggctgatccacgacctaactagctaagctatagcttaatttgatttctatttaagaccttgacattaacgcatggaggtgtgcccaatacaattgtgaccgatcgatcgaggaagaagacgacgaccatgaggacgatgcttcctctcctcgttatcctcgtcgtcgggctccggctcgccggcgcgagccctccgccgcagccggtggcctgcaccaagggcaccaccgactgcacggtgaccaacgtgtacggctccttccccgaccgcaccatctgccgcgccgctgacgcgtcgttcccgcgcacggaggcggagctcgtggcgcccgtgacggcggcggcggcggcggggcggaagccgaaggcggcgacgaggcactcccacagcttccccaagctggcgtgccccggcggccgcgacggcaccatcatcagcacccggttcctcaaccgcacggtggccgtcgacgcggcggcgcggcggatcaccgtcgagagcggcgtcgtgctgcgggacctcatcagggccgccgccgccgccggcctcgcgctgccgcactcgccctactggtacggcctcaccgtcggcggcctcctcgccaccggcgcccatggcagctcgctctggggcaagggtagcgccgtgcacgagtacgtcgtcgggctacgcatcgtcaccccggccccggcgagccaggggttcgccgtcgtcagggagctcgtcgccggcgaccccgacctcgacgccgccaaggtctccctcggcgtcctcggcgtcatctctcaggtaagtacacaaaccacacgtgttctacttcttcgttaattatttcatcatgcatgtgatctgatccgtacgtatataccatggtgcatgcatgcattgcatgcaattacacgtaattgcatatgggggttaattttgtccttgattgtccttcttgctttggatcttatcatgaaatgaatgaatattactactactaactgcttgttgcatcgatccatggagattgattaattactttatccttccttcaagtgaaagatagccctaatcaatcaaccaaccatatttatgaatgaataaaagcatctagaacatgatcaatttgacatgaaattcatttgatgtgattttgcaggtgacattcgagttgcagccgcagttcaagaggtcggtgaggttcgtgacgcgggacgactcggacttcgcggagaaggtggcggtgtggggcggcgcgcacgagttcggcgacatggcgtggctgccgcggcaggggaaggtgatctaccgggaggacgaccgcgtcgacgtggccacgccggggaacggcctcaacgactacctcggcttccgcgcgcagccgacgctgggcctcatcaccgccagggccgccgaggagcggctggagaggaacggcaccgacatcgcccgctgcctcgcggcgcggctgccgccgtcgctgttcgagctccaggcctacggcttcaccaacgacggcgtcttcttcaccggctggccggtggtcgggttccagcaccggatccaggcgtcggggacgtgcatcagctcgccggaggacggcctcctctcctcctgcacctgggacccacggatccgggggcccttcttgtacaactccggcttcagcatcgcgctgcccagggcggcggcgttcgtcgccgacatgatgcggctgcgcgacctcaacccgcgggccttctgcgacatcgacgccaagctcggcatcctcatgcgctacgtcaaggcgagctccgcctacctcggcaagccggaggactgcgtcgacttcgacgtcacctactaccggagctacgacgacggcgagccgcgcccgcactccgacgtgttcgacgagctggagcagatggcgctgcgcaagtacggcgccgtcccgcactgggggaagaaccgtaacttcgccttcgacggcgccgccgccaagtaccccaactccggcgagttcatcaaggtgaaggagagatacgaccccgacggcatcttctccagcgagtggagcgaccaggtgctgggcatcagcgggagccccaacatcgtcgacaagcgctgcgccattgaaggcctctgcgtctgctccgacgactcccactgcgcgccggagctcggctacttctgccgcccggggaagcttttcaaggaggccagggtctgctccaaagacaaatccgccgccgccggtgatgatgatctcctcgatgaattgtgatttattattatttgatcgaatttcgttcaagtcaaataatacatgcatggctagctagctctgcatgaaatgaaatgcaaatttatatttaattaatcaagaaaaagataagcacgtacgaaataatccacctgctacattgggatggcgtatgtggtaggtagtgatactgtaaattggttggcgtgatttgattttgagatgtaatgatgctttaatgtggacagtgtcagtggtttggaaaattgtactccctctatctctaaatatttgacgccattaactttttaaaatatgtttgaccatttgtcttattcaaaactttttatgaaatatgtaacatttatatatacataaaaatatatttaacaatgaatcaaatgataggaaaagaattaataattacttaaatttttttaataagacgaacggttaaatatgttttaaaaaatcaacggcatcaaatatttagagatggagggaatatattaatttaatttgagttggaagaacaagttcaactgtttggaaggagcgcgcgatctgagtcttaatcagctgttgctttcgtctttcaatatgtgactataaacgtgtctctctatgtttttcgtcgttttattcgttgaataggcagagctcctaccgttgaaaaggtaagtgttaaactttggtttttgttggtgttctctctacgtttaatacttctaatttttagtcccatccaaacaccgtttatttgtttcttgcatttttctacacgtaactataattaaacctctttgtgcatttctctgcgtattctttttaactgaatcggcacagctcctgccttgtttctcttttacggttttgtcaaaggtaggaagttaaagattaaggttaatcctattattactatgaagctacatagtttcttaattatgatggtgggttgttttttttttagcaagagcagagagcccccatttccattactagaaatgaatagcaagctacagagtgagagcgagagatggtggccgggttgtaatgattatcatcatgcatgacattatctatcaaaaaaatctattcatggcaacatgtgcggcagcttattgagggttgagagtgagactgtgtcatcttgtcggtcatggcgtcgaatggctacggtcaaggaaattattttgttttgagtagttgaatggaggtctcaatcatttatgaatggggtatgctatgtttaatgcaactcctttttcggtgactaacgcaatgtcttttaaaatgaccactcctaaatactactatattcttatagaaacagggcataaactaaattgggagaatgactaattaatttggccttggccggcctatacttttttttatggttttgtatgaaatggaggtggttttcatatttatattattattgtgtgtatttagctgatgtcacttaattaggtccaccactttaaaacttgcctcatttaagtttgtgttgtaacagaaaatttatcatttgcgtttaggggtgtgtgaatacaatcaaaccatgcatattccatcaaaccaccatgaaatatggtttagggtgtgttatattatgtgtttgattttcaaagtttaaagtgaaaacaaccggttttatattttaggttgaaaaataaattaacttcgagcaattcatagactttacagtacttatatttggtgtcattagtatccatagttccttataggctagatcgatgtagatttaatttgctacggctacagctgtggtgcatttacagtatcgataacaacagattttgatctgcagaaaagctgaactgatcaggcttctgcagttgcatcgatctgttggtgataaccaaagcaagagttgatgacattctaactgcagtttaattaacgaagtgcataacattgaggtcatgcggtgatcacaaattaaactggcccagtacgaccaagccttccatttacagcccagtgcgacaaaatttcagccttaattgtcaagcgagcccattatcagacgaacgtgaaaaatattggcccacctatagcccactaagtgaaatcccagcccagtaatggcctattaaagcaaaattacagcccacgtaatctagtaaaagtaccgtaccactaatggcccagtaatacaaaatcaaggcccgtttatattacagtatgcattacagcccaatgatgatacagtaagtcaaatacggcctattaagaagacagtacggcccagtaaaggcccattaataggaaatcccagcccactaaagtccatttatagacattacttggtacaaagaatacattaaaaaaaagcatggtacaaaaatacattgaaaaggcgtggtacataaaagtaaatgagttagctatcaatttgcatggtacaaaaaatacattaaaaaacaggtgcatattatagaacgcatggaaaattatacatctgaaaccatttcatatggtaatggaggttatatttgaaaattttgttctaaattttggatgtgctgaggatatatattggtattagtggataaaagatgccgataatggaggttatatttgaaaattttggatgtgcggaggatatatattggtattagtggataaaagatgccgataatggaggttatatttgaaaattttgttctaaattttggatgcgctgaggatatatattggtattagtcgataaaagatgtcgatattttctttttagagaagggtatttttacccgatctctatacccaaccggatatatgcagccttttaaattgagaatttagcccctcaaacaactactcaggtcactgcaaccatcagtctacgtgactcaaacttatcagttcattgagacttttgaggctgacatggttatttttacaataggagattcaatgcattcttaataaaagagatggctttctagtggtgtaattatcagtgccattagcccaattatcatgcatcctgagatggaactataggttcaagatttggcatacattactggcacttaaaatccatggatatctctactggcacttaaaatcgacgagaaaattcgaaacccatctatcagattgctagtagtttgttgtggacaaacccgtgtacccgtgattgatatattgcttgagtaacaactatcacatactacagctgtacagcaagcaaatgatagcatttcctaccattttgaaacttgcaatgaaaaattaagcagcaaaatttgagtcactgaagcgcatttcaaactaactacaagtcaaccacacaaatgtcatgcatccttttacattctaaacctaattagaactactgagcatgatgcgtgaatggtttacatttctgaaatggtttcagccacatcagaaaccatttctcgattgattcgccggcggcgaggtggagagagagagtctcgagccgagccacgtttcgtaggggggaagcgagccgagccgagccgagtcaacaagtacaccgtacacggatcccgtatagagacgagacaagcgtacattcgtacgtactccgtgcaaatactgtttgttgcgtcgaatacacgacaaagtcaacgaacgatacagcgtggcgggggagctcatctcactggcctcgcgctcccacactgccacgtcactcacactctcactaatggctacttggtggttccggcgaagtaggcgagcgcgccgacgagcggcgcgttgatgtaggtggccggctccgactgcgcgaagttgccgcggtcgtcggcaaaggcgtcgcggctgtccggcccgccgacgacggcgccgacgagcacgttcgggttgggctcgccggagtggaggtagccgaagccggcgtcgcaggagatccgccccgggtgggcgcgcaccgacggcatggacgcgccgcggtggtgcgcccgcctcgggtacctgcacccgaaccccaccatgtacgacatccccgccgggttcttccccaggatgtagtccacctgccgcttcgccaccgccaccagctccgccgccgacacctcccccctcgctccgccgccgccgtcgccgcacgacgcggtggcgccgctcgaccggaggtacttggcgtacgccagcatcaggaacgtcgccgtcgtcacgtactgcatgttgctggagccttccctgtacaggaggccgccgggggtgtaccgcgactggaagctcgccgtgccgggcaccagcgagcagatgtagctgtcggagtgcgccttgtagagctcgaggccatggaggcggttgcggaggaagcccttggcgaggagcaccttggtgcccacccgcttgtcgtcccagctgaaggagtagtcgtcgtccccggcgccgagctgcatcccgttcgcctccacgtacgacatgaacgacgcgttcctcgacgcgcggtgcagccacgacgccccccacaggagctcgtcgtggtagcccgagtaggagcagtagaacgggcacaccgacgacgccagcgagtcgctgtacgacccgcggtgccggtcggcgaagtcgaacacctgcgtcgcggcgtggaggaggcgcgcggagtaggccgggtcggcgcggcggaacaccatggacgacgcggcgagcgcggcggccgtctcgccggcgacgtcggaacccggcttgtcggcggtgacgcggtagacgctgcggggtgtgtccatgtcctcggggcgctcccagcagcggtggtcctggttggggtcggcgacctggacgtagagcgcgccgggcgtggcggtggcggccttgaggaggtagtcggcgccccagcgcacggcggcgcgggcgttgggcagctcggcgcccatgaacttgccgaagtcgagcacgctccacgccagcatcgtcgtcgagaacgccatgggcaggccgaacttgacgttgtcgccggcgtcgtagtacccgcccaccaaatccacctgaaacacaaacacgccggaatcacaaactcctcctcgccggagacaaggaagaaagggaaagagagagaggcggcgtacgtacattgtactgggcgccgtcggtgaggccggagtcggcgcgccacggcatgcggttgccgggcgggagcttgccggagcgctggccctcgaagaagatgatggacttggcgagcgcgtcggcgtagttgaacgccatggccgagctcggaactaagagcagcaggtggagcacgaccagcagccgcagccgaatgccggcgccgccgcagctgctgctctttggctccattgctgcctgcctcaccggcgaagtgagagtgtggctcgagagtgaccaactgcacattaatatagtgtgaaaagcagtggccgttaagttagttaatttggccggtgctggagtagtatatcaatttgctgcgagaaaccgggaagttggggggacaatttgcaggagttgagaggaaaagaaatcgaaattccaatttccaagtgagcatttcttttttcctttttgactgacaatgtctcatggctttgggatttgtataccaaaaagaatgaatgaaatataccagtagcacttgctaactggaattcaacagagtttgcagaagctatcaatgtgacaagcacacaacaatttgtggttggggctgtttttagctcagcgcaaagtttatatttgggtagaaattaaagatatgggattgaaaagttatgtgtatgacaggttgatgtgatggaaaatgactgaagtttgaatccaaactttagatctaaacatagccaggtatatttctaaaaccaaaattatcgtatttgttcatctgaagatgaacaaaaaaaaaacagctgccttgtgacaatcctgttcctttgagattcacaggagaaaataatttgatgcacacacacacacaaacagtatcatctgaattctcagcaatgaacaccgtgtttagttctattttttttttcaaacttctaatttttttatcacattaaaactttttacacatataaatttttaacttttccgtcatattatttcaatttcaatttcaaccatacttccaatttcggtgtgaactgaacacacccgaaactggaaagccaaagcgtccggtatgttagctactaggccggtgcagagcagaacgtaggctggggaattcggcgactggtcggctttttgcaaagccaaagcaaaagcatgcagcgacatggacgaccgtctctgctcaccttcagctactgctactggtactcctctgcctgtctttctctctttttcctttttctttctttaaaatcttcaagccagccatccatttctccatctattccgatggccttcctttctccattctcatctcatgcgtgtgttcaaccaaggccacactgcaatgatgcctccagttgcatgaatattcatatcaagcctgtgtttagttccaattaaaaatttgaagaaattggaacgatgtgtcggaaaagttagaagtttatatgtgtaggaaagtttgatgtgacagaaaagttagaagtttgaagaaaaaaattaaaaactaaataaggcccaattgcattttgatctccactgatggtatattattaaggatctgtttggatcatttagtccctagactaaaattagtccacgattaaaaagtttagttccctactgtttagatctagggaaggcacgtgaaccgagggacaaaggagagagactgttattttagggcagtcccaacccataacactagacatggtttccataaactccacatcatcaagaaactactaatagacactactcttccaatgcaaacaccactattccatacttcaatttaatgctacttatctcacatgatgtcttggatgttgtgtagaaaccatgtctcatgcaatacatggtttccctctctttcttcatttattcacttgccacatcattttttttttcttaggtggcaacttatttaatgctatggatactatcctagttattgggttgggaatgcccttagtccctacaagtatctccaagagggactaatatattttagtcctaatatgcacttttagtttttttagtcaccctgtttgaattcttaggaactaaaaagtacaaaaatagagggactaatggattattccgatgaaccaaatatggcataagctatgctacttactaattacctgcagtagaatggcattaagaagagcatgcttaactagtggaatgaatgaacgctccactccaagtgcaattggcaatgatgatgttctctccagtctccaccccataatactgaaggactactcctataatctgaagttaattgcagagctcgaggatggcagatgcatttgttgtgttccatccatgggggcaacaagacccctctgcttgatacaagcacatgtgtagctttccttttgtcttactccaatctcaagtgcaatcctactatcacttcagaaaaaaaaaatcatcaaagtaaagcatagataatgtactagtactactactattccaccatcaaggaagaaattactctaccataactgcttttccttctgtcctactgcaatctcaacttctcaagtgcagtcctactacttcagataagatactccattccaaagtgcagtagggacaatgtactagtaccatcaagtaaatttatcaccactaaatttaacagaagctgtagtaaatttgattgttgggcttgacaattgccatgctttgataagactggttaaactcctgaagctgtgaccactgatgtttaccgaactgttcacatgcagcgtgcagaggcctgagaagcaggtgaagaactgtaaaaataaaataaaaaggctggtcaagtctggagagtggtcaaaactgacaaacatgcgttgcgttgcagctaaaagtaagggcttggctttgcatggcaggcactggccttcatcacagagaatcctattcctagggtactgtactatacgtgctatgaccagaacagtttcatcagtgaacaaagttgacagttgaaatacacacagggggacctcgtcctgattctgaatctgctttcgctggggattatgcagtcatgctgcctgaaaaaagtttaagcaaatctagtgggtttaatgcaaagaaggaagtaattcgtgtttatctgttcctttttcaactcccgttcagaaccgagggcaagtggtagtaaatgggagatgttattttgtgcattctaaaattcagaaatgcagctggggggctttttttataaagctggatatttatagatggaaaaattgcaaaaaccaccctagatattatcccgagtttgagacttcctccatgagacaattcgttggaaatacctcttctaattcacattagtttaatattcctcttcaattaccattgttcagtgtttcttactttctttcctcttccctaattattgttactcgtccattctcatggcgcaaagcatcagaattgcatcgagctcatatttcttatcttgaatctgccagagcccaaagaaaccaggcaccggtaaaccctatgtgacaaacgcaacaactcatcttcgacgacccccgcatccaagagcaaagactcgtgatcactatcacccaacgatgtgctgcccgataggtcgccatgagtggggatgccacggtcgtgtcattgggtctagccaacatgagtgacgaccatgtctcctcgcctattagtgtttgtataagcgtgtatgtagttaatagaacgaatattaataattggggaagaaggaaaaaaaacacgtgaacaatgataatggagggaaaataccaaagtattgtagacagattcagcagaaatagctgaagaatatacgtgcttttattcctttgagaaattagctatagcacctgttggttcttcagagttgttggtactgaattctcagtcagtcacagtgtgaagaacgcagtccgctaagttcttcctcatgggttgccaactcacctccctcattttctgcgtgtatgtttttcaaaccactaaacggtacatattttgtaaaaaatttatattagaaagttacttaaaaaatcatattaatccattttttaattttttttatagctaatacttaattaatcacgtgttaatctatcgtcccgttttccgtgcggaggggaggggttcccaacctctccaaaagaacacacacttgtgattcagatcagagttcacacaaaatactacacaatacgggcagttttgctcatgatcgactcggactattggtcaatcaaacagcagcaaattcagaaccatttgcaccaatcaggactatttttacccaattacaactagcatttcaaacgaaatgcatttgtattgagaccaggacctaaccggggaaaaaatcgcaaattatagcaaagcaactccaagggaaacaagaggcgtctcggcctcacctcagacggcgattcaacaagaggtcgaacagcctcgcgccaccgtcgcctcaccccgtcgccgccaccgccgccggcgacgacgatcgccgggctccacctcggtgaacggcccaccatcgcacactattcatgatcgtgggccgtcggatgacgaaaacgggccagtctttttttgtagactttaagggttcgatgacgaaatctctgaacccacttctctgatcgtttaaccgctgaatcactgtaaaaatatttagtcgcgcgtaaccattaaggatttctaattcttatatgccaaataatctcaaactcaatgcaatacctgaaaacggtcaggatttgaactccagcagcagcatgcagcatgctctctctccgtctgaattttgggacaatttggcactgaggccgtcgacatgaggactgaaaaaagcataaacatcgagcaacatgtatctggaacaaaagtgcattgatcttgtatcgagtggatctttgcttcggttactgtacatgaccttttagctcctgaattgtaccaatgcttagtcagtaatcaaacaagcttcattcagcccatcaaaacaaaacaggttttgaagccatcaaagaacattatcatgcagcctgtcaaaacaagactgttttgaagcaaatttaggtaggaaaaaattaaaacatttaaaatcaggaaaaaaaataaagcattcaaatttgatttggatggggtgcaccagccaaggctgtagtgcaacgcctaggcgacacatgagggccctagtggcaagccactatggtggactctcccccacgaaaaataaatttaatatcaaagtagacacatggcccacatatcagatattaaactgataagaacagatactacacttgatcttagccaaaaggccgagaaaggtatgagttgctatcacgttcacctcctgcttttgtagcctctccgtacatctcctcgtcttgatcgcgcgatgtggtactaaactgtgacaatgaacgaacaaacgggagggggatacaatacatcatgcgatgcgggcttgcgtgggccgctggctcggcgaaaccctcaaatgggccggccttttgaaaagtctgtagttaagggggttcggagtcaaaatctccgacctccctttctgactgtttcaccccatcatatcgcagtaaaactatttgagaggcattgatatagattgatcatatctagctgttatatcaactatatgaggagaaatttgaagataaatacgagcttgccttgcattttttttcttttctttctcaattctcatgatttatttttcctagaatcctgtcatgttcatcctgatgttaagcttcaaagacgcagaaattgttttttcgcgaagaaagacgcagaaattgtaagaagctgcagtaaagacgatcaagatatgaactccagatcgacctccaacaacgtgctctttcctttaagtctgtagtttgggacaaattgctgtggagagcgtccccagtcgacctgaacaaacactagcttcaattggctcttttagttgttttactctacttagttctgaattttcagtctgacaaacacagaattacgaacggtcgaacgcatgcatctgtagcgtgaattgacaattacataaacatttgttatttgcactacactatagaccatagtgaatctttacttacatgtgctgggcataaaaataataatttcagtacacaacaactgtactttttacattctgaacaagggttcttagatgcaaccttccactgtactttgcaagaagaattctcaagctcaaggcaaggccttaattaacccagagaagggaatcattgatgatttgtttatcgccatgtacaaacacaaatgataaaacagagaactatcaggattggaactgttgctttgtgctctatctatatgatctgaagtttggcacaaattctcactgaggcatctaacaagagacctgaaagaaaattaacagagattgagcaacatggtatgtgggaacagccgtgctttcatctaatatattcaaacaaaaaaaagatttgtcagtatgtattttgaagaacagatttgtgctcctttgttcagaattgtcagtctgaatatattcaaacaaaaaaagatttgccagtatgtatcttgaaaaacagatttgtgctcctgacaataccagtagatgtgcaaatgctattcagcaatcaaagagaccatcaaaagtgactcagaagtttaaaggcaaatttcatgccctgaaacaaagagcttggataaattggatttaacaaattcaattggatttggttggggtgcgccagccaaggctgtagtgcaacgcctaggcgacacacgaaggccctagtggcaagccactatggtggaccctcccccacaaaaaataaatttaatatcaaagtgggcacatggccacatatcagatattaaactgataagaacagatactacacttgatcttagccaaaaggccgagaaaggtatgagttgcattgttggctacaccctgcttttctagcctcttcctggtactactctccttgatcctgcgatgtggtacaaaacgaagacagcattggcgtttgctgtgcctgtgtgggccgctgactcgtcgaggccttctcaaatgggccggcctttttttttgcaagcctgtgttactggggttcgtgtttacttgggggttcggagaaaaaaatattcagacccccttctctgatcaaaatctactcactgaaagcgatcaagatctcaactccagacctctgctctttattgaagtctaaagtttggaacaaattggtgtggagagcatcaatgaattgacctgaattaaaacatttagagagacatgtatctgggaccaaagtgtgctttgatcttgtatctattcgctctttgattttgttactgtacttagttctgaaatttcagtctgaagatcacaaaaaaccggaactctttttttttttgcagaaaacagaaacaattgtgctccagtaattgtatccctgctttggatctattatgagcacacacctaataaaattatgaacgtccgaacgcatgcagcgcgaattaacaattacataaacatttgccattttcactacattatagaccatggtgagactttacatgtgctgggcataaaacaataatttcagtacacaactgtactttttacattctgaacaagggttcttagatgcaactgtccacttcactttgcaagaagaattctcaagctcaagtcaaggccttaattaacccagagaaggaaatcattgatgatttgtttatcgccatgtacaaacacaaatgataaaacagaaaatgattaggattggaactgttgctttgtgctctatctatatgattggcataaattctcactgaggcatctaacaaaagacctgaaagaaaaataacagagatcgagcaacatggtatgtgaaaacagccgctttcatctaattgtcttgtatctattggctccttgatttagttagatactgtactttgttctgaattgccaatctgaatatatctatctatcttctattatatactaaaagtccattaaacgtcctacaaacactctcaagacgacacgtggcattcttataaacgctcataaaccgtcacgtggcactatttaatctcaccgtcgattttcatttaaattggtggacccgttattttagaccattagattatatctatatctataccgttgattttcacttaaattgatggatccgttatttagatcattagatatatatctctaatactaatactttccacctatacatacgagagagaataggttcgccaaaaaaaaaaagtaagtacgtaagattgaaaaggaacaataaaacctacatacgtacggtaaaagaataaagccatcatgtcaaaaaaagatagaaccaaaaaaaacatacgtatatagtatcatacaaaaaaaataaaaaaactcccatatactcccacacattagttattattaataaatttgaaaaaaataaatatattcttcgaattagtaaaggtgtctcatgtgattatcaacaataagtattgaaaataaaccaagcgctaaactatagatgtttgtcaaaatataaatgtttaacaccataaacacacatggtgtctactctataccaggaatctactcaaaacttaaaaaaaaaattcttttgatcacctccatcttctcttttagtaccgtcgaattacaacttcgctcattttcaaattgcataatgtttaacaccataaacacgtggtgtctactctataccatgaatctactctcaaaacataaaaaaacattcttttgatcacctccatcttctcttttttcttttatgaagggcataagcatgaataacatagtttgctacgttgctataagtataacagggacgtacatatgggagttaaggcggtcccagtggagaccacagtcaccaatagtgctcaacttactacttaccgatgcacaactcgataagggtgtgatagtaaattaggcattaaaattgtgttccaggttagtctggaggtgcacaactacatcgatatgggacccatgtttcaaggaaatagacaaagaaagtctcgccactacaatcggcttcacgcattagagaagcatttatatataacttgatgttattctattaatttgtacaagtggtatttttacaatatttatatatagttttgaaaattggtgaggcacgaaacacttacgtgtagtggatatttcaatgtattaatgatgtattaggcttattttattgatacattacgtagttcatctatgaataggtacttggcttttaaacagtgataataggttgaagtgacaacaagaaaatttatatgtaaccagaggcaaagtgattttatttaatctaggagataaccttattacttaaatatattaaagtatgcaatatatttctcggcttataaatggtgagatataacctttttaaaaaattgtcttcataaaactgctcgcgcatctgcgcgggctttcttcctagttcaaacaaaaagacaatatattcaaacaaaaagagatatgtcattgttttagttagatactgtactttgttctgaattgtcagtctgaatatattcaaacaaaaagagatatgtcagtatgtattttgaagaacagatttgtgctcctgacaataccagtggatgtgccaatgctattcagcaaaatcaaatagaccaccaaaagagactaaaaaagtttaaaggcaaatttcatcccctaaaacaaagagcttgaataaattggatttaataagttcaattggatttggttggggtgcgcctgccagggctatagtgcaacgtctaggcaacacacgagggccctagtggcaagccactatggtggaccctcccccacaaaaaataaatttaatatcaaagtgggcacaagacccacgtatcagatattaaactgataagaacagatactacacttgatcttagccaaaaggccgagaaaggtatgagttgcaacattggctaccccctgcttttgtagcctcttcctggtactactctccttgatcctgcgatgtggtactaaacgaggacaacgttggcatttgctgtgtctgtgtgggccgctggctcgtcgaggccttctcaaatgggccggccttttcttttgcaagcctgtttactcgctgcaagctcgaactagaaattgctttgttcaacaagtgacatgattctttggctgattatgaagattgcaggtgtgcgtacatcaaaggattgatggaacatgcactgcagtttggtttaacggttacatcgaatcgaagcaagaacaattacatgaatatttgaagtattgcatttgtactatattaataccatgatggatctttaattacaggtagtgggcacaagaatttctgtatacaagcactgcatttttttacatgaggaataaataagggattattgcggaaactatctaactagtaaaatatttatgtggaaatttctcgagctcaaaggcaaagccttaattttcccaggcaaggagatcactgacggttttctgtgatctgtctatctatataccaaatgataaagagtggtacaacgtatgaactgtcgattggcctgcaggcaagtgaacaaagtaaaagaaactaataattagtcatacgcagcaagaacaagatcgtaccacacaattggttaaccgattcttacgtagctactatgggctatgagctgtggtgcgagcgttttcataagaaactgaaaacgtccaacatctgaattcagcattgatgtgatgtgctctaagtctgaagtttgggacaaattggcgctgagggtgttgagatggaacctgaaaacaaaaaaaaaaaaaatcaagaccaaccataataagtctgcgatatgctctgctgctatttcaaactggcagtgctagctagatttggtcagattcttcaatctgagatgttggcaatttgggtgaaactcacatagattggcatagcagggctgttttgatgctgggtcttcttccaagggtgggggcacttggccgtaaatcatttcacagctcatatcttcaaaatctgcggtgattcataaattcagtacttcagggtacataatcagctaggacagtgtaaaaattgagaagaaaaaggatggacaacatgcatgtcaaatggtagtatgtcattgtcaaaagaacaggaagaggaaactgcagagtttggcattgagtagcacaagaacgatgtctgtcttacttggattcatggtgagagggagtccgaactcgttggtgaagaagttttgcgtcggaattttgcacatgttgacgcacattccgacgcagccgctgttctccaggtacctgaaacggagatgaatgttttctgaattttttactgaatctcgcttgaaatccaagacgaacacagttgaatcgtccgtcttacctgcatttctttatcagcactccactcttctgcttcaccccattgacctcaacctccacaacctgaaagatcaaggaattgatgcaatgagttcatgacgatgaactagctgtgtctctgaattatactcctacctctgatgggccgacgagccagtggaagaaggggacggtgagggcagcgttgaactcgcaggcccacctcgtcggcgggaagagcttcttgaactgctcgggggcgccgggggggagcatggagaggagcacctcgcggacggcctcctgctgctgcgcccgcgtccgccccaccatcacccgccgcgacacgtccacgaagctctcgtagtcccactcccacaccgacctcgagctcttctccttcttcttctccttccccttcccgccggagctggagacgacggcgtacttctccatcttgcgcgcgaacagccccatgaaggcgcgctccaccggcccgtcccggtactccgtcttctcccccatcggcgccggcgcagtcgccgcgcaccgaaccctcctccctgcagacggtacacgcgaccatggcgccgccactggcgccaacagcaacgccgccgccgccatagtcgtcgtcgtcgtacgtcgtcctggctcagctcagcctctgcgtactcttggcgcgtctccaggtttcatgggcggtggtggtggttcttggcattggcgttgcgtcgtcaggcgaacctgaggctgccggcgtgacacggtggcggcgagcggggggccatcgccgtggatgcttggcactgggtgcacgacggccacaataatttggtggattatatggtgatggtgatgatgtttgtggcgattcgattggctcgtggcgcccacgattttttgtgtggaggcccaaaggatggcaagtccaatgggctaaaattttcaccttggaataagttcactttgggtccctctatttgtcactcagtccgattttcgtccctcgaccgcaaaaccgggtacgacccgtcccccaacttacgaaaaccgggcaaacgaggtccctcagcggttttgaaggcggttttggatgacgtggcatctacgtggcttgtttgactaggtctccgtcccacgtggaattaacgtagcgcttacgtggcaattttcaacccgaaaaataaataaacctcgcgggacccacatgtcagtttcacatagaaattataaaaaaggtggggcccacgtgagccccacatgtcattctctcccccccccctttcctccaccgccctgttccaccgcatcctcgcagcccgcgcccgccggcactcaccgacgaggcgacgacatgaccccagccgctgccgcagcccggcgaccggcggcaccacccacctccctaacccgccgtggccgctcggggtaagacggttcccttgttgctgctcccgccgtcctccgccactcccgctcccgccgtgacgacgcaagagtggaccacgcccggccgggcgtaggtcgacggtggcgaccagctgtggagcggagcaaaggccggtgacgagcgccgtcctcggtgccccagcgaacagcatgaggcgaggccccatcgaccaggctcggaggggatccggccacccggcaacggcttggagtagaggatagaggagatccagcgaccggcaacggcgtaggcggaggagctcgggggtcggcaagtggagagacgggcggcggcgaggggcccatcccccggcggatggggacgtcctgtggccacggagcccggcggatgtcgacgccccatcggtggaggaagtcggccggctgcagtagccaccgcaccagcggctccgcttgccttggcagcgctaccgcggacaacgacgccgcggccgctccccccgccgccgggtcgacgctcctctgcgcgctcgccgacgctctgtgggctcaacggctgcggcagctagagccacctcccgccgccccttcctctcccgccggccgccgcacgccgagcgccgctgcctctccaccgcgagagaggagaggggagagagagagttgaagagagggagatacgtgtggggcccatgtgggccccactatatttattatctgacttgtgggcccatgtgggccccgctattttaaaattattttttgtgtgcatctgacaggtggtcccatgtttttttattaatttttcaagatataatgccacgtaagcgccacgtcaatgccacgtaggacggagaactagtcaaacaagccacgtaggcgccatgtcagccaaaagcgccctcaaaactgtcgagggacctcgtttgcccggttttcataagttgagggacgggttgtacccggttttgcgttcaagggacgaaaatcagactaggccacaaatagagggaccctaagtgaacttattcctttcaccttccgccctcggcctgatggacctaggcctatgtctacatgggctgaattcacatttcacaactgacgtaggctgagttcgtttcttttacttccccaactcacctctctctcttttccgcaggcacgtttttaaattattaaacggttttttaaatatatatatatatgaaagttttttttaaaaaaaatcatattaatccattttcaaaatatagctaatatttaattaattatatattaatgaggagtatttcgttttgcgtgcgtgggatctcaaccatagaactcagccgtagtgtacttattggctactttattgctatacacgtaatgtcatcgcttatacacttcatcccataaaaacgactttttgaaatgtgtcgtctataggttctactcatccacgcacgtaaaacaaaatgtcgcattagcgcacgattaattactttcttattttcatatcttatagtttcacaactacattttacacctcaatgcataaccacacaatgttattggacgtagatcttctgcagcactgttgctgcaatagcaatggttttcatgtgaacccgaattcacacgtcagtgtctaccattgcactagcaatactgtacataatctcaccatcggatgtcatttagttggaattaaacccggaatacatataattttcatctcttattcctccctacgccattcgtatacgcaagtacaatcgattaatcatcgcaaagagaaaagaaagaaagaaagaaagaaaaatctatactctcgatcaccaggctacatcagtgtgccagtaaagatgctgaaattcatctcgaaacaagatcatatattccacttgatatatctcacgattctttacgtaagttgctgtttaccactagttataacttgatactagtacatcagcatgtcgatatattgcaatcaatacgatgggaagtactattagctagtacagatcaaaaagtaattaatccattgcaacatgagaaaagttcacatcaaacctatcctatcagcgtccatccagtagagaaaagattagaggaaaaaaggagcaagagagctatgtacgggcgtaaaattacgggacagggctgaaattcgttggaatcctaagaacgtgtgacggcttctctgatacaagttgattaattaattaagctgagctttctgtgtcccatttcgtcaattaattagctaccctctcacacaaacacatttaccatttaggccgagtttagttctaaactttttattcaaactttcaacttttccatcacatctaattttttatatacataaacttccaacttgtccgtcacatcgtttcaatttcaaccaaacttataattttggcgtgaactaaacacacccttacccacactcgaaaaaataaacgccagaatgcagttgtataagctatacggttgaacaaatactgattataaaccgtacagcttatcggcaatgaaataatactaccaatttacaggtaaaacttttatatatgtttcttcagtgatttaaattccaatgctaaaaaaaactttgatgaaatatctcaaagtcaactctaaaattaaattttaatgtttaattaaattagatggctgcatgtaaacaatagttatactgaagttcaaatttggcatctttttcttaaccttctgcggggtcattggattgtcaaaagctagcttgcaacttgctctgaaatatttcatgaagattagataagtcaaaagcctgaattaattgtccttgttgtcgggacaatgggacataagcgggatatggtattttgtactacctccgtcataatatgtaggatgaggttaaattatactagaattacgaatccatgaatatgatgtgtttaatcccatcgtaggttgctacttgctactcccaataaaagagagagtatatgttttatcgttacaaacatccttgtacgtactttagattgtcctagcattagattataatttgaagcaaaatttaactttgaaaattacaagcacctaggacggagggagtagattggaagcaggtttcttcaatctctatggcctgcctcgatcgaatgccctcttttaaaaaattttctcggtgaaggtacatatgggccggacagatcctaattagccagcaccaggcagatgcatcccgggatatgatgggattccacaaaataccagatataaatccagatggagaccataattctaattaactaaactgcatgcatgagatctggagctgtttaatttcatcattagctagagcaagccagtttagcatacatgattttcacattaatttatgcatactatagttatttcacacaaactcgatcactgtcgaaccgtcggtttcattaagtttgatccgccgtgcttaactgaaacatagaaaaacaataaattgaaatacgaatagaaacaaaacatgcccatgctcatcgaaatgaactgatcgatgactagctatagcttctcctttatttaattaattcggtaaaagtacagcaattctcatcatgcactgagctctactacatgtgatctgtacataattacacacgcacataatccatagaaagaaaagcagaaaaagatgagatcgatgaactccaagaactaaagaattaattattacatgcacgatcactatcaatatatattgtccgtgtaccgtaagttgctgctagctagctagctagctacttgtcgattaccaccatggacaatggcggcggcggcggcgggtggccggcggcgtgagatcctttgtgatcacttacagtagacggcggttgcaaggagagggcgaggtagacgatggccggagtgcaggcgaggacgaggccgacgggcaccatccacagccggctgttggacgggtggaacgccacggcccaccacgccagcagcgacgcccccgccatggccgccgccaccaggcacgcgtccacggcgacggcacccgctgccacctcgccgccgatggcgcccgccgccgccgccggcggcttctcgtcgtcgtccatgccgtatatactttggaatggtgacaggaagaaagaggaatgaattgaaggtggtcaatggcggcttattagctctgcttcctgtatggctgtatatagtctcgtactactggtgttggtgtgatgtggtggtttacgttattggaattggaagctgcacccaaccattcactgcctataacttactctttccttcctggtcttgcaccactcggtgtaggtgtgttctgggcatgacaacaacttaacatcgagagaccaaatagattgatcgatcgcccagttcgattatttattttattattgtataaaaataccttttttccttcacagaatttaaacttatttctactgtattgcttattattacacttatttgttcaaagctactgttagttaggagtaccgtttcttaaaataatttactgtataattagagaaaatccaagaaataccattaataaacactcaaaatacaagaaatatcatcgataagtgtgagttccataaaatgatgtcgtacaagtgattttatcccagaaatgctatcatcgttagggttccgtccattccgcgccgttaaatgcatgttcattctatagcatttaatggagtgatattaatgtaaccctgatggtgatggcacttcggggataaaatcacttgtacaatgacatttcatgcaacttgtacttgtcaatgatatttttttggaattgaacgcttgtaaataatatttcttggattttctcatataattaagtagctagataatccgtgacaacattgcatgggacgaggaccaaatcaaaccagccatgtaggcaccatatcagctaaaaccatcatccaaatagcattactgtatctggttttacaaaccgattgaggggcgtgatttgaactcgacgcttattgaaggacctaaagtgaactttttactttctaaaccggagtcaggaaagcccatcaattatatccattctttaagcccaattatcaaaagcccatttcagttccttccctgtctcggcccaaacctccccactcggcgacgcgaccaccaccactctcttcttcttccccattgccgtcgtcgatctcgccggcgacaccgccgccaccgcgcctccgcctccctcccttccgcggatcgtggcgggctagggcgtggactctcctcctcggtcctccacggatcgagcccgccgccgatgggggtggtgatcgagcgggaggagtgggcgctcacgccgctcgcctacccgctcctctccgccgcctccctcgccgcggtgctcctcctcccctacttctccccaccgttgcacgccaccgccgccgcgtccccgtcgtcgcactcccccttcgacgtgggcaccaccccgttcctccgattccgccgcggcttcctcttcgtgttctcgctcgcgtccggtaagcgctctcctccattcaccattctgccttgctcgagccagcgtgcgggggggctctgatgggtctcagttgttgtgtagtggcggaggggatccattccgtgttcggggaggatgagttcgcgcggtgtgggcttggaagggagcagatggccgcgcgccttgccgccgccgcagcagccgtgctcttcctcggtgggctttccggcgtcgtctcagataaactgtgagtagttgtgacttttggggagcaaactatttatccttttcgcagctctgtcagtagagattttcattcagactatgaattgctgctggatggtcgaattacttgtaaattcatcaaattcctcacgcttatgtgatctcccattgcatttcgaaacaatgttgatggtattcaatgtttaaatagagggactactgcttcctagtaatcaggcaagctatgtttggtgcctgattctggaacttttgttgactgttttgtttaaaatctagtcatgatgtttactagttggtggttaagatcaataagagtttttcattcatgttgaccctgctggtagaacatttttttatccttcacttgtttattaccaattctataccaagacataccccttcaccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 31410 - DNA, 14072 bp, Oryza sativa
  unsure (1)..(14072): unsure at all n locations
nnnnnnnnnnnnnnnnnnnnnnnnnnnnnnnnnnnnnnnnnnnnnnnnnnnttggctggctttcattaaaggatccactgaataaaagatacatgctagatcataaaaaatatgcacctcctgattgtgaccgcgggtgtgttttatgtggacatggaattgtggagaccatgttgcatctaaattttgagtgccccttttcaagatttgctgggccgttgttaggattttctggaaaacatcagacaatttggagaatataatgtttggtgtctatcttcgctaccgagaaagatgctttatcgagaaaattttaatggtgacttgaaaagtttggaaagtgagaaatggttttatttttgaaagcaagccagtttccatgtcgtcttggaggtgtctcttaaaaggagatcttctactccttttcaagctagcagagagagagagagagataaagatgtagccatgtattggatcagtgttttttaatatttctattgtaattacatttttctttatatattaaataaagcatgcaataacaacggggacctcctttgccgtgtcttctttaatagaaaatcacgatattctcctatatttaattccaactatttccttaatgtctgtacctaactctacaaattgttattacttattttaggagacagacccattaattaagtgaggagaaaggtcagaggatcaagctgcatcagtggaagctgtacgataaggcaactattagtgtccatccaattcatcgtttaccctgtacatggaatgagagagagagagagcaaggagacaagagagcgtcccctcaaatgcccatcgacttcggcagcaagctcgatcgtcgatcggtacaatattaccaggtgacaaaagacacgagcccgccagcgacgcccgcttgcttgtcgatcgaccgtgccacatctgtctatctatagctgaccgatcgatcgacaccggccggcatccgaggactaatgagagtcgcggaagaaatttgaggcaccgagaggaagaggaagaggaagaggacgacgttgacgcggatgatatttgaggccgccgcacgctagcttatccatcctgtgtggtggcgtgtcgttcgatccgacgatgttaccccgtgcgcaagtcaggccgggtcactctcaaggtttcaattttggtccccaccgaaatttcggtggttaccgaaatttggaaatgtcgtgatttctggatttttcagaccgaagtgatttgaatttgtaacgtattttgactgaatttgaacagatttagaaatatttgataaaaaaatggaacttttggggagatttgtgtttgccgatggggtcgaaattactgaaatttcaaaccttggtcggtcgtacggtatgtttgggtagtttaaagttttaagaaacagccggttggtagtcagcttctgagaaactaagtttctcaacttaattatattttctaattaattttctgaattctataattatagcttctcaaaatctgaatgaaaagttaattaaactgtttggaaaaaactcctgaaacagactcctagccaggatctcggcctctagcatgtgccgaccgtgactcttgagtgagagagatggccagtgaaagttggtgaaagcatcgtccagacggtacaaaaattcacgtggcaatttcgttgagccaatcaatctgcttggtccagtggtacctgttagctaggcctattgtagttcatgtgagtagagtggagatggaacgttttatattataaaactttatagcattgttcacgtaattctactaacagaggaagtactatagtaccactattttgaatataatatgcttgcttggtcggttatacaatataaatggttctaacaattgaaatttgtaccgaaatctaagtaatttaagtgctattcgtattactttatacccgtgtaatcaatcacctctctttttattttttaatatatagaattaccaatctaacctaataaagtcttatttaatgaaggatatcaaagttctttttccttatctctgctaaacgcccaaaaatccacgaatacttatattttggaactatccaaactatcggttataaacaacggagggagtagtagtatgcatctctaattaataaatatgcaataataacatacccaagcttagggtggataaatatctagatatttttacacgtgaatatgtcagaatccttatgttggaggattgtccttgttctgttgcgaaaacccagctaaaatagatcacatcgttcacttttcgcatagcatttgactattcgttttattataaatgtagtataaatatgtaaaagtacaggctaggattttagtttttttggtgataaaataagtcataataaaataaataatatttatataactttttaaataaaatgaatggttaaacattacgtgaaagtcaacaacgtcatactgggacagaaggcgagtactatatctatctcttggaatagccttataaaaggaggagttgttaggagcaacaagcttgcaacaatggcgaccatagcatccatgcatatgtatggcttctctcttcaaccacgcctgtgcagcaccggaggaaggccagccaagatcaccaggactaagcctttggcgactcatgattcctctgcgcacatcgtacgcacagtactaaaccacacctccctccgtagttagcctctctagtctcctttctgtctctctgcatataacaactgaactgatcaattattccagagctagctagctctactgctataagcatgcaacaacgagattgagattgtatattttactgtatgggccaaaaaaaaatgtatattttactgttgcattgcatatgtacaatgagatgatcatatgattccatttgaatacgatcatttgatacatacagccacctcgtttcaaggagcttcagcaagtattgaaaaccaaacttagggaggcatctgctgcaggaagcagtgcttccaagaaatggctggatgcgtttgtggactctatcttcacattcagtcatcaatctttacgtcccaccgaggtagggcaggcaagcatgattgcatatacgttacacaaaatgcagcagcaatttattgctttgaacttcctataatataaattttcttccgtcctgtaaaaatgaatgctttttaggattaaaaatttgtctgaaaagagtattcttctaagtactactacctccgtttcaggttataagattttttagcattgctcatattcatatagatgttaataaatctaggaacacatatatgtctagattcattaacatatatataaatatgggcaatgctagaaagtcttataatatgaaacggaggaagtacatgttatattcaaaactttgtcccatcctactcctaatcatgcatcctcctatcatacatcatagttgtttccttctcaagcattgatttatgctaaacaagttagaagagcaagtagcacttattttggggtctaagcaatgaattggagagaaatacattaatttcccttggagaaacaattttcctctaaaactaaattggagaatcagttcaatttccattgctaataacttacgtatgtggtggatctatatatccatgcagagtaattttgcaccagttgaagaaattggtcaaataacaaatatattgcggatagaaggggcaatcccggaggactttccagagggtgtatatattagaaatggtaattctctttcattactaactattactaactagattgaaagttatatatggtagcatttggctcgggtgcctggtgggaaggaaaatatcgggcgccctgcgccccacatccctcctttctctctcggtctcatctattcccctcctttatctctctcttcaccatttctctcctctctatcccctttgatctgtgaggaggcaaaggtggaggcaaggtagtgacaggcagaaacataaggcaagatatcggcaggacaaggcggtggctaataggggtgacggtggcaggcagctgcagtggcggcaatgtagacttagctgagtctatgcaacaacggcggcaatggctatgtcctgagtggctgtaggagtgggtggtggtggtggtttgtagggcatcatcagccaaatcatcatcttcggcagctgcacgccatcattagccacgtctcctccgtggcttgggcagcatctaccgtcgatgatccggctaacctgaagtggatttagctggtcttttttcgggtgattgtttcaatgttttcattctatgtatatggttgtttcattagtcagatcaaagtgtttcacttggatttttttatggtgtttcaatttttgtcttcgatttcactcggaacttgttgatctttcaatggctttaaatcattagttttatttattgaaccaaattgtttcatctggcgatccgattgcgtttcacttttttcaagaactaaaacattctttcacttagtgctgaaacactctttcataaggggtaaaataatgcctgatttttaggaaaaatcgggcacccgatttgtagtcatttcatcacaacagacacatacggtcagatgcagaacaaagcattactatctactagcttctcgaatatatatgacattttaaaatgtgtacagttaaaccatcaaatcttaaatcattaatatatgtaaatataactccctctttcctagaatattataacctagtaccactaatctaaaacgacatcctgtcgttaggggtggaaacggatcggattcggacggatagtggtcacaccattgttaacagtgaaatttggtaagccccgaagtcctgatcggcctagagttagtattggcttcagagttctggaatcagccgatgagagtcatcaagtcgctagtaatcagattaagaaaattaatcaattaaagaaagcttatctagaagagaccgtgttcaaggaagatgtggcatggcagtttatctattaattaggaagagtttgtgtttccttttatctttaggaaagtgtgtttagtgtcccataaggattttatgttttctttttatctttcgaaaagtttctttcttgtccaacaaggactagtatctacccatgggtataaatatgtacatatgtggtaattttaatttatctcatagatcaatacagctactcttggcgtatagccaccctctttcccgaggtttttatttatcatccggcgaaaccttagcacttgacgcggggttgcatcggctttcgatcttcggcgaagggggtaagtcctacgttccgccagtcctggcaattgtatcggctataatggtgttgttcaaggctgcatcgcttcgacctcttggatcgctctggttcggttgatatttttgcctacctatttatcatatatcttagttaatctagttttagtatatcgatttagtcatatcagctgattctcgcttaagggtttatgccggtatcggctaaatcgatttactagattggattagctaaggtatccaccaccctaaaaattagtcaaaagcttgattgtctagatattgtgtttcttttcatacttagtgatgcattagtacattcgatctactaagtcgtatttagaaccatgatctctagcctgcttcttgattgctaataagggtttcatcggggtttcagccaatgagttacatgggcgttgcatcggcttacaaggattacatacaagttggttttagccgatcgcaataaaggtttcattgtttatctaatcgtttggatttaatgacatcggactttcagccgatgtaagctttaaccttcggattagtgtttatgctctcatatcattattagccgattggtttctactggattacattaccatcagccgattgtctttatatcgttatctacattggacatatagccgtttgatcaaaaccctattgacatcggctagtatcggcatcgactggaactactccatcagcttatcagccgatcggctatttgatctgctattgtatatcttgtgagttgcaggatcaaactgattggcacacccgcatctcatcaacctttggacctgcactggagttaagcaaatctcccaggccaccgtgttttcacatcaacaaccatattctaaaccattttttaagcagattcgaagcgggtgcggatatgtgcgcatgcagagcggattgtttcggatgttggaaatggtgcggagtcggtgcagactcggttcgggaaacaaattaaatttatcagatgttagatgtttatacaatcaatacaacattgagttatcaatgcaagggacagcaatacaataatcattaaacgacctttcataaacttaagtgtaagatgagacggcaaaagcctcaaacaaggaagtttaggttaattgataaattaggtcattggatgggccgactcatgttatatgcccagatagagtggttacatgggttgatattttcggattatccggcaaacgacctatgggataatccgatagaaataccagataatccgcatttatcggtttttagagataccacatccgaatcagaatccgcaccttactatccgcattcgcatccatatccgccgatttctaaaattccataccatcctcgtttaggacggatttggaacggatcagatcggatataatccgatccattttcacccctacctttcattgtatcaccgttagtctcccataaactatgtgaaaagtccatttcacacttagaataatatatgcaaaaatacactttatgtgtggtgcaatggagtatagttaagggtaggctaatagtgatggtaaaaggggaagaaaaaaccacttgttcgatagcatcttgtggaacttttatttgtcaatattactcagcaagtcatacaggaataggggtatgatgcaaggattcaacaagggatagctaagcaggttcatttgcataaagcgagcatttataaacagaagctgaaagattcaaacagttgtaattattaattaaacatcctctgtccagcgctaacccacgttgcgacaggcccaaccatccacctaaattatccaaattcaaaagattacactaaggtgagactaatcacggtgaatctggttgaccgcccgtaaccgcgggcacggctattcgaatagttttactctgatcagagctgtacaactgtacccacaagacacagccccacgacacgtttccgtgcgcccacatgccaccacgacatatcagaaagaggccgtgacaggacccttcgcataaccccctctagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataagttcttccagggcatcccgcgaactggtaaccataggtaaccatcccatagtaatattataaaacaatgcaatatttgaaagaaaacaatagagcatttgcaatataggatcaacatgttcaagtgacaagcatgacttgccttgctctgctgctggagaaacctcggcgactatttcgaagtacacgggagcgtcggaagaaacggaatctagcgacatacaaggcaaacattgcaaacaggctataagactactgaaacagagaacaaaaccatttttaatggattctacacatttttcttgatttactgagacttgaatgggcttaaacggagctcggatgaattagttatgaattttagaagattcactgtgtttattactatacaagaaaaaccttaaatcatttattgcgcaataaatcccagggctgacgtcagcacagaggggggtgcggcgccggcaagcgggccccaccggtcagcggctcaggaggagcggttcaccgtggaccaggaccactcgggtggtccaccgccggtccacgggaccgacggcccagatcgccctcgggccgatcggacgggcggcggtggaggcaccgccgggctcggctcggcatcaaagccgaccggccgacccggggctgacggcggtggcacgcgcgcgtcgcgttgccggcgacggcatccggcggcggagacggcgacgcataggcggcgccgaagggcggtgatgctaaagcgacgactaaccggcggcggcgctaaagcggcggctaggagggagagggaggggaaaagaggggaggggggtgcctcaccgagggtggccggcgcggaggaagacgatggcgaacagcgacggctagccaccggaggacgacgtcggagggcgacgagcttcggggtgccctaggaaggaaaacagagggattagagagagcagatggaccacggcaaccggaaaccatggccgaaggcggcggtggaggtggtgctcacccgagtgcgagggaacgagggctccggcgacgaacctcgacggaggaggggtggacggtggatctcggccacgcgaacccgacggcggcgacggcgcggcctggcggcgaccctaacggcggctagcggcggccggagtagcggaaaaggcggcggcaaagggttgcacggcgcgggagcgatgggaggctcgagagagtacggcggaatggggaaaaagtgagaggggacgacggcgatgcttaaatagggggagaggggaccggacgtggccgggagaggcgggaatcgccggccgacgtggggggtggcggaggagagagaggcgggattcgaaaatcgaatcccggccatctcgggcgcgggcgcgagcgggagagagagaggagtgggcgcgggagacgcggcgcacgcgcgggcgtggtcgacgtggcccggaggaggcggagacgtgggtgcggcggcggttgcgggcgcggcggcgcgagcgagatcggcgggaggtgggggaaggacccgacaggtgggccccacctgtcggtgaccccggagaggagggcggcgggacggcctggctgggcctcggcctgcggccggcctagcaaggaggagggggaaggaaaggagagaatgggccgacggcccattcgaaaaaaaggaggaaaaagagaggaaaaaagaaaaagaaaaaggaaaaaaaaggattttccctggaattaaaatattgcttgctcaattttaattggttaaaattatttctagagctctgaaaattccactaaaaatcctgttaatgaatttcgacatgtagaactcaagaaaaattccacatgtcaaatctgattattatttgcattaccttcttagggttttctcttgatttgcacctgcattttcttagggtcatttataaattaaattttaggcttgggaggagaactttggggtgtgacaaccgccaaggccaggtcaagctcccatgacttggaggaaattcagaaccgaccatccacgcaaggccgtgatggttgttgaagaagttcaagccctccgcaaggagttcgacgcccagcaagcaagtagccatcaacagcccgttcgcaagaaggtcagaaaagacctttactgcgccttccatggacgctgttcgcacaccaccgatcaatgccgaaacattcgacagcatggcaacgcgcaagatccaaaaccgcaacaaggagtagctgttgaagcacctcacgaagctgttcaagagcaagcacccccggccgaacagcgccaagatgtgcagcgcagagtaatccaagtgattacaaaggttgacccgccgaatcaactgtcaaaacagcaaaagaagatgcagctgcgaatggcgcacaacatcacttcggcaagcgaagaggccccgtgatacttgaatcagtagatttccttcgggccaaaatatgccgaaggagtgctgttcccgcatcaagaccccctggtgatctcggccgaggtagttggcttcgaagtccggcgaatcatagtcgacggaggaagttcgaccgacgtcatcttcgccgaagcatatgccaggatggggatgccaaccctagccctcacccaagcaccggcctcgcttcgcggttttgacggagaagcagttcaagtcctaggccaagtacaattggtggtagccttcggcacaagtgaaaagaggcgcaaagagcaaatactgtttgacgttgtcgacatcccatacaactataatgccatcttcagtcgcgcaaccttgaacaagttcgaagccatctcccgccacaattatctcaagctcaagatgcctggccctgcaagagtgatcgtggtcaatgggcttcaaccttcggctacatcaaagggcgatttggccgtaatcaacagagcagtccacaatgatgaggccgaaccgcatgaccgggcgaagcacacgccgaagcgcgcccctcatggcagggtgatcaaggtgcaggtcgatgatgccaatcccacaagacttgtatcgctgggggcgacatgggcgaaagagaagttgagaacatcctggaggtgctcaagaaaaacattgatatctgcgcctggggccccgacgaggtggtaggtgtttcgccatatctcatcatgcatcatctggcggtcaggccgaatgccaagccaaggaaatagaagctgcgcaagatgtctgctaatcgccaagaagcagcgaaagccgaagtgcaaaagctgctcaaatctggggtgatccaggagatcgatcaccccgagtggttggcgaattcgatactggtgcggaaatcaaacggcaaagggcgcatgtgtgtcaatttcacagaacttaacaaggcgtgcccaaaagaccatttccccctaccgcggatcgactagctcgtggattcgacaactagctgcgaactcatgagctttttggatgcgtactccggctaccaccagatccacatgaatccagccgacatctctaagacagccttcatcacaccattcgacaccttttgctacctcaggatgcctttcggcctgaggaacgccgaggcaaccttcgctaggctagtgtacaaggtcatttacaagcagttggggtgaaatgtggaggcttatgttgatgacatcgttgcgaaaagccacaaggctttcgaccatgcgtccgacttacaggggaccttcgacaacttacgcgcggcgggtatgaaactaaatcctgagaagtgtgtttttggtgttcgcatgggcaatttgttgggttttctcgtttctgaaagggatatcgaggcgaaccccgagaaaattgatgccattcagcaaatgaagcccccgtcgagcgtacgcgaaatacaaaagctcgcgggccgaattgcggcactcagtcgattcctctcaaaagcggccgaaagaggcttgcgtttcttcaagactctccggggcgcggaaaagtttacctggacacccgaatgccaagcagcgttcgacgagttgaagcaatatctgcagagtccacctgctttggtcagcccagcactaggaagcgaactgctactctacctagcagccttgccggtggcggtcagtgcggccctcgtccaagaaacagagtcaggccagaaaccagtgtattttgtctccgaagccttgcaaggggcgaacatacgatacattgaaatggagaagcttgcttacgccctagtgatggcttcgcgcgagcttaaacactactttcaagcccacaaagttacagtgccatcacagtatcctttgggctaagagctccggggcaaggaaattactagccggctcagcaagtgggtggcggagttatctcccttcaacctacatttcctcgcccgcactgccatcaagtatgaagtcctagctgacttcgtggccgaatggacaccggcattcaccctttaatccgagcctgtcgaaacaaccttgggtgacgtactccgacgacttgtttcgggaaacaactaaccgaacaccgttacactcgatcaatatgaaaacacaagcgctcctatcagcgcagaatactacagatcgaaaacggaagccgaaagctgaaaagtcagcagacctatttcgctaatatacgcaaatgggccaacacgttccgacctaacgaaagcacgaaaagtgacaatgcaaagaatagcgaaaaggaagtaaaacacatctttatcaacttcgaaaaaacaatcgaagaatacaagtcttacaacatggtatagacaaagaaagcaacggctttacagcctagcttacagataaattacacattcgcccccacaacaatcctcactccctaaggaatgatttggcgaatcaggttcgtcatcactactaatattatacacgaccctaagagggaagggggcgaaacacagactagactataacgacattgggagatcgcctcctgacgatctgttttctgatggtttcgccaaaagcgaaccatgtcctccagacgttctgtatggatacggtcgtagtcttccagggttctcccggggtgcgcccgcattcagccggcaaccttcaaaaccttgtagctgttgccgtttattatcatctcgcagtaaacaggccgaaacgggcatcgcacctttggcaaacccttcgccgccacgaacttctcgttcttgtttcgccaattcccaaagggggaccgaacacacaattttcggcaaacaccctgctaaaacagtgcagaaagggcaaatgacgaagtgcaaagttaagactccacaagaaacgtaaaagtgggcaaaaagagtaagcactctctagtatgcaaaaataatgcgaaaatgacgcaagcatatatgccaaaggcatcaagcataataattggctaaacttggatcatccattccatatatcaaaaagaccgttcttggctatagtaagaaagggaaggggccattggccaaatttacatcgttcgcctttgtcacagcctgaattttcgtttcaggatttataaagtatttaataaaatattaatagaatttatattaaatgttccttaaattacaagtgaagttaaatgtgggaaataaaatttcctaaatataaagcatggctggattttatttttattaaattctccatgattaattgtactctctgaaattttcttggatttttcggagctcaattcctaattttaataatacaaggactatttcagtaattattcacatattaaattaatcattaaatgagctggtttcaattttgttaaatacttagggtgcccaagttgtcgacgtttgatgtcgcgattccggtatttgcatagtatggagatcgttggtactaggatatacgcgagactgaggtaaaagagatggagacaaggatttttatacaggttcgggcccctgaattgtcaggtaatagccctacatcctgttggccgaagccggtattgctcttattcaccataatcacaccaagtacaatatttggggtagcctatctaactgttgtcgactttgcggtctgtaggtctgactcgtagtcgacaacagggtagtcttcttcctcgagttcgtgcccggcgaggtcagagacagcgctagatccctacggctagcctcagtacgtaccggatagggtcgatccaggcgtatctctgatgtcgatatccggcggcttgtcttggcgcatgttggcttgtattggcttgtagctttgtggcgtctatgttgtctgtgtcttctatggtgggtgtgtcccctctcctcctagggggccttgtatttatacccataggtatccccttgtgcaagtagaactaggggaacaaatatggatacaatccgagtagtccttgtcgtttccatgtagaactctagttgtctttccttatccggaactcttcccatatccacaggttctttccgtataggacatggtatatggtgggtcc

SEQ ID NO: 31411 - DNA, 16592 bp, Oryza sativa
aaccatagagacatggagccttcgataatgtcgaatagaattttcctaaaatcaatactcagaaaagaatattagatagaaatagcccccgagcgaacgctcaaagggtaacatgttataatatgtatggaaaaccgaaaatgcattaaacttacagaccaatgttttgtatatgagcgtctactcttttaccgacttcgatcagtcagtttgttgagttatacactctccctagcccctagccttattgtcggcgaattgttcttggaggataaggctcttggacctttcacctgcctcggttgaacaagcactgatcctagcccccagccgtgaagttggaaaatccattttcgattacacggcttggttaatacgcacggcgagaactcttacacgaccagatcttacatggtctttcgtctctaaaggatccgacaaagccttatccgctctgggcgtccccagccgaagtttccttaggttcctcagaggctttgtcaagacggcgtaaagggacattaggataggtttcaacgctaggtgtcttttgtggtaagggatctctgggtaaaacacttggcgatattgtgcacctgatatcaactttgttgaagtagaggtaatgggagaatcactacacctctggtcagaaccaggtagtagtcgtaactcaaccactagaattaaatgtacgagagatcgctacaattgactggttgaggaccagtgagtaggtgtctctcgatcatttgaagtcgtagtacgaggaccgctgcgttattgctgtagtcgtacctcgactctcgaacacctatggaggcgctggaattggtttattacatgcgcatctcatgtggctagcatgactcacacacccaacttgtagcatatccggatgtccgttcacaatcatgtcaggtaataaagccgacaacgttcacgaggaattatccgttaacaaccttttctcaaatagtccagccacagccggtgctatgagataggttgtcagttttcgttggtaggttgggcgcgacgactctgcatttgtcgagatcgttctcgataatgcggtgtacttgaccacaacctactcgagtgctcaattgttcctgaaaaatattttctagaagacaagatatatagcagataatatcgagtatgtactcaaaaaactgcatgaatcttctagcattatcaggatataacgagcagattaaatatcagggcattatgtaaactgtaaacaagcatgatttatacagaagaagacagagcgagtccccagcgttagatcgtagtcgatttaacatcagggacacccgcgcaacagatattgtataaaaaacatgctctaggtaaacataataaattataaatccgacaatgttgtatgatctgaatattggtatggaaaattttatataaaataatgcgtacctgtgtagatatatgccggatatatctacgaaattagtagatcaattaaattaattaacctactaattacatttctgacatgtgtattcggagtagattagatcgatgcaatcttacttctccaggtgtacagccgcatgaatgcagtaaacacatgcacttgctgttaattgatctgatgcatgcacatatggacgttatccaaattggttggacttgacgccggccgtgatgagttgacgcccgtgtcaactgactaaaaatcgggtcctagtcagaacatggtagcactactctggcagttgatttttggctcctcgacacacttgcttggttggtaggaatcggtgtcgggttcggcttggactcggccggccgatgccttgcaccagttgatgtcgcacgcgtcgagggttaggctgcttccgacatcatggttctccgcggcggcggtagtcccaatctcgtcggaagatatgctccgatcaggttagattttcccacagccgaagtcgccgagtagcttgttgttggagaatccatctcgtaaacccatctcatcgaaaccttgaagcaccaaaaatcgccctacctggcgcgccactgtcgacgttttatgtcgcgattccggtatttgcatagtatgatgatcgttggtactaggatatacgcgagactaaggtaaaagagatggagacagggatttttatatagtttcgggcccctgaattgtcaagtaatagccctacatcctgttggccgaagccggtattgctcttattcaccataatcacaccagttcacctttagtcctcgcccattcttccttctattcggccggccttatcccttcccaaagtctggtttgcattcctccttctatcgggctgtgcaatagaagcccagccaaaagtctggtttgccttcctgcgccactgttcatcttccagctcaggaagagccgactgtccgccgtgcgcatgcactgccgccgcctcctccttccaaatccgacctccccgttgctcctatttccaaattagttctgggaatggaatcctcttaatctcctcttccttttccccaagaaatccccaaaagtttctacggaaatcctttccaatttcgcggatcaatctttcctttttccggcgaagatccctagaatttcccgtagtttttccgtcgatttgggcctggacccgagctcccgtgcctatataaaggaccccctcgttgtcctctacctctccctcaagtcctgtcttccgccgtcgccggaattgctctccccgggagccccttctctctctaccttcggccgccgctccagccgccgtgcgccgtcgcttcggccgtcgccagtcagcgccgccacctctctcggctccgcaaggtcaatagcaagctcagcagccatctccccaaagccgaagaccccgggaagcacttcgtcgccatgaagaccgagctcgccgccgcgttttgatctccagcgaggccctgctgctccttcctgttagtgatatgccctagaggcaatcatagagatgattgtatcacatactttgtttacatatttatccgacattgttccttgaaatagataactccttattggttaatgaatatgtgattctttcatgagactctttatgttgtttgttactatttctaaaggatccctaatcaaatatcatatgtggaacaaatatgtttatatgatcagcacatgttttaattgatgatcatgtctcatggatcatggtatagagataccaaattaataatgtggacacatgttggtgaacatgttattggatagacccaacatgagacactgcaagagccatatgtgttgtgtcatcagtgatctcatttagtgttggtgttgaatccttagacctgagattatcatggttctcaacatgtgtagtagcttacttaagaactgctaaatgctactccgtaaatgggtagctataaaagtagttttcgggtatgctatgaaatatgtagtgggatatgtataatcaagatgggatttgcccctcctatggagagatatctctaggcccctcgatgttgtagattatggaagtgcatagccatgccaaaggtgattgaggggtcaatcacaagttatataatctatcaacaggttcgagtgaatgattagctattagaggatgccacatatctagccttgagcttaatcgatatcgtgaggcaaaggggtttatacaagtatacactagaggttcaaccgatatgatctttatgtatgcccggtgggtcaatacgttctgctaggggccgctgttgacgcgtggaccgaaaaggagttttcagattacagccgagtatatatgaacatacagggtcgcatgcttaatgggccggaataaggggatttgatagggatccaatataagcttaattcggatagggatccgaataggagtcctatgggccttggaggcccgagtgatggatcctatatattcgtgaggggtgtgaccggcggaggtattgcaatacgtgagaaaccctagccatcacttccctccccgagcaaaaccctagccacgcgcgggtgcaagcacatctgcgcgtggcgttccgtccctgtacgtgtggataccggtagagacgccgctggtttgcggtgctgatcggcgtgggaatacggcgaggagaaagcacgaggaggagaaggtcgagccggtgcgatcgactacttcctctacatcgacgcgcgctacttcgcgagagttccttcgacttctcagcgtcttcttccgctgtgcagcgcgtcgagtggtaacgatctatgatctaatacttgcatggttcctggtttacgcgatagaaaattttgatttatgctatcgtagcctacgcgtatcccaacacttccatcatcaccaagcttcaccgccgcctcctttgggttcggtgttcgcctccgctttgctgacctctaggcgaagagcctaaatcttcggctcgatgagattgtagtaatcggttagagcggtagaatgtgcttgctcctttttgagctcagccttgaggcgctctatctcagccttcgcctcgctccccttctccaattcagcttggagccgcttattctcagccttcgcctccttgagggtattggcgaggccctccatctccaagctcttgcggcccagttcgtcgtccttggctcgaagacggttcttgaacccgtcaaggcaagcccgcatagtccgttcggttgaacaatgggccgcgagaatctagatcaaaagacaaagagagggcgaagaggacaagcgttaacataagccgtcgaagacggacaactgaaagtaaacaaaaaggagaacaacatacccgaaccgccaaacgcttgatggcagaatagccttcgtcgaactcgttcagctcggtgaataggctcgggctgccagccagagacacgagattacttaccccctcgacgaaggggataaggtccgcgccagtctcgaagtcagcaggggcgcagtggggggccaccaaagaatactctgaagcagacgtctcgacgaccgtcttcttccccttctcaatgacaagcggcgaaaaccacagtcctccgcacaggactgccaaagaccctagcaacgaccctgacaatccggtcagcaaaggccaaagcccagcggccacactccccccgagctccacctgcatcaaccatggcgctgagagcggtcgaaagacccaagctccgaccagtgggcgaagtaggggtctcgtccgaagactcgtcgtcgctaaaaatgcgagcgacatcaacgagccctttctttttgggggccttcttgatcgaaccccccttcgtcaccttggttgcggcgatcgcaaccagcgccttcaccccctccatatccatttggcggaggagggagaagttcgactccaccccggtcccaacgtgctcggggctcggagtcggagtgtagctgggcgtcttggcgcggttgccggcggcctcgtccgtggccttttcggccacaacctccgtttcccccacatcctccccttcctctttgtcgtcgtgatctatgacagtgtctttgtcatcagcatcagagtcggtggaggcaggggccctgcacttccggggggccaacttcacctgccccgcagccacttcctagatggcccctcatcgccatcggccttgaaggacttcgtccggggaggcagttcaccgacatatacccggttcgcccgaccggccgccagccgcgtaagcagctggctgaactcagtaatcgacacgtcgccgatcatcttccgggcttcagtgtcaacctgagcaagggtcaacactgcagaaagtcgaaaaatcgccacatcaagcgttgaacaaaaagagcgagtcacaagtacgtaagggaaatgcagaggctcactgttcgccccctcgggcatgacgagctttgacaagccgtgaacttcctcgtcttcattcaccacaacatgccacgattgggagagggggaaaatccgaagcatgcaaaattcctccaccagatcgcggcagctaagccgagagcagaccttgcgaagcagggtgaaccgagcctccatggtgccatcgatggcgaccttgggcttcctgttcggcgaaattgccctgcgccgccaacggagggccttcgccgcgtcggaaccggcctcgaaggggatggagtggtagaaccacttcgccatctaatggcgatcccacttcgacatggcggcgttcaccggccatagatcggagcgctcggggcgaacattaaagttcacgctcccgaacgccgttttctttgtcccggctggggtgaccactgtcttcgagttcacggtgccatagaacacggcgccgaaaagctcggcgctcggttcgaacctggcggtccggcacgcccagtcgaagatggtgactcggacaagtgccgatgggctcagctggggaagctccacctggaaaagacgaaggatctccggcaacaaaacgttgcatggaaactgaagccccacctcaaaaaacacggcaaataccatcgtccggttgtcgccgtgtttcggcaccacggcctttcccggagcgaaggccttcccctccaccagcaggctggcgctgacaagctttgccagctcgtcgtcgtccacaagcgaagcccctagaaaggcggtggtgtcgtcgtcgattcggcctggattagggcttgtcgcggaagctgggttcggcttgcgaggagccatggtgaaaggtgtgcgcggtggcgaaaagggagaacaagcgaaagatctaggaaatcaaagggcgtcgtgaaaggaaagaatggagaaagagagagcgctcgcggtgaaaatgacgagagtgcggcggtgaaaaaggggaagggggaatatatagcccacccaggcgacggttcgtctccccacccaatcgtaagagggaaagcccatcactgttcattttggcctagagaaaattaaaaacggtttcgccgttcgcaagacgcgaaacctagaaaacgttactaaccataaaagtacacgtacacataatgcacactttctctgcaggactccagaataggtttcggcaggagcgtcggtccaaagggggcgccccataccataccacatggtttgcacggtctcagccgaagctcctatctcactcttgcccgtgaggggcttgttggcggtatgtcatgagacccttcgaccggacctgccgaaaccatgcaaccaggggtgggttcaagcccaagacgtcgagtctgttgaggtgaagcccccatggcgaagactatgaagcaaagatggcgaagggtgaagaatcgcaccggtatcccacaaggttgaaggcatgttgggcgaagactatatggcgaagagtgtatggcgaaggcggatgactttgccgtagcaagtccaacttcaaggaggcccaagaggccatctcagccgatcaagcccggaggccactgggccagcgttcgccagtcggcccattaggggcccatataccttaattacactatatacccatgtaaatgtccctttcataagggcaaccatgtaaattcccctgttaaacctaaaccccaataggggaactagtaatagggttataaataggctcctagggccatgtaacggggatccagaaaaaataaaagaaagataatacacttcaccgtttccagtgactattgagtatccacgtccttcgacgtacgcagttgtcacttcgacaaccatacttaatattctctaaaacatcatttacaattatatcggaaattgcttcttgctgctactacacgaacaacagagattaggaattgtgaatttatgattagtgaagatggagtgctggtctctcgagttgagaagtattgacgctttttttttcaacaaaagattacctaacggcttacggtataattaatagagtcgttaaaattaagatcaaaaccggttaatgaaagcaatcaattcactttcatggaatcaaaaactaatttacatttgtaaagaatatttttagataaaagaagataactatcgtacttacatgacgacgaaagattactttctgagcaaaaaagcaaagaaatagaaggtataaatagaacaaagtaaacagcagataattcaattgttggatgttgggtgccttcccaatcgaccatatcttaactaatataaagattcataaatttccgttcgtcacacttattttcgtccatcaatcgtgcgattccctcttccccctctcgcgcgtgtgtgcgttgcccgtctccaatagttagcgcggaaaaataacatgggttgcatcgtaatacagtaggaaaaatagggtttggatagggctttattctcagctagatatgaagcagatttgatttgatttttgggaaaacggaaagaggagaatataaggattgaaacccctcaactaatttcatattatcttaaaggatgcggccgagttttatgaaggcggtgacatcgggaggcgtcgggaagatgaggaacttgacggaggtaggggatgacactgtagtgatgggcccacacgacagtgagatagggagggtaattagtttttcgttgcttgctgggtcggacgcgtgtccgcgggccgaggaggaggggagaataaggaatgaaagcgggccggctcggctgtggactgagggtggccatgggctgaaaatggcccaggtgtaatgaggattttatttagattactatttaaataaatgctgaaatgatatttgtattattaaaaatagcaattaagctctgaaaattccaagaaaattccagaaagtgtaattaactatagagaatttaattaaaattaaatctagccatatcaattttatttcctacactaactttacttttcaattaatttaaacacctacctacttaaaaaatacttaaaaaatacaagtattccagaaatttgtattttagttaattaagtaaatctttcttaactcctcctcaattttctcatcttttcttcccgttgcaacgcgcgggcactttttcttgaaaaaaatcaaagatgatacaaaatcctaatcgtgaacggagtacaaatcacaacataaaaaccgaacgataatcccaaaaaaaagaaaaaaaaagcggcgtcacctatcatttgagacttttcctatcaagcaaaagtaccaaacagtgtgaaaataactttggctaaaaataaatatttttagttttaatacactgtagcgaagcacgggtattttgctagtatacctatagatacatatacgctatgccctggtcttttgacgtacatattctacatgatacgtttgcaatatctcagtctattaaaagacgatctgataaaaaaaacctcctcaagtttctcattttgaaaacgaagctttaacgcaacaatttaatgagaaagagattaaggaggctattttccaaatggaacataataaagcaccgggtcctgatggatttcctgctgagttctatcaagttttttggaatgttattaaacatgatttaatggatctctttaatgattttcataacggtactttacctctattctcttttaactttggtacaattattctactacccaagtgtgttgaggccatgaaaattcagctatataggcctatatgtctacttaatgttagtttcaagatttttaccaaagttgctacgaatagaattatgagtgttgcctagaaggtcattagtcctactcaaactgcttttataccggggaggaacattatgtaaggtgtggttattttgcatgagactatacatgaattacatcgcaagaataaaagcggtgtaatctttaagattgattttgaaaaagcttatgacaaattcaaatggtcatttgttcaaaagacgctaagaatgaaaggtttctcccctaaatggtgtcagtggatagcttcctttattcaagggggtcatgttggtattaaagttaatgatcaaattagtaataattttcaaacccataaaggtcttaggcaaggggatcctttatctccaattctttttaatatagtggctgatacgcttgctttacttattaagagggctaaagatgttggttctataaatggtgtaatttcttatttggtagatgatggtttatctatattgcagtatgcagatgatactatcatttttctagagcatgatttacagcaagcaaagaatctaaaattgattttatccgtatttgaaaagctctctggtcttaaaattaattttcacaaaagtgaattattttgcttcggtcaaacgaaggatcattacgatcaatattctaatatctttggttgtaagttaggctctcttcctgtcgaatatcttggtattccaatgcattttagaaagctgggtaacaaagactggaaggttattgaacaaagaattgaaaaaaaacttagtagttggaaaggtaagtatatgtctgtgggtggtagattggtgttgattaattctgtactttcaagtttagctatgtttatgatttccttttttgagataccgaaaggggtacttcaaaaaattgattattatagatctcgttttttttcaaggagatgatcataagaaaaagtacaaacttactagatgggatatcatttgccagcccaaagatcagggtggtttaggggttcataatttggaaatacaaaataaatgccttttgagcaaatggttgtttaagttaattaatgaacaaggggtttggcaagacttattgaggaggaaatatcttcataataagtctattactgaagttgataagaagcaaggtgactctcatttttggtcagttttagtcaggtctcatgaaagtttaggatactttcttaaacatgggttcctggattgtgaatagtggggaacaactagattttgggaagataaatggttagataacttagcctttaaagataagtatccctctttatatgccattgtccgaaggaaaggttcttcaattgctagtgttatgagatctgttccacttaatgtttcttttaggagagctttagttggtcagaatcttatttttttgtatgagttgtgtgcctctattgtacatatccagttgaatcattcttctgattgttttagatggaactttaatcagaatggaaggttctcggttaggtcaatgtatcttgctttaattaataatggctatattgagagaaataaaatgatttggaaacttaaaatgccgcttaagattaagatcttcatgtggtacttacttaaaggggttgtgttaaccaaagacaatttagcaagacgaaattggaaaggtagtttaagatgttgttttttaatgaaaaatgagaatattcaatatcttttcatgaattgccattatacaaactttatatggagagcaatacaatattcttttggtctatgccctcctagtagtatatcacatattttttatggttggcttttgggggtggacaagaaaaggagtaagcttatacttgtgggagcctctgcaatatgttgggctctgtggttaagcaggaatgatttggtttttgacaaatcaccatctattacatatatgcaggtaattttcagggcaacatattggctccggtgttgggctcagctacaaaggtgtgatgaagatggcgagtttatgaaggttgcatgccgtaggctgaaacgacagtttatgcacctttttgcccattatggttggagattcacaagtagacttcaataacgtgttctccttatcttagatgggttattttttattttaagtgcgtgttctcaatgttttgttggactacactcttttttaagtgtaacttgtaataattgtttgtagctcgttttgagcaaaggccgggatattctattccattgtcaaaaaaaaaaaatctgcttcgacgacgttcgcatatcacacagcctaaatttgtcctcttgcgccagcccgcaattaacactactacaaaaatcgtttttctgtacgagggggtcggtaggttccatgcgggccgcttgtggcggcgcctgcaaaaaccgcccccccgggggcgggttgattagccgcatgcgaaaatagacccattatcgcatgcggctgtcctaagcagccgcatgcgataatggatcttcgcatgcggctggcttaagggaccgcatgcgatgatcggccatatatgctcctccaggcccgagcttgaccatttgaaaacgaagctttctctctcgtaaagcaagcaccaattagggggggaggttttcaactcgaaatttttacttgaactctatacgaaaggtgaagaactctctatcctgcttcatttggctccatttttgttatatttcgttggtggaaagtggagtttttttaatattttgacaaggtttgttctaactattttttgcaaaatctagcttcaaaatatatgttttgatgggcaaattttgcatgtaaacaattgtacatactagttacatgtattgttgtatttttttgggagacaaatgcatttaaacttttgtatgaaatacctgcggtctatttttttatctgtaaattttttgcctttatataattagatggatcggtcgtcatggatgtatgagatgcggagaacgcagccgatatttattaaggaagcatctaaatttattgatcaggctaaggagcatgctttgagggagaatatgacaaagatcttttgtccgtgccgtcattgcaagaatcagaaattgttggtagatcctggtgaaatattgggtcacataatggagtacggattcaccgccaactacaaggtttggacctatcacggggaattcgccaatccggaagatgacgatgaagagttaagtttcgagatgaatgaggcagagaattttataatcgaagacatttcgcgtgaaagaatggttgtcgatgtttccaccgatagtgatgatttcgatggtggttttgatttagaggatatgctacgccatgttgaaccagaggtgctagcgggtaggtcacgaggattggagaattggcaggcattagagaaggcatcgaaggatcttctttacgatgaaacgaagggatgtgataaggatttcacagtcttgcgttcagtgcttgaacttctgagattgaaggctaaacatggatggtcggacacaagttttaatgatctgatgagtttgttccgtgtgttgcttcctaagcctaactttgtatcatcgaacacgtatcaagcgaagaaactcatatgtcctttatctcttggtgtagaaaagattcatgcttgtaagaatcactgcatattataccgtaaagaatatgcggaattggaatgttgcccaacgtgtggcacaagtcggtataaaacggggaatgggcccgtagattcagagtgtaccgatccagattctgataagggtaagcgcgggaagattccttcaatggtgatgtggtacctaccaattaaggaccgcctgaagcatctgtactcaaacccgactgatgctgagttgatgagatggcatcaagagagccgaaaaatagatggtatgattcgacatcccgccgacgctcgccagtggaagacatttgatgcaaaacacctagaatttgctaaggatcctaggaatgtaaggtttgcattgagcactgatggaatgaacccgtttggtgacttaagcagctcgcacagcacatggccagtccttctcacaatgtataatcttccaacatggatatgtcagaaacgaaagtacattctactcactatcctcatacaaggtccaaaccaacctggaatcgacatagatgttttccttgagcctttgatggaggacatggaggagctttggaaagaggggttacgactatgggatgagtttaagcgggagacttcaatctacgtgcgatcatatttgttaccatcaatgacctacctgcaaacttttcattatctgggcagattaaagggaagactggatgtctaatatgtctggagaaaacttcatacaaatacctgacgtcgtctttgaagacagtgtacatgcgacatcgacggttcctaccacaaagacataggtaccgtaagatggctagattgttcgataatacagtggagaatgacactgccccagtagcaagaggtggtacatacgtgtatgagataacaaagaagattaaggttgtatatggaaagggaaagaagaagacagtaaagaggaagaaagctgatggtgacaacggtactgcgtcgcctttcaagaagcattcaattttctttaaatacttagattactggaaggacctagagattcgacatgcaattgatgttatgcacctcgagaagaacgtgtttgatagcaccgttggcacattgctggacatcccgagtaaaacgaagaatggattgaagtcacgtaacgaccttgtagatttgtccatacggcatgaccttcacccagtagtgctgccaaatgggaagaccgagattcctcctgcttgttacttgttgacacttgaagagaaaaaagccttctgtcaatgtttacaaagggctagagtgcctattggtttggcatcgaacatcaggaagctagggtccaagaaggttttgtcccattccggatacaacacgcaagactgtcataggttggcaacggtgttcctatcaaatgctataagggcagtcaaaccagtccatgccaaagtggatatgacaaagttgtggtactttttcaatcgaatttcacaggagggatttgatcctttggaattatgttcgcttcagacatttgccgtcgagactgtatgccagcttgagatgtatttcccaccatcatttttagatatgatggagcatttgatcgttcacatcgtccctcagattattgaacttggtccattatacttacatcagatgtgggcctataagcgttacatgtcgatcctcaaaggctatgtacgcaatcgcgctcacccggaaggatcaatgatagagggatacacaactgaagaggcagtcgagtgttgtatggactacataaaggatgctaatgccattggcattcctgttcatcgacatgaaggtagattgtctggaaggggtactgttggtaggaagcagttcttcgataatgattacaaaaaggtgtccgcggcacacaacagcgttcttcaacagctcgctatcgttgagccattcattgagcgacacctagaagaaatcaaagcctgcttcccagggcggtccaatgattggatatcaagagagcacaagcgtcgctttcctctgtggttgaaagatctaaacctgccagttggtgattctgtggaggaacttactttacaaagactggcatgtgggccttcaagtattgtcaattcatggcaaggttacgacatcaatggatttaccttgagtacgactacgaaggacatgaaaagcaccgcacaaaatagtgggatccgtgtcgaagcgattgacacgagtggagaaaagaggtcgtattatgggaccattcaagaaatatgggaactggactatggcctaaacatccagatccctgtgctccgttgtgaatgggttaaagacacaataggggtttccgttgatgactacgggctaacgatagtcgatcacagtaaaacaggccacaaggatgatccatgggttttagcagagcgtatggctcaagtgttttatgtgaaggacccttcagatgaaagaaaaactattgtcatatccggaaagcaacagatcgtcggcatcgacaacatcgaagaccccaatgattacaaccagttcgacgatgtaccattgtttactgatcttcctatgcgaattaagaaggttgagagaacaatcgatgaagcaaatatgtcgtacgttcgagcagatggtgttgccaaggttattaagtcatagttattttgtaacctttagttctcattgtattccaaatgtacgtgcatgaatttaggtcccccttatgttgtaatcattagcatgtaacatttgattacgagttttgagcaattttcatgagttttcttagtgccaaaaacatttggaatgtataattgtggcgaaatattgggaaaaaaatatatatggacagtttacttagagaaaaaaaaatatgagtttttttggtaaaaagatctttctatgcggctggctcgcatgccggcttaatagcccgcatggaaagatctttttcgcatgcggccggcttaacagcccgcatggaaagatctttttcgcatgcggccggcttaacagcccgcatggaaagatctttttcgcatgcggccggcttatgtcgaccgcatggaaagatatttttccatgcggtcccttaagccgcccgcatacgatgatctgcgcctatatatagggagcgcggggagccaaaattttctaagtcccggctcccgcgaaaccctagccgccaggctgccaaaatttcccaagtcgtcgtcgccgtcgtccccgccaccgccggctcctccccaaagtcgccccgccccacgccgt

SEQ ID NO: 31412 - DNA, 1971 bp, Oryza sativa
tttaattttaaaaaaaaaaattgtaaaatgtgcaattgtggattgtggattgtttaattgtgcatcgtggattgtgatatgtgcaattgtggattgtttaattttgagaaaggtttaattgtggattgttaaatggagatttatgtttaaattgggacttatgtttaaattgggacttatgttaaattgggatttatgtataattgggacttttgttaaattgagatttatgtataattgggacttttgttaaattggcacctatgttaaattgtgacttatgtttaagttgagatttatgttatattgggatttatgtataattgtgatttttgttaaactgagatctatgtataattgggacttttgttaaattggcactatgtcaaatggagatttctgtttaattgtcactgatgctaaattgggacctatgttaaattgggacttatgtgaaattaagttattgggacttatgtgaaaataagttaaattgtgacctatgttaatttgagatttatgtataattgggacttatgttaaattgagatttatgtataattgggacttatgttaaattgagatttatgtataattgggacttatgttaaattgggacttatgtcaaattgagacttatgtgaaattgcgttaaattgggacttacgtaaaattgggacttatgtcaaatttttttacgtcaagttggaagatgtcgaacgaaaaggttccatcgaacgcaccaatagcgcctcaagaaggtaacgctcctcaaaattccggtagcaataagcagccagacgcttctagtgaagaaacgtggcgcacaccaagtgacccgtttccaatggaaataacacaagtcgccccccgcgatgatgatccggactacatacctatcgaacaggccgtaagtgctgaaaatcgttagccatgtattattccctaactatgatgtgacatgaacctaatggtgtatagagttacctattctgtgcagatggtagtccgacgccgctcgaaacgtaaagccgggaggaacaggacagagcaagaagttgagatggacaccgctacgtctgcacctgaacgtacggagacatctacaagtgcaggcgggagtgggaaaaaaagacgtggtgagagaagcaaaaataaattacccaaggaaacttacaacgtgattgctctcgatcaggatggaaagcccgtcgagccaccgatagtgcggtccaagttcagcaacgcctgtggcactctagtcaggacgcgttgtcccattaatgtcaagttgtgggaaacagtggacgacaacatcaagacacttctctggaatgagttgcagaagtattttgtgttccctcctggatcagaggtcagggggagagattacgcacttaaaaagatgggagatcgatggcgacagtggaagtccgatctaaatcgggattatgttcagaagaatctcccaccgtttacggattatggacatatatcgcaggctgactgggacacgtttgttgcggatcgtacaacaactgaagcaatggctttgaggaaaaaaatgtccgagctcgcgaagaagaacagatatccccatagattggggtcgagcggatacgctggtcacgtcgatcaatggcgggagatcgagcaaagatttgccgcggccggtaagcccctgctggtagaccccatggttgaacgtagcaagaactgggtttgggcgcgcagcacaggtcaagtctcggatgagggagacatactatttgtcacgtcctgataaattcatcccgaaataaaaatcattcgctaaaaggaataatagaattaattaaaattcgaaaagaaattggcaaacactaaaatacgtgcaagaaaaattcaaatgtggcccggagaatttttgttaaattctccttggtctaaaaggagccctcaaattttagtggaattttcagagcacaaata

SEQ ID NO: 31413 - DNA, 6385 bp, Oryza sativa
tccccggcgcgctctccccctcccgttgctatggattcgatccccgtgcttcgctcttccgtttccgccgctcgccgctcgctctcgccgtcggattcgtgctcgcgccgtgctcctctctctccgccgtcgccgccgagctccgttccgccgccgccgccgctccggacttcctccttactcggcgacacctccgtccgcttcgccgtgttgccgccgactccgtccgcgcctcctcctcgcccgaacatcgccggagcaccgtcgccctcgtcatcccgagccgcgccgccgtcttcttccgcttcggccgccgttcccgtcgtcgccgtcgaccggggtgagccgaagaccgttccgttcgcttcccccttccctcctctctctcgggtgccactccgccgcgccgttggtcgccggcggcgaccatcggggcgcgggtgcgcgtcctcctcccgtcggccgtgccggcgaggccgccttcggcgcgccctcgcggctgccaggtgggcccggccgtcagccgcccgcgcccgcgggtgcggctgacgcgcgggacccacggcgccgaccgccgccagccgcgtgctcccggtccaccgtggaccgagaggctgacgcgtgggccccactcccgtggacccggtccgcgcgccctctcccctcggctgacgcaataattcgattttaaattaaaatttaaatgaagaaattcgcaaatatccatttaaagagcatataaacttcaaatggccatatcttggccatttgaactcggaattggaccgttcaagtctctaatttttccttaagatgtaaagaacccatttttgtgctttgttcctgcttgttatttggagtttattagagtaaaagcctttttcttttccgttggtcgtgtagacgctgcagcttcggaagatccgctcttcgtggaagttgaagccggtgtttgggaaagcgagcaaggcaagtcacatcatccttgagcatattgaatcccagtttataaaattattttgatttaaattaatgcattaccgctttatttaaattcccgcgttatcactgttttatttagccatgcctatttacctttgttaagacattattattgctattgttattattaccttgttcaccctagaataaataaaaccctaactagtggacactctatttatggttccactagtatgaatttaggtagatgcttcgctgattaattaggcaacattaggtggttttataactttagactttgggaattctcatatcatttggacactatggaatggttggcttatgttggaattggacacacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctaatgggtaaggcttagtttgtggctcagtctagtcataaacaaaagtacacggattggagatggatgaagtcgggtgtcgatggacattctccaggacaaatgaaggctacacgagctgcggcccggtagtcgagatgtcatatggcagagggttggtgccctgctgctaggggctcagttctgcctgcctgtcccgggtatcccggccgtaggtgggattgggtcggtactcttgtttatggctaggatgggttgggaactatgtcacgtcttccgtccgtataccgtggtggtatgtggcacgtgtttgcacgtgaggaagatgtgtcctgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctgggacccaggtcgggttgccagttcggtccgaatcatcgtaggccttgggttaaggcaggttcgtgagggttcacggccttgtttaataatactgtgtagctctaggatcgtctttacaaaatggctttgggcaactaagtgtcttttaaatgctgtttactgcaaaacttaatccctatattattattcccttgtacctcccttgcattaattatgcatccgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaactatttgtgaaagttcctctttttctccttcccctaatgctatttgcaaaaggtttaccctcttcttccttcttcagatttcaactagtactagttggttagctttgtgaagaagaagatgtcgtcagttgtttgccgaagctccgaaagactgcaggatccgctagcgaagtggaggaagcagtgaagccagctgtgaagcaggagtgaagatcttggagaacctgtcgctgaacctaagccaccctatagggtagtgttgttagtcgtgtgttccttgcttgtgtgtgtagcgcgtggtttgcatcagtgggttgtgatgtaaccatgctaggttgtttgcttaatcaacttgcagaataagcaaaacaaacaacacatcaacaaaaagagttagttcctttaaggtcttgtccctagttctggtctattctttccttgtatgcttcccctctcaacctctaccttgtgacagatggataacactggtaacaaaggctacgggaatgatggatccgatgactcaagaacccaagccaatgggaatgagaaaagcatcaacgaaacctcaccagagctaatccaagttgtggttaaccaaaccaacatgttggcaacaacctttcaactattacagaattggaacaacccagcaggggcaaccaacgttcaagtgcctacagtccagcaacagtgcaaattatcagaatttctcaaaactgagcctccaacctttgccattgccgtcgatcctatggaagccagtgattggttgcgcacaatcgagaagaagctagggttgattcagtgcaccgaccaggagcgggttggcttcgcaactcatcagctggttggaccggcttcagagtggtgggatagctacgaagcatcacggccagaaggacataccatcacctggaacgagttttcatctgtattcaagagatcacatgttcccgcaggaatgatcacactaagaaaacgagagtttcgctacctgaagcaaggagatttgaccgtcacagagtacctacacgagttctatcgtttggctcactatgcaccagaagatgtggaaacggatgaagacaaacaagagaagtttcttcaggggttaaaagatgagcttgcagtgcaactacttctagaggattatgaagatttcgagaaacttgtggacaaagccatgcaactcgaaagtgagcataatcggatgacgaactgcaagagaaggattgtcaacatgccagtatttccaggtggtaaccaaagacagcgcactgagccacttcagatcaccggatcttctgttgcgcatcaagagtttccgccccaagaagatggacgcaatgcagacaacaacactagcaatactaatgatgatgataccaccaacaaccatggatcttgccccattagtggccactcgaataaagcgtgcaatgtcagtagcattcaccaagatgtcaacgatagtatcaatgttggaacccagaatgacaaccttagcaattttgactctgagaaagactccaatggtgatagcaactatggtaccactgatgccaatgttagcaaggatttccaaccaccaattccaacaccgggtcagaatgatcgttctcagacggacaactcagtaaaaagggcattgatttgttacaactgcaaagaaccaggtcatttctccagagattgtccacagccgaagcgtaacctgcgtcatcactccggccattatgcaagaagaagacaagtcactcgccttgtggtcactggagcaaacgccgtacctgtgaggcctcatgttaattctaacccatagtggaaacaatgtaccgatgttaagcaccttccctttttgcttaagacagtgccttgtattcatgtactatgggagagatttgtaataaaaacaagttctaagaggattcttttggaagatgcggatatgtgatcctgtgtataattgtttactgacaaaggagacctagggtctcgtgccagaggaactatattctaacctcgagttaataaccaacctgatgatggaaaagaaaatcaagcgattaaccaaagagacatttatttggactaagagtttcagatgtgtctttttcggatcaaaggcaaagacagtcagtatagcttttggtgaaacacttcaaggtttcactgaaaggcagcaagccaaaggacctcatcgtccccagaagcgtccgcaatccacattaaagaataccacctgttagagataagccgaaagatgattgataaaagagattggcaaagatgttctcaagcatgaaagaagtaggccgaaaggtgattgataaacagaaacatgctctgcatcgctcaaggaagacccctgatagtaattgcctcccccacaacagtcaccttgtcattaagtaagcaagatgacctaggtaaaagtgtttctatgaaggcaaggagtgaaatcttcaactcggtatcagatgctacacggagtgaaaagtgcaagccccggttaccaggcgacgccatgtcttgggagatgatccaatgggaaagaacacatcaaggctgaaggtgcacaggaatacgttgaatgctaactgaggacaacatgaagtgaatagtggtaagttagaagtaaatgacaagcatgatattctcatgataacaagcatggtaccctagtaatgacaagctgatatcgacgcatgacatgaagttgataacttgtccgaggttgactccgaagatatgaatcatgagaagttctggaacggaagcatcattgaactaccgcaacctagtctgagtcagccaaaaggtgcaccctggtccaagtcaggtgaagagaagattccatccgcaacaggaggtcaagccaagcagttccgagtggtaaagttttgctggaagttcgtcaagacgcaacggaagaagtcagacaagaagagaagaccgcccaacctatcttcttgctagcctcctcgaatctcggggacgagattcttgtaaggggggtggatttgtcacgtcctgataaattcatcccgaaataaaaatcattcgctaaaaggaataatagaattaattaaaattcgaaaagaaattggcaaacactaaaatacgtgcaagaaaaattcaaatgtggcccggagaatttttgttaaattctccttggtctaaaaggagccctcaaattttagtggaattttcagagcacaaataataattgaaaagaaatgaacaaagttaaaaaggtttataaaaagaaaaaccctaaaagaagtctccttttcccccccccctcccctcttgggccggctcggcccgttccctccctctctctctctcttcccccgcggcccatcggcctcccccgcgcgcgcgcgccgctgacaggcgggcccgcccgccgccctcgctgacgggtgggtcccacctgtcatctccctcctcgcgccgcacccgccgccgcccgtgccctagcgccgccgccgccgccgaatccgccgcatcccgccttccccgcgcgccataaagaggggcgaattactccccgcgtttccctctcccgattccccctcttttccctctctctctccctcggattcgtccggattcatcccgcaatcgtcgccggcgtcttcaatggcggccgagatctccgcgcgcgattcctctctccccggccgcgctctccccctcccgttgctatttattcgatccccgtgcttcgctcttccgtttccgccgctcgccgctcgcttcgccgtcggattcgtgctcgcgccg

SEQ ID NO: 31414 - DNA, 32755 bp, Oryza sativa
  unsure (1)..(32755): unsure at all n locations
tggatgaattttgtttttgtttttggatctgactcttctcagtccggcggcggtggtggtgtcggcggccgctgatttttttttttttttacaattttttctatggctattgctattgctaaccaaatcggattgtgtgtatggacgaaaattagatgtgacgaccggaaaaatatgaatatttatattagttatagatatatacatggtggaaaaaaagatcgcaacatcacatcagaatatggtctacagcggcgctggcctttatactgagtaaatagaagtaaaagcaaaagcaaatgtaacaatgaggtttggcttagctcagtggtaggtacttgaatggggtcgttacagtgaccatggttagaaccctctccttttatgtttttactaaacttttttttacttagtttttttaaatccattcttcttatttcttttttataaaaaagtgatatttcttttaaaagttgactctaaaattttttaatccattcttctactttttaaatttgtactaaatgtgatatttctttttaataaaaattaatttaaacaaaaaaaagtacattgaagatttgaagacaaaaaaacgaaaatggagattgatgatttaatatgcacgcacgtagattgatgatttttaaaaaaaggaaaatggctgacctgggattcaaaccctagtcctaacgtacaccaggaaagaaactaccggttgcaccactagcgacaccattaattcattgctgcacatcagtctatttagcgtgtacaaggtgtcagtgctaagtgcattggcgctgaggccctgccacgtcacgtctcgcccgccacgttggcgcgatgtcagcgccgatcccgttggcgctgataggaacaacatcagcgccaaagtggcgttgagccgacagcctattcctggatatagttttttatagggacaagtttcgaaataaagtttctaccaggatcaatntatcaaanaaaggaataaacttgccatcttcatgcatgcaaaccctgcatagaaagaaatactaatcttgccgctaattaattatacttgattaaggataatcaagtatgactgccagcttgatcttggcagccgatttcttccttattcctatacgtttaatgctaattaagctaattaactagtagtattagccaaatatagctgatcaaccccgtacttctataatttcgacctaaatcacaatgacatgctaaatttgattatcaccagcgaggttgttccttacggctggactcgacaatcggcatctacgagactacgaatcggcagcagggctgcagggcgggctatcgtaggcgtcgcgcgtgtgaaacgggccggctgggcgaagcggcccaggccgaggcgcggggagccgcagggtggcccagcagggagaaagcggcccaagcgatgagcgggagcaggccgtgtgggcgagcggcgtgggctggctgggcgaggtggcggcccacgcgcggggaggcgagtaggccacgaggccgagcgaggcgcgggcctagcgtggcttgggccatccgggaaggaggagccccgggagagagagaaaaagggaggagagaatttattctatatcatatagcagagtttaataatctgtcatcgatattatctttttctataatagctgacaactttattagttttttatgatacgttattgggttgggctttcttttaaaaaacaccccaaataccattacgaacatacaagattaataattgttttatctcattagaaatttcataaaaatatgaaaaattttatgtgatctcttacacaacctggaaaatttgtataaaagtttcaagtttttttacttttctatttttaaaaaagatataacttatatgttatatgctatataatatactattttattgttatttttaatgcaaatgatctttcctacactacataagatatttatttttatgctattatctcttgtttaagcaaatcctctcttatataccacataaaaatattttttctaaaaattaaatataccataaaaaacatgaatcttctatacaagctttcatgttgtgtaacgatctgatggacggctccgattgtccacgcgccggatgaagcgccgatgaggagagaggggcaaaaccctagctcccaaatgttctcccaatccctttctctccggcgacgagcaagcagaacgacagcgaaggtggcgacagcggttcggcgagctggtgcgcgcgtgcagtgacgaccgccgagcggatactgcttcgccggctgggggaggggggcacctaagggcgccgccaagccatgccacgtcatggtagtccggcgaggcaggcgcgcaaacggcgagcgccgagtggcccggacctcgtcagcggcgggagagaggaacgcgcacgcgcgcgcacgcacggtgaacccgacgcgactgcaagaaggtgaaggtgtggcggtgccgctccggtgagcataggggcttcaagtctggtaagtaatccaaacccttagcttaattgatttagattttgagtcttagggttcttacccgaaattagggttcttcgaatttggggaattttgtcggaaaattttaattgtggctttagaaatagaaataagaggctttgacttttacattttcatgtaatcggactcgggattgggcgcaactgcgcatgggagcgatcattgaatcggagtttccttcttttccttttttatgttttttatcacgaatcggactttcctttttttttctttttatatgtttttttgcacttttttctaattaaacggacaagggaaacatcttcaattttttatgtagtagagatttatgatctatttgtagaaaggccgttttattcggctacaatacgaaagagggagggccattggccaaatttacattgttcgccctccacggcaaatgccaaaagaaaactacaaaatctaaagagcgggcggagggcctcacacctctgggtgatcttgggcatctcctccaccctctccggccgctgcctcttcgccctggtttgccgcctctgccttcgccaattgttcaagcagacgcgccttggtagtggatcggccatccttttgccagaactgcttgcgccaggcacaaagcgcgagggaaacatcttgacagctgacctcccaatcccccttcgcaaagttagggaattcggcgacgtgttcgcacccgaactgctgcagcaagcccatggtgaaggccgccgacacacgcgcacagcaatcgccgtacgcggtggcgcaatccgagaccgccctgccggcctgctgagtccactccgagaagtcaaagatggaggcatcttctctagggactccttgtaccctctcccccatatcattgagggcaaggcgaagcgtacggcatgcggttttggtggactcggtggctttcaccatcccttgcgtgaaccgttccgcctctttttcagcgctcgcctctgccttgagggccttctggcgaagagcctccatcttcggctcagtaagattatagtactcagtcaaggtggcggattgatccttctccttttggagctcagccttgagtcattcgatctcggccttcgcctcgctccccttctccagctcggcttggagccgcttattttcagaattcgtttctttgagggtgttaacgaggccctcgatctccaagctcttgcggcccagttcgtcatccttggctcgaagacagttcttgaatccgtcaaggcgagcccgcatggttcgctctgtcgaacaatgagccgcaagaatctagttcaaaaaatagaggggacgaagagggcgaacatcagatataagattatcaaaaaaaacgacgagggaaaggaaagaaaaacaaacgacaagactcaatcatgaaaaaaatatgcaataatttagtggctgatgtcataatttcgttttgagtttgaaaaaaatatggaagcaggttgaaaactttctgttcctagcatttttcatcctaatctctacagaaacttcagcaacctagagcaaaacagtaataagtataaaatatgtgataagagaagatttgctatatgttttcttatgaaaataatataacacagacaagtctttagcaaacaatagcagattttctctaaatgcacttgtgtttcgcccccccccccccttttttatctgttcgacgcctgatgttttgacacgttttgttttcgcagtgctgactcttgctcaggccgacaccgaagcccgtaggatgatcggcgatgtgtcggtcactgagtacagccaactgctcacgcggcaggtggccggttgggcgaatcgggtgtatgatggtgatcttccaccccgggcaaaacccttcaaggccgatggcgacgaggggacgtccaggaagcatatgcgcgggcaagtgaagctggcccccgcctcctccgactttgatgccgatgaggaagataatgtcgaagaccatgacggcgaagaggaaggggaggacgaaggggaggcggaagttgcggccgaaaaggctgtggacgaggaacaagctttatctaaatcacgagcgatcctaaccgttcaatcgaattcgatgactcttagcacacctgtaccgacttgggccgtggcctgccacatgggcccaacgcacttaacaggccagccacaacgtccttctaattatgggcctaattgtgtattatttattttggatttaatttatttagatctgtgttttagtcggtttttaatttggttttataaaaattcgaggtgtttttgtcaggcctttgacacatcgccttgtccgattccaatttcctgttccacgcgtttcccgtcctgtttgttcgcacgtgccacgtttagcgtgactttcctttaatttcagcccgaccgatgatcccgtttggaatgttgcacctggcctcgcgtgtctcgccacccgtgcgctcgcttttgttcagtacatcgtcatgtactcgcaagccacgcgcccacgtgtgcaaaccacatgtggaacgatcacatcagttcatccaattaaaacagcagcgatctgtttcgattggttaattagctaattacaccagcactttctgttgattcgtgtggagattatggataccccatacctacacggcgtggttatccgactggttataggggataacttatatctatgaaaaatgtaacggatcatgacttgggtattatgtttccctgtatattatgtaacggcctaaagtcctggtttgataagatcgtaaagtagatttaggaaacagataccgtattggttaaggtttctatcttgtaatcctgccccccattctatataaggtgggcaggaggccctctagggnnnnnnnnnnnnnnnnnnnncgtcagatcaatacacacccgacggaatcaaatccccaaacaggagtagggtattacctctcattgagagggcctgaacctgtctaaatcctttgactccgcatctatccacttttttaggtctcgtgtgctatcccttttattattgccgaattcatgtttagacagttggcgcgtcaggtaggggtgcgtcaagatttccgtcaataagggcgatggaaacaatttcaggaatcgccgacatctttttcggtcgaggataatctcaattagaactacgattctaatccctggtttgtcatttcaatattttatattagattgatttctaatcatatattgatttactctccgatattttgttcgaatacgtgtactggaggtcgatgagatctgccgaccacctgtgcacgactcatcgtgctgggagactatcaagcaagccatcggatacgtataggagacgtaatgtggaagccacacgtgaaatactccaattgccacagactcctgatggtgtcacaacatataaagaagcagaaagcagatggcatacatacatacatacatacatgcattgattaatacccataatcatctgcactttttatttgtttctactaccaatctcagtttgatctgtggtttattattttgcatgcacctcgttgcccgagtctaattcgatccggactcggacccgcgacctgtatgcacgcatggcagaagattggtataataatctgattgtatggatgcatataatgttcatgctacaggagatcaatcggccaaccaaataacatatgtgtgctgcatatatgcaaatatacatccacaggattaattttcttgatactaactagagactatttttgtctctttacatgtattgttagagccaccgccaaatttgccatggtctctatagaacacgtcggacgatgccgctgctgattggtgtctccgcctgcacggctggcctattatgccgctgttgttgggcgtctacgacttcaccgaccggtttgccttggccaccgaccagtgtctccgcctccacggctggccaattatgccgccgttgttgggcgtctacgacttcatcgccggtctgcctccgtcgtcgccgactggtgtctccgcctccacggctggcctattatgccgccgttgttgggcgtgtatgtcttcaccgaccggctggcctttgccgccgctgattggtgtttccgcctgcacagctggcctactatgccgccattgttgggcgtctacgtcctcaccaccattcatggacgtccacgtcttcaccgaccggcttggctttgccgccggcgactggtgtctctgcctacacagctggcctattatgccgctgttgttgggcgtctacgacttcaccgccggcctgcctctgtcgccgccgactggtgtcctcgcctatatggttggttggccacaccaccgttcatgggcgtccacgtcttcaccgaccggcttgcctttgctgccactgactggtgtccctgtctacacggctggcctattatgccgccgttggtgggcatcttcgctttcaccgtcaaccgctttcttcgccgccgactggtgtcttcattgttattgatggacgacctcgtttccacatcggccacctctgccgtcatcaaggggaatattgcaaagctaagtcatcatttattctttatatgatattttgctcttcctctgcctcactacatcaactggttcgccgttgactagtgagtcgggggctacatatgttatatcatattttttaaacaattttcataatattttttttgattgcttgcgatataatctgagtacaaaagtgcctatcgagttatggagttctatcttcctatgctttccgtttggtttgtcatggatagttgcatttgggccgattcctagcacccgggggctcgttggatagaccgagtaacgcaaggtgctaagtattactcggaagaaatcaaaagcatagagataaagataatttattttcttctcttaacaattgcaaaagtacccgagtattaaattctaattcgtgaagctttattccattaatgacgaactcatgtcactcatatgcatgtttgggaagtgcctaggccgacttccggtgcttgggggctatgactagtcggacagagtgtttaaacgtaatgagtcatcagctcggggaaatcaaaattgacaagaggagaaatatatatttataaacattttaaaatacttgaattatatcttcgagtattatatttacatcagatactactcattccatatgtttgttctgcaggatccagatccagatatgcataaaagggattcatggctttaagcttatctcttacgctctaggaatggatcagttagaacatcaccaccggcttgccttcgccgccgccgactggtgtctccgcctgcacggctggcatattatgccgccgttgttgggcgccgttggtcggcgtctacgtcttcaccgccggcttgccttcaccgccgccgactggtgtctccgcctgcacggctggccaattatgccgccgttgttgggcgtctacatcttcaccgaccggccgcctcgtatgacgccaactggtgttatcgtcttcacggctggccacgtcgctgccaccgctagtaggcgtcatcatcttcaacgcaagctgtctgcgtctgctgccgactggtttcttcactcccatggctgcatgattctgatactgttgattggccttatcgtcttcaccgtcggttgtctggtttgctgctgactactgctctcgcttctacggctggtttataccgctaccattactgatggacgtcatcgtcttcattgttgggcgtcttatctaacgccgactggtttgttcgcctccatggctacgcgtcttcatcatcattgactgtcgtcattgtcatcgccggtttgccttcgctgccgcccatggtgtcttcactttcacggctggcctattttgctgctgttcaaagacgtcttcgttttcgtcatcattctacttcttccatcgccgactggttatgccgccgccgactggtgtttttatcttcacaactacgcgtcttcgctaccggtttgcttctgttgccgccgactcgtgttcacttcatcacggctatgcaactttgtcaccatgatggagcggcttcatctttattatcttcggcaccggtaaactctattgcctctacttcgcaagctttgctacttcaccgaccatgacgtctacaagaacctcgacatctcggcatgcgttaacaaatataatgccgtgttattctactacaacaagtggttctctaattatcaagatttctactcagacatcttcgacacatatcttcactcaagtgatggctactcgatgacaagaagctacagttctcgactctatgttcagttgctttccaactaaccaaagagtcgggggctacacaaatacaagactctcaaaattcgataagctgaagaaatcaattaatcagccaacgagtcaactctaggagtcattatcttcatatttgcttcggagcagacattctacttcagcaactccaattatttcaccggcaattttggtttctggacgctgccataattaaagtatcaaattcaagatttaatctacatgttcgggagtttggagttatcaaccaatcagctcagtttagatgagttggacaacagcatctactttcctccaagtgaagcatctacacagctataacactaagttctgtagtcatcttcgtaaatcaagaagcgttgcatcagtcttcgttatgcacatgctcacatcaaggaaattactcgagctttgatatcttctcaacagtttgatggattattgtcactgacatcatcaacagcacctctatttcattggccctgacaactctgccgttgctaatgggtgactacgtcttcgcttctggctacttccgtcattgccgacttgttattttgccttcatggttgacctactatgcaaacgctgatgagcatcttcgtcattatcatcggctgttacaccgctattgactggatcaccgacatcgtcatcttcatcaatatcctgtcaagcctcttcaacatagcccactctactgctattgatggacaacttcgtcatcatatttgatcatctctgttgctgcttatcatcattactgttggttgcatttgtcgtcggcgactattttcttcatcttcatgattggtggatttcgtcatcgcctttgatgcgtgtctacatcttcaccgtcggcttactttcgtcaccaccgactggtatcctcgtcttcacggatggcttattatgtcgccactagtgggcatcctcatcttcttcaccagctgcctcgtctgtcaacgactgattatttcgctgccatggttacacaactttatcgctgggcgccttcatcttcattgctggctgacctgactgctgccgactggtttcttcgcctctacggctgtgcaacttcatcacttttgattggtatcactatcttcactaccaccaatatttttgccacctctggtgggcaatattatctttatattggtcgtcttgtctctatgccaactacatcagctaccatcaatggacaattgtgactactacagaaggacaagctatatgctcaagggcttactagctcaaacacaagtagcataccttcaatttggacttgttctggatacatgcaacatgaatttatgatcatgggtctattttctatgctcaaagactggactatttattatcccccataagggttatcaaccgaatacttccgccagttgggattcaattattatatctatttgggagtatcccataagggataatcactcagatcagaagctattcatatgagctacacttggtctatatcacccagaagatttattactcgggagcatgttacatgcgtcatcctttaaagggtgttgaaggcatttttttttggcctaggcctaatatgtctgcagcctatattttcagggccaaagtgcgcgtgatcaagtgccaaataccttaaaatccttttataccgcagttactcaactttttaggagttggtacaatgcatcttaaaatgtgtcaaacagtaaagctttatatagctgccccgctgacttttttatatagtcatggcactgtttgggtttatcaagcaattgattagatacaatatcattattttttgccatgtaagtgtgcatttttattgaccaatattatggctaaggctgattatatattttggtcattttccagacgggagtttatttactcgaatgttacaccacatatgccatatatttccagttacggtgaaaccatgtgtcttttagggacttaagcacatatgttaaagcagtgtgcgcatggtgtatgcccaatactttggaaatttctttattcacaacatcaagctcttctttatagctattttgctatgtgaattttcaacgatgttgtcaactttagattgcacgcatcatattctgcaaagcagtcggtatatcacttggatcatattatttagggattcacaccgcatatgctatgtattaatattaagtcacttggttgactacaattatcaaaaccactcagttggttggattatttactccttgactatatgtttagtttgttcaactatccacatagtcgggggctacacctattaggtgcatctagtcgatgcacctaagtttacatttaattatttttcagccctccacagtcttcagatttggtaaaagtactcggcagaccatggcaaagatgattgaagcactcggctttggagtaatctggtttgagagaagattatcttttcgactatgaaggtctcaggggatactgtggagattatgggtaccccatacccacacggcgtggttatccgactggttataggggataacttatatctatgaaatatgtaacggatcatgacttgggtattatgtttccctgtatattatggaacggcctaaagtcctggtttgataagattgtaaagtagatttaggaaacagataccatattggttaaggtttctatcttgtaatcctgccccccatcctatataaggtgggcaggaggccctctagggggcatatgatacaacctgatcgtcagatcaatacacacccggcggattcaaatccccaaacaggagtagggtattacctctcattgagagggtctgaacctgtctaaatcgtttatctccgcatcatccacttttaggtctcgtgcgctaccccttttattattgccgaattcatgtttcgacaattcgcttaaatattttcgttcctattttcatggcaaacagacgagacaagcagataacgtatttacgtttcctactatgcttatgtttccatctaatcttgggcagctactgggatatctatttgagttgtttgagtccgtatgatctaatgttgcagtgaacgaaacattcttttacaacaaatcacccacctattttggaaaccctctattaaggaaattcgtttcattttttgtttctctatgtatggttcaaatattgcagtaaactgaaacatcttttcactatttgctgaaacattgtttttatataaggtaaaacaacatctgatttaaacgattaaaacattttttatctacttagtgaaataattccgatatacctgtgtcgacgtgtgtcgacgtttgatgtcgcgattccggtattttcatagtatggggatcgttggtactcggatatatgcaagattgaggtaaaagagacggagacgaggatttttatacaggttcggacccctgaattgtcaggtaataaccctacccttgttggccgaagctggtcgttgctcttattcaccataatcacaccagtacaatatttggggtagcctatctaactgttgtcgacttggcggtctgaagtgctgactcgtagtcgacaacagggtagccttcctcctcgaatccgcattcagcaagatcaaagacagcgctacatctctcatatcagtatcatagacaccgtaggggactagccatgcttatctctgaagtcgatatccgacgtcttgtcttggcgcatgttggcttgtatgttgatcttgtgtcttgatctattgttccgtctcccctctcctcctaggaggccttgtatttataccaataggtgtccccttgtctaagtagaagtagggaaaaccaatatggatacaatccgagtagtccttgttgtttccatgtaggactctattcatccttccttatatgaaactcctcctatatctgaaggttgtttccgtataggacatggtatgtggtgggtcctgccgaaatttagtcgactactattaggtatgtggtatccataaccctgacaacctggtggaacatcgtgcaacatttaaaaataattcaataataagctaaaaaaatttcgttgtaatatatccatgtgtggtcttgttttaaagatttaattgcaacgaatttaatggtgcaatcggatcatgatttggataaataatttaaaagaaaaaataatttaaagtgtttttcacgcatacgtggcgctgcagcgccccgattttacccctccctatcggccgcccgacggggagtcgcctccgatattttgccattatgttgattgagtctatacttaatcgatccttctgttttgtcctgtcttcctccgaagtcatcaacgacttgccaatattgtagactaatttaccataacgtctatattgctgaacttcaaaattttccgatcacataacaacggttcgttgaacaacgctgaatatatagaccttgttagcttcgtaaacatgctgttaagagaaaaaataaactacgatatcctgttaagatggcagttgggatatcagcatccggcattattaatacacgaaagggtggactatgtcaagtcaaaattatatatgcataatgtgcttatttgatcatatatatttttccaaaatataatcgcatatagtgaataaacttgtcttgtgacatggaaagaatggatttatacaaccaaacttcttggttacacactaatatacaccacgaaaagtgtacgagttattactattcgttctaacagaagatgttttgcctttttctatattcattgatgaaacattgtatatatgttatatatatatatatatatactaaaacaaatattcgtgtattcataactagaagaatcatttttgcagatgtatgcttattttttcccaggtggatatgtccctcgaacccaaatggccgcctacgaaaatagcaaccgggggtaagatcgtcgtccgcctgcaaaaatcaatttttccggacggatcacttaagagaaccgcccgtaaaaatacttttattttcgctagcagacctcttaagtggttcgccagcaaaaattacttttcacatgcggactacttatccttattcactcgtccaaccggcctgtccctctccatctcctcaaagcacgtatgcgcaagcaggagctggcggctcagcacgcgcaaggaggcggcagcggcggaggagatggaggagctgacggccgtccgtgtgcacaaggacgaggaggaaccagctgccgtcggcggctcggcgcgtaaggaggccgcggcggcgtcaaagtaggtggagccgatgactgtcagtgcatgcaagaaggaggagccagtggccgtcagcggctcggcgcgtgcaaggaggcagcggtggcaacgtccaaggaggggagctgacagccgtccgcactgccctccccccttcatctcaaatatggcgctggcccctccccaccctcccagatctagacggaagaggagacaatggcggtgacgctccaatcctctccttcccttcctcctagatccgtccgccgccgcctgcggcggtggcacagacagcaccggcccctcccttcccagatctagacggaagaggggagccagccggcggcggcggaggcagaggcggaggtggatagaggtagagagccgtcggctagagggagaggccaactgacaacagattttttttcgtgcactgaaaatattttcgtaggcgggtggatctaatgcctacgaagatggagatgccgagatgccggctgtgaacattattttcgaatcatctatttttgtaggtctttggttacgagaggttcttttctccacctgggaaatatatttttcgccgcctgtaaaaacaattcttctagtagtgattgcaacaagttaaaggaattttaattttacatattaagtccacactccgcaagatatcctaatctcgaaaggaagctcaaggttgatcgaaaggagcaggccatcatttgctcgatgaaaataagagccctgctatcatttttgcatccatgcacaagctatacgcatgttgtatatagtgacagagttatttggagattgaaggatatccagacaatgtttttatggacgtatagcataaaaaccttccaaatttcacatcatggtgtatatagtgacatcatacgtcctgacatcatgaggtatataatgatatataattcggtatagtgacatcatgagctataattcagtatagatggacatcatgatgtatagattttgcatggatgcaaaaatgatagcagggctcctattttcatccagcaaataatggccagctctttagatcaaccttgaacttcctttctagagtaggatatcctgagtgtgtagggatggaaattttgctcacaggtccaagcatgagtgtaatattttactctgagtgtggacttaagtaatatgtaaaattaaaattcctttaacctgttgcaatgcatgaatatttttttaagtatgttataaatatacaatgttttatcaatgaatatatagaaaaaggcaaaacatcttctgttagaacgaatagtaataactcgtacacttttcgtggtgtatattagtgtgtaaccaagaagtttgattctgtaaatccaatctttccatgtcacaagacaaatttattctctatgcgattatcttttggaaaaatatatatgatcaaataagcacattatgcatatataattttgacttgacttagtccacactttttcgagcacataatcatgccggatgctgatatcccaactgccatcttaccaggatatcgtagttttttttctcttaaaaggatgtttacgaagctaacgtggtctatatatattcaccgtttcaacgaaccgttgttatgtgattggaaaattttgaagttcagcaatagagacgttatggtaaattagtctgcaatattgataagttgttgatgacttcggaggaatacaagacaaaacagaaggatcgattaagtatagactcaatcaacataatggcaaaatatcctttaattaattacggcacggttacgtatgccttcgctaagaatttaaattttgtcctccaaaagacgatgctatatatactgtcacacccggagttttcctttttcggtagtttctaattcaccaataaattgtctatagaaattactttagttaaacaagataaaacccaaattaccaaggtatttaataatcgaaaatgtcagggagaattttttttcccgaattctctttgctcaaaaaccattaacgggactcaaaaaccatcggaataaatgttgttaatttaaattgtcaggatttattcgttcaacaaaaaattgtcaggatttaaattaataatattttttctctcccgcctttggtcgtgaatcgtgctcaattcactcctctcttcgtccacggtttcgttttgcatgacgagacgaatccgagtcaatttcctgttctgtttccattcttttcctaaaatgtgctcgattcactcctctcttcatccacggtttcgttttgcatgacgagacgagtctaagtcagcttcctgttctgtttccgttcttttccaaaaataacagcgcatttcttttccggtttgggaaagtcctagtcctaatcctaatccctccccctctccctccccctagccggccgcgcgccctctctctccccctagccgcgtgcgccctccccctctccccatccgagttggcctcctttcccctcctaatccgactccccaccggtcccacctcctctcctatttttcctctcctatataagtcctagtcccccacctttttctaatctatttttgcctagtcctagccgcaagccgctgctgccaccggccactgtcgtcgcctcccgccgtcgccgttgcgtcgtcgatactccgttctccctctctattggtgtgtttgccactgcaaccatcaatttagctattctattccgtttgtttctcatctagcgtcgccgttgttcccatgtgttgccgccggatcatcatcgtcgaatcctcctcgccgatcgtctcagtttggtgaggaactttcccgtgatcccctagtttaggtattatttttcctagcgttattgccgtaaccctaattgtttagtcccgctaaaccatagtgccgccgcgccaccgctctagcgccgccgccgcgctgcggccctagctgccactgccgtgcgcctagccgtcgcctagctgagccgcagccttagccatcgccgccaccgctctcccgcaacgtcttcatggttggttcgctgcccgtagctcggtagctgagtcgcaaagccctaggtgcatccctaaattcctatcggcctatcgtttaccaaatctctactgtaaaccgtgtctagtttaccggtttagccgtagtcgttctaagccgccggttccgttcgccggttcagttgactgtttggatggtcccgtgtcacgaagtattgactcattgagtcattaactcgtgagacttgcttaccggagatatatttctattgatctatttatctttgggcaataatatgtaataaatgattatggttttccgattattagtaatcatgcagctcatattgtaaaattcataactaaataatttgagctccattttaacccattcaagttgcagtgaatccgttaaaatgtataacatccattaaaattggtttcttttgttgtttcagtagccttattgcttgtatttcttgtgtactttgtttgtcgtctagattccgccagttccagtgatccagtttatttcgaagtggtaccgaggtttcgtcagctcaagagcaaggcaagtcatacatacaacattgatcacgttgaacctatttttacaaaatccaccgctttctattaaatttattgttttagaatgtcatgtgggatggatgcctatcgtacttagcctgttgaatatcttatgtcattgataacttgggttataattgactagatgattggtttagcaatacttagccatgcatagatcaattagctcacaatgggaatcattataattatgtccttaattatattatgatgtaccaccataattaaactaaaatatgctttaatggtgggtgttggtacttgttaacgacactactaggaatagtcattctcagcaatggtgccagaaatagtcctggcatatttatggttactgttggtatttcttacgaccacagataaatccgcaagcgcacgaaataccgatgtagcacttcaccttcgagtgatcccaaaaggatattgaactcagggaacgtgtgtaatctacctaaggctaagactatccaaggacatcaacaataggtaggcaagctaggctagagaggtatttctatgtgttttaattatctacgctaagcaaaggtaatttcctatctgtagctttgggcaccaacccctgcttttctaccagcgtggttccggctatagctctatgatgtacccgaatgtggaggattactgggacgggattcagggctgtcaccacctaccgcctacctctgacaaatccgtgggatacacaacaaacaaaggtaatctctaacctagacaccacgtctaagttattaattattactctaatatttgcgcaggaacttccttcaatatccgtagtcctagtactagagcatttagtacgaatactaaacaatgaacccacaaagatggaaatatatcttacttagactaagtaattaaataacataagaaaaaaacacaaatgcttactttatagaagaagttctccgaacctggagcagagtgtaccgccagctccggtactcctccagaattcctcctaagaaactgcagtcgtcgagaaagaagtcggatgagcgccaaacttccgggcacccctccagagcttcccctcactctctaccttgttctaatgtacaaaaaatacaatagagcctcttgtaattcagctcaaagttgtgtgttggaaatgagagtgagctactccatttataggcaggtatgacggttacagcttatgtgaaatgtccaaaatgcccctaaactgccatcaggaagtaatcagggccgtccacatggaaaatggcgatcaacagcctcaggaacggttcgatcgaactcaggacggctctgatcggcccgtttttcctcgtggacactaattttgaggccctcagcccattggcccgatggattgggccatttggaggtgtttaactgacttatggggcctccaatctatgtaaatgtgtcctgaatgccggaggtacagtttgtcgcttgacggatgtgttttcttctcaaaatacccgcatacacatatttcaccaacactagtggaaatgattagtaataaaccctaccactaagttggatactatattttatttcattatatgcaagtattgatggtaaaatcttatgatttaaggatggtcaacagttactataatcagcaagcgcacggatataccattgtagcatttcacccagaagtattccaaggtatcgtatttttaatctcaagggaagataataagagtgagctttgctaatgcactttatacatatactgcttataattgtcaaagcctaaatagcggttaagtgtaatacaggggtagagtgacacgaagcaaagctgattaaatcctcatcatgaaataattctaactaagtgggaaaagaaatagaaagcattcaattcatatacttctagtatacacttaaatcctagtttacatctgctaatgtacaatcatgtggccaataccccctaaaagtgtcctcctggtacttcaagagaccaccccggttgctgagtttcttacgacaacctgtcatggctgtctagccagggctaaatatggaggagtaccctccctaggaatttgtcttaggaatatatactaatgtggaggaatacccgtactgagctgtcatcatcagcggcccacctctactatcctgcaacatatatgcccaattaatgatatttaataatctaagcaccatgctcacattactaaatactactctatacacgtgcactcaacatagagcaactgataaatcagacattaaacccacaccattacacctctctggtaggctacccacacaattaacataatgcagatataaagcaagaccaatacttagactaagcaaagtaccaaagatgtataaagaagagtattgcatttattcggaatgtattatagacgagattacaagagctgctagagccataccgaaaactcttccgaagactccggggacttccgaacactattctatactactcctgatgtgcactagggttcccgatcttccgaaaggttctaataaacaacagtttggggcttgcccctggttcggccgaaccagggtcggctccaaccgacctccccttcggtacagtggctgacaagtgggtcctttaggtggttgtggaagttaaggtcagtttccgactgttacacctgacttgtgggcccattttatccatttgcttgcttaggagtgaggtttcttcactttctctttattttatttgataaattcctgcaacatgttattctccaagtacaagtggaactatattatttgaaaacaaatatgcattgtaagtatagctaattctccattattttagttatattgacggtcaaaatttgtctgtaacaaccgtcaacaaaccacccaagcttgaacctttgctcgttccgagtaaaggacaaaagggaaacaaaacttttcgatccctatactaaggttgaatatgtggagcttggtaaagatcaaatgaggaatacttgcattcacatatattactatgtcaaaaatttagactagagcagatagcaagtcatacttagatcaagatcgtgcaaagtgtgtggaatgtatggcggaaaatatgatggaaaacaaaatgtagataaagaaaatgcttctcctttgtgcttatgcttttcctccaaaatatcctttaacttttcatagagagggtatggcttctttttccttttttttcatcatgctctaattttgggagagcaagaatttattattttctcatagccatacctttccctcttttttttatttttgcaaaggatttttctttggaaaggaagcatggatggagagcttatttgtggataatgatgacatggatgctatcttccagtgtagaagcttagcatatgtgtgcatatatgggtttatgatcttgatcataaagtatgaaaagcatctacacaagtcacaagatttgacaaagttcaatggatatacaagtaaccaaatattgtataaagtttgtaagtgcaaactatatttggctgtggtaggaatttatatcaaatgaggaacatgcaaatttatcatttcaaaaaacaaatcatccagaatttaaatcaagcttggatctagattatagcaactctatatcactatatcatatctcacaataacttagggttagatcactgttggtatttcttaacgacactattagaaatataattcccagcaatggcgcataaatacttctggtatattatggttatagagttcatttgcaagcgcacggatataccattgtagcatttcacccgagagtattacaagggtatcgtatttattttataccgtgggaagatcatgtagagagaacttgactaataatttatatattatttgtgataatcatatcctaagcaggggttaagataatccaagcgtagagtgacacacaagcagtaagctactcattctcataataaaatatctaagctaagtggaaagaaaagagaaagagaatctattcctatacttctagtatacatagtatacatatattctagttatctgatatactagctaataccctctatgtgatgccctcctggtacttcgagaagccacccctgactgccgagttcctcacgacagcccgtcatgaccatacaaccggggctaaatacggaggagtatcctccccaggaaattaacttagaactatatacacgtgtggaggaatacccgtactgagctgtcaccatcagcagcccacctctcatccgcagcatataaccccaaataatgatatctcgtaatctagacacgacgtctaaactaccagatactactctaatatcatcgtcatgacatagagtaattgcatatgcaaacattatacctgcaccaaagcatctcctagataagctagcagtatattcaatataacatgaacataatgtaaagtaggcattcaaatactcgaaaagtatttcaataccataaatgttgatgcgaaaacacgaggcctggaagatctgcttaacttcagtgcaggtccaaaaatcttgcctttagattcgtgagcgtgccagttgatttgatcctgcaatcaacaagaaataaagacaaagaaatcgcagttaaatccttaaacgatagccgatcggctagccaccgatgacgtatcatttatctttgagccgacgtcatatttgaatcaatcggcagtcatgaataagtaagagtaaatctattcgatcggctgtagatatcaatgacacataatattttcgtcgatatatacataaatcaagtgattgggatagatcggtcaccatgaagggtatttcttcatgaaggttacgaggctgtccatttttggcggctgcacttcaacttccttcatgttccgtgcattcaggtcgtatttgatcttgaccatagagcattgctctgctcttggtctaaagttgaatttctgctcctttccattgatgtggaaccggatgttcccagcccccacatcaatgttggcttccgcggtactcaaaaatggacgccccagaatcaaaggcgtctccttatctaactccacctcaagttcgacgaaatccactaggatgaagaaatccctgacttttattggcacatcctcggcgatgcccactggatagcagacagaggagtcagccagttggagcctcatcggtgttggaatcaaccccgtatagttcagcttgtcgaaggcgtccttcggcatcacgctgacactggcctcaagatcacattgggcctgatcgaagtgttgtgtcccaattgagcatgaaattatgggacaccccggatctttcttcttttccggcagccggtggagtatagcgttgctacactcctccatgagcttggccatctccatggtaggcaacggctttttgttgttcgggatgtcctttaggtagcgggcttatgttggtacccgcaatgcatccaccaacgggatgttgatgtggatcttttggatgacatccatgaaccgagcaaattgctcgtccatggagggcttcttccaacattgaggaaacggcagccgcgttgtgtcacagtattcctgcggcgcgatcttgttgagctgcatctcctcatcttcctcgggttcatttatgctagcgggctgtgcctcctttctagcttgcttggtccctatagtgttaggatatggcggatcctgagtggattttcctcccctcgtggttatcgccttaacatttttttagggaaggttcgggctgccccggaatccttcccgtctccttcataggtactaaagagtctagttgcaccagcagagtctatcattttgttgaagctcagctggttttggaaagcggaagcaaagccttctagcttgacatttatattctcaagaactttaacattcaaggcaagctttttgtttatagcatcatttgttttagcctgcgcaaaaactaagtccttcacggagggctgattgaagttactgttattgttattgttgccgttgttgcctccttgatagtatggtcggggctggttccacccctggcttccttgcggccggtagccattattccccatgaacatggcttcctcacgggtctccgggcaatgattccctgagtgaccagtgttctcgcagaccttgcatgtgatgtgcgagtctaatgccttgacagtggcttgcggtttggccttctcctgatcgtccagtctcttcatcaggagatgcagtttagcagcaaacatctccgtctccttgacagaatgcatgccgcgttgtctggtctagagtcgttcttcgctccatcccatgttggataccatcttctcaataagatcaatggccgcacggaccgtctttgagaagaaggcacccccagcagtagcatccagatgatttccagatgagggaatgagtccattgtagaatctttgcagaatgagtcagtcgtccattccatgatgaggacaggtggccacatactcctgcagacgttcccatgcttcgagaatatcgtctcatccctagtctgctggaagcttgatgttctcctacgaaaggcattggtcttgcccatctggaagaattttgagaggaacgcggtggagcatctgtcccaagtgttgactgtcatccggttcgcatagaaccattgcttcgccttccccaggagtgagaatgaaaacagacgaagcctgacagcgtccgaactgacaccctttacagtgtaggtgctgtagatctctagaaattgttgcagatgagcgcttgcgtcctcgttcagcttgccacagaacgggcttgcctgcgccatagttatcaggctgctcttaagatcgaagtcgatgtgtcccatgttgacagccgggtcaacaggcacgttgtcagcagacggagcagcgaattcgcgaagggtcttcttggccctattcatgaaacttggtgacgttgggatggctagtttcttttaagagagcctcttctgtggagggatgacacgaggcttgactctccggaagaaggactatggattctcgttaaagttttccggtaagttgaaaccagttatacactatcctcttttcacgacacaaataaaagcaatcaaggttagcctgcaaaggatagtgactcatacagaggtattatatatataaagttattagcttagtcaactcattattaatcttccccgacaacgacgctagaaatgcttgttagtacttcttaacgacattgctgggaatgagtattcccctaggatatttatggttacagatataatccgcaagcgcacggatatacaattgtagcattttacccggaagtattccaaagtatcatatttttaatcccaagggaagataataagagtgaactttgctaatgcactttatacatatactacttataattgtcaaagcctaaacaggggttaagtgtaatacaggggtagagtgacacgaagcaaagctgattaaatcctcatcatgaaataattctaacttagtgggaaaagaaatagaaagcattcgattcatatacttctagtatacactcaaatcctcgctttacatctactaatgtacaatcatgtggccaataccccctaaaagtgtcctcctggtacttcgagagaccaccccgagttgccgagtttcttacgacagcctgtcatggccgtccaaccggagctaaaacgaaggagtaccctcccaggaatttgtcttaggaatatacactaacgtggaggaataatacccgtactgagctgtcaccatcaacggcccacctctactgtcccgcaacatatatgcccaattaataatatttaataatctaagcaccatgctcacattactaaatactactctatatccgtgcactcgaaatagagcaactgataaatcagacattaaaccaacaccattacacctctctggtaggctacctacacaattaacataatgcagatataaagtaagaccagtaattagactaagcaaagttccaaagatgtataaagaagagtattgcattaatttggagagtattacagaatattacaagagctgctagagccataccgaaaactcttctgaagactccgaggacttccgaacactattctatactactccacttagcactatactactaatagtaatgtatgaagagcaattgagcttgcttgagtgggttgagaagtgaagtgagctcctccatttatatggtcgatactttgcttagtctaagatggaaaaaaaactaatttcataacttgcctggaaactgcgagacgaatttattaagcctaattaatccatcattagcacatatgagttactgtagcacttatggctaataatggactaattaggctcaaaagattcgtctcgtgatttctgtgcaaactgtgcaattagtttttcttaatctatatttaatgctttatgcatatatccaaaggttcgatgtgacgtttttgggaaaaaaaaattaggagctaaacaaggcctaatgtgcaaagctacagatggatcatggtcatattcagctagctttatgtcaggtggtcagatgcagtggtaagaacttgcagctcattaactttttatcaaaacaattattacaaacattttgcaatgccatctaccttaaaaccttggttcagcaaacatttaaagactatcaattagttgaaatttgatttcaattagttcagttgtacacatcaaagacaaattaggagatagatattagatatagggataatacctcctaaaactatctcaactcttattgaagctatggagatattttcaccctgcggctatcaatatgaaatatctacggtccagcaagcaatgcaaacttgtatttacatgcagttggtccatttaaaacctgccaacatcgaattgttgccctcagaaatgctattgaagtagaacatggaagcaactcatttacctagcgaccctacaaataaggggatccggtgacctggttggagagcttgcagccgtggacggagaggaagaacatggcgacaaatcctgcatggtgccctatcatcagtcatttagaataaaaagattgtacaaggcctgttgcttttgatagattgtcttttggaggtgctcataggggtagggtgtgtgtgcgcgcgttcataggggtgagtgtgcgcatgttgtgagcgcctgcgtttgtactgtgtttctcaacaaaaaatcagtacactgataaaaaattggaggcataaaagcagaacaaaatgaagcccaaatttagtgtacgatagcatcttgcatctggaaaaaggagtaggctaacattatagggtatattacaatcttgttggttccagctgttaatcatctggcctattttatacaacaaacccttcaatccttaccaatctagtttgctgagatgcagtagtacttgtggcaccgcaatgaagataccctatatgaatcaaggttgttcacctgaacagggcaaaaatatattaacaatctcatttgtaaaagggagtaatctagattgcttgcagctaatccaattttcgttgatatgaaactaaaaaattgagtaaataccccagatgcattagaccagatttcataatacagtgagtactgaaaaatcactatatccatctaaaaaatattgattatatagtaagtgtatcacttcatcaccagttataattcaatgagaaatacttgacatgtgttaatatcagacatctaatgtaaaatcaaaggtgtttttattattattttgtgatgaacaattggcatcggagattattggttttattatttggaattaatttgcgaagtggttttggagatgattggattttacaagtgaatttacaggatgctgtcattttatgtgaccggtcagaccgggctctggtagccggtcagaccggcggtatgcgtgcggtcagaccggccagcccgcggtctgaccgaccgactctgtgtcggtttcggtttcgggttgtttgtttggatatccgtgattgtttcatgattatggcttctagatggatactatacgtatgtaatgctgttgtttgctactaatgagtcaagttgggatagtttggtctcggaatatggtttgttttgtttatttcatgtgtaggtgactcgatgtctcgggagagtatttgcggtgatggaccgggagtcggcttggggataagacgacgtccgtggtggtcagacatcatgcgggatacttaggctagagttgatgcacgtggttgatggagattccatatggcatacgatggagatattatgtgcgtatgggatgcggagtcgaatttggagggagtctaaatttggtacgattggttatgtaaagtttgtttcttgtactagagggtttcctaaggtgtttaggactcctagtatgagtttggttcgtgactttaaactgcctacctcgggtataaatagagggggagcgtgaggcttcccggtatcgcttttgagagcaattgagttgagttttgagttagggtttcgagtttagtcgaaatttttgtaaggagtgttgttggtgtactttgtaaacacagagagaatcaataaagtcgtcatccactttaaaagttcttcgatttgtgtttaccgggtctcggcggtctaaccggcgatataccggcggtcagaccggcggcaagcagcggtcagaccggcggcataagggcggtcagattggcggcggcgacagctagcggcagctgatcttggcggttcgaccgatcgatctacatcggtcaaaccgacgttcatcttcggtcagaccgcgatccgttaatttcaagggtaacttttatttccgccaaaagtttttgtttttaggtataccaactattcaccccgttctggttgggcttagttattgtgattcgatcctacatctaacactgatacagtgagtgtcgtgtcagccacatgatttgcaaggcattcaaaacacaacacttacgtcacgaaagtgtcaaccatttgtgaacaaggccacgtcgtcctatctggtaatacaaaagatcatggagctgtttgtagcgaaaaatgaacagacatacacatgaattcacatggagctgcttgtatccaaaaataataattaggcctcactcgtcaaataagtacatggccttccctatttaaatggtttaaaaatcctaataaataccaataatcatatataattaacatatggcctatttaaattgtttaaaaatcctaataaatacaaataatcatatataattaacatatggcccatttaaatggtttaaaaatcctaataaataccaataataacatataattaacatattgcctatttaaatggtttaaaaatcgtaataaatacaaataatcacatataattaacatatggcatatttaaatggtttaaaaatcctaataaatatctatagtcacatataattagcatatggcatatttaaatggattatgattcataataaataaaatcatgaagttaaggagaatatattaaaaattaatccaagctgtttgaccttcagtacattacaaataatttacatcgtccatacaacaacctatgtcactgtcttcctcacgtactttctcctcactattgttccttcgctatgatccttacgtgagtaaggggtctcctcctttgataggaggatgttcgggtcaaccatcactgcgaacggaggttgtccctcaaacagattgtaatgttcgtcagtcttatccttgactccgacgattttcctcttgcctgggagaaccacgtggcgtcttggctcatcgggccctttccccttctttggtttgctagccatgtccttcacgtagaaaacttcctttaactcacttgcgcttcttagatggtacggcatcatcttcgtcaatgatgacgaccttgatagggtttgcccaggccggcagctcgccggagaaaacacggttcgcccagccacccatctgatgagtaagcagctggctatgctcgtttatggtaagctccccgatcattcttcaggcctcactttcggccttaggcagcataagtactatcgaaataaaggcaaaggaatgagcacaataagaaggggaagcataacaaaaacaataacaccaaaaaaagttgaattgaatagcaaactcacaattcgcccctccggggagcacaagtttcggtaggccatccgcctcctcctccttgtttacttcgacttgccatgtctgctaaaggggaagaatctgaagcatatagaactcttccaccaaatcatgacagctaagccgaagagtgatcttccgaagtagggtgaagcaagcttccatcgcgtcgtcgatcaccactttgggttttcggacgggcgcgatggccctacactgccacttcatggtcttggctgcgtccgatgcggcctcaaaggggatggtgtggtaaaaccacatcgacatccaatgacgatcccatttaggcatggacacgttcacagaccataaattggagcgctcggggtggaagttaaaattcgtgctcccgaaaaccgtccttcgggtaccggctagggtgaccaccgtcttcgaatttacgatggcgtagaagatcgctccaaacagctcggcggtcggctcaaaacccgcggttcggcacgtctagtcgaagatggcgacccgaaccaaagcggaagggctgagctggggcaatacaatctcaaaaagccgaagtatctctggtagcaagacattgcaaggaaactggagtcccgcatcgaagaatgcgacgaagactacggtctagttctcgtcaggcttcggcaccaccgccttgccagaggcaaaggcctgttcttcggtcacgaccctgatcgaaaccagcttcgctagctccgcctcatcaatgagcgaagcaccaagatacccggtgtgctcttcgtcgatctttcccgggtctagaccagtggtcgaagcaggagcaggtttacgaggagccatgaccgaaaagtacagaaaggctagtgaaggagttgagatcacgctagtcaaagtggacaacaagagccggtgaacacaaaaggcagacagggcaatactcccggtaaggagatggtgaaagtgactcggggtaaaagtaaaagcgacaccggggggaagtatatataacccacccacgcgacggttcgcctaccacccaattagagcttgccacgtgtcgctaggggggtatacggaacggtaatttcccgttagagtgggccgaagattgcaaagcctaatacaatggatagccgggccaaaaagcccaacactattcataggctgtaaagccaagacaaaagcttctgcataaagaggcatggtccacacacaatttgcctgggaaaaagcactaccactaataacaaaagtgtcaaaatttgtgcaggaacgagaacaggtttcagtaggaacatcggccgaaagggggcgcctcatgccataccataaattttgcacggtctcagccagagctccatactcacccttgcccgtgaggggcttgttggaggtataccacgaggtccttcgaccagacctgccgaaaccgaagcgctagcaaggattcaagccgaagacgtacggcgaagaccgaggggacgcagttgcgctccacacccgagaaggctgcatgggtgaaagccacatggcgaaagccatgttgcgaagcacacggacttcgctggagatggaccttgtcagaagaagactacgcgggcgaaggctgtatgatgaaagccatatcgcgaggcacgcgagcttcgccaaagccaggccttgccagaagaaggcccgatgggccgtcgtgcccttgaggagccccttcgccatgactgggccgagtctgttggcccattagaagcccgtatatgtaaaggacacagtgtgccctcaataatgtccctatcataagggcaaccatgtaaattcccctataagcccaaaacctaaaagaagggagccatagggttataaatagcctaatgggggatcccgaaaaaatttgaccaagtaatacaattatctttacttccgactattgttgagagaaccacgtccttcgacgtgacgcagttgtcgtttgacaacaaagccaattgtggacccgcagtaatgggtgtttctatgctagtgatagtgtatggtgtgcaaatcaaacattgtggaatctatggtggttcccaaatcccaacgcacaaagaacacagccttagcaagtgtatggtgttgtgatagttattttcaagccaaatctatctataccatattacgttcaatattaagcacttgagaaattgttcatgatccgaattttataagttcaacatcatttttttcttcgcaaatacgcaaaaatattatacgtcaatatattagaagaaagtaaaatttcaattacacaacacaacagcaggaggtcaggtcactgccaaggaacgccaaggaaaaaacggttaggggaagaaaagaaaaactccaaggaagtaaatgactccgaaactagcaaagcatcaaagaaagggcctgatactactatcctgctaacaagaattctaattgagcagcgccggcgcaccccaacatcaaatatctactccctagtttaatggcaaatatttatgaccgaaacaagtaaataagagagtgctttattataaaggcacctgtagtcacaatttatgaacgaggtaaggcatgtcattgaagtcacaattacaaccaactcaagacacttttggagtaggggtgtgttagttcacgtcaaaattagaaatttggttgaaattgaaacgatgtgatgaaaaagttgaaaatttgtatgtgtaggaaa

SEQ ID NO: 31415 - DNA, 4192 bp, Oryza sativa
  unsure (1)..(4192): unsure at all n locations
ctttaaacttgtaacttttttatcacatcaaaacttttctacacacaaactttcaacttttctgtcacatcgttccaatttcaatcaaactttcaatttttatgtgaactaaacacaccgtcagtgtgaaaagatgaacttcatgttggcctgtcatatcaatcgtgatactggctaacagtcttaacacaaccaaatctcggtaatccaagctttgtagcgaccataaaaggtgctggaatataaagacagatagaccttgtttagtccgcggaaagaaaatattttggtgtcacaacggatgtttaaccggatgtcggaaggggttttcgaacacgaataaaaaaactaatttcataactcgcttgaaaaccgtgagacgaatcttttgagcctaattaaaccgtcattagcacatgtgggttactgtagtacttatatagctaatcatgaactaattaggctcaaaagattcgtctcgcgatttccatacaaactgtatatttaatttttgtttttatctatatttaatgctacatacatgtgtccaaagatttgatgttatgttttggggaaaaaatttaggaactaatccaggccatagttataaagatttttgtgaaaggtttttgaaatttacaaaaatatcttcctctaacttcattggtcaactagttcgtccagggataatcaacttgcgtgcaacatgggccgaacagtgtaaactccaatcatgtgttgcggccacactcatggggactccatttttgtccatgttaggctaacagtaaagtaccattctccatttgctgtccatgttaggccaacagtaaagtatcattaatttttcacggaattgtcaaggtgaacaaaattagccactgtctatccgtacaagatcgacacgaatttgcagcgtgagttctgtctgtacaagtaatcagatagcgattgctttcttctttgttcggtgacaaaactacgttttaccatcaactctatcgaaaaaatacatgtaacgctctaagccgtaatatatcacgaccacgtatttagaagtgagctagtctcatcaatctaatcatctcctgattggcttatcagtcataagcagaggctccaggagccacatctaggccctggcttatggactcatagttttctataaattttagaaattaatatgaaacttactggagtccataacccaagcataaagcttgagcagttgagccctagatatcctatgatatgcccctggccgcaacagtagattctatttgccttagcttttgaaacataaaaaggaaaaaaagttttacacataaatgttccttgtttgatttgttatttttctacgtcttatcatccataactcaaccgattatagccatttaaaataaaatgaattccatcaaccagataaaattatctcaaaaccagataaaattatccatcaaccaaaaagaatagatataattcacagctttcatccctgtttaatcatggttttaacttcatatggttcgctttatttttccgtgatgtttgctgtcttatttggactacactcgatatgaagtgctaaattgtaataatgggttgtagctctcttgagcaaaggccgggatgtttatttctttataaaaaaaatggtgtaaagatagatgggagtatggacttgtcaacacaagagtatggaggtattgtgggtgtcatctgtacctcttttagatgccatctgttttaatcactattcctgttccgcacaggcgcaccgacaagcaaggtggcgcgtgtttttggcccacacccacatgtgcggttttgacccaccagctacaagcaattccgaattttgataagttcacgattccgccccactagaccaccagttacgtgtgcgttgttagagtgggatcgggaaaggttatgatttgctcaaataattagttttttattatcacggatttaattaaggtaaccttttcttttattttattcataggaagttgtttcttttttatataaaaaatttaaaaatatatactaaaatttgctaactttcaaataaaatttaaaagtacttcctataaaaatatgaaactaaaatttaaaattttcaactaaaaatttagaactaacaactagattttgaaaattttcaactcaaaatttgaactttcaagtaaaattttaaaagatttcaactcaaaatttaaactatcaagtctaattttgaaaacttttaactcaatttttgaactttcaagttaaattttgaaaacattttactcgtttcaaaacttttcaacttaactatttgtttactattttcattataaaaactataattaacacgaatcaattcgcttagcactgtaattagcactaatagcgtgtgagctatcctacttcctccgtttcacaatgtgtctagattcatcaacatctacatgaatgtggacaatgttagaaagtcttatattgtgaaacggagaaagtggctattttcattataaaaactacaattaacacgaatcaattcgcttagcactgcaattagcactaatagcgtgcaagctatcatagcgatgcgacactatgcacaataaggaaaagcgtgtataaaaacaaaaaagacaaccgagtccaagatgcacggtactccctccgtcccaaaaaaagacaacctagtactaggatatgtcacatcgtagtaaattttttttaaggacggaggaagtatttattttcttggcgcaccactgcccaaaaggaaccccctttcggagtctgagtgatctccgtcctaagaccctgtttagatgggactaaaacttttaagtccatatcacatcgaatgtttagatattaattataaatattaaacgtagactattaataaaacccatccataatcttggactaattcgcgagacgaatctattgagcctaattaattcatgattagcctatgtgatgctacagtaaacattctctaattatggattaattaggcttaaaaaatttgtctcgcgaattagctttcatttatgtaattagttttgtaagtagtttatatttaatactctaaattagtatctaaatacaaagactaaagttaagtccctggatccaaacgccacctaaaaagccaagggagtgcattttctagacaggtactaggtaagaaaataccttttttttttacggaggtagtagcgttttctatatagtttatcaaaaatatctaccgctttaattactctcccttctccatggagagcacgtgctctccaatttatcctactaatataacacaagaaacgcaatcacgactgaaaagtacggtgaatttgtcacttcatgttctctctgatggagattttgtttcgtttccgtaccgcttgtaaagtaccgtgatacggacagttacgtgtgggcataaaagcattcacacatgaagtgcagatataaatagaaaccccggcgatcaattaaaatgtgcatacagggagaccaaaaacggtgccatccatgtatacccttcaaccacgcgtatgcatctccagctccaggtcatccatctcccctaaagctgctcgtctatctcatcagaaagcatccactggaaaggttggcaatcttgcacacagcaatagatgtgtgatccttcagtgagtgagaaatgtaaaccaaatactctgctttgtttcatgtttcagccgtatttcagggagattcaggtgcatctaagctccaaactgggagaggcatcaaatgccatgaacagtacttaccaacagctgctggattcatttgttgatcacaccttcacattcaaatgtcaacctttgcgtcccactgaggtaaatacaaatggttcgattctgttccagttaacttgctgacaaggagctgaaaaacgagcagaaggcaaaatattatatgcataccttgtgttggcacttctatagagcaattttgcaccagtcgacgagatcggggagatcacacgggttatagagattgaaggagagattccagcagattttcctgagggtgtctacataagaaatggtaattcacatatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 31416 - DNA, 394 bp, Oryza sativa
cctgcagcccgacgacgaagctatgccagcaggacgacgacagatggtgaaggcccggccctccggttgcggacgcggaggcccaacccggcaacggtggacggcggcggccccaacgcaccaggccggcgacgacgcagccacgccggatagagcgagagcttgggttggggcctagggcaggcagcactgggtgtgggggatttggctcgctcaatgctggctatgggttttgttcgactgatttagggttcatacgtatcggagatgtatcgggattatttttatttatttgaaaatcgtggatggtggggatacatgccggatacgtatcgaggcgtatccgatacgtatccgtatccagcgacgtatccgatacagatacgtgacttga

SEQ ID NO: 31417 - DNA, 848 bp, Oryza sativa
ccggtgattgtggcatatctccaatgtgtacgtctcaaattatttcaggaaagaagcaatctttcatacatggagtgaggagatatatgggttcgggatctcaggatcttacacaacgctgagtgcccaagttttttatattccagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccaaagaatgcagaagttccaagcggcgcagatgctagtccatctggacaggcaagtgagggtaggcgaccacctggtgaaggaacaacaagcaggcgcgcaaggccaaggcgtcgtcgcgcagcaggcgattccatggtgtaacaatgctatcgatttaggaaataaaatgctgttgtgctgtaatgagtgttcggactaaatatttctatcgtgtaatttcaattgaatgttgttgtaatgagtacctccgactattgttgtactagtagtattgcgaactattcggtgttgtatcataatgttatcgtgatgagtattcggactaagtactcatatcgtgtaactgcagttattgttgtaatcagaaatattccgtatggtgacacttttgtttgtttgtactcttgtgcaggaatgtgttagtaattcgcttatgaacatttattacttatgttgaactaattatttatatgtttctgatcaatctgtttgatgcaggtatggcgtacgacacaccggcgctgttgaaccgtgggattgacaggaaccaccgctcgttcct

SEQ ID NO: 31418 - DNA, 774 bp, Oryza sativa
cggcgccgccatctccgtcgtcgccatctctctctcacacggtgggggttagagacggtggggggagcggagaagagaaaagaaaggagcgccggccatggcgcggcggcgcgaaggtcgccggcgatggcgacgccgtccacgcggtcgcgtgagagagagaagagaagagaagctagggttttcggcggccggccgggagaggggggtttttgatcctccgatctcggcgcccggccgtccgatcgaaaccctagctgatcggacggccggcggcggccggaccgaaatcggcccaagtggggagcgcgcggcggcggctttcccggcccaggcccaggttgcggcctgggggaggggagggggcgcttgcccgcgcgcaaagtggccataggccgaccggcaaaggccggaaaagttcaatttaggtccctcggggccgaaaatgaataaaagagaacagtagcaatttttccattttattttgtcgatttttcatgcaaatttcaatagaattttgaatagatttttgcatgttttacctctgtttaaatttgaaccaacgggagaattttcacagagagagaattacagagattttgctactgttcatatgattttatatagtcttccgctgcaaatagatgaaattgatgaaaattagtgtttctaaaattaaatttcgaaccaacgggagaatttaattttaggaacattaattatgtgctatgatgttgtaattttctgaccaacgttgttaattgcaatattata

SEQ ID NO: 31419 - DNA, 755 bp, Oryza sativa
ttactggtgaacctaatattttgttgcatgaaaatgggcatcccaatatgagagctgtgttttgggttgaccaccggaataagaaccagtctaaagaagctcgatttattgacatagacatcactcacgtaatgccttatgacatgcgggacatggagtgccatagcttgagtgtatcagctaaggtatctggtgttcgtcttggtggtggaatgagttatactgaatctttgctgcatcgatttggtatccttgggcctgatggtggtccaggggaaggtctcttgaggactctgaaagatttatcctctggtccacttgcgaaactattctcgccatctcacctcaccgacaaggaaggtagtgaattttctgtctttgccatttaatttgttaattcatgctggaaattttgttggtaagcatgcatgttgattgcttctgctcagttgcgagatatttttgctgtttttccttgtattattcatggattcttccccgttccccttgaattgcagatggaatgcccaattccaaagacaatgactacaattcgaagtttgacctggaggtgccagatgatcttgatgtgtcaattgagctacgaaactggctcttcgcccttgaaggcacagaagaagtaggagattggttatcgcctcatggcagtgatcatatcagtagagaagagaaatgttggcataccacattcacgaatctacatgtgtcaggcagaagtagtgatcggcctggat

SEQ ID NO: 31420 - DNA, 3566 bp, Oryza sativa
gtagtaaccgatataatgcgattcaaatgatttattgatctcacatcttggcttccagtccccatccaaaattccaaagataccggtgtcaggcagggagatgctagtaccagtcaaaagattcgaaagtatatcttgttctggccaatccaaacaaaaagcttgaaaataacagctatttaaacatgcgctgagaaacaaggaaggaaatttctgcgagacacaatctgcatccggcctattgccacgtgatttagatcagatcagccgaactagacggctagcttttcatcgagcaccgtgagataacgtaatcaattcagtgacctgatcaattatattgacagtaggttaacaacagtgacaggttgggctaaagcaaataacgacagtgagcgcagccacgcatgcaggaacccacggctaacagggtccaggcagcatattgggttcgatcgatcgacagcttttggaattaaagttagcgaaagatgatgttaagacggtacaggagtcaagcaaaagctgaacaccgaactgtccggaacctaattaattaatctcccagccgccagcagccgcggaaagataagggaggcattggcacggcgccgcttgtgcagataatgctcagtaatttacatccattatgtcgacgatgctaatgctgagtggctgatggcataaagttgacctgtcaaatctaatctcatgtgtaatgacaaccaatctaaattgttaacgagtgtgatgcaaatatgcaattgttcagtagtaaatcggaccctttatctgttactagtagaaaaattaaacggatgggacaatgaactacagtagcacacgctgggatgttggctggctggctggctggctagctagctccaagatgcggccgtatgcaaccaaactagctggagccacacgtacgattccgggctgcaaaaatgcaccaccacgaaatctcccggaacgtcgcggtctgcaatccatcgtccaatctagtttgaaatgctagcctatttttgtttcacggattagtctcgtatattacgtattgcctctcacgtcgatgccacaattaaggcaagcgtttcatccaatcttagtattttgcattttggcattccgttgcgtaattcgtcaaaaaaaaaaactacttggaaacgaaggtaatttggacgagaattggagcactgaccaatcatgcatccggcgaagaagatggcctggacgaggccgaccttgtaccgctcgccgcagacgaggccccactcggacaccgtcgacgaggcgcgcccgctgcccactcccacccggtccccgcggcggcgccggcgccggcgcagcggtcgccgcaccggccgtccccggcggcgcacaccatggccggctcccggtcggcgaagatgatgaccatggtgtgcagcgcctccagcagccacgccgacgacaccagcacgaagtgccgcagctgccaccgcccgaactcccccgcgtgccacgccagcgcgtcgtcgatgctcacgcgccgcttcacctcgcctccaccgccaccgccgcctccgccggcgaggagcgcctccgtcgacatggctatccgctcggtcggcgcgcgcgtgtgcgtgcgtgcgtgtcgctcggtggcgtggggggcgatgcgtttttgcacggtgcgccctgttgtatttgtagggagagcgagttgcctgtgtttgtgagttgtgtactttgtgtgagttgtgtgtgttttgtttgttttatttggaagttatttacgcagtttcttaactctgcttactgtcaacagttgcgacaaaatcatttttctggactactgctagtacatgctcttccgatccaggatttggatctacagcgtatttgtcacatctggcgtggtgattaccatcgttggatgcattagggctgagtttagttctaaaccttttttttttcaaactttcaactttttcatcacgtcaaaacttttttacacatataaaattttaactttttttgtcacatcgtttcaatttcaaccaaatttttaattttaacgtaaactaaacgcactccaaggtgaagtatctttggacaagttggaattggaagactgtaattgcgattggctttgcattttacagtcatgtactagtacttgtgtgctttttggacaggttgccgtgctgcacaaaaatacctatccgataaggcgactttgaatctaacatggattaagtatggcaatgcatgccgtggctgatatgggcgcctgcgtttggttgtcttgagctgtttattagtggcgtatatatgctcaagagaaatgtgcgtaatgtatttggtctactcatagtccaaccagatgatttgagaagtcaattttttatatctacaaggctttatccggctgagaagaaaaggattgccatcgatgtatcggagtggggcagtgctgcactgctgcccaagtgcccatagctggccatgcccgacacatccctaatgataaggtttttttttttcatttttatggagaactatgattatttagttcggcagctatatattgagagaagatttctctttaagaccgtgttatgcagttgtacactgagaaaagatttctctcattctctgcacacacgtttcccgaactattgatggatttttttaagaaaattatatagaaaaattattctaaaaatcatattaacttatttttaaattcaagatagtttataattactctccgttttaggttataagacgttttaactttggtcaaagtcaaagtttataggtaatatagtaatatttataatactaaattagtttcatcaaatcaataattaaatatgttttttaataaatttgtcttagtattttttttacaaaattgttcaaacttaaaacagttaaaacgtcttgtaatctagaacagaaggagtaataaattatatactaatacttcaccatacgttccttctaaatcttctcttttcctcgtgtccaccatgcgctcccttccaattctcccgtcatcgatcgagcacgtacgatcgtgtacgtttttttagtcccacatggtgtccgcccgggcagtggcgttctattcgctcgcgacgtctcaagggttttggcatgcagtagtagctgctgccaccacgtcagtccaagtccagcacgtgtacgtacgtgcaggatgtcacgactcctgcgttggatcttaacgccgcacctcactcgctccgagatcaatcgtcgtcccgtccggatcccatcccggccgcgcgcgatcgattctgcacgcgtcgcgtggcgtcgcgcgcgcgtggcgcacgcagattcaccggtacgcgggggggctcatcgcgaacagcattatgtggcggtttccgctgcgatcgcgggtgcctgcgtgcggagtgcggtgtcgctgttgcccgtgcgggcgtcgcgtcgcgtggtgtgattcagaatcgtgcgggatatgacgcttgcattgtgatgggcctaatttgtgcggccgatccatcgcttccttatttgtagtagagccc

SEQ ID NO: 31421 - DNA, 2340 bp, Oryza sativa
gcatcatcagcggttcattgcggtagaatcccaggaccttgccatactcgatgaggtcgtcaaatacctcgtccagatccgtccacttgaactcgaacccttccctcaccagcttctccgacgaatagcacactctcggcttctcagggaacccttggaagctgccaatatacgcatacaagagacgatcaccgattcaccgtcagttctcttccctgattcaccgtactacctccgtaaaaaaaaacccaatcctgaatttatgtccagattcaaatttagaattggattttttttaaaacgaatgtagtagaagtttgtgtcgctataactcgaaactgagagtgccagattgccagttcgtacgtaagtacgtacccgtcagttttgacgttgtaccgagggtgctttcctgccacgaaacgggcgaatgccacgacggtggtgctgaggctgctgcagatgtacctccccgacgccgactccttctcggcgacgaatacctcggcgcggcagaggtcgtccacgtgaactgtcggaatggggccggttgctgccaggcctttcagggtttttagctgcgtctcatcacctgaaaaaacagaaaacagctagcatcgatcagtcgaatttgtgctcgctgatcttcttaaactaatttggcgcatgtctctcgatcaggttctcactagatagcaaggagagcatagctgagacgcttgttgcggccgtcggcgtcggcgctgcacccaaagtgaacaccgggaacacggtgatgaggctgatgttgttctcctccgctaatttgcatgctgccttctccatgagcacctttgagacactatacgcctgcgaaaaacaataatggggtatgctaacgttagtatagatgccaaatagatcgcccggcacagccatgcctagggtgaggtcagtcgggccggcctggccctacacaccgggacgtgccgtgccagctcacgggctacacacacggcccagtaagactcaagccgtgctgggctagcccgaaggcacgacaacctatcgtgcttctctacagaataagtctatttttcctacctaaactctgtgggctgtgttcatatggctgaaaaataaatctattttgtattcctcttgtctttgggctagcataagtctattttacatccctccactatttttgttcgatcatgccgtgccggaccggtccaccgtgccaagggagtggcccaagcacagcccggctgtcgggtcaggccggcacgagcacgaccccggttgggctgtgacgtgcttgggccgggctaaattggcatgccttgggctgggccgcgggtctcgagccatatggccatctataagcattagggcgtcatcatctttatggagtatactagtcttctagtagtagcattgtttcttctttttagagtttaagtacttctattcgtaacgtttgtttgagtggatatagagatggatttctatgcattatcaaaaaaattgtagggatgagatggaggctcaaaaaaggtagaacgtgacccaagctggtggcttctctttcgtcaggtactcgacgtcggaccaggaatcctcgtccaggacatggccgtcgccttgcagcggcctgccggagacggcgggcgccgacgatgtgaggatcacgcgcttcaccgtgccggctctcacgcacgacctcatcacattcatggttccttggacgccggcttcaataagctctttctgccataaattaacgtacaaatgcagctttgtcatcgtagaaatcaagagcaaattaatttcagaactggagacttagagagcatatatatatatatatatatatatatatcatcagagatgagacaacacaacatgcagtggtgtcgattagagaaagcgcgctaattagctagctgttcacctcaggattctgtgactggaaattcaccggagcggcgacgaggaaggcgtaatcgcagccggcaacggcatcgtcgaagctgccttcttcgtccatgtcagcgcggaagacctccaaggggcctagtgcttccaagtccttgagatgggaagtcttcttcatgtcatctgaatacacaagagtaggatcttcagaggcagaactgaactctggaaactcgtagtagcgtcgtcttgagaattgagatcataacgatttgcatcctttccagcatatttcactatatgaattaggtgcgactatcggtttgaacatgtaaatattttctacattatctaaaaaaaatattttctacatggtgcaggtaagagtggcatttggcatttgctaagtagaagggaaaa

SEQ ID NO: 31422 - DNA, 3589 bp, Oryza sativa
caaatttgactcaaataaaacgtgtaatttgcaaccaaatttgttatttttgttctaataattgtataagttgaaatttgaatatatctctggattggtatatatcttattatttttctagaatcttttttatcacaaagtaggactttctttctgttgttcatgacgacaattcagaaaatatgctactgcggaccaaagattccacccctgaatctgaaaggaaggaaaactttaactgtgcttagttcacgtcaaaattggaggtttgcttgaaattagaatatggaaaagttggaagtttgtgtgtagaaaagttttgatgtgatggaaaagttggaagtttgataaaaatgtttggaacttaacaagggctgaatacgtatgaacagaagattaaaacgggaaataataccacctgggtttctgaccgtcgtgttgacagcatatcccttctgaagcagcatcttgatgagcgccgaagcgatatacccgttcccgccggtcacgcacgccgtcttcatctcaaccgctgacatctcgtcgggaggacacgccgcctacttcgacccctcccagtccgcctgagaactagctaggacgacgatagttcagttattaccggcgttcctctgatctgatcgcctgtcgctaaatgcaacaaccagagatggtatcatatcatcgctgtttcaatttagggcgatgatgcaatcatgcaaggcgttgtttgtaattcattaccgaaagagtcttgcatccacaaactagtcccgtgtgtcctctgtcctgtccaccccttctccactgtgcaccatgtatatttctttttcaggtcaaagtacgtccaccatgtgtttatacacgtctggttgtacgcgcatggctcgagcagtgcaggacgcccgtatcaagattgctagttcccgcaagtcagcgagcgtttcgcgacggcagcgcctcagcttcgcgtctgacatgggcctgctgggcctagtgacttttcaacggtgattaacgatgattcagtcatgtacgtatatatgccccatatgcacgttgagtaacacactcaattagtaatagtatctcctaattgtaattggacaatccacgtacatacatgcacgcagtgattagaacatttaactaaactttttaacagaagattaaatttttaaattgaaaattttgaaaactttcaactcaaaatttgaaaactttccactcagcatttgaaaactttcgatttaaatttgaaagttttcaactcacaattttagaattttcatctcaaaattcaaaaactttcgattcaaatttgaaagttttcaactcacaattttagaattttcatctcaattcaaaaactttcaactaaaaattcgaaactttcaaatcaaattacaaactttcaagtcaaatttcaaaactttcaactcaatttttgaaactttttactcaaatttaaaaactttcaacttcaattttgaaaactttcaactcaacttgaaaacttctatatcaaaatttaaaaagttgaaatcaaaatttaaaattttcagctcaaatttcaaaatcttttgactacaaatttaaaactttccattacttttctaaaaaaaactggtaactgaattatttacgttgttactgttttaaaaataatactaatgacagtaattaacactaattgccataattagcggcggaagcgcgcggacaagacgtcgaggagacgcgcgcggctgcgcgaattaagcagtcggcgcgcacgcgcctcctaggaacccccggtaagtccgcgctaatgctagttagcgcgcgtgctgccggcggcgcgcgtttcaggcccagaaggcccagcgccgctgcgtcggcgcacgcgcgacttctccgcgctttttttcgtttttttaaccttttttccctttctttccactttttttctgattttttttatctttatcatgttttgagtttgaaagtttataaattttgagttgaaaattttcaaacctaaacttgaaagttttcaaatctcgactagaaagtttacatatctcgatttgaaagttttcaaaattttcaaatctcgagttgaaagttttcaaatctcgagttgaaagttttcgaatctcgagttgaaagttttcaaatctcaaattgaaagttttcaaaattttcaaatctggacttgaaagtttttgaatctcgattctcgagttgaaagttttcaaatctgagttgaaagttttcaaaatttgactttaaaatttaaaacttaaatcgaaagttttcaaatctaacctaaaatattttcaatctgttagtaaaaaaatctcccaaaaaatctccagaatctttcctagttaccaccattagtgttaactatattaactaatatagtggttaagactaaaggggaggagggagtgctcgctgttggcgcgcacgcgccagctagcagcccccgtatcgtatagttgtatgcgccactgttaacaacagaatttggtaagtattcgtatcagtaaaggggatttggtcaagaagagttggaggcggagatcgagttctggaacagagcaagaatcggctggagtctgaatcggctacggttaggatcggctatggctaggatcgcctaatgtcgggttaagctaaataagccgatacagtcgattctgacaaaagaacttgtgcgcgacgtccggctcaggttgatgtgcttcaagatgattgccacgcatggatagagtcctgggaaatcaattgtatctattaattaggattatttatgtaaattccttatagataagtgtgggcaagagtctgccgcaaagacttgtgatagtttagagtttgttagagataatagtcgtgtccggtatgggcatatcttgtaatcctcgggtataaatagaccccgagccctatgtaatttagacagacacattcaatataattccggcgcatcgccaccttttgctttagttttatttcgacgagttcttgctttcgggttgagctgcatcggtttcgatcttcgacaagaggtaaaactcgttatgacgaattatgttcttagggattagcgcttccatcttcatgacactcgtatctcatttatataattcgtcaagttatcatatattttacataatctatagcagtatcattgtctaatctatcttcggcagacatttgcacgcaaaagacagcgattaggttagatctcaacgttgatttagatatataagatatctaccattctatgaatcttctagcggcttgattgtctagatattgttcttcttttcatacttaatgctgcatcaatcgagtttgatctattaagtcgtgcttagaatattgatctctagcctgccacctagttgttgattagaatagcatcggagtttcagccgatcgtatctgatttaactacagttatcctatttgcttcattaatatgttaaatctgccatttatgttaagatactgccataactaaatatgttaaactcttgtttgatatattattattgcttcaatatcttaatatagagtagtatgggctgcagga

SEQ ID NO: 31423 - DNA, 1434 bp, Oryza sativa
ccatacacgcggagcgaaaacccacgaggggtcagggcgcctcggccctcggggccgaggggggtgcagcccgaccccctcggggggactaagaggagggcgaacacatcaccctcgggcccgacgtcccccgagggtgccaggccacgtgggcgattgtgtctgcctcaaacctctagtcatgatactcccgatcccatgtcaccgacagtagcccccggcgttatgccagggcgatcgccctccttaagggaagcggtcgggcgtgacgccactcctaaggcctggtgacaggtgggaccggtctccacaattgggcagaaaaccaaacggtcacaaatcacgcacatcggcagtggtaattcggctgtcaacaatgagcggtctcttcaagactgccacattactcgagtagcacacgaatctggacatggcgattcgtttcatctgaagatatggtaacgtcgcttcggttggcgagcgtaattaacgcgcgcacgatatgatctacctcgaccgccacaaccgcatatccacctcatgcgccgcaagcgggcgaatgggattagtggaagcgtgggcgcgagaaacgagggggcgaaatagtgggcgcgagaaacgaggagccgggcatagcgttggcaagggtataaaggcactgaggaagggacttgtttccttcctttcgccattattccccttgtctttgctgcttgcgccctaactcctcctttcctgcgccctaccctcgccacacgcgctcgctcttaatcttctcttcctccggcgccatggcacggggctccgctctgctcgatggtagcgtgctgccgccctcccgcatcgtgagcgagaggcaggctgggctgccgcgccgcttcatgccggaatcggccaccggccgggagatagtcacgctgggcgagggacgcccggcgccagactgtcacgtcctgataaattcatcccgaattaaaaatcattcgctaaaaggaataatagaattaattaaaattcgaaaagaaattggcaaacactaaaatacgtacaagaaaaattcaaatgtggcccggagaatttttgttaaattctccttggtctaaaaagagccctcaaattttagtggaattttcagagcacaaataataattattaagaaataaacaaagttaaaaaggtttataaaaagaaaaaccctaaaagaagtcttcttccccccccttcctctcttgggccggctcggcccacctcgctctttccctctctctcctccccgcggcccactcggcccctcccccgcgcgcacgccgctgacaggcgggcccgcccgccaccctcgctgacgggtggggcccacctgtcatcgccttcctcgcgccgctcccgccgcccgcccgtgccctagcgccgccgccgccgcggattccgccgcat

SEQ ID NO: 31424 - DNA, 2676 bp, Oryza sativa
ttgcattaattgtgcatctccggtgtggcctgctgagtactgtggttgtactcattcttgctcaatcttttccccccttcagtaagagaagctttggagaagaagtcttaggtggagtcctggcttataccccagttgagcgcctgtgaagatggagccgtaggcccgctagtccgctgctgtttatttttgtttgtcaggcctgaagtgcctttgtaataatgtaaatattatcgatataataaagatgtgtcttttataccatgtttgtgtggtgtaccccggcttttcctgggacggggattaatacactggcgttcgggaaaaggcaattttcccggtcgcgacacagactacccggggcggtccgtcttctttctcccttttgcaatggcagggctggttccgctattttcttctttcttcatggatgttctggagttctacgatctccagatggcgcacctcacccccaacgcggtgatgacattggccatcttcgcgcatctgtgcgagatgttcattggggtgcgcccatctcttcggctgttccggtggttctttaccgtgcagtcggtgtcgccgccatcggtagtcggtggctgctacttccagccacgggggccggcgctgaaccgctacatcccctgcgccctccgcaagaagtgggacgactggaagagcgattggttctacactcccctcgccgacgaagcgcgcctccgacttccgagccagcccccggcgcaggcctccagttggcgggcgccggtagatctgggggatggctatgacgctgtcctcgaccgcctggcgggcctgcgatcccaggggctcacaggggccatggtgtatggcgactacctccgtcgtcggattgcgccgctccagcggcgcgctcggggcgcctgggagtacaccgggtccgaagactacatgaggacccaccagggagtgagatgggactgggctcctgaggacttcaagatattggtccaacgggtgctgaatctcaactccgtggaggcggccctcattccccaaggaatcctccccctctgcagcgatccagaccgcgcctccatcttgaccattatgacggcagtcggggcctcagaggagggagctccaaagggccacgacggcgcaggcgggagccgcaagggggatcaatctaccccaggagggggtcgtgcttctgggccccgcgtcaggggctcggggagcaaccgccctatcgacgaccgggggaagaggaagctgggacgaacacctcccccatctcctccccgagggggcggggcagtgcgtgccagcagcaggcgcccggagggggccgcgccaacatcacagcccgagggggagcgcaagaagaaacggctccgcaagatgggggagacagaaccatctcggggaaacctcatctcccctccaaagtggtcgttcaaccgaccccctcgcaggttcatctctcactcatcgtggctgtatccattctcttcaacgcgagttttcactcacccgtctttgttcgtcttctggtcttttcttctgttttagcgagatcccgtcgcgtccctcccgtcattccaagtctggccaatctgaggccgaggatccggcggccgcagaggcacggaggcgagaatctgaccggcgagaggccgcagatcgcctacgggaagctgaagaggccgcccgggaggccgcccgggctcgccaggctgaggataccgctcgggaggaggccgcccgagcccaccaggccgaggaagccgctcgggagaaagccggatttcgccaggacgaggcaatggtttcttccgaggcagctcgcgacgaggtcgcgggcgcatcgcttgggcccactccctcgggcgacgctcaggcgacaacttccggggcagctggcgacgaggctgcgggcgcgtcgcctgggcccactccttcgggcgacgcccaggaccaaacaggtccggggaacatccccgagtccggcacgtccattggcgggccgagccgcgcgacatcttctccaaggcagctcttccccacgccttccgtcgccccgctgagcgcagagccccttctgcaggccttagccgccgcaaacaccgcggtgttggatgggttaagtgcccaggtggaggccctgcaggcggagcgtgcggagctcgacgccgcatgggcgcgtgtcgaggaggggcggcgatcggtggaggccatggtggaagcgggccgcaaggcacaccgccggcacgtctcagatcttgaagcccgtaagacggcgctggcggagatcgctcaagaggtggaggaggagcggggggctgccctcatcgccaccaccgtgatgaacgaggcgcaggacaccctccgccttcaatacgggagctgggaggcggagctaaagaaaaagctcgacgccgcccagggggtccttgatgccgccgctgcccgagagcagcgagcaacggagaccgaaacggcgctccggcggcgtgaagaggcccttgaggcgcgtgccatggcgctggaagagcgcgcctgcgtcgtggagaaggacctggcggaccgcgaggccgccgtcgccatccgggaggcaacgctggcggcgcacgagtctgcctgcgccgaagaggagtctgcactccgcctccgcgaggacgcgcttgg

SEQ ID NO: 31425 - DNA, 954 bp, Oryza sativa
acgcggcgtaagacgaggtcgtcgacgcagagtgatcgggcccggacgtggcgctgatggtagcgccgcaggctctgctggtagcgtgcggctcggagggccgcacgccgccttcgttcttccaagtagtcgaggtcatctctacaaagctgatcttgatcagcctcgcagtacatggtggcccgaggagacctcagggtgagctcggatgggagaaccgcttctgcgccgtagacgaggaagaaaggcgtttccccggttgctcggcttggtgtggttcggttcgcctagagcaccgctggcaactcctcgatccatgaatcgccgtgtttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagtccccagacagcaaatggccacgaaagtggtatggtctgcagggcctgggccggctgatggatttgcttggcgtggaattgacacgctctacatcggtggaccaggtcgaccgcatcattgagagctgtcggccaatagaaaccttggcgaaaagctttaccaaccaaggtgcgcgaggcggagtgtgctccgcattcgccttcatggatatcggcaagaagcacaacgccttgttcccgaggagtgcacttcaggaggattcgggctgcagga

SEQ ID NO: 31426 - DNA, 2497 bp, Oryza sativa
tttttttataattcgtatttttattgttgttagatgataaaatatgattaatattttatgcgtaagttgtctttttacttttttttataattttttcaaataagatggacggtcaaatgttaggcacggaaatcagggtttgtttgtctttttttttatggagggagtactcttttctcaaagtagttgtacctcccaatatgatgatctatgaccacgagacatgacaacaccaacaatgaccccgaccaaaagcaacctcagtacgctctgctcagtgcttggggtcctagctgctcctatttggtgcgtgaagcaattctcactctttcttcgtctactaggagaggcgaagtagccaactaaccgcggcgatgtcggcggttgagaggaagacggcgtgcgtgaccggcggcagcgggtatatcgcttcggcgctcatcaagatgctgctgcagaagggatacgctgtcaagacgacagtcagaaaccccggtgagattcttcttacttctcaccccaacaatggtctgtagatcgtcttcagttcattgattttgtgtgtatgcggtgacgatagatccgggcagtaacagcatgctgtgtgcatagaagattttgcggtgttctgtttggtagaagataaatgctgatgtttgatttgtttcaagttgatatgaccgaagaaaactatttcgggaattcacaagaacaccattggtttggcctctgaaactgcagcgcattgtgattttgagttccagatgatatggagaagaactctcatttcaaggagttgcaagcactaggccccttgaagatcttccgcgccgacttggaagaggaaggcagtttcgacgaggcagttgccggctgcgattacgccttcctcgtcgccgctccgatgaacctcaagtctcagaatcctgaggtaaatgcatgcagacacgtagcacatctcccaccaaactcagtgccattgtggggccaagtgccactcgatgttgtccacttgtcctaggtagtaattgccacttgtcaagtctctgatcgctgccaggccactgttgattagatatcaattatgtcacattaattactattccttcctccaaaataagtttgttttttacctatctcacacaaaccaatatttacctacaagcctataatatactcactttattaaatcccaatataattatttctatttttatttattctcaatacatatatactatcatattttcaagaactctaatgtaatgattagttaaaaataaatttattttgggataaatgggagaggcttatcatactttcacatgatgtaatgattactttaaaaataaatttattttgggataaatagaaaagtctaaaactgaatttattataggacggaaggaataatatttcctcccataaaaatcttgtctctgaaataataataataataataataataataataataataataataataataataataataataataataaacaactttattatgtacgtgtccaatccaatactatgttgttttattttgaaacgggagagtacttttacttgtatcgtcacgattaatttacttggtttgtctagtaaatcctctccataataaccagctgaaataacgatctagagtattatttggtaatggcagaaagaactgttggaagccggcgtccaaggcactctgaacgttctgaggtcgtgcgtgaaagccggcacggttaagcgcgtgatcctcacatcgtcggcggccgccgtctccggccagccgctgcaaggagacggcaacggcagcagccatgtcctggacgagtcgtcctggtccgacctcgactacctcagatcaaccaacgggatatctcctgctcaggtacacacaaacttacaaaattttacatgttcagtcagagttgatagtacagtcgcttgcgtgagagcacagcggtggtgtttgcgctgcaggcttacgcgatcgccaaggttctctcggagaaggaagcgagcaagctggcggaggagaacggcatcagcttagtggcggtgtgcccggtcgccaccgtcggcgcgtcgccggcgccggtggccaacgagagcgtcgccaacgtcctctccttgctgtccggtgagtacgtaagcaccggcagtattgtttggagatcatggatggaaactctttccctccgcacggaaaacggaacagttcattaacacatgattaattaagtattagttaacttttttaaaaaaatagattaatttaatttttttaagcaactttcatatagaaagttgctgcaaaaacatattgtttagcaatttgaaaagcatgcgcgagaaaaacgagagagaagattgagaaccctcagtagcaaacacgacctaagtgtgctagaataaactccttcttccaaaaacccaacctagtattagaatgtaatataatttagtataacgagagttttcatggtgg

SEQ ID NO: 31427 - DNA, 6703 bp, Oryza sativa
  unsure (1)..(6703): unsure at all n locations
aaacagcagtgaatttgttcccatccgcttttatgaaaaacgtgcctattgacacgtcaaactgttcaataaaattgtgctcctttcaacattttctcaatttctacccctcaattttcacatgcacaattaccaaacgattaaacaatatgttttttacaagataaaagtatagaaaagttgttttaaaaaaccatatcaattcatttttcaagtttttcagttaaatagtatttaattaatcatgcgctaatccgtcactccgttttatgtgtcgggaggaaaggattcacaaccctcactaaagaacacaacctaattgtggctctatgattttcttttttgaaacaagcaagagatctgtcatttcattaagtagcaaagaaaatattctggtggaacaacgaagcctcacaaggtctttcaaggtccccagttcagcatctgaagatcaggtcgtgttaggccgtgtttagttccaaaataattcttcaaactttcaacttttccatcacatcaaaacttttctacacacacaaacttctaatttttccatcacatcatttcaatttcaaccaaacttctaattttgatgtgaactaaacacaaccttagtgtgggaaagttattacagagatgcgaagacaacttcttcctccttttctaaatatttgacgccgtttgatttttttaaacatgtttgatcattcgtcttattcaaaaaaaatatgtaattattattttttttctatcatttaattcattgttaaatatactttcatgtataaatatagttttacatatttcacaaatttctttgaataagatgaatgatcaagtatgtgctaaaaagtcaatggtgtaaacatagggagtactaataacatgaactaacttgctagcttttttttttatgctagctctctcagctcaactttgcgggcatcgcaggaattactttttggtatgattaatcacacacacaaacgagaagtccaattcgcaggcatgcagcgttgggttacttttcaatggcgcgtgtgctgttcctctctcgcttttgtttgcatagagaaagaaacggatcctatcattttcaacgatgttaaatcgtcacaggcttcagcgtcagatgtactacctctatcctaaaaaaaaaagttcaattctaagaatgaacctgtacacacgtcatctgggaagataagatgatccttttttcttggagcaaaagctttaccttttgaaaacacgatcgaccgcattaaaaatgtgaagcgtgagatgttcatcgatcgacataatcgatcagtgcaggtcattatctaaggaaggaaaatcaatcagaagagcaggtatggtgcatgcatcacgaaaagcatttcttgttctgcctctctgtctggcgactggcgtcgtcgcttgtaaaatagtgttggctaagtcaaatgtattatgttcctgctctccgggatttgtcctggcaagtgccacaacagcgcaatcagcaaaagaaacctcatcatcagtgtgctgctcggattctacctgggagtaaacccaagtcaccttctctgtcacaggagaggtattaactgaccggagagagagagagagacgatgtcgtcggaggttgagaggaagacggtgtgcgtcaccggcggcaacgggtacgttgcttcattgctcgtcaagatgctcctggagaaaggatacgctgttcagacaagcgtcagagatcccagtgagattctactccctttctttcttgttacatgtttttccagtgttcagttttaactgaaaatcgaagaacatgtcatcagttcataatttgtttcagaggagtatttgcacgttcagttttgggattgattgtgtcagtacaattttggtttggcctctgaaactgcttttgtaactctgaatttcagataacccggagaaggtctcccatttcaaggacatggaaaaactcggccccctgaaggtctttcgcgccaacttggaggatgaaggcagcttcgacgaggccgtcgccggctgccactacgccttcctcgtcgccgctccggtgtacgacaagagccacaagtccgacgatctcgaggtgaccactgctgcaacctgcaagctcgattagtatctgtagtcagttagttagttactgaattctgaacttggccatggcagaaagagatagtccaaggcggcgtcgagggcacactgaacgtgatgaggtcgtgcgcgagagccggcacggtgaagcgcgtgatcctgacgtcgtcgacggccgccgtctccagcctgcggccgctggaaggcgccggccatgtcctcgacgagtcgtcctggtccgacatcgagtacctcagatccatggagaagctgtcgccgacgcaggtacacatatatacacacgagctgttccatgtcactgaaccacagcaatgtctcgtagaacatgagttcggcgccattgttgctgcatgcactgcaggcgtactcgatctccaaggttctttcggagaaggaggcgaccaagttcgcggaggagaacggtctcagcctggtgaccctctgcccggtcgtcgccgtcggagcatcgccggcggtgagggtcgataccagcgtcccggcctgcctctcgttgataaccggtgaggaactatctagcgatcaccgaatgaatgaaacaagaagcaatccaagaactcgacttctgaacgtttttgggtcgctgcatcgatgatctgtgaattttttttttcaggcgacgaggagatgatgaacatcctcaagggcatcgagaaggcgtccgggtggtcgatgccgatggtccacatcgaggacgtgtgccgcgccgagatcttcgtcgccgaggaggagtcggcgtcggggaggtacatctgcggcagcctcaacaccacggtcaccgagatcgccggcttcctggcggccaagtacccccagtacaacgtcagatgcgattggtaattaagaaattaagctttatgcattcgtgcatttggttatctgaatctgatcatgcgttgctatgtacgcagcatcgaagagcatcaccccgagaagccgaccatctcgctctcgtcggcgaagctcatcggcgaagggttcgagttcaagtacaagaacctggacgagatgtacgacgacctcgtcgcgtacggcaaggccctggggttgatccccaactgatggtgatgatgggcggcgtaattccactgctttggcgattacgaccaaacgtgtgttgctttcaaaaatactattgtgtctagcattctattgctacattgctagtagtactagtaccaagttccaatacatttggcggtttggctgtacttcgttctgttcatgtaagaggaggattgagaatttgagatcctcttagggggtaagctgtctaattctccggaaaggattagctgaaatcctctaatagtttttgcaataccaacgtactttcccggtttnnnnnnnnnnnnnnnnnnnnnnnnnnnnnaaaaaaaaggttgtgtttagtttcttggccaaatttttttagtatacggatatacatttgaagtattaaacgtagactaataacaaaacaaattacagattccacatataaactgcgagacgaatttattaagcctaatgtgtccatcattagtaaatatttactgtagcatcacattgttaaatcatggcgtaattagactcaaaaaattcgtctcataatttacatgcaaactgtgtaattggtttttttccacaaataatactccatgcacgtgtccaaacattcgatgtgacctttttagcaaaaaaaaaaaatctaaacacggactaagccacatgactttgagtcactaacatgtgggccctctttactatggatccatgtgaatccgtaatgggaatgttgtggtctggcacgcgttgaaaaaaaaaaaactctctgaacagcgtttctacctgctgcgacactgctgctgctgtcaggtgcagccgagcaggttgagaaggccaaggccacaaatcgatcggtcaattgctcacgctacacgacggcatgcggatgcgggcaatgcgagcatgcaaaaaccacagacgtcacacgctgcctggctctgtcacgtactggccacctcgtgtttcacctgggcacggtggccggcctgatcttttgtgcagtgcgtggacgagatttttgagcgcgacgggcacgtaaccaggcaccggggcgatggatgcgcggcaagccggcaacgacaatatccttggcatcaacctccgccggtcgtcaacgtgggactagggatggcaattgtgcccgtttgcccgtttacccgcgggtaaaaaccctattagggttgggtttgttctccattttatacccatgggtatcttattgggtcaaaagctatgcccgatgagtaaatgggcatgggtatgggtaatcactacccatgcccgctttgcccgtttacccacgaaatctaacttatatgtaggctaggagcaaaatccactagaatacataagcccagttctttgatttcttcggtttcccttttatttcccttattatttctctcctcttactctatcgccgccagaggagagacacgacaccgaggtggagaatatttgatgttttaagttcgattcgaacttagtagcttgtagactttttgttccactgcttttgttgtggcgggtaaacgggcacgcccgcgggcaatgggcataggtaaccatccttacccgtcatgtagtaatgggtatacccacgagcacaaataatctcacgggcatgggtataggtaggcactacccgtgcccgtcgcgcccgattgccatccctacgtgggacaaggcgaacggtggaaattagtgcagagaaatcagtcaacggatcgcgcatgcgacctcccgctcactcccggcgcgtggtcgcgcattcccgatcccctccctcgcgggctcgcggcccaccgcggcctgctagctttctagcgcgcgcgatgggctgcccctgcctgctcggcatcagccccaattaggaaaaagtggatttttttttatttttaatttttttattaaaagttttacaaaaataatttttcattttgaaaattgacggaagtagtcgcctaccgccctctgggagggcgatttttaaaaatcgccatcccagagggcggcaaaaatgacgtggcagacggccgttcgctctcgggcgacggccgtcaacgaaatttgtaggcggcccccttgccgccctccgctagggcgattttgtactgtgcggggggccgcctgcaaatgggcggcgagggggcatggaattttgcaggcggcccccttgccgccctgggggagggcgatttttgcctcccccctataaagcccagtccctcctctctgaaatttcattatattcactaaaaatccaaaaaaaacgaaagagagagaggggagggcagcagaaggggagcggcgaagccctgctggttcgctcacttcatcacaggtatgctcccatacatcttttacatttgtactaatatgttatgtttgagtatatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaattttggagaacaatattgtagagaatgtaacttagggcgtagtacagaaatgcgaggttaacgcagttattgttttcatcaggcacaatgtcaaataaggtcacattttagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtatcagttgtagtgagtcgtgcaacagaaggttatttttgggaactaatgccgatggacagcactgctgcttggagacggtatgtggaaatggcttttgaacggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggccatgggcatggcggatgagggggagagagtcggtataattgttgatgaaatggagagggaagattcggataatgaggaagcggacgacgacgcatcatccgatgaggaaagtgatgtaatggccactgattgggcaaatgaggacttctctggacttgttatatcagagggtgatcatgtaccctgggagtataaggagaacgaggtaattgagggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttag

SEQ ID NO: 31428 - DNA, 834 bp, Oryza sativa
tgggaacaaccaggttctacctatggcttttgcatttgtagagagtgagaacactgaaagctggtattggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcgtccatcagaaatttcactcagtggattgagaatgagcctaaggagaagtggtctctattgttcgacaccgatggatctcggtatggcataatgacaaccaatttagcagaggtgtacaactgggtaatgcgaggagttcgggtacttccattggttgctattgttgaattcatccttcacggcacgcaagcgtactttagggatcgatacaagaaaattggtccgtccatggccgataacaacatagtgtttggcaacgtagtgacaaagtacatggaagataaaatcaaaaaggcacggagacatagagttgttgctcaaggcacacaagtgcatcggtatgaaataatgtgtgt

SEQ ID NO: 31429 - DNA, 4837 bp, Oryza sativa
ccgtggactgtgtttttgggtggaaggaggatatcactgcgcgcttcgagcaggtgatgcgccttccacacctaggaccggccaacacccttcctccgtactctacagtcgggcctagcaaggcttggttgctccagttcactgtaagtaaataagttgttattatcatacatgcttatttgcgatcaacagagtgttttgtactaacatttcattcttaattgtaggcggaccttctgcaccctgacgctgatgattactcggtccgacgctcccttgaggcgtacctgttgttgttgttcgggtgggtgatgttcactagcacccacgggcacgctgtggacttccggctggtccactacgcacggttcatcgcggatgctcagccacaggacgtgccacagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtcttctttttttcttcacataacatgtctaattccgatcatgtttattgcagcgtcgttacgctcacgtccaggtgagacgaggttacccggacttcgtgttcgagtttgaccgtctcctgccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcatgtgatgagacagttcggacttaggcaggtgtttccgggcaacgtgcagccgaccgtcctccttgccgaccactcgtgagttcggattgttcatttctaaatttttatgataattaagcgatcatcgagccatataatgtacctctcttcacatgttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtgggggtacgtcgaatttgtattacttcttacaattatttcatttatcttgcataatataggacaactactgaattttttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccatggacgtcgtacctccagctggtccggtgcaaccacggcctcgcgtgcctaccgtcggagcaggacctcgacctacggcacctgtttcgcacggtactgctcagcccagaggtttcttaagttttgtttctgtttttgtacgaaaacatcaccccgtcgtaacttgatgttccatcctcgcaggacctcgtttgccttcgagcgcccctagcttcggagcagtgcgacctacagcaccggtttcgcacggtacagttcagcccagatattagttcatttttgtttcagcttttgcacgaatatgtcaccatgttttaactgcacgtttcctcatcgcaggacctcgtctgccttcgagcgcgttcgcaggcacgaccggcacttccgcgagctccgcaggggcgttcgccacctcttcgggcgcgttcgccagctcttcctctcacggagcgtcgatccctcgcccacacggtactttactttttattaatactattaaatacctgtatgaaactgatagtccttgtccagcaggatttgcagccgggatcttcggtactggggcctcttcgtctcacgccggtaggactggtcctactagccagttctacgacgacgacttgcacggtgcacaccaccacgacgtactaggctcctctcagcttggaggagctccagaggcgcacactcaggagcagccagaggtcacacctgtacaggcaggacgagttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacgcactttcggcgcttcatggtagtgtcagatccagtagcgcgtacagtccacaacagcacacatgaaaagcggcagctcgagttatcactatcaactttcggcgctgccttgttgacataaagtgaatcacgcccacgcgtgatcgtcttgtcacatctaatgaataatgtatctcattgagttcacatatattgcagtgaaaacgacgctatataattgacaattgaaggcaacctcttcatatcttctttcccactagcacacaacacacgaaaatggaagcctattcattggtaatacataatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacattccaactatgccctaaaaaataataaaattgtattttaccagtcttggagattttaatcttgtatagttttcaatataaaaagatttgataactattgatatttataaaaaaaaatatagcacagtataaatcgccctcccccagggcagcaagggggccgcctgcaaaattccatgccccctcgccgcccatttgcaggcggccccccgcacagtacaaaatcgccctagcggagggcggcaagggggccgcatgcaaatttcgttgacggccgtcgcccgagagcgaacggccgtctgccacgtcattttcgccgccctctgggatggcgatttttaaaaatcgccctcccagagggcggtaggcgaccacttctgtcaattttcaaaatgaaaaattatttttgtaaaacttttaataaaaaaaattaaaaataaaaaaaattcggaaaaagtgcaccgaaggtccctcaacttgtcagcgagatacaaaatcatcctcgaaccgcaaaaccagatatgcgggattccttaactatacaaaaccgatcatacgagattcctcggcggtttatagcggatgagtcagcatgggacccacgtggaacccacgccacctcatctcttccctcttatttcccctcttctccctttctctctctcacttttctcagccggcgacgggcggcgctgtgggggaggaggccgccggggggaggggagaggagaaggtccggcagccggcgtcgcgccggcggaggcaacgccgccgtcagcatcctcccttcctcctctctctctctctctctcactcttttctcctgttggaagccggccggcaacgaacatagtggcgcggcggcgccaccggggagggtggtgctgcgtggggcacgcggcagaggtgggcggcgccggtgccgaggaggaggaggtcgtggcactgtcgtcgtcgtcgtcctcggcgtcgaggaagaaggtgggcgcggcggcggaggctagggggttgccgcggctggtgcggtacaaggtgctggtgctcgtgctcgtgctgcagtttctgtacagcaggcaggcgtcggtggcggctcccaatagcgggccgctcccggggtgcggcgcctggggttgctggcacacgcggtgcggcgccgccgtcgacctcgccctcgacacgctggaagcttgtgtacgcgtcattctatcttgggaaacatggctgcagtgctgcacggtttgaacttcaggtttatctggtaaagatcaaatggtgaactgaaaacagtaggtgtccatcttgttcaggcagagatgtgtttataaacttcagaatctgtattactcctggtcgaggtagaagttgatacttggaaattggaatgataaacagatgatattctcgttgtttatacacaggacaagctacaggtttcgcagaattaaaatgcatacgaatgcaaagagaatttgtcctctgcttgcaaggggccaatgatatatactgtatgagaagaccaacaaaaagattcctgtaagagattctgggcaatgttcagagttcagagacttgcaaactctcagatgatggacagtgtcatcgaccataacccggtcagaatgtctctataccaattttgcacaaatctgacgacgtgatatatatcataatcgagctgaaaagattagcattggctagttacaaacagcaagttgacaggctataataatctcatactatactcctacttgaaaaggattcaaaagattgcttctttata

SEQ ID NO: 31430 - DNA, 1250 bp, Oryza sativa
ttcctgcagcccttagacaagtttgaccatgttagatgattgtttggttggcttccacaagtgtggcaagattcctcttttgtaatctaggtcccacatgtaagtgtctctaaaaagtgtggcatggtttcattttgttggctagagtgtggcttggattttgatggcctcatctttggcaagtttggttaagaaagcatggtaaacctagtcaatgttagtatctgaaccaaacagccccttaatctccatcttcatcttcaatattcaaacaccaccgtagtattgtgtagtactctaccagctatgcttaccattgctgagagcagcgtgatatgacgatctatttgtccactccatattgacacttcaatcaaccacccaactcgcaccgcaccggttttattttataataaaggtgatattctggatatagtgctcgtcagaatgtttcttttaggaatacttactgataagcacgccagaccacctcactggctcactacacaaattgaactctttccaaagaacagcaacaaaaataaattcatcgtcctcttcgtcatctgggctggagaggttgtagcgaccgacgacgacgatgtcggcggttgagaggaagacggcgtgcgtcaccggcggcaacggctacatcgcatctgcgctcatcaagatatgctgttggagaagggatatgctgtcaagacgacggtcagaaaccccggtgaggttctcctcctcattttttcactctctaagttcatgttttttgcagtgtttcttccattcagttcaggtgtgaaatcataggccagctagtaccatatgagctttttagcgagtgttttcgcttaaccaattagcaaatggcaggcttagccgcacatgaggacaaaatcttatccttttccaacttccaactgatagttacatatatacatatcgtgacatatgatggatcgaattattatgagactttatatgatctcaaaaagatggtgtgaattttcagagttcagtttcacctctcaaagattctactaattgctgcgatttgtattcagatgacatggcgaagaactcccatctcaaggacttgcaggcacttgaccccttgaaggtgttccgtgctgacatcggcgaagaaggcagcttggacgatgccgtcgccggctgcgactacgccttcctcgtcgctgctccgatgaacttcaattcagagaatcctgaggtgaaaagcttacaccctt

SEQ ID NO: 31431 - DNA, 4157 bp, Oryza sativa
cctgcagccctctccatttcgtttttttttccgacgttgatggtggcagaaagatttggttgaagccgccgtcaatggaacgctcaacgcgatgagatcgtgcgcgaaggcggggacggtgaagcgcgtgatcataacatcgtcggacgcagcgatctccagaaggccgctgcaaggcgacgggcatgtgctggacgaggaatcctggtctgacgttgactacctgagaacggagaagccgctagcctgggtgacgttcctctcttgacattttcacatctccatcttatccataaatttaagaaaacttttacagtattatactgacagtacaaataatcgaaaaaaatattattttttcctcctgcttcaatataatatagtataaaattaaaggggataaaattgtctttttatactattggtggagggtaattctgtaaactcataatttatagtgaaatactcccaccgtctaaaaaaccatatgtcacattctagcactccctcagtattttaatgtgtgacgccgttaacttttttatcaacgtttaaccattcgttttattcaaaatttttgtgcaaatacaaaaatatctatgtcatgcttaaagaacattagatgataaatcaagtcacaataaaataaatgataaatacatttttttaataagatgaatggtcaaatgttagtcaaaaagtcaaccgcgtcataaattaaaatacggagagagtacgaggttgtgttttttttaggacggagggagtagagataggcattattttcaccaccatgaggtgccgcgccgctgcaaactagcacaatggatgaaaattattaaaataccattgttaatttaataaaaattcttaaaatactcagtatattgtatagaaaagttctctaaatttagggcctgtttagattgtaacaaaaataaaccttaccaagttttggcaatgttaaaattttggcaagatgctaatattatcaaaattttggcaggatttcttatatattgactaaatttagcaataaactaaacatagactttttttataagtttaccaaaaataaatattgtatggttgaaaatggcgtttgcgtttgcaggcgtactgtgtctccaaggtgcttttggagaaggcagcatgcaagttcgcggaggagaacaacatgagcctcgtcaccgtattcccggtgttcaccttgggcgcagcgccggcgccggtggcgaggacgagcgtccccggcatcctctccctgctatccggtgagttagaagcaccagcaccagcgatcaaatcaacaagctagctcccaccaaagtctcaacacttgcaggtggttcttagatcccaccttaaaaatttacaccccgtcacatcgaatatttgaacagctatataaaatattaaatataggctagaaaataactaattacaagattacgactaatttgtgagacgaatctggtattacagtaaacattcgctaatgataaattaattaggcttaataaattcatctcgcggtttattagcgatgctgtaattagttttttattaatgccccaacaactcttacgacaccctatataatatccgatgttacacgccaaaactttaccgcgtctctgaatataaacacacctaagttggcttctgtttattacttctcaggtgatgagacgcatctcgaagtcctgaagcccctgcaatcgttcaccggctacgtgtcgatcgttcacgtcgacgacctctgccgcgccgagatattcctcgccgagaaggagtcatcgtcattgtcgtcggcagagtcgtcggcgaggtacatctgctgcagcttcaacaccaccgtcttggcgcttgcccgtttcatggccggaaggtacccgcagtacaacgtcaaaaccgaccggtacgatcgaattgttggccaacttcgaaatccaacatagatatacatgcatgctgtgttcgatctgacgagcgagtgatgatctctgttatctttgcagcttcgacgggatgcctgagaaaccgagagtctgctgttcgtcggagaagctgatcagggaagggttcgaccgttcgagttcaagtacacgaatttgggcgacatacttgatgaccttgtggagtaaggcagggccctgggaattctaccacattgaacgaacagctcatgctgctctactttcaacctactcccttcgtcaaaaaaacgaaactaagactggatgtgacatatcctttcgtccaaaaaaacgaaactaagactggatgtgacatattctagtacaacgaatctggacaggtgtatatccagatttgtaatactaagatatgtcacattcagtactaggatggtttaggatggtttttatgggatagagggggtagatgtcacgaggaccaaactatatatgcgcttgtgaaataagtggtctgtgcctttaaacatctcaaagaaaaaaaaatacagtgttttaagatgagcctaatacacagtagataatggcaaaaaaaattaataccttatagggtatcctttggtcttgcatgtcatttaaatagttatatatatttttaaaaaaattaacaagattcatttggatgatacgtaagaaataaggagatgtccattttgagggaccaaggctccgttcatttggtctgttagggatgccacttgtttttttagccgcttcccaaactgttaaatgatgtatattatgaaaagttttaaagcttctttaaaaaaaatctaataaaaccatttgtcatatttatagtaattaatactccctccgtttcatattataaatcatctagttaaaccttttaagtaaagggtttgactaagtttataaaaaaaaactagcaacatgtaaaaaaaattaatttcattaaatactacattaaagatattttaataatgtgtttgttttgttttaaaatattgctatattttttataaacttgattaaatttaaaaaggtagaatagaaaaaaaattcaaaacaacaatactatgaaaatggagaaagtattcaattaacctgacactaataatttagtctcatttagcatttgtgaaaaatcctaaatttctagcaccacatccaaactcagcccaaaagagcttatccggatagtggccatccactttgcccaaaaagaaacgtgctatgcagcctcgggggttccttatttagtgtatatgcgctagcaaagtacgtagtgcaacactttatccaatttcctttcttgttaaaaacttttaactcagatttaaaagcttgcatgtgaagatttgaaaattttcgcattaatatttaaaatttcaagtcagatttaaaaattttcaaataaggatttttaacttttaactcaagatttaaaactttcaaatcaaattcgataacttttaaccatgatttgaaaaaaaataaatctatatttgaaaatttcaactcagaattgaaactttcatttcaaaatttaaaactttcaactcaaattcaaaacttccaaatgaaattgaagatgaaagattcaatttctaaaataaaaaattcgcaaaaaaatagccaaaaaaaagcgcatgagggcgccgcgtaagctttccttcccgttcactcccaggctctcggcgcatggtcgcccattcccgatcccctccctcgcgagaaaattgcatatgtaccactcgtaaaaactggcttcgctataatgccattctcaagataggattcgcccaaacgccactcttaacacgtgggtattcgctggaatgccactttcgggcttttttccatttcgaaaatacttttcatcaatttcaatttttcttggactattatgcccctgagtcaactgattcagtcggactctttcttctcttcgtttcaatctagcgaccgaacgcgagaagtcgagaagagaagcggcagcgacaccggcgccgcccaccaccactgcatcgccgccgcggcgtgcctcaccggtcccgccccccaacagctgcgccgccgcctctccccggtgagtctcctccccagccgccgcctatcctcagcgaaaccctaggcaccgagccggccgcatcgacgcgtacggccgtgctgtgtccgccggtgaggtgctggcgg

SEQ ID NO: 31432 - DNA, 2261 bp, Oryza sativa
gaagccagtttttaatgagtagtacatatgcaattttctcctccctcgcgggctcgcggcccacctcggcctgctagctttctagcgcgcgcgatgggctgcccctgcctgctcggcatcagccccaatgaacacggtgcacagggatagtcacacgacacggcgcgattgcagtagcactgtacctaccgtccgtcccatctctcgatcggcttatggacaacgtgtatgacgcacggccgtattaacgtcagttggatgccgatggacggccatgaatccatcggtccagacgcacgcatgctcctttgactctaccagctacgcataccattgctgagagcgtgatatgacgatcttgttgtccactccatattgacactttaacccagctgacgtgcgtaatcgacgctccgactcaggacctgtttagattcatgggttacttttcagtcctctttcaaatagctgcaaataatctaaaagttataaataggtgagctatttcagggctatttgaaaataacacatccaaaaaaactatcccccttaagaatactaattagggctatttcaggtggggcccactaaaaaatgtcttttctctttatctctctccatgagaaagtgcattaaagattaaatagctcttaaaataacccttggatctaaacaacttgagactattttattggatggctatttttttcttaaaaattagtagtttttaaaataactcttagctaattctctatacatgtctcaatcaaccacccaactcgcaccgcaccggttttattttacaataaggtgatattctggatatagtgcatgatgtcagcatgtttcttttcggtagtacttaaaaaaaatcttactgataagcacgccagaccacctcactagacaaattgaactcttcccaaagtacagcaacaaacataaattcctcgtcctcttcgtctcatctgggctggtgggttgttgtagcgaccgatcgacgacgacgatgtcggcggtcgagaggaagacggcgtgcgtcaccggcggcaacgggtacatcgcttctgcgctcatcaagatgctgttggagaagggatatgctgtcaacacgacggtcagaaaccccggtaagattctcctccttttttcactctctagttcgtgttttttactttttttgcagtgtttcttccattcatatgatcatatcctcggcctgctagtaccatatgagctaattagcgagtgttttcgcttaaccactcattagcaaatggcaggcttagccgcacatgtggacaatatcatatctttcgaaagggagaagttgtcaaatcttatccttttccaacttccaaccgatagttacatatatatatcgtgacatatgatggatcaaaatatgatgcgactttatcaatacgatggtgtgaattttcagagtttcagtttcatctctgaagattccactaattgctgcggtttgtattcagatgacatggcgaagaactcccacctcaaggacttgcaggcacttggccccttgaaggtcttccgcgccgacatggacgaagaaggaagcttcgacgatgccatcgccggctgcgactacgccttcctcgtcgccgctccgatgaacttcaattcagagaatcctgaggtgaacagctaattaacatcactattgactctgatactctgtaactgatgtgctctactaatcttgatttcctttttttttttttttttttgcgatgttgatggtggtggcagaaagatctggttgaagccgccgtcaatggaacgctcaacgcgatgagatcgtgcgcgaaagtagggacggtgaagcgcgtgatcataacatcgtcggacgcagcgatctccagaaggccgctgcaaggcgacgggtatgtgctggacgaggagtcctggtctgacgtcgactacctgagaacagagaagccgccagcctgggtgacgttcctctctcttgacattttcacatctccatcttatccataaattcaagaaaacttttaccgtacaatatatactaatatatgctactactagtatgtgctgccagtacaaacaattcaaagatttttatgaatatttccttgtgctttaatatattatagtataaaattaaagggggtaaaattgtctttccatactattggatgagggtaattatgtaaactcacaacttatagcgaaatactccctccgttaaaaaaaaaatctcgtaacatcct

SEQ ID NO: 31433 - DNA, 1933 bp, Oryza sativa
agaatgaaaattactaaaataccatttttaatttgataaaaattcttaaaatactcagtatattggaccgaaaagttctttaaatttaccaacgaaaataagcttgcacccaattggcaatggcatttgcgtttgcaggcgtacagtgtgtccaaggtgcttttggagaaggccgcatgcaagttcgcggaggagaacaacatgagcctcgtcaccgtgttcccggtgttcaccttgggcgcagcgccggcgccggtggcgaggacgagcgtccccggcatcctctccttgctatccggtgagctagaagcaccagcaacagcaatcaaatcaacaagctagctcccacaaagggcctgtttggggggagcttctagctgctgcagtatattctagaattagaagttgctctaaacagttcagcttttgatttagattataagaagatataattgtaaaatccaaaaaatgaagctgggaaacacaatttttccagattgtaatcttaaaactccaaacagaccccaagtctcaacactctttgcaacgcgtgttacacagtttaagttggctgctgtttttttactactacttctcaggtgatgagacgcatctcgaagtcctgaagcccctgcagtgggtcaccggctccgtgtcgatcgttcacgtcgacgacctctgccgcgccgagatattcctcgccgagaaggagtcatcgtcattgtcgtcggcagagtcgtcggcgaggtacatctgctgcagcttcaacaccaccgtcttggcgcttgcccgtttcatggccggaaggtacccgcagtacaacgtcaaaaccgaccggtacgatcgaattgttgaccaacttggaaatccaaaatagataaatattgttgtgttcgatctgacgagcgagtgatcgtctctgtatctttgcagcttcgacgggatgcctgagaaaccgagagtctgctgttcgtcggagaagctgatcagggaagggttcgagttcaagtacacgaatatgggcgacatactcgatgaccttgtagagtacggcagggccctgggaattctaccacattgaacgaatagctgatgctgctctaccttcaacctagctgtcacgaggaccgaactggagtatgcgcttgcgaaataagtgatcagtgtttttaaagaaaaaaaaatagtacagtgttttaagatgagcctaatacacagtggataatggcaatgaagtttaatacccttagagcatatccttcgttcttgcatgtcatttatatattttttataaaaaaatttaacaagaatcatttggttgatacgtaagaaattaggggatgtccattttgagggacctaaggctccgttcgttggtctgttagggatgccacttgtttttttagccgcttcataaactgttaaaagatgtatattatggacatgtttttaagtttctttaaaaaatctaataaaaccatttggcatatttatagtagttaatactacatccatttcatattataaatcattttgaactttttttgtcaaacattttcagtaaaaggtttgactaagtttatagaaaaaattagcaacatttacaacacaaaatttatttcattaaacactacattaaatatatttcattaaacacgaccgtgcctgggccgtgccgcccggatggccatctatacatccggtcatagatttggtttttatttgtagtactcgtcaacaactagcatgtgtcacattcgatacttggttgattttttatgagacgaaaggagtactcctcaatcagatatcaaccaaacaaccacccactttcatatcaactgaacagttctgtaaggacagttccgtaaatggtccatccttctttccatagatggtccaaccccgcacatagtgttgcatcctcgtccta

SEQ ID NO: 31434 - DNA, 4671 bp, Oryza sativa
ttttatagagcagaaaaaactttgttgagctttagctacagaaaagctggaaggtcctgccaaattgagcactgcgtgtcgtatcactcacctcttgatttaattttcttcatgtcttacttctaaccattctgtcatttttcaactatattttatttaataaatggcattatagttttttcactccatacttatctctctaagaaaaagattgggaatattttatattagtggaggaagtacacttggttcataagatacgatggtaactggaaactgaaaaaaggaggaattgaaatggtcaattgacttggtgctacacggtgatacgatagctgaggaccctgttgctcatattttttattggatttccctttttttttttaataattctgagttttcttctatcggatatttgaatgcctctaggagtgatgttgttgcaaaggactataatctagatgtataagtctatggatctagatactttaactagacttatcttaaattatgatttatatttgagtggttctagaaagtctctatgtttattgcgaagtgatgtacagttagaagcttctggaagctgatttttttttttaccgggtgggaacagctagatgttctggatgctgtgttgttaaggtacaactttttcttaaaagaaactgctaaggtactacttgcttttagaattatcacataacactgtagttttctattttgcttgatcttctgtatttttttccttagacaaaattcatgatttatttgataagctaggggcgccacgtggcccaatcaaaagctggcataaccactggctttagattaatagatagattaaacgtagactaatgacaaaactcattacataaccctggactaattcgtgagatgaatctattgagcctaattaatccatgattagtctatgtgatgctatagtaaacatgtgctaattatgaattgattaggcttaaaaaatgtctcgtgaattaactctcatttatgcaattagtcttgtaattattctatgtttaatactctaaattagcatccaaatatccaatgtgacatggaataaagtttactccctgaatacaaacatacctttgcatctaaataacaaagatttcttattggtgacaactgacaagcatatcctatcagatgaacgtcagtgacagtgactgtactcttgtactcttacaaccgccgtcttcattccagtaagctatttctctcaggaggacgtagtggagcctggaggggacgaagtagccggcggcacggcgatgtcagcggttgggatgaagacggcgtgcgtgaccggcgggaacgggtatatcgcttcggcgctcatcaagatgctgcttcagaagggatatgctgtcaacacgacagtcagaaaccctggtgagattcttcccccttttttgttgttcatgatttcagttacaggctgtgattagtttcatgccaaaattagaagttcaatgaaattagaacgatgtaatgaaaaagttagaaatttatgtatgtaggaaagttcgatgtgacgaaaaagttgaaagtttaaagaagaaaaatgaaatctaaacagggccacagtctttctcccattcagattcaaaaatcttttggtcagaggtagtttatttgctgaactgtcgtcatgaacaatagaaaaagttcttctatctgcaccatatagaaaatctttatatgttccaactgatatagtgacatatgctggaaacgatggatgcaaatctttatgatctcaattctcaagacaacgctacgaattttcagagttcagtttcacatctgacgatcctactcttgtgtattcagatgacatgaggaagaattcccatctcaaggggttggaggcactaggcaccttgaaggtcttccgtgccgaccttgacgaagatggcagcttcgatgaagccgtcaacggctgcgattacgccttcctcgtcgccgctccggtgaatctccagtcagagaatcctgaggtgaacagctagcttagctaattaatccggttttctctaatcgacgtcacagttgacagttgtcttgtgtcatctgatgataagcatgctctttagtctctagtactgaaattaatttgctcttaacttctacgatgacaaattaagctgggtttcctgccaacgtttgatggcagaaagagatgattgaagccggcgtccaaggaaccctgaacgtgatgagatcgtgcctgagagccggcacggtgaagcgcgtgattctgacatcgtcggcggccgccgtcgccctccgtccgctgcaaggcggcgtcggccatgtcctggacgagtcgtcctggtccgacgtcgactacctgacgagagagaagccaccatcttgggtcacattctactcctttcttttttggtcctccatcaaatcattcatatacattttttaccgggctgatgaaaatgacggctggctgatgctagcacaccccattgtttttgcgtttgcgttttgcaggcgtatggtgtctcgaaggtgcttttggagaaggcggcgtgcaaattcgcggaggagaacgacatcagcctcatcaccgtgctcccggtgttcaccttgggcgcggcgccgacgccgttgaccacaacaagcatcccaactacgctctccttgctgtctggtgagagcctgagaaacatacgtcaaatttaagaagctactcttttatttgttcagattcaagatatatcacattttatatttgatttgtttattttagaattaagagagtatgtacttccattatgtgttacgattgacgttgtttctttttcaggtgatgaggcgcagctaaaaaccctgaaaggcctggcggccaccggctccattccggtggttcacgtggacgacgtctgccgcgccgagatattcctcgcggagaaggagtcggcgtcggggaggtacatctgcagcagcctcagcaccaccgtgatggcgctcgcacgtttcgcggcagcaaaataccctcagtacaacgtccaaaccgactggtacatatacacgaactggcactttcagtttcaactttcaagtgactgatcgatcgacacatgcatttcttgagagaacctgatgagccagcgataatctttgtttgctcgtagtttcgaagggttccctgagaagccgagagtgtgctattcgtcggagaagctgacgagggaagggttcgagttcaagtggacggatctggacgagatattcggcgacctcgtcgagtacggcaaggccctggggattctaccgcactgaattgatggttgctccgtcaatttggagttttggacataaaaattctcttgtgaaattgttagtcctcttgtcttgtgaaataagtcattgttgtgtgttacggtatggtaatctctttatgatacggaccctttcactaccacagaacatgtgaaaaacctcttaaggtatcggttttctcaaccgacactagggatgcggcaccaatgagtgctccagcaccaatcccattttaaaaaccacacctttgagaccacttgcgatctataaaaaggctcgatgcatggctggatccaattaaccattattgttatgggctctctaacccgtaaacaaggtggcccatagcaaatttagaataagttcatttaaagtcccttaatttgaatctgattttcgtccttgtactggaaaaactaggtatgatgggtccctcaacttacaaaaccagtgcaaacaagatccatcaccaacattgttctcatttttcgctgacgtggcacctacgtggctaatttaattaggtttttggataacgtggcattgtcgtggcatttacgtggcaatttaatttggaaaataataaaaactgttagcctacatgttagttagaaaaaaataattaagaccggtggggcccacgtgagccccacatgtcattctcacaatcctcttcttccacctctctccccatctccctctcttcattgtatctctctcctctctcttctcctccctccaggcgcaacggccgacggacagcgtggaggagggcggtggtcggtggggagaaggggtggctgttgacagaaaacacgaggcctgggagatctacttaactccagtgcaggtccaaaactcgccttcggatgtgtgagcgtgtcagttgatttgatcctgcaatcaacaagaaataaagacaaaagaaccgtggttaaatctataaatgatagccgatcggccagatgccgatgacatatcatttatatccgagccgatgtcatctgtgtatcgatcggcaatcgtgaatgagtaaggaaaaactaaatctacttgatcggctgtagatattaacgatatataattcttatgtcgatgtatacttaaatcaggttgtcggtgacatgggatcgggagtatcatgactagaggtttgaggcagacacaatcgcccacgtggcctggcaccctcgggggacgtcgggcccgagggtgatgtgttcgccctcctcttagtccccccgatggggtcgggctgcacccccctcggccccgagggccgaggcgccccgacccctcgtgggttttcgctccgcgtgtatgggttaggtgagctcagtgggg

SEQ ID NO: 31435 - DNA, 2637 bp, Oryza sativa
acctaaccacattaattgcggtttggctgagcgtgtcacaccgcatgtagcgcagtgcagtgcactcgtttatccggtctgtgaccagtcacagaccggtcagatcgcgggttaggtggcggcaggcggtctgacgcacgcctcgccccatcccgtcaggtcgagggcttctaggcgctcgtccccagctggagctagcgtgttacctcccagagatggcacgttagccctgatcagatatatgccaggcttcatcctaaccattacaggcaaaatgtagtgtgaaggagagccaacgtgcagatagctaagctgacgcgtggtggacaagaatgaccgatttgtgaccattctgacaccggtcatgtcgccagcagacagccatgattctacgtcgcgcctgctcccggcgaaagtggaggtaggtgcgggccgttccatcagaaggtgactcgaacggcaaccatgcaaatctccgtctatttctgagaaggtgggggaaatccccacagaaaaaagagggaaatggtgcatgtggtatccccttaagatataaaaggaggaccttgaccactgagagaagggggagctttttcttggattgattttttccagattcggaacctagaacaagggagaggttggctcacactttgtagctgcttcatacacagatccaccaaaacacaggagtagggtattacgcttctcagcggcccgaacctgtatacatcgccggtgtcttctgtgcttccggtctcgcgaaccttccacatacagattgggagcttagagtctcacccagggtccccggccgaaccggcaaaggggggccagcgcggtctcccggtgaggagccccacgctccgtcatctggcgcgccaggtaggggactctgcgagtgatcttctgagctcttgcgctctttcgtgtgcaccaagcttttcctgttcagcctcatggctgagcaagcaaaggcgcacgacctctctccgagtgtgagtggcgacgacggggagccgaacccacgccgtcgagctcgtactccaccgccccctccacgccaaagtcctaagcggggggaggcgctcgagagggtcgaaagatccgcgacttcaccgatcgcgggcgatggaaaagaacggcgagatggggagcgtcgcctcctcgtctacggcgacggcagcacgccccagggcgcgctccaagctacgggcgcgctcttacgccacccgcctgtcgtccctgacccggagtctccagcccaacgatggctggacgacgtggccaaattggtcatgacggcgcggcagcgcctagatgctggtgggcggtcctccgccaccaaggcctctggtgctgctaccaccggctccgcgtcgtcaagacggagggcacgacgagcggcagccgctgttcgccgttcggccgtcactccttcgtcgactccttcgacccgggaagatctgcgtggggagcaggacgcccgcaccagcatcgagcgccggcgtaatgaccgaagtgctgcccacgcaacggagggcgcttcctcgtccagagtgtcacctcgacacggacgtgggaatcagccctccgtgcccccggttggtggtgtcggctgtagagcctttgtggcgagtcttcggaatgtccgttggcccccaaggttccggcccaccatcgccgaaaaatatgacggcagcatcaaccccgccgagtttctccaggtctacacgaccgggattgaggccgccgggggtgacgacagggtcatggcgaatttctttcccatggccctgaaggggcaggcgcggggttggctaatgaacttgccacctgcatctgtccactcttgggaggatttgtgccaacagttcaccatgaacttccaaggcacatatccgcgccccggtgaggaagcggacttgcacgcagtacagcgaagggacgatgagtcacttcgatcgtacattcagcggttctgtcaagtccgcaataccataccatgcatccctgcacacgcggtaatctacgcgttcagggggggcgtgcggcacaaccgcatgctcgaaaagatcgcctccaaagagccccagactaccgcggagctttttcagctcgcggaccgagtggctcgtaaggaggaggcatggacctggaacccctccggttccggagtggcagcttcggccgcccccggatccgccgctcagacagggcggcgtgacaggaggaggaagaagaggtcagtccattccgacgacgagggtcatgtcctcgccgtcgagggcgcttcgcgggccacccaaaaggggaggccagcgagcgacaaaaagaaaaaggccggcgctcccagcagggagcgcccagccggcaagtggtgcaccgtccacaacacttcccttcacgacctcgcggactgccgtgcagtcaaaagtttggctgagcggacgaggaagtgggaggaagagaggaggcaggagcgccgagagggcaagtccccggcggttccttccggcaatcggcgaagtgaggccaagaagaaggcccccgccgaggacatcgacgacggcgatgatgacctaggtttccaagagcctggggccaccattgccactgtcgatggaggagcgtgtg

SEQ ID NO: 31436 - DNA, 2902 bp, Oryza sativa
tggcggacctcagtctgccctacaacgcggtcctggggaggcccgcgttggtgaagttcatggcggcggtccactacgcctacctccagatgaagatgccgggccccgatggccccatctctgtccatggcgacctcaaagtcgcgctcgcttgtatggagcagcgcgcggaccgcctcgccgtcgtgtccaagcccgagggtggcgacgagaggcttggcacatccgcccccgccgccccgaggcagcggatagtcacgtgcgatgaggtcccagtcaaggaggttgtcctgggcgacggcccgtccaagaccacacggatcggtggtctcttggatggcaaataggaagacgcgctcgtctctttcctgcgggcaaacgctgacgtcttcgcatggagaccggcggatatgcccggggtccccagggaggtgattgagcaccgtctcgccgtacggccgggcgcaaggccggtccggcagaaagtgcggcgccaggccccggaacgtcaagccttcatccgcgaggaggtggcgtgacttctggaggccggattcatccgcgaggtcatccatccggagtggctggcgaacccggtggtcgttcccaaggcgaacggcaagcttcgaatgtgcatcgactacaccgaccttaacaaggcatgtcctaaggatccttaccccctgcctcgcatagatcagattgtcgactccacagcggggtgcgaccttttgtgttttctagatgcatactctggttatcatcaaattcgcatggctagggaggatgaggaaaaaactgcgttcattacccccataggaacttattgttatacgacaatgcccttcgggttaaagaatgcaggtcctacttttcaacgtactactcgaatttctttgggtagccaattaggacgtaatgttgaggcttatgtcgatgacttggttgtaaagacgcgcaaccaggaaacgttactttcagatctagcggaaacttttgagagcctccgctccgcccgcataaaactgaaccccgataagtgcgtgttcggtgtacctacgggcaagcttctcgggttcttggtctctgcccgaggcatcgaggccaaccccgagaagatacgagctatagagcggatgcgcccccccagcaagcttagggatgtgcaatgcgtcaccggttgcatggtcgccctaagtcggttcatatcgaggctgggagagaaggcgttacccttatttaagctcctcaaacgctccgggccgtttacttggacggaggaggctgaacgtgccctcactcagttgaaggtgtatctcagctctcccccagttctggtcgccccagagccaaatgaacccttgctactctacttagcggcgaccccgcaagtggttagtgcggcgttggtcgtggaacgcgatgaggacaatcctcattccgcgcacccccaccttgtgccgacttggcccgggagagagcagggaggagaggcccccgagccgaacggtggcccaaggcccccgacgaccggagatggccctctgcccgcttgtcagacggtgctaggagcccccgacccccaggaaggccccgaggccactgcgggaaggccgcacctatcgccctctgaccccgaggctaaccctgtgccgatttggcccgggagagagcagggaggagaggcccccgagcagaacggtggcccaaggctcccgacgaccggagatggccctctgcccgcttgtccgacgacgccaggggcccccgacccccaggacggccccgaagccactgtgggaaggccgcccccgtcgtcctccgaccccgaggtcgtcggcacagaagacgagtgcgccccgcgaggccgctcgggtgaagagcgccccagggatgcggcccctagcgaaaaggatcggccccaccgaaaggtgcagcggcccgtctactttgttagtgaggccctccgggatgccaagacccgataccctcaggcccagaaaatgctttacgctgttctgatggcctcgaggaaactgcgccattatttccaggcgcatcgggtcactgtggttacgtcttaccccctcggtcaaatcttgcataatcgagagggtactggacgggtggtgaaatgggcaatcgaactttctgagtttgatttgcactttgaaccacgccacgctatcaagagccaggccctcgccgactttgtggcagaatggaccccggctcccgagctcgtctcggtccccgaaaccggctcgggtccctcgcagctgcctcacaccgcccactgggtgatgcagttcgacggctccctgtctcttcagggcgccggtgcgggggtcacgttgacctctccgagtggagacgtcctcaaatacttggtccgcctcgactttcgagcgaccaataatatggcagagtacgagggactccttgccggactcagagtggcagctggactggggatccgccgcctcctggtgttaggcgattcccagctggtcgttaaccaagtctgtaaggagtaccggtgctctgactcgcagatggacgcctacgtgcgccaagtacggcgtatggagcgccattttgacgggattgagcttcggcacgttcccagacgggataacatgatggccgacgagctctcacggctcgcgtcctcgcgagcccagaccccaccgggcgcctttgaagaaaggcttgcccagccgtcggcgcgacccgaccccttaggggagacggatgcgcctaaccggcccccgaggcccgtcggagtccaggcctcgggacccgaggggagtgctcccagctcccttagattgattgcttggatcgccgagatccaagcatacctcacagataagactctacccgaggagggctgcaggaa

SEQ ID NO: 31437 - DNA, 1753 bp, Oryza sativa
gcacaagatgggggtgcgcgaaattaggattgtcctcatcgcgttccacgaccaacaccgcactaaccacttgcggggtcgccgctaagtagagtagcaagggttcatttggctctggggcgaccagaatggggggagagctaagatacaccttcaaggagtgagggcacgttcagcctcctccgtccaagtaaacggcccggagcgtttgaggagcttaaataagggtaacgccttctctcccagcctcgatatgaaccgacttagggcgaccatgcaaccggtgacgcattgcacatccctaagcttgtgggggggcgcatccgctctaagttagttcttctccgcattgccgaccccccccctcgggtgtgcatggttggccgggggctaccacacatgcacattctcttttctcttatttcagtatttcaataaaagcagtttcaatttcctaagggctgtatctgtgccgttttttcctttttgaagaattttgacttgaaataagatcactcgtgctcaaccttgccctcgggggctcggttcggtcagctaaaatcgccaaacggggcccagaaccgagccgtgccctggggcgtggtgaactccgggggggggaatcggcaaaaacccacaatcgggtcacccataaccctcggtcaccacgttcccggcctggccagcctcgacatgtggatctccccaggcactagccccgacccgcgcctttcgaggactgggacttgggcacgagtccttaaatcaagctaagacacaaaaggaccacggcacagatcatcctcatctcatttgtatagcaaagtaaaattaacacaaaaattttcatcatttttgattgcagattaagttgatctatacaaaaaagaggcctgaaggccttagaagaaagaaaaagaaaaaactagagattagcgggggcctgggggctcaatccgatgcgcccgggtcgccggcctcgtcgtcactgtcgtctgcaccgctggcgtcgccctcctcgtcggagttgggggcgaacgcgagccgaggggccgagccctcgaagctgtggacgatgtggtcggcggcatcccggacctgcgcgcgcgcgctgtcttcagtcccaggagggaactcatccagcgccatccacggagagaagttggggtccctggcctggtagctcgccaggacgagctccaccgctccttgggcgaggtccctcgaggatgacttgacggtcttctcgagctcctcggggagctgctggagagccccggccatcttcgagaggtgctgagcgaggcctccctggttggtggagtacttcattgtctggcctttccagaggcccgcctgccgaccggcgcgatccagatgggagactgcatcccaaagcatgccgggccctatctcgcccgccaagcggagggcctcggcttccccggcggatgagtctagcgcgcgctgcatgtcggcgatggtgagttcggtagctgcgaggcgggtggctaagtcactttcgcccgcagccgccccgccgctgcgtgccctcgagtccagctccttctcccgcgcctcgaggtcagcggcccgctggtccagtgcggccctctcggcgcggacacattctagattgcggcgtgcctgctccgccagcgctgcctcacggagggacaggctgtccgtcaaccgttgcgccgcggcctcggcctcttcgagagctcgctcccgctcggtaaggggctgcagg

SEQ ID NO: 31438 - DNA, 4821 bp, Oryza sativa
  unsure (1)..(4821): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgatcaagattccaatctctaatggcatccaatatgacattatatgatccgctctcagactctgggacacaggcttccatacaatgtatcatcctttccaaatcagcaggcgcggaccaaaacattccaaattttattattatcctatgaactttccagtcttcatcaatataatgtgctgtcaaacagaggtaatttactgttgtctcaggtccatcaggagtccagatgcttgctgacagagagacacgtcgggaaaaatgtgcaattttaccctttatattttccttttccttctgaaatagtgtcaagcaatgttcttccatagcattgcgagagactaaattgaccacagggttgagtttctttacaaatctcatcatttcttcgtgctccacaattgacaaaggataaccatgcaaagctatcatcccgactaggtctggatcagatgtttcctgaccagctggagtggtcacaaatgaggtcctctgtttcatcaggcttgtataatctggagtcggcacggaatgctctgctggtaccactcgaatgggcttaggggtcgagtcaccagagctacttgccctcagaagcttgctagagtattctgcgatctgaaccttcccatttgtcaaggcaggtgagagctcatcttgcaccctggacttcaaactaggcacgctagaaggataaaataaacccttctgatgaatttggccccctccacgtccacgtcgtcctgcacaggttataagatgtcgactcagatggcttctccccccgaacttattcgcactgaggcgcttctggcagtgaatgcaatctgcagcctggagtttcccctcaatatagacaggtgtaaactccttccacacctttgacgtgaatctgttaccgctgggtgttaccgagtttatatcactaagcgtctctgtaataacatcattgaccggatcgtggggtgaaactggatcgttctcattcaccaaaactgtgcatataaaatatggaaacgttatttatattcctgaggtaaatcgcctttataaaggaatatctacatctcaagatcctaaaccacaccaatgttaacttatctacactattgagtaatgaatgaacccagaataggcaagaatggtataccgcatgggaagtaggaatccttctgtcgcctctgcgccgcttcctccttgccagggcagattttctgatgccgccatagatggcttgtgccgttggaatctttgcagctgaggcgattatggcagtagagacactccgcaaactgaccttcccattcagaaagatgggcttgtactcctcccaaaccttggaccttttcttgtgcctgtaccggaacgggctgtgcactccatcaaatgccacatccactttcatgctgttatcctcctcatgctcctctccaggaacaggatgctccatagtgttttggagtgaatcatgatccattcatgggcggatctaacatggggcatggggggttcagttcaacacccccaaactttttgggaacaaacaaacatcaaggttaagccaaatttctgcaacagaagctagggttaacgcaaattcgataaaaaaaaagagagagggagagatgggaaagaggatgtgctaaccaggatgcggcggaagcagcaggatgctcgctcgcgggatggatggggggatcggcgcagacggcggcggcggcggcgaaagatgtggatgcggcggaagcagcaggacgagcggcagcgccgcatctgatcgcttgcggggcggatggggatcggcgcaggcggcggcggcggattgcctctctaaacccaaacggtgttcgaaccggtgaatgaatccaccgattcaccggttcaaccatcggttcaataataaaataataaaattatatattttattgagagaattttggtttaataatcaacataaaatatatatttgtttcgttttctaaaaccattatagcaactaacctaaatagtcaggtgcgcacgcatgtatgcaaatagaggtagcaacgagcccaactattttgattagaaaatttgagggttaggtctaaaatacgatgcgttcattttttatacatttttggtatgaaaatatttaagggttatgtaaggttgtgaaagaacccatgggccttgaccgtggggggttcaatccctacgccaccccaattttccttcggttatgtagtaaaccatctgggtttaaatgatttttctcaagtcagttatatcttcggactaggcattggttttggtttatttggttaaacccttggttcagttcgatttttacaactagactattgagatgccactctttttggatgaaattacaaaaaatgtcattgaagagtaaatctttacatattgccaatttagcatatgtaggacatgtcacattgccaatatggaggggcatgaaaatgacccatttgccttcgtgtatattgagtatgccgataaaatacacctatatacaaacatatatctaggtccaataggtttattgtacttcaaatatttttgttacaaatttatcccctcatatcttgttctcattactaaaatttttgcacgggataaatccatacaaaaaattgaaacatgacaaaaataaaggttcactgctgatattagtactaagtgagatatcagaggaaaaacttgctcctctttttcatactataagtcgttttgacttttttacaaactttttaagtttgatttaatttttaagaaaatttagtaatatataaaagactaaattagttttattaaatctagcatttagtatattttgatagtatgtttggtgttgaaaatgctactatatttttttcctacaaatttggttaaacttaaataagtttaactaagataaaaatcaaaacgacttataatataaaacaatataaaacagagagtatattggtagtacatatgttctttttgaaaattatttatgtatacatattttggtcgcaaaacacccagtccaccagtagaaagatggtgtatgtgacaacagcaaaactttgcatatgatactacatgagtcacatacagatgacaaaaatgttattcctaatgactgcacttgaagttttgaacacagtgctacatgtgacattccagctacaaaattttatatttgctgcgtgtcagctcattattccagaatccacctgtatacaccccaaggaacataaagatgtacacaaaaagaataatgaagaggaagtacagcattagccacttccaagttttggactgcacgaacctatacacaaaaaactatgtgcaacttagatcaaagttctcaattttgtcaccaaggattgcatgctctctagcttgtcattcaattgcctgatgtcttcggcgcatttctgatcctccacaccgctcgcctgggaaacgagggctgtacatttggccttggattctaagatttcgatttgtaatgaagcaactgttgattccagtaactctttcgttcctgcatctgtagttgagtgcagattaggagtcctaggagtacctatgctgccaaaactgttctgcctgctcaacttcctaggtgaaaaagtattgtcgattcctccgcttcctgggacatcacaatttcataagataatctaaaattgttttgagaaaatgaagtaggtaagcattttccaaaaaagaatcagttttaacagcataaattgtacgagggaatataaaaatacagtaacataaacaagaaagaaaagcaatggcatataaccaaataatagtgattgctgcataatttgctgaagcacaaagcatcagatcaaaataactcccaggtggcatttgttgacagtatacaccaaggcaaaaacccccgatgaaaaatttggagacagttttgtcttatctaggattgttttttcgacttgggcataaaaaaccgtaactagatctcctctttgcagcatttaatgacccaacaaaggagttagataaagaacactctatttcatattataaatcgtttaacttttttcatagtcaaacttctttaagtttgaccaagtttatagaaaaatataatagtattttcaacacaaaacaaacatattatcaaaatatattcaatgttagatttaatgaaactaatttgatatttgaaactaattttttctataaatttggtcaaacttaacaaagtttgactatagaaaaagtcaaacgacttataatacgaaacagaaggagtagctgatagcagtgtattactagtaaaaattcatagcaaaccaaaaaggagcaaaagaaggggaaaagtccaaaacacagggtagcatggcatctacaagaaaataaatcagggtacatgtagggaacacatacctaggttcctgagttgttctatagtcccctggccaagagacttatcaagcttaaggagacggagaattccagcagtgatcctccccattgcatcagcttcagatctacaaagcatggtgagatgctctaattcttcttttgttgcaactgcctcaatctgccgagtcaaacaaacagaactagttcaggaagcagttgttaatttccgagaggtttggacaaatattcagaagat

SEQ ID NO: 31439 - DNA, 9704 bp, Oryza sativa
ttgtaagtcatttgatgataaagattccaagaaattgagttggagactattcatagttaagctcactgctgtgtcactaggcagttttctctcacgtttgtcagctgatgtctttgtcgcagagcagttacctttgctaacctttgaaatccgttctccaacctggccaaaataagtgtagagacctaacacaaaaaacaactgctctactgaagtattggttgtaaactgttgaaaagcaacaccaatcctcacaacaccctctgggggtggcacaatcaacaaagggctaccatcagctgtaaccatagctgcctcaaaccggatgtcatccagctcaacacatttccacaaacttggagaggagcccctaactgttctctgttcattcgaagtgctagaggtttcaagtgagaggcttagatgagaagctcgagtagcccacttcctctgacttgcatcaacaggttggtacccccagagaaggaagcaagctggatctttgtcaaggtttagcaacagacacttttctgatggtgactcgcagaagtatagattttccacatgaagtcttgcccccataaatgatgattgcgggcaaacattcttagttccactgtacctcgtgatttcctcagcatctaatggaatagagagatcaaattctttaatataaaatgacatactgttgattgaagaatcaggcaatatggcactgcggttggccacaactccatcagccaagaatgaggcaattcttaagcaggattgctcctggagggttacctaggaatgagaaagtatgggcggtgtttagttaagcagaaaaaaagggtgagcattacttcactctcaatgttaaggagacacaccataagaggttcacatgtgatgacagtttttgaagcaaactttggaggtaatggggaaggagtgagctgaagacaatagagggaaaataaaggaattcctgacgtgaattccaattgctgattctcaaatggatggatttgaggacaaaaattttgacctggcaattcaataggaggcgttagacttgaccaattcatttatctcagcaaaggtatcataaagtcttaccaaagtcaggcacaggtggaggttcttgtggaacagattgcatagagggctgtatcaatgtgcatggtggacgagaaaatgtgtccctggagaaataacatgtcagtacatgaggatcgaacagaggttcttcaattgctttgatagctcaaacaaaaattctagcacaggtagaacacaaattcccttacttacgaaaagttaaactgtgaatgtatcctattttgcaccatatgcatcttttggtaacctagcaatgcactcaactaaattctgttgggcttaatgcatgtgatacttataggcatcaacaaaatgcactgaatttagtatgtattgtaactgagcaagtgaattacgatgaacttccaggtgcatataatctccagtaaaaaggactcaaggatgcacgtactacctccgccccctaatataaggaatattcactattttcatataacgtttgaccactcgtcttcttcaaaaaaatttgtgcaaatataaaaaacgaaaagttgtgcttaaagtactttggataataaagtaaatcacaaataaaataaataataattccaaaattttttgaataagacgagtgatcaaacagtgcaagcaaaatgtcaaaatcccttatattaggtgtcacgtcctgataaattcatcccgaaataaaaatcattctctaaaaggaataatagaattaattaaaattcgaaaagaaattggcaaacactaaaatacgtacaagaaaaattcgaatgtggcccggagaatttttgttaaattctccttggtctaaaaggagccctcaaatttttacttgaattttcagagcaccggaaatatttattaagcaacaacaacaattaagaaagtttattaaaaagaaaactaaaaataatcctccttcctcctttgggccgagttcagcccaaagtctttctctcctccctcccttttcccttctctctcgggcctcctctcccctcggaccagctccctccccctcccttccttctcccgggccgcccctccctcctctccttcccggcccactccctcctctcgttgctccgtcctcgtcctttcggtgttgccccgtgcccgttgtgtggttgtcgaccccagtacccgtgtaccggtgtcggtagtcgttcgtgtgtgcgtgtggtgaccgtgttagtgtgcccgctcggtagccgcgtggtttccacgtgtgcagcccacgtggtgtctagtagagtccgtttgtcggccacttgcctcggttaacacacgaggtccgctttcgtcgacccgtggactgtctctgtgtacccggtccaccgtggtcccttaggttgacatgtggggtccgcatgtcagcagcgcagccttcttgtcttttccaggctagagcttacacatgttttatagttgcaaagcttaattataataatccgcaaatctccatataacagcattaaacttcggatgaccatgccttggccatacgaactccgaatcgacccgttcaagtctcttaatgtttgttataacctaaagaaccatgtgctttctttttatgtattgttattgcttctttacagggttgtagctttgcttgtgtgcttcgcgtagcttctgtcattccggaggtctccgaacacacacctcccccctctattcaaacctcccaaaatggttttaggttgggctcgaggtgcatggttttcctaggagcacctcggccaccgtaaggaccagtcttcgggcctctattgcaaagcactactgtactaaccacatgtctaatgggtaaggcttaactcggtgctcagtctagtcctggcaagaggacacggatagagatggacgaaatcggggctcgatggacatctctagggcaaatgaaggctacacgggctgcggctcggtagtcgagatgtcatggcacagggccggtgttctgctgctaggggttcaatcctagcctacctatcccgggattctggccgtaggcgaggttgggtcggtgcttttgtcatggctaggatgggtaaaggggttatgtcacattctttatgacgggttccacggccatggaatgcggagtaaagatgtgtcttgtgggtaaagatgtacacctctgatcagagtataatctattcgaatagccgcgccctcgattatgggcaagcctagcaatgtacccaagttagtggtttaattcttaaaacttgcttaacaactaaaatgtggaatggttggcccggattggcttgggacgagctgggacccaggtcgggttgccagttcggtctgaatcatcgacgccttgggttaaggcaggttcgtgtgggttcacggtcttgattaataatattgtgtatctctaggatcgtctttacaaaatagctttgagcaactaagtgtcttttaaatgctgtttactgcaaaacttaacccctatattattaccccttgtacccccttgcattaatcgtgcatctcccggtgtggcttgttgagtactgtagttgtactcatccttgctctatctttccccccttcagtaagagaagctttggagaagatgtcctaggtggagtcctggcttataccccagttgagcgcctgtgaagatggagccgtaggcccgctagtccgctgctgtttatttttgattgtcaggcctaaagtgcctttgtaataatgtaaatattattgatataataaagatgtgccttttgtatcatgtttgtgtggtgtaccccggcttttcctgagacggggattaatacactagcgtttgggaaaaggtaatttttctcggtcacgacattagggtacagagggagtaacatatagtacctcagaaagagcccggcaatctttatgcaagacaagtttcttgaaatccccccatcgggaacacttgccttcaacaaatttaaaaacgattgtcatgacatcagtacaataagataaattacataacctaaatcaatcatatcatcagcagatgacatcagtacaataaattggaaggtaaagaaatttacccgtgagaagaataaagactgcatcagaaattcaagctgaaactctgttgacaaaatggtttaaagtcagaatagaatagtaaacatagcatatttgaagttttccagagctggtacataccagcatccttaatgcagaggaatatatgatctacaataatggataccaaggaagatcctgcagcttctgcaagctggtcaaaaaagaaaagcagaaaagaaataaggacacaaagaaaaccaataaacatcctacttctgtactgcatgcaatgcagtgattaaaatgcatgatggaaaaggcaaacctgttgagcttttggatccacatcacccctgtttaggcacacagataccccggtcatgaaccgaagaaaagcccgcaaacctgaataaaatagcattcaagctcaaataccacttcaaacagcattcagaaagggaagggatcaagcatcatgaaaagtaaccaaataccaggttcacttaaggcaggacagagagcttcagtaatatgcagctgaacttcaagcccaacaggattgttttgctctgttcgtttgactgtgatctgatgttcaaagcaatgtgtaagccaagcacacaaagagggaagttcaagagaaactgaaaagaaaaacatcgagttccatatgatatgtcctgaagttcaaaagcactcacgttggcctccccagatattccttccaaaaatctttcaccaccaaaaaacattcgttttgcaccatcatcatctcgttttccatcttcactgctagaagagttaaaccgagcatccgtgaacatgtcaggatgaggtaacagatcaactgacagtgattgccattccaatttctgtgaatttgaaagaagaaatgtgtgtggtcataaatcctttcaagtgtagcatttctcagttcattatgtttccaatagaacagttttttttttaagaaatgtcaatagaacagttagcaacataaataaacattaatcttctggagagaaaaggagagtaccaaaccttaaaaatataaatgaatcctttattgttcgaaaaatcccttgcttctttcagatttacagcctatataaaaggcattctaatcaggtactgaagtgcaatcatttactatatttaatgctaatctaatttgcaagagtacctgccatttttcatttgtagtgtacagtacaagatcacgaaatgtgatagccgctagcggtggtgacctgaaaaggaaagatggaatgaatgttcctgtttgcagaaaaacattgcagggaaaagctacatcatgaaacagatattaataagagaaatgaacaagaactgagatatggagctaagccataagaaaaagggccaaaaatcattcaaacaaagatgaataccaagttgcgcctccttgatgacgtggaccaccatgtgtttctaatagaaggttcacaataccgacttggactgtcattccatctgcaatctaaccacggtatagcaaattaagccctatccatagttcaattttctgcacgtattttttttcaaaattgtatatattgtaataaaagagcagagaattgcttttcagaatatcagacaagatcacataagaatatagaagaattatcaaatcagatagcaaaataggtgcattggatgcaaccatcatggataactggaagtgacaatttttatttttagacagcatattgaattttttacagagtaaaagtttggaatgtgtttacgttgaacatcaaggtcaaagaaataaaccttatcagcatatccatatccgctgtttttagctggtgatggcgataaagcactgcaaaccaaaacaaaatgacagagaagactgaaatcagtaaatgactgtgctcattcaaccatatgagaccagagccagaagaatgaatttgcctgctagtgcttgaaagatcttcagaattgtccttctcaacaagaacgaggtcaagcttatcaatgttcaccacaattggttctacttgcacatttgacactgatggaagctgtagcaaggaaacgaaataagcttatcaccaaaagttgcaagtacccaatggctattcaataattgcctgaagctttgaggtcaatgctaatggagtatagattttaattttccaaatttacctgagatcaccacccaaccaaaacttgcaataaccagatgcgcaaggaataccaagggcagctttatttctctagatttttcacaggtatggccacatgataaaaattaatgggagtccaaatttcatggcattgtcaagacaggtacaaatagctgcttcctaatcatcattcacttagcctcccacacaaacgtttcaaacccagagctataatctatcacatgagagcgaaatcacaagttcatcacagatttctaccacgcagaggcgcaagtaaagtgcaaaacaatgctctcccgaaaatcatctaaatttggaaaccaaacaataagaaatctaacactaaatgcaccccttaagccttcagggggagaagccgggaagagtaagcacactgacatatacaaaggcaccgggtcagggctcccgccattaccgtgatctggagcttcccgactcgcgcggtctcgacggcgagcgacggaggcagcaccaggctcgcgtgcaacgcgtcgccattgatatctgcatcacccaaatcacgcccaaaaaaaaagttagcacccggaggcgaccaaattggcatcctcaaccggagaagcggatcccaaccgagattggagagctgcgcggtgcggccctgcagcttgaactggtcgcgggagaaggacttgagccagtacttgagcgtgtactccagcgcccgcgctatgatcgactccatccccgccttccccccgcccgcgcttctacaacgcccctcccctgaatgctccggtggctcttcgtgccgcgcgcgcggtggcggagggaggggacgccccttctcggtgtcggtggcggcgccgccgccggatcggaggtgagattccggcgagatggagaggtggaatggaagagaaggtgaaagaaaatgtggggccctcttttaggtctgagacttcctttcgccttaagccttttttatcttttttttttcttttgttttgttttttgcaaagctgtagtaatttgacaggttcagattcgcattgttttgtaaatgatgctcgtgagatcaatacccgtgtttaacttttattggttttaataatttgaagtacagtggacgtgtaaggcagtaaaacatgttaaaatctggacatgttaagacatgaccatttaactttaattagttttaatttgaagtatagtgagcgtgtaagttgctttaaaaatcatattaacttatttttaaaataacatgattaattaagtatttgttattgttttgaaatatgaattaatgtaagcaacttacgtatagaaactttttttaaaaaaatacatcgtttagtaatttgaaaatcgtgcacgtgaaaaatgagttggtaactctctcgaaagaacacagcattgttctctcctctattgtcttaagctttgtgttttcctctcctgttttaattctctccaactttagtcaagcgattggccatgatttttcctcgtttgctgttgtaacatcagtagaccgaaccgacgcttgcacaccttactgctcatcacagtttggttgtaccataatcccttttccacatggtaatccttttctaaatattataattaactcagtactgccctacaaaaaagtgatcaccaaaccatgttactacgctccaaactctcactggcgagtgtgcacaaaagttaaccgaaaccttcaataaaaagcaaattaattttgaagcaattacaacacatcacactctacattattcgcatactgtcaaatcgctggctataactagacgaagcttcatctcgtggtaaagctgctcgcctcgaaatccacaacatcatctccaactcctcctctcgatgatgattaggaacagaacagtccgggtaaacaaaaattatttacagcttaagacagtaattaattacctgagtatttttttactgacttactgtgactgtcgttgtgaggaaacacagatcgatagatcatagatctgaacttttgttccttccttcccagtgggagcccattcttggatgggaccaagaacaaccgtggcacgtgagaaagggagagagatctgcacggccagaacatcaaagtttattattctcactcacccaactcttcaagcagagaataaatcgcagagaatcacaatgattattaacttaacctatgccaaaggaaggtagcgagcgagtgatctatgcctgtccgtgtccctacatgtcacctcttttatgcagataaagtgaagattttcaataattctacgattaaggaccgtcaggttggtgatgccaggatactgcaactgcagcccatagcatctctgaagcctgaaatgagaagattgcagaattttgcaaatgcaactgattctctctgatcaattgaggagttcaaggtagcatgtaggccatcatatgatacaatgcatcatgtcaatccaatcaaatcatccagagtttcaggccagtgaatggccaagaaaagcgttctccagaattgagccaacagtcacctgcaccatcctgcagaaagccataataaaagcgaggaggaaggaacagagaaaaaacggctgtcatctttcagaccggagcatttgtccggtgtgttttcagaattcagacatgaattccggaggtcagaaagcaccagccccccatctgcttaattacttcgtccccaccgttccgatcttttaatttcatggagtcattagcacacttcccaagttgacatgctcgcttctccagccatgtgagctaaagcggtgtggagaagacaacctgacatgtgatctttcacatcttttttttgcaggtgttgttcttcggattaccgggtagtttgtccatgaactgtgttcagtgataaacttcttctggagttctggagattgtgaagtagttgatcctacattcggtgctcgagcaatagcaaattcgttccagctgaaaagtataaactcatgactactgatttctgaatattttgggtattcacctctgaactctgaagatattcagaacactagtgcttatcaggcctgaatttatagtgacaccactggcccatgatggcataaaaccatcatttggatcacactttgattaggccgtgcagccccaaccacaagtccaaaactgaccaagaaaactttgatgccgcatgcctaacaagtagagtgaaaggttttcctttttcttgactgatagaagagtcaaaagtttgtgagcaaaatccttctagtaacccaaatttcagtcagcggtgaacgcgtaattagagcatgagagggggacttaaatgaaccaagtgtccaagtgtgcaatttttaaggggaaaaattacggtagaattcagtaagtggcgatgacgaa

SEQ ID NO: 31440 - DNA, 906 bp, Oryza sativa
tagtggatcccccgacgcggtggaggcgctgagcggcggaggggaggcggcggcggggctaggagcagggatggcggcgttcgaggcggcgaggggcgcgccggcgccgcgcatcggcgtggcgcagtatctggagcgcgtgcaccggtacgccgggctggagccggagtgctacgtggtggcgtacgcgtacgtcgacatggcggcgcaccgccgccccgccgccgccgtcgcctcccgcaacgtccaccgcctcctcctcgcctgcctcctcgtcgcctccaaggttctcgacgacttgtaagcataaatcatctcttcttaattaacctctaatttactcgttcgcaagtaaaatcttacacataattgaaccatgtaaaagaacctcagttttgttaggatacatgaagaacaaacacaaagattgtggccactttgtctgtgtattaatcccagcaactgtgtttgttcttatcatgaacagttggaaacataaccacagatctgcagtcactactgcatgaacagtcaatgggtagattgagaccaaccaataccacaattaaataagaatgaattaatcgatcggtaattattatttattttttggaaaaagtacgaatcaccccccgaactatagcggtcgtctgaattacctccctgaaccataaaactggatattcttcaccccgaactatgtaaatcagacgaattacccccctcgacctaatccgcggtggttttggtctatgtggcatacgctggtagtccagtcagtattttatttattaaaaaaatatggaacccacttgtcatactcctatccaactattcccctctctctcttatctccctcttctctcactctcttctcactaacgcacacggaggcaggcgggcgac

SEQ ID NO: 31441 - DNA, 1614 bp, Oryza sativa
tctctatttgtatgtcagaactagaattttaatttgaatgtttctagagtgaaatgttatatgttgatatttttttaaaaaaaagagagtgactttttagttgcatgagcgtagttccactcgagtgaggaaaaaaaaacagtttctgaattagtggagtatactgtatacttcagttctgttgggttaattaccattcgcgcgcgtgtgtgcagccaccacaacaacgcgttcttcgcgcgcgtcggcggcgtgagcaacgcggagatgaacaggctggagctggagctcctcgccgtgctggacttcgaggtcatgctcagccaccgcgtctacgagctctaccgcgagcacctcgagaaggaggcgcggagggacggcggcggcggcgacatgctcgccggcgcgtcggccgccgccgccgccaaggcggggagaatggcggccgtctcgccgtccaagctgctggaacgcgcggcggtgaacggcgccgcgcagcacgacgactggaggagcctgggtacggcggcggcggcggaggcggcgaacggcgtgcggcggcacaggtcgtcgtcgtcgtcgcggtattccttcgattgctagtatagccagcgttgccaaagagcgcgttctgtgtgtatatatcaggttatcaacgagagtttttgaggctgtaaaaaaattaaagacggattaattacctgccaaagtgccaattagcaaatgtttgccatacacgaacattactcgttgcctgttcagcaattcagcaatgaaaatgaaaatctggaacaatcgtcgagtcgttgtagagttggttgtttgatggaatttcttttcatgcattaaacaacctaataccggatataacatattctaatattatgaatcatgttgatttttttagaacacggagaaaatatacatgaacacaccaccatcttgtgtaaaacggaaaaagaaactgtttttttccgttctttttccgtgtgtcaatgtgtcgtaaaaacaccatctaataacctcgcagagaaaaaaaccacagtacttcaatagtttgtacagaaaacatgatggatcaggctaagtttgttgaaatcaaggtctcaaagggaaaaaataaagaggaaatcatgtaaagctcataccgaggagtacaaaattagaccaaccatagaagaaaaccaactcatcaaatggccagtttagttccccgccaaaaaaaaattttacacatgtcacatcgaatgtttggacacatgcatagagtattaaatataaataaaaaaacaactaattacacagattgcgtgtaaaatgcgagacgaaacttttaagactaattgcgccatgatttgacaatgtgatgctacaataaacattttctaatgatggattaattaggcttaataaattcgtcttgcggtttatatacggattctttaatttattttgttattagattacgtttaatactttaaatgtgtatccgtatatccgatgtgacacgttcaaattttacgcgtaactaacacacccaaagtcatagttcgagcagttggttggttcaaccatgaagactgtgactgggagtaaaacaaaaaaaaactgaag

SEQ ID NO: 31442 - DNA, 4152 bp, Oryza sativa
ggtggtcagcgggggcgcgcgtccgatgtcgtcgggggcagcggcgtcggcggcgggggtggaggcgggggcggcggggggcgggaaggacgacgagctggctgatctggtgcggcgcctagtggacgccctcgcccgctactccgatcgcctcccgttcgacctcgatcgccaggtttgccgctcggatctgtgatcccccccgtgtcgcgcgtgtgttttgcggtgttttgataatctctaggttttcctcgctgtttagggatttgtggtggtccgtggtgtaaaggtggcgcgccttgcttgattgtttgtggggaaggctagtcttttttgtttggaactatattttatactgtggccattctactattgtttagttgttattacatacatatgagttcgaagcatcgatttggtaattcgttcttagcagctgtacaagctagaagctgtagtaaatttttaggcgtggattcgcagttcgctaatgatatgtctcccttttgggaaatgtggtcgtatttgggtcattgtgatagttgagattttgatgtatcctttaggttagtaataggctaatagtgctgcgagaaatagttactatgtagaagtgttggttggccagaaagatgcaaacttttatgatggcttgctttatgtgatatcatcgaatgatctacttacctctatagtcagttaatgaatcactaaataattcgttaatggcatgttgtcgttttgtaagttctcttgactgtagtgttttacaacgctatttccaagaactcggtagtaatacaacgtgcagatcctaggctagtaatggatgcaagcacaggcatacacatgcgaacatgacatgtgcatgcacggcgaggtaaaccgatttctatgctcagaaatctgcgctacaacgtcattaaaacgactttaggtatcaaatcacgtgaaagcacttaaaagtgccgtagcgctcgaaaatcgaccttctgggccctatgttgcaacttgcaacagcatgagcattcatattattccacaaaagattgtacttggtgtcaatttttaatcccttgtatcagtcgttgttgtggtttggatgagtgaattggtgccattttttgtgatttctcacacacaaagtccgttttattaattcttgctacaagaattattgaattacttcaatcttctattttagaaacttcgctcatttactacacttgccgcaattacaatcacacttatctttgcctggaaactgttgagagctcctcaagagcaacctcggaggccacgtagacgcgttgctccatcacctagcaacaccagcagtagatcacggccaggtgctttgacctcaacggatgcttgttcatcttcagcagattcaagagcacaggaagcaatcaaccagcttttccagccagtaaacgtattgcctgtttccttttctgaatactgaaatgatgtatctgcttttaggatccttggactgatagtttgcttatattcttctccagctgactcttgagcagcttgttaggcataaactgagcgaaggacgaagggtattttgcaagcaactgctttcacacctttttttttcacgaaatttaaagttttgttataccaatgcatgtttctttcccatgtgtgaattataatgtttaggttacatgccggttacttggtgtgattttggaggaaacaactccagaggagctccaggtgagcaaaagcgctgctgcaaaaaaaatttcctgttttttgttaacgaatttaatttagcggaattatacttttttttcagaaccatgtcacagtgagaccttctgtcctggaggttcttctagaaattgcaaaattctgtgatgtctatctgatggagcgcattcttgacgatgaaagcggagtaagtaataaggaccatgcattttttctgttgcatttatgttttacgctttacaagtatgctcaagacttgatatgtcaatatatactgatatcggcatatgcacgcggaataaacagtaatcaatttaccattgatatcggaataatacgatgaatgaacaactacctggtctgctattttatttcattatgttcaggggttctttttttttttaaaaaaagaaaagcagaagagtatttttggaatcatcactatagacacactgcctagtacggaatttgaatgagctattatagcttgacatcagcacaactgaataatgttgcaggaaaaggtgttatctgccctgagtgaagctggactttttacgaacagtggattgataaaggacaaggtaagccgcatgatgaggtcacttcagaaatataactgcttaatcgttttttttttcatttgggtatagccattggatgttcgcaatggaccttatgtaacatttcttcaaatggcaggttctcttctgtagtacagaaaatggccgcacctcttttgtgcggcaactggaacctgattggcacattgatactagtccagaaattgttcatcagctagctgtaagtcacaattttaacaatcaagtatcatacttatagaagcaggttttgagttgctatgctcccttgcagaggtttatcaaatatcaactacatatttctccacaacgagcagaaagagtagcatccaatgttttcagctctacaagcttggaacaattctttggaggccttgatcagagatgataatatgaggtagagcaggagagaatttattatttgacatgtgcatcggcgtgtttctcatgaaattgatagcagcacctgtatatcatcaccaaatttgacataaaacctgtatgctcaaccgaccggaagacatgacggactgaatatatgtactgcacaattctacacgccgttcctctaatttatactgtctatctctctgcaggtgagctccagcaaacaatggcatagcgagaactgagacgaacatcattgttcattttttttccttgaatgatggaactcgtttttcttgtaccatgtgtaaaagtcgtgtcatgttaaactggttctgcaactccccataagctatggaaagagatagcatctgtagcataatccatgtatcaattgtgttcctgtataaccgaaatacttaaaattgtcatccagttatttgttcggccattcatcccagaaatgtgttattttcacaaaaggaaaaatctcaactgaacagaaggaataaaaactttctgcagcatccaacattagcacagcaaaatccagcatccactcaaataagtacgtatcatatcattctttccgcatatcctatcctaacatttttggagttgtcaaaatctcaattgcatatcctagacaaaaaaaataaaataaatggagtcgtcaaaacttcaattgcatattccacaccaaaaaaataaatttcaggaacctccaaactgtggatcttgttcagttgggcttttcttcttggcacctagggcacgtacagatgaatccataatctgcaagctccgcctgcctctcctcgtaggagacatcctcatcgatgtaggatatggtaatctagaattttcacagttagtacttggcaaaacaacgttttcaatgttttcttttttcactggcagcacaagaaaaaaaatatttgagataagcgttaacagctcagtacctcatcgtccttcttgataggctccagagcaattatcactgcattaccatcagtatcctgcaacggtagttcaatggttttgtcggattgctgactggcaatttggtgtgaaaaatgagcgaatcaactggaagaaatatagattacctcatcccttttatatgctttagcatttggacaacatgaatgattcatacagctttgcaaaggaaagaatgccgtccctgccaacgagaaattcacaagagaatgaacgaatactgctgggtaaatagaaaatgacattactgtggggggagataaacttgggaagaagctccacataccctcacaaggagctgcatagtcttcacctaaagcatctagaaatggccttgtaaccttttcagcttcctcctgggatatgttgcacttcagattaacaatgccacaagaaaagctaaggctaaccagtgaaaataccttct

SEQ ID NO: 31443 - DNA, 2425 bp, Oryza sativa
aaagaaacaatgacagagtatgtaatgcacatatacaaatgaaaaataattagatttacttacagattgttcagctcaaacatgccaattaaatggccatacacgtcaagtgagaacactaggaaatgtcaaggtgaccgtttttttttacgtgagtcaatgaaacttgattacttgaatgtgaagggaagctacttatttatatatatgaactgatctagtatatgccaaaaaggatacagggtgcacactcagaatcaaaaatagcatccttgagaagctgcaatgactgcgaaacacagaagataatgatctgcccatcaatccattggtatgtgggacacttttcaatcaaaacaataaccacttcttgtgtgccatttttatattttaactgacgagctagtgaataaagcttcgtttcagagcacaatattgtgaatagaatacctatatagtttcaaaagaatgaaatatgtgacagcataattaccgtaagtgctagatccctaatttgctgcctaaatgtatcttcatcacaggaatcaacatcctcaggcaaagcaacagagtcccaccacctgcaacaagattttttttttttgggacatattagggtggaacaacaatgcaaacaactcaaaggatcttgtagagctagagcaaggtagtgaaagccacactgagctgaaaataacatcttgccaacaaatccaaaaaaagagaacaaaatatgcaaccatgcaacagagatcttattgactgttataaatgagaagagtggaaatatactagtaccattgaattattgatatacacttgatgaagaaactatcgattgtgcattaaaataacactgctggtagtgccatacgcgcagctactttatcagaggggatgaatagttgcatgcgaattcatgactttacctctttttgtagcccatcgaaagtggtttccatgcttccataagcaaagaaaagtttgattcatctgtgttattttgaaattcaggctgcgttttgagtttcttgtacctcagcagagtgaaagtgatagcctgacatgtaaaattgtatcgagctcatgcatcatgatcaggagatattaaattgactgcaattggtagcaataaggaaattgcaattgaatcttttgtttggggatgttcttgatatagctactaaaactcgtcttgtgcaatagtctgtcctggtgcattgataagtagattgctgacagccattagtgataacagtaccaactcaagtgtgatgcttgaatgctttttgtattagccatggacaatggcaaagttctagtatccccataaaacttttggagaatattagaatctgagatgagcacataacacgatgtttagtgcttagtacactaaacattaattctatatttctatcacataccttggcagcaacaagaaaaatatcattggaccctgaaaataaagattggtcagtagcagataacagactgacaacctcaatcacaatcatcactaatcaggaacaattgatctaggcatgctgcatttaatgaatagtgaacacaacataaattcgtaatgatggtatataatgatcactgcatactgcacttaccatttgcatgttctatgaatttctgaagagcagatctctgggatggttcagtcttagatccagtacacagcaaagagtgataagtttcccagtcggaatcagcacatgattggctaaacaaaaatgcagaatcaacaagttatgtttttaccccaagattacatttctatctaagacggcaagaacaagttacatgttctgataagataattaggttttaagttttaacacgaccgacaactataacctatgatggagaatgaattgatcaacaaaatatttatgcctcaaacaaaattcctaacatctttgggtgttgcagccaaaagaaagtgtgaactgtaaaatggttagtgactcaaacctgcagtagcgttcttcctcacatccacgacaaggaacaacttgaggcaaactaaaatggtctgtgaaaggcagtgacatgtcaccagtaataagtgatcctaagacctcttctggcaaagtactactgttttcctttgttgcaccagaagaactggcactcgatcccaaatcactctcatggcaatgcctcctattagtgcagtcactgcttgaaccaacgctttgccaatacaatcttcgtccaatctggaactctatagaaccaatgaagcgaaagcaataactgcacacagcgcaatcaatctgaaataaaacacaaaatggacaccacacttcagggaggagcagttcacacaaaaaatagaacggaacaaatacctaggatcacttcaaaagcagacgaaacctgttaagactgtgctgagcaccaaccaata

SEQ ID NO: 31444 - DNA, 16193 bp, Oryza sativa
aggtccccttctgcaaactccttgttcgcacaaacacctgcaagaaccaactggttaagtatcttggcttttacccgacaccaactttatacaagcactccaagtttgccggattgcattgcacaagatatataagtattcagtaaccagtacctttcccatgcttgctgctgaagttcactcttataccatcatgtttcctggactgtatgagcccattgtagtattcctgaaaacaaaagtagcatagctgtgtgtcagatgggagctacagatcgtcagcaatacatgaactaaagtaaccaaggaaggagaaaaaaagccataaaagatttactacaattttactggcttcaaggagacaattgtaactgcaacacagaaagaagccaagaacacaaaagattgtttctattctgtcgaattgatacctccatcgagctacattcactacacactaactgggatacccaaaaaagacaaacttaagattgtacttctgcaaataaaacattaaactacaccgttactgttgtaaactaaacaattcgcctctcatctcaccaatctaaaaaaaaccatccatgcggaccaaaaagaaatcctcctttctcagtaagataactgaaaccaatcatagtaagatatacccatcatagtatcacttccttataacgaaattcccgacaatgattacccaacctttctacagggaaaaacaataatcgcagcacaagcaattcccaagcagatagatttgagacccggaggatggatgggcaagggaaggaaaaagaaaacgtacctgcgcgggttggagaggaggggtggcgaggagctgggcgatttggggcgcgaactccctgtccaggtcacacgggcttgcgctgctcccacccatgccgccgccagcgcgagctgctgcctcttgcggctgcttcttccgccgccgctcgccgccgccgccgtggggtttggggggttttgttctcgagaccttgtctcgtacttgggggagaggtgtggatatgaacatacgtgttcgagctatgaaggcggaaacaagggaagtacgcctccttgttgaaaacggaaactgccatttttggttcaaattgacagccggtgtatgcataactgcacacacataaggaatatgtgaatgttacttgtaaactgcatacatatggtatatgtgaaattgcgattatcaactccagtcaactaacattgtcatcatatccctgatgcttatgcaagaattcccccaaaaagaatgctaaagcaattaaaccaccaccaagtacctaatccgtagtatagaatgtaattcatcctctagtactatgaatctgtatagaagtaggtaggatgtatcatattatattctatattgggttaagggagtatatgtactagcccagttccattccgagtttatgtgttcgtcaccatcaccatgtcaagtcaacatccagccttcaacctttgtaaccaagacgtgcatcgagattgcttgtgatgatcatttcaataatgcaacatacactgctaattactagtaatatttgtgagtgttagatacaccgaatacagcagaaaacaacttcctaggtccccaatgcacaatacataaacaatatacaaactttttcttttctttttgtttttttgagatggaacttaattatctaccacttgctgggtagctagtgagcgccagctcgatcgacaattctcattagatgcatagcagtatagcccatgtatatatatatctatgaatttagatatatcctatttctagatttatagttagaaattggattttttttttggagcgagtataatcgaattgctgaattgataccttgtcaactccttcgatccgatcaatcaaacctgccatagtcatagtgccgtgatcatatatgtatgaactcccccagatatgcgattaatccaactaactattgcctaaattacttgtatattagccatatcattggcataatgctgtcaacctcttagttagttggattgcaaattaaatgggacatggcacgagcaggtaactatacaaaattttcatcgtcatccacgatccaaccaccagctggtgcaaaaccagcagcttgatatataaattcaggcagtagctgcgccattgctggtattagctagcttctctgcagcctcttccattcctagctagcttgtgcaagagctcgcaacaatgtcgtcgtcgtcgtcgtcgttgaaggccttggtggcgttcatggccgtggccaccgtcgccgagctcgccgccggcagcaagacgtgggccatcaagtgggcctccggcgggaactacggcgactggtcgtccaagaacacggtcgccgtcggcgacagcgtcggtgagtgagcttctccattcctcctccgttcttggcatctggcaacaatggcgtctgagctgatcgatcggcgtgtgtaatgtggcgcagtgttcacgtacgggacgccgcacaccgtcgacgagctgtcggcggcggactacacggcgtgcagcttcgccgccccgctctcgtcggacgccggcggcagcaccaccgtcgtcttcgacaagcccgggacgaggtacttcgcctgttcgtccgggtcgcactgcagcatgggccagaaggtggccatcacggtctccaactcgacggcgccgccgtcgtcgtccaagggcggctcgtcgtcgtacggcgcggcggccggcggcggcgccgagctcgcctccaagctggtggtgggcctcgcagtcggcgccggcgccattcttgcgctctgaacatgaactcgatcgtctctgaattattggcagcatttccgtcgtttgagatctttgcgttgcggtgttcctatttgtgtaatgtgcagtggattcccttttgttatgatcttgttttttgtatgcatattttcttgaatgaatttagtagttatgcttgattacacaaaatcagaacttgtctaatgaaaattttacacagcatcgctagcacttcacaaatttgacttctacatattgtaaaaaaaatatcaaatttgaatttgcatgcttgtgcagtgaaatatcacatattaatccatcctgcaatgacagtttttttttacatttttttaataattatttaaataacatcgcaagaaacgaagggcatctccttaaagggcgaaaaagacttccccatcacaatcataggagtaacagtttgtactttgtaatgcattccatcagagaaccaacattaaaattagcatgccatatatatatacacacaaaaaaaggctgcttctgatgtaagacctcctaacatcccattccagcgacggcgaacataatctaattacaaaagctaactaaccctctctgtccaatgatcagagcaattcaaaagacatggcatcacccatggtgaggaacatcgggtgcataaattaatggtgctaaggctttgtcatcagctatagctgataggactatgtcagtcttgctacgacaaaattcaccagctagctccacaaaaggatcatgagctgccctcatattccgaatagatattggagatcatctatggtgagccgagttgcactgccgccaggtttgtcctcaccaaaagcagattggaccatctttctcttcttctcctggcaagagaacataaaagttgtgttgacaaaaatggagagtaaaaaagaaaacatgcacaagcatggtgacactgtctaaaatgaattgatcaccagtctagctccaaagcatgtccaattatttaacaacccttacaatcgagagaatcgaaaaaaaatgcatgaaattgcctacatgatttcagctactttgtaaaaaaggtaaacctcatattagtttcaagaaaaaaatacatgctaaccagtatacgcaagaatggaaaattttcattttgtagaaatgcatctttaactgatgaagttaaatatgttcagttcatatcctacatccagacgactaatgaagtgcataccatctaaaagaagaaaggctcatgcttttgaaatgaaaatgtaacagccaaaatgatacctgtagagctaaaatccgatcttccactgtgtctttgatagttaagcgggaaacggttacaggacgggtctgaccaattctgtgtgctctatcaactgcctggtcctcagcataagggttccaccatggatcaatcataatcacatggcaagcagctaccatgttgagaccaagatttccagccttaagtgacatgagcatcactctcacctgaagaatgaaatttagttatatttgttgaccatctacatgtaacatcaaaaaaaagaagatagagatgaagggcgtcagaaaagtacctctggatcagtgttgaattctctcactgctgcttctcttaagttgagagacattgcaccatcaagccttctgaattttatacggctgctatccagcgaaagctccagcaagtccagcaagccagtccactgggagaatactatcgccttagaaggggctacttcacttggacttgattccatagtatcactccaagttagagcaggtgtattcacgattgagttaagtatgtcagtggttgccctgatcttagaagatatgtaactgctttcacagattgatggagagccatctgcttctacagaactactagttgttgcaccagactccaatttatcagctatacaaaaccttaacactccaggtgaaaaaactgtttgagcgcttaatttcttcccacaagaaggggagggacagacattctcatcacttgttaagctcttatgcacacactgataacagaaaacatgaccacatgttgctacaacaacatcctcaggtgggtcctgcaaaacgcgcagaaatcaaattaccgtagttatcttagtatccatggagtaacaaacagttcagataaaattaaactactgattgtttaatcacacacacatgacagttcagataaaattaaaccactgattgtttaatcacacacacatgacaatcctgttctgatatccttattttgctttttcataaaagaaactattcgaagataatgtaatactatttttttgcatgtacagtatgtgattagattgcttacactgcatctggaacaaattgcatagtctccttccagctgtccaagcaaatttatcactgtttccttaggaagtttgtttgccacttctacagaaccagtatcaatcaaatctttttcctttcccttcaaaagaagaggatggtcacaagcctgccgaagtcgcagcagcaatacaagaatgtttgcaaaattttctcttatcgtcccagcagaagcatattcctgtagtatgaacatggagtataaacattttgcattgaaatttctgaactactgcaaatattttgaaaaagaaaagtaatcacactgaacatggtaaactattgactagcaaacctacttgtgcttacgaagataaatgtaaaaacttggcttctgttcattaaaagtaaaaccttcacaattgctgtgggcacaatacagctaagtgttcatcggataagacaagagtagaaaacaaaatgtatggagtattgatatggtgctattctaagaccttgcagcaacaactgagttaggaataaatcaaaaccgagcatatctaagttcaaataatgagtatctagagaacggacagtatctatctatgcaccataactgccgatcgctttttcatttaagatctaatagttgacatagtaatgcaatattttcgatagaaaaaaaaagaggcaaaattgaagtggccataccttgaacttttccctagaaccttcttcaagcatcatatagaaagttcgctcctcttttgagaagtctattttgctcagctgaatcgtttttggtggcaattttatgattggttctccatcgattagtgtttctgtatttgaacagtccaaaaaatagattaattagacaacatcagaaccagtgaaaacaaaaaaacagccatatgcactgaaactgaaagcacatcttacaaatttaagatatgcaaccaagtattgaagctgaaaacatcaactcaagcaacatataaataaacagaatgttacggggtactcaatatgattccacccaaaaagatagtactctttcaattatgtttcccaccttcacaaattccagattttcagatgtatttcatgacttccataaaatgctagagatccaagataagaggttgcatttttccaagtaaaagttgattttgccatgatatcgtattatcatatatattagctccagcacacacatatataatgaatgaatcaatatcaatatttttaaattttcatagttgtgagtaataccaacgattattgcaggaattagtaagcatcagaggcaatgggatgtgggtttcatatagcagatactaaaaggtacaaagttgcagacacatatgcagtcatgattttctattttaccttttgtgcgccgcaacagaactatcttcaagacagcttggagtttcttatatccacgagttgcatctctagaaatttggtattttatcatagagcgaaaggaaccatacacagaatatggttcatacttcaagaaacggaaataactatacagatcatcaattgtattttgtataggagttcctgataaacaccatctccgttttgctctcagtccacaacaggctctagccacttgagtattgtgattctttattgtttgagcttcatcaagcacaactctgaaccatcgcactctggcaagtggtccaccatcaaggtcagcatctgaatttttgggtttctttttcttctttggttcgctgtctttctttcttttattgccaatagaaaatgctggacataacccatatgtttcgctgttcttttcctccatatcctcatcaaagttttgtttgggtacctcattggctacaatagtgtatgtggtgacaacaacatcatattttgtcaactcagttggatctttagtccttgaacctccatgataaaccaaaacagacaatttagaactttcagtaaccttggcagccaactcactagcccactgtctaagaacgctggctggacacaccactagtgttcccgcagttgatctattagcagacctcaaagttgacgaaggcgatggtctcactctagccttcttcttgggttcaactttgacagcatttaccattctatcaacagcagaccccggtagactagcccagggcttcagatctgcggcatcacttgctgcttctgatgatggaaacagtgttgaatcctgtagcatattcccagattcacccttcagttgcttcttgtccatgactatcactacttcatcatcctcatcaaggttagctacagatttcatgctgcccacatcagcagacatgaacttagactgctcaaccctctccttttgtataagggcaatagttgatattgtcttcccaagaccctgcgtcacataaagttatgtccctataagataggggatccagtaaaacaagtaacagttatcaaggtagaaaatagaactaacctgatcgtctgccaaaattccacctgaacaatgtgagctattctccctggaaaccatccaagctaatgctattctctttcaataatgaagaacatagcagtgaacaggatcagtagaataaatagaattatcacacaaccaagattttcaaaatataaactttacctggtgcttaaggagtgatactgacataacaccttcaggcaaattttcttccgttgtttcttgactgatttgctgcacaatatatttttttgttttaaaaaggtataatccacagtaagtacaataaaattgaatcaccacacaattatattctataccttcagggcttcatcatacaccaccctctcatcacggccaaaaagcctcttttctatatttaagtggctctgagtgccaaggccattgactccaaaattgttaacagaattgttgtatggcactgatggaggaaagatcctatgtgagtttagacctccatatgcagagacaccacctgcaagtttcaaacagagagaaaaaaattactaatatcgcattttatactagtaaaactatttttatgtgatcacccatcagaatatttgagggaattatggtacatgaacatcatcattatcagttttaacttttcagttgctattaataggtagcttccaacctgttgacattgcagatgtaggcatctcgattccataggcagaacttgtttgaaaaccattgtacttccaagtggattcttcctcgatcttcttgtcacctaaactcgaatgactgaacggaaatggttgatgcagaacctcatagacatcatctgacaggtttcaaaagggaaaaactttagttgtactaatcgcaagttacagcagtatacttttcaagttaatcaaggatagttctactcaccgtcatcatcatcaattgaaacaccctggccataactaacatatggcttgtagccacttgcaatagcaggtgaagggaacccaattccattatagtgcacagtgttaggcttcacagtggggtgtgtactttcaacattgttacctcctgttagagaaagtggacgagacttgtaactgctgctcatgaaggtatgtggaagagtcctgtattgccaagcactattctgacagtcagtgttgacaccgctgctgctttcaataatgtctgatctattctcagcaggtctatgagaggataaagcatgagtgttgtttaaccagttatcgtcatccagcccgactagtagttctgaactattattgccaaatgctgtgttgtgcaaaaccacctggttaacaccatcattgggatcgtcaaaatcaagattgtcttctgtatctgagtacgggctgaagtactcttcactgtctgaacacaagtcaataatatccatattgtgctagcaaacatgggcatcaactctctgttgtcagatatctgcgatgcttagcttcactaatccccaacaagcctggtcagaccacactatctccagcacactgcaaacaaattatcttgatgaacccacttgaatactatcttctgcaaaataatttgtgaattggaagtcagaagtctgaacaaatgatgcattcagtaatttgcagcagtaactgtggtttaattcttcaaggggcactgcaatagcccagataggaaatacaatttcaacttggtgcatacaagggttgcaaataacacctaaaaatatttttttaaaaaaaacacttttttacatcaagaacaatatttgcctaaaccaggcacagtgatgtgcaataaactgatacataaaactatttaaggaagtaaacactaatgcattcctaggctaagtgtattgatcaaaatgcagcaccctattcaaagaaaatcacaaatgaaagattaactattaatccaagggccaaaattttgaaagaaggaagaattgtcacaacatgaactgagtgtgccatcacgcaagcatcgccttcgacaaggaacggcaaagccaactccacaacaatcaaacaattcgactacaggaatgcacaaccctaatcaagcccacgatcgcttaaaacttccccccaaaaccgcccaatccaccaaaaccctacctaagcgaaatccgcccaaagccaccgccttctcctcctcaaaaatgatccgccgcaatcaaaatctcccgcaaatcgcaacaaccctctcacacctccccgaaacaaaacatctcacaaaagcattccatccatttgaaccaaaaccgctaataaccccaaagaaagaaaccagtcttgcaagagagagtagtaaagaagttacctcctccgaatcgtcgtcgtcggcggcgattatccgttggagggatcgaaggcggcggggagcacacgaatcaaatcaaatcaaaatcaaccaaatttctttttgaggggaactgcgtggagattttatctggttcgtgacggccgcgcggcggccgaatcggaaaaactctctctcgcaaagacgagtgggaaacctgggacttatcaaggcgtcgccggtttctccgggggcgcgctcgtgtgtggctgacgcgtggggcccacgtgccgggccccacgtgtcagtgggcgcgggcgagcgggaaagggtggaaatttcgattggttcgcggcttgaaatcgtcgtggaggtgccttgtgttggaaggaaacgggtcgtgtgtgttttaaattgtttttttctcaacgcaaagtatgatgcggtttcggaagaaattcctcggaaattcagatggccccacctgtcagtggctattgggcgttgcaacgggggctgtcaacccctgaaaaatcgactgatattttgaaaggaggaaacgaataagtaattgcaacggtaaaattatcttgttaccgttcaaagaaaaatctcttgttagcaatagcattcggactaaccatcattatcaacgcccatgatcttagttaattgggcattaacatcggacggtcctggtttactgatcgattttttgctgtgctgcaacttgcaactaagcagatataaacagccacgaggattattaaaaacaatataaaacaagagaggattagagtaataagcccttgtttagttctcaactttctcttgaaacttctagcttttccatcacatcaaaaattttctacactcataaactttcaatttttttcttcaatctttcaattttagtcaaacttctaattttgacgtggaaccaaacacaccctaatatacttattttgcacggactactacaggtcttcaaagatgagcactaagggtatgtttagtttttaaacaaaaattttcacgctgacacatcgaatgtttcgacacatgcatggagtattaaatatagacaaaaacaaaaaccaattacacagttcattaggaaaatgcgagatgaatcttttaagcctaattgcgccatgatttgacaatgtggtgctacagtaaacatttactattgactgattaattaggcttaataaatttgtctcgtaatttataatttattttgttattagactacgtttaatacttcaaatgtgtatttgtataaccgatgtgacatgcatggataaaattttttgccaactaaacaagccctaaacacatgaaccgaagaacacttggaatcaaaatcgttatttatatccaaccaaaatgatcatcaacggcacagaaggctagaccagcttaaaatgcagaaactcaaaactgtagaaataattcacagccatcatagtatttcaaattcagaagaagaaaaatacaacagaaaaaaaaaagaagaaaaaaaatatactccgaagcgacttgctttcacccatgggccggggcgaggcccactgcgaacgggctgggcggcccaaggtacggcatgctcgccgtcggcggcgcggccgacgaagcagaggcgacgccggggaacgcggccacggccggctccgtcagcgggacgccgggcggcgtgtcgccggcgccggaggtggccgggagagggtcgccgccgccgccgccgccgccgtaggccggctggagctggcagtcgggccaccggcagtccggctggaccttccgctcgccccacgtccggtgggccagcccgaagcccaggacgaggcccactacgatgagcgccgccgcgaggcacaggaagatcttggtcgccttccccacgtagcagcacattgcaaagctaagctcgtcgtcttcttcttcttcctcctctccggcgagctcgtccggccaccgctctctcacccacaattcacaaagagcatgcgatgcaacgccgcagccgcactcgcagcagagagcacgagaggggaagagaatgaggctggagagagagagcaatggcgagagggatccagctccaactccaactcgcctcgcgtttttggcggtggtgctggctgtcggctttgcactcgtgcgaggcttcacgtgaaggagagagagagatggagatatagagaggttcgttagtatcacgacctaatcatcatattattaaagtgaaatgatcaccatcggtgactgcatgtttctgaacattttaatctcttttgcagtcagtgcagctcactgttcagttagtcagtgttgtatatatgaacagcagaaaacatactacagtaaagttagaaattcagattatggcaagtctcgtttctgcagtttattccagtaagtcagctctgcatcgatctaactaactcaggtacaaacaatagttgctatcatatcacacctaaacttgtctgctgttagtgataggagatgcactactctgccgacacatctagtaaaaaggtagtaattgattgaaggtaattaactggagtctgggacaagatgataaatgaagtgtacaagttcagaataatgctacagtgggtcttcagagaattggatggtgcaggttatgtggtgagggtccatggtgttggtccaataattctcttacttttatttctcttttgcccttttttccccttagcttttaatactctcattttggatgattgaatagtggagcacaaagatgaaggaaggcctcaagacaaccagtggcatgtccatagttggtcacatgttgcactgggccaaagaccagcttgcattttttgttcattcctaggtgtggttaggtatgcagctttaggttagagccttttatgatgcaaattcttttgattgaaatgcagagcttttgctaagctaatcattaattagtagtaccctgcaacagcaagataacggtacaacctactaacatgatctgcagattttacaatgaataaatcagctgctcgtgacacttgcttacacctggggatgtgcactttctgcggtggctgcagagatcatggcaatttttatagctcatcgtcagagtacgctttggaactacaccatccatcatcatgtgaagtgaaaaggcaaagcactactaggcatgccagatactgtcaacaaatctttttagtctaaactctgaagtctgaaccacatatttttcaactggaaacacatgtaagtaaatttcatagagcatggtaaagccacagctgcagcctgcagaacaaactaccgcaaggcacaagcctatcagttcaaagggacaccattcagagtcacaggagcaaagctagaatgtacacatggacgcatttttccggacctgaccaagaagcacccacggtcacagagaagtttctgaagataaaggcaacatctatatatctattccaccactatatcaggaggagcagtaactccaaaggactcagcagaagcgtccaccatcttcttgacctcatctgggttggcaccaacaatcttgttcaccacctccttgtccttgatgagaaaaaatgtcggcatggccttcactccaagcttggacgaaacactctgcatgcacacggtatatgatatagcagcttggctcagtaaactaatttaatgagcatatatgcatagcagttttgtaacaaatggttatgccatgatattcagtagaaacaattgaacatcaaagatgaaagctccgaagtctaaggacattttctagacaactctatgtgaaattatcagtttaggcatccactttctctactttctattcctcaaaagacacttcgctttcagaattcagaacaactcagagaaaatacgaccatgggatgtattccaaaaatacatgcataaacaacacgtcatgagaccaaaaataggagaatggtttccttctttaaaaaaaaaacagagagaatggttacctggacatcatcaacatccacatagaggaacagtatctcagggtgtgtctgagctagctcctcaaacttgtagttcatggacagcgaagtcacacaccatgaagccccaaagtgggcaacaacctacacaaagtcgaggggtcaataaccaagttaacttctgagtgagtaaaaagaaatttctggtgcaactgcagcggataattatcatcaggaaaattttcaatttggaactcagtttgtcaattacagttacagtgaaagaaaaacgagaaagacccagaaagaacgaaaagaacatgattacagaaatcaggttgcatgaagcatccatccccacaaactattatacatatatcgttctaacaaaattataatctacaaacagcaattacaaaaatcgtgggccgaccaaaatatgacttgagaataaacaacatcaatattcatcatgagagacaaagcaggaaagatgtgggggaagcccggcgaaaaaaaaagaggtgggggaagaacaaggcaaggaagaaaaaacccacagggtggccttcgttgcttgcttgattgacgaacagatcccatgactcctccttctcaaccttcacaactttggaattgccaacccccttctgctgctggatctccatatggcctaagaagcaagaacagaaccctctccctttcactccgtgttcttggtctcctcctcctccttgctcctttccccaagaccccaacaagaagagaacaaaattatcacagactgtctacaggaaagagaagtggcaatcctcctgaagattagataagcatggggatttatattctaaagctggtgggtcctgccttattttggctggtagtttcttctggagtcagtatcctatgcagtacttcaaaagctatgagcttatatcaaccacataaaagatatgcccaacgggaataagggccgtgatgcagaaagggtagcaaattaatagagagcttatctcctagtggaaaaggaatgcttatcaggtgggtactagctctgaaatggtaacgtattctacatgagctggtcaatttattagcaatacaacaaattgtggatgttagaacatattggagatggtaaattacaaagcgatgtttttgtgttcctagctccttgaaatcggatatatcataaagtatcatcattttgcagagcgcacctactgcaatttccatatatttcttattgcaataatcgaataacaaagaacaataagtttgtattctcccgctctagagtaataagttttgcatgtggcaaccttgcaataacatccagtttaaagctaccaagtgaacaaattaggagatccatacggaagggaaaacgtagcttgttttacttaaggtagcacacatgtcacagaatcacctcaaaaacatggactgcctgaggttagaagattagtttgctgccattcctagaattcctgcaaagcaagtaataactgtgaattgtcattttctgcgttaactaaaagtagagacgagaccaagaaatttacaagtctggatgtgttcaaatttgatggacatcatagtaacttcatataaaatatctcttactcagaaaaataaataaaaaataaaaaatctcaagttcagtgttacggtttagttgaagactttgatactgaacagaaccatgagaaattaatccagtctctaggagagctttggcaagtttaatcgtttcaacaagatttggggtttaactgctctcacttatgaaaaaaaaaacagctttttgagagaggaaaccctctagaagttcccttgttccttcaagcaggccacgagtccagaatacttgaaaaagaaagataacatgatgatttgatatggtgcgagtttaataccaacaaccctatccattggtggtcctaattaaaaaaaaaaggtgatggcaaacagacatgccaaaatcaatcatacaaaaaaagaactaccaaaaagagatttatattccaatcccccattagcttgccaaccatggtgactgtagacggtagatacacaaaacctagaaagaaagggggaaaaaagcaccgatgaattgcaaaaccacacgcaatttctcacagcagtgaaacagaccactgatctacaaagattgaagcgtgcgagctgtgaatcaattggaagtacacgatgtagcatagcgtagcatagcatagcatagcgccattctactcaaaactactac

SEQ ID NO: 31445 - DNA, 15584 bp, Oryza sativa
tatattaaatatcttaaaggtgctggattagctatcttaggcctcctccaacaaggatgagtcagctagctcataaatctccacatcagcttttgtatgatgtagaagagagagaagataaggagagagagtgcactatctcttcttcaagagctaagctcctaaacaaaatatgagaggggttgtggaacccaaagcattttgaacaatgtgctatgagacaacctattaaaaaggtaggctttttgctatctcttgtatgaggtggacaagcatgagctagtgcactagctcaaccattgaaggaggccttaaaggtgctagattagctgctctcctagcgatttggagaggcgcatccaatacggtgtggacacgttgtttcgttacagtggtcctgctaccatgggccagctgattgtttggcccagcgaccgacggccttttactggccatcgtggcatcggtggcgcggccttgcgtcgtcgtggtttggctgtatgctcagccatccgcgagccaccgctaccgtcttgacgcgtgcccattctccaacccatgtccggctaggattgagcgaaggctgtgtttctcgtccgctccgcttcagcgaatcggcaccgccgcgtgtcggccatcagcgagacagcgacacctccaaggctccaatgcccagcagcccctctctcatccatggtagtgctctgtcatggtgtacgggaatgacagggttggctgctccactaaaaatacgcgcggagacccccatgaggagcagatcgagggtacctgcatcgctcctttctttctttcattcgaagctggttctgttccttacttcttcctcttagttcctgttttttgtggagacggtactttccctagtcgcatcatcccgtatgctttgatctttttcagttgtgcttcgctctggatttcaccattgtgatgtcgatgttcttctgaccatgcctatgctcattgattttgatttttgttttctgccttctaggttgcgcggccaacccttaccgagacgtggttttactgctcgccgagccatccgcgttgcccccttccacttctcggcatccgctcgtcgtcgtcctctccgcatccgcatctcttcccaatttgtttgttcccctttatgttcttcactgtggctgcacgtacaacaagcttgaatagcatcacatactccccatcccgtcctcagcatcggcgtgccgcatggcatcgcagcgtcgccttcttcttcggcatcaaggtcgactcggtggctcactgctagcacagatggcgggcggggagtggatctttcaattcttcctcagcgacttgcccgacggtgttgctagctgacacaaccatttcctcaatggcagaaatcggcgtacggtctacctgtcctcctccggtacggtttcccttctcttatctctcatctagcataaattgaagataatgttctgaatttaggctaaatttatcagatgtttgtttgggaagttcgttcaaagattcagatagaacccagcacatttccgaatattggtgcctccagatttctctctctatttcttttttaaatgttgccttctgataattcgaactctgcgccaattcctcttatggaaagagagtcgatgtgatgtcatgaggcaaaacatgaactggtgagcttccctgaaacctgttgattccctggcaacattgatgttttattaggatgaattctcacattaatagcttccttccattagggctttcaatgttctaaacttttttttagagaaatcatgttctaaacttttgattggtgaaagaagttacaattactaaggagctctcatcctctcctgcgaatgagattctattcatttttctgttcctgtactttaagcatgtcagtatgccactacttcattgtccaaaactgagctccaaagaaaggtcaaagtggccagcttaggattaaaacaagtttagcagaatcttcttacacaaattatttggtgtttttcagcatacaggtaaacagacggctagacttcatgatacatgctaatgttgggaggggcaagccactatgctcagctcatggatcttcaggaacggagctgccagcatattactgacaaacaaatacaaggtaaataggcagaagagatccttcatgtgctttgctctccgatgttctccgtagagaaaagaaaagttaatcatttcaattatttatttttattcattaattatatgtaattagtaaattgttgtgttgtatatgtgttaccattttgacaaaaaaaagagcactccgattgatcattttctgaaccatacaggaaaaatactccatgcttttgtatgagctgttcttagtctcttatagaatgtgctgtggtcttaatctctgaaggctgagctgtgttagattggagcactccgatccaactcttttgcccaccaaatcaacttaccaatgcctgttagatagatctctctccccttgagcccaacggctcaagggggccttgaccgcgccctgatcgggggcgcccagcccaatggctggtgggcccccgtcacactgcgccatataaaagaggggtggaggccggcacggcacatggtacgagattcaccgccgccgccaactccaccctacaaaccctaatccgatcgagagggggcgcagccagtgacgggaagcgccaccgccgcgccagacctcatcgccgggacatctacgaccgtcactcccgcagccgtcatcgccgtcgacctcaccggcgccgcatccacgacaaccgagcgccaacgacgacgatggccggcacttcttcatcctccaacacctcaaccggtcggtctatctaaaccctctcccgttttcaatctctatagttcaaacatcaaacccaaatagaaccacccgactagatctaacctaggtgatcctagtgcaaagtttaacaatggtatcagagcaaccctagtgtttagatcgtttcggggaaagaaatccaaagaaagaaaagcacaagatccgcacggatcaaaagaaccaaaaaccctaaccctaattcttacctcgtcgccggccgtcgtcgacgccggcaacggagggggggaggggcaaagaggcgccgcctaggagccactcgacggccgcgcgcgcacctgcacgcgcgtgccggcgagggggcccgcggcggcgccgccatctccgtcgtcgccatctctctctcacacggtgggggttagagacggtggggggagcggagaagagaaaagaaaggagcgccggccatggcgcggcggcgcgagggccgccggcgtcggcgacgccgctcggcgcgaccgcgcccgcccgagagagagaaagagaggagaagctagggtttcggcggccggccggggcacgaggggttttgatccccgttttcggcgcccggccgtccgatcgcaaaccctaagatcggacgtccggcggcggccggaccgaaatcggcccaagtggggagcgcgcggcggcggctttcccggcccaggcccaggttgcggcctgggggaggggagggggcgctcgcccgcgcgcaaggtggccatgggccgaccggcaaaggccggaacaaagtccatataaggtccctccggggccgaaaatgaataaaagagaacagtagcaatttttccattttattttgtcaattttcatgcaaatttcaatagaattttgaatagatttttgcatgttttacctctgtttaaatttgaaccaacgggagaattttcacagagagagaattacagagattttgctactgttcatatgattttatatagtcttccgctgcaaatagatgaaattgatgaaaattagtgtttctaaaattaaatttcgaaccaacgggagaatttaattttaggaacattaattatgtgctatgatgttgtaattttctgaccaacgttgttaattgcaatattatagttatggttatatgtgttatgtctaattctgcccaacggtgatgtaggcttaatgcataatattttaatgttaattttgttctcaccgcacatgattatttcaggtggctactccttgatgggttgcattaaagatattccgaccctaaaaggagataactacgcagaatggaaaagaaaactcgaccttgcttttatcttgggagaggtggactgggtattgactaccccatgtcctatagaacctgctgaccttgtcagaggtgaaaatgagtcagatgctgactggcaaaagagacagagggacaatgctcctctcgtcatgtcgtatgacattgaacaaaagaaatggtccttagccaacaagaaatgtttggctgtggtaaagaatacgattgagcctaccatattgggctcgatcccagagtgtgacgctgtctcagagtaccttgaaagaataaagagtcagtttactggctcttcaaagacttatgctacacagctgatcaagcagcttgtgacagaaaggtacaatggaggtggtgttagagaccacatacttagaatgagcaacatggcttccaagttgaagccaatggatttgggcataacagatgactttctggtccatctggttatggcctcattgccaaagcagtttgacaattttattgtcaactacaacataagtccagagaaatggaactttgagaagctcattgctaattgtgtgcaagaggaggagagaatcaaagaatcaaatggtggttcaataaactatgttaaagataagaaaaagaaccacaagtctcccacctcaaaaggtaaacagtctcagcatctgcctcagcaacaacagttcgctgttgagaaagatcaatgtctccactgcaagaagacaggacactacaagaaagattgtcctgattttttgaaaatgatcatggcaaagaaaggtgagaacattattacatttgtaaatgaatctcattatgttggttactctagatccacatggtggattgattctggagcaactattcatgcttgtaattgtttaaaggcattccgttcgacgaggactacgcaaagaagagaaagcaccattagagttgccaatggagttgaagaaaaagttgaagctgttggagatcttcctctagagctcgcgaatggcttcatacttttacttcgagatgtcttttatgttccttctttgcaaagaaacttaataagtgtatcaaagttggattttgatggatatgattgccgctttggaagtggcaaatgtgaactatggcataataatgcatgtattggtcttgctgtgttgcgagacgagctttatttgttatctctttctgagaatgtgaatgttgtgtcctcgttgacaaaagaaaacaagaaaagaaagcgaactcccgatgtctcatcgaaattatggcactgtcgtttgggccatatttcgagggggagaattgagagactagttaagaatgaaattcttcctccattggagttctcagacttagaacaatgcatagaatgcattaaaggaaaatttgtaaagagcatcaaaaagggtgcaaaacgaagcgcaggaattttagagatcattcatacagatatttgtggtccatttcctgtgaaaagtgtggatggctatgactcgttcataacattcacagatgattactcccgctatggttatatttatccaattaaagagcgatcagaagcattggataaatttaagatattcaaagctgaagttgaaaatcagcatgatataaagattaaagtagtaagatctgaccgtgggggggagtactatggtcgacatacgccttatgggcaagtccctggaccttttgcaaggttcttgctagagaatggaatagtagcccagtattcaacaccgggcgaacctcaacagaatggggtagctgaaaggcgcaaccgtacccttatggatatggcgcgcagcatgatgagctactccacactaccactcggtttatggatggaggcgttaaaaaccgccattcatattctcaacagagttccaagcaaatcggtgcccaaaacaccgtatgagctatggacagggagagtaccctcgctaactcacctccgtgtgtgggggagtcctgcagaggccaaagtatttaacccaaatattgggaagttggaccccaaaacagtcagctgccattttattggctatcctgaaagatcaaaaggctatcgtttctactgtccaaacagttatacaaagtttgtagaaacgagacacgccgtcttcttggaagacgaaatgattagggggagctcggtagttcgagaaattgatcttgaggagaggcgggtgtctgtacccgctccgtcgactcaggaacctttcttctctctacctgctgatgttgtgcctgcaatgcctgtcattgaggtaccagcacctgttgttacccctcctgtggcaacaatgaatgagagtgaggaacctgttatacaggattcaacagaaatggttgccacaccagaggaggagctacaacaacctcaaatagataatgtgccagtacaggagactcatcaagagcctcaggtacaggatgtgccaaatgtgcaggcccctagaaggtctgaaagagtcagaagatcggctatccgtgatgactataaagtttataatatagaagagtcgcatatggaggatgatcccacctcatatgaagaggccatgagaagcgctcgctcatctgaatggttggaagccatgaaagatgaaatgaaatcaatgaaactaaacgatgtttgggatttagaagaaattcctaaaggagccaaaacagtaggctgtaaatgggtctacaaaaccaaatatgactccagagggaatatagaaaagtttaaagcgcgacttgtggcaaaaggcttcacgcaacgagaagggattgattacaatgagacattttctccagtctcttgtaaagattccttcaggattataatggcactagtggcacattatgatttggaattacatcagatggatgtaaaaacggcatttctaaatggagatttggaggaaaaagtatacatggcgcaaccaaaaggttttgtcatgaaaggaaacgaaaatatgggatgtcgtctaaagagatccatttatggattaaagcaagcttcgagacagtggtacttgaagtttgatgggacaataaagaaatttgggtttcaagagaatgtcgaggacaactgtatttattcaaagtttaagaatgggagatttattttcctaattctgtatgtggatgacattctactggctagtagtgatgtcagtctactgcaggaaacaaagaaattcttgtcctcaaactttgacatgaaagacctcggtgaggcttcatatgttttgggcatagagattcaccgagatagaacaaagtatgcattgggactttctcaaaagacatatatagaaaaggtgttgaagaaattcaacatgtacagatgcagtgctacacctgctcctataatgaaaggcgaaaagtatggggcatcgcaatgtcccagaaatcagtatgagctcaatgaaatgaaaacaaagccatatgcgtcagctgtaggaagcctacagtacgcgcaagtgtgcacacgacctgacttggcatttgttaccgggttacttggcagatttcagagtaatccaggcctagagcactggaaattggtaaagaaagtcttgcgttatttgcaaggaacaaaaggcctcatgctgtcttacagaagatcagaatcactccagatagtggggtactcagattctgactttgcaaaagataatacaaagtcaacatcgggatacgtgtttaccctggcaggaggagctatttcatggaaaagctcaaaacagactatcactgcagggtctactatgtatgccgagtttatagcatgctatgaggcaacggggcaggtgaactggctaaagaagttcatacccggtttaaaggtggttgacagtattgagaaaccactaaagttatactgcgacaacgaacccgcagtaatgtacgctcacaacaatcagtcaagtggtgctgccaaacacattgacataaagtactatgttgtgaaggacaaagtccgggatcaaacaatcagtctcgagcacattaaaacagaaaggatgctcgcggatccgctcacgaaaggcctaccacccaacgtgttcaaggaacatgtagccggcatgggtttaagggaagccttatgaatcctggactacagggcccaaaagtaaagtatctgtttctgaatagagatgtgtatagtggctgtcgaatccatcggcgattgaccgtgacgatgaaacatgctctatttacaaatctgtgatggaatagaaaaagctaaaagaaaaagtgagatcaagggggagaatgttagatagatctctctccccttgagcccaacggctcaagggggccttgaccgcgccctgatcgggggcgcccagcccaatggctggtgggcccccgtcacactgcgccatataaaagaggggtggaggccggcacggcacatggtacgagattcaccgccgccgccaactccaccctacaaaccctaatccgatcgagagggggcgcagccagtgacgggaagcgccaccgccgcgccagacctcatcgccgggacatctacgaccgtcactcccgcagccgtcatcgccgtcgacctcaccggcgccgcatccacgacaaccgagcgccaacgacgacgatggccggcacttcttcatcctccaacacctcaaccggtcggtctatctaaaccctctcccgttttcaatctctatagttcaaacatcaaacccaaatagaaccacccgactagatctaacctaggtgatcctagtgcaaagtttaacaatgccaagccaattgagtgcagcaaagcacaaacaatatggtctttatagcctgtgcagatatagctcttccattggtgtgttctgccaccacatcacttccaaagttgtttccaagctaaaaatcatgctgcagtggtggttcaatcccacacttgaataattggtgtttcctgcactgatgtagtagtgactgccttttctcacttgcataattgatgtacttcgctcacttttttatcttaacatatttcataatatcatatagattctcctcaaggactgcgacaagattgaagctcatgcttagcaggaaaaccattttttttttacggaaagcaggaaaaccatttgaaatacctatggaaatatccctacacatgtgttaaccatgatgatctttttcttttcgaaatactgtaaggcaggtatatccatcatctttgtcatctacaactgccttagctatacaaatattcaactctcaaagtagtttggtagctaattaatcagacaggtgatgtaaatgtatacatcgtccattgattcacagtggatactcagttgttgcatttaaatgtctcttttcaggaaccataagttcatttacatggctattttaagagtccactgctctgattagtaacataacactgactgaaatgaggatctgttcattaatttgagtttcttctactgactcagtaacatctctccatgtgctgacttaattctccaaactttgagttctactgacttagtaacatctctcaatatgctaagttaattctccaaactattaacttaggaatgatttaacttggcacatattttcttagtgttcaagaaatgattttagcagatgcttgccattgcacctggtgatctaagttgactgaattgctgaggcggatatgtttcttgaacagaaagttctcatagtgaagtgtcaagtctcttcttaaaactaatgaatctgaaatatgtagtcggtctttcataccatagttgataaatgcaatactattgtctcatctgactgggtttttggccagttctagagtttacagatattatcttaatactgcagtcctcgcaaacaaaactacgagaaatttaaccatgttccattttcagttagttgacataacgaactgcatcttgtgcccattgatattggatgagtcatactatgcttgccacccctgctatgtattgtgaaattattgtttaaattattaactatcaggaactgtttctggcgacttcagttattaaaaaaaaaactatacaggttaaataatgttcttagtaggtacacaaggaattgactgttgttgttaggtaatcctcttagacaaaccttgcaatcgtacatttctttctgtgcgttacagtcttacatgctacaataccgcgcagcgtagcgcgcgagctcactctagtaatctaaaaagagtatggcctagtccgttaaccatagtgcatcttgaaatcgattggaagaaggaaaaaaaaaaggcatagtccgttcatttctcattgtgatacagtgatactgattttacctcatttttattagcatgtttttcaaactactagacagtgcattttgtgcaactttcttatatagaagttgttttaaattattagataaattattttttaatatttgaagtaataaacctcaattaatcatgtacctgcagttaatcttcgtccaccgcaagttctgtggttctgtggaatatattccaagtttgcaactgaaaaacttcatgagcactgactgcatttgcactgcagttcagtggatgcatcgacggagaatgaatacgcattccatgacagaactaaaacgcagggaaatacagagttacaaatcatatggcacgaaccgatacacatttcgtggcataaccatcattttgatgcaggagccagcagcgaagttctgccgggcaaaagtagtacaccattttggaacccacggttgcatacaaagttactccagaaaatacattgcaatgcagttaatattgctcaaatcagctacaacagaaagaaaacacatgatgcatgcgtgttctcttctgctcacagcgcactagcgcagtgccactctccttcctactgtacaagttacaagaagcaagcggcctcatcagcttcagccaaatgatatccccaatgctgatcgattatcatcacatcatgatggccacagcaacttcagccatagctcagcctggaatcgaaggaccgggcttgtgtgtgccgtcttggtattccgatctcgcaagcatttacccttgaagcgaacctcagtgaacaaatcgtctccccaacggatgatgcctccggagaaatgttgacaaacatcagcgttttggaatcacctccaaggcaaggctgcaatagaaagttgatataagaaatatgtttcaaataaattcagggattgcaggtttttgtattaccatccatttgcacaagtcactcacctgcaaaaggtatgtaagttttgagttcctgaagggcacatgatcgtctcctttcgcaattgcaaagataacatcgctaagagctgacaagcttttattgattgcctgaaacataaagaaaacaaacagataagacaatgtgattatcaaataagaatattgtaaatttgtgatgaacacactcacctgagtttccttcaaacgatcacccgtggagccacttttagcaaggcgttcactgccagctaaatcaatcaagttaaggacaccttggacttgttgcccagtgttctgcattaagatcaaaagaaaattagtgacatacatttgctcaagtttcagtggttctgtttagttagcatgaaaatgaaaaaaaaaatattgtgaccagtttgtaaagtttcagcactgtgattaatattctaaaatatgggtgaagcgagtacctcatttgatccagatatcttcagtgtgaaaacaaaatggctccgggaagattgttcattcatttgggtcctacccacagacctggttcaatgtggtgaaaaaaaatttagactcactgttgatatgtagactaggtggctaacagacacatgtgaattcagataataagtgctagcttgtataaaaggtaaaccctcttatgtttctgctctctctaatatatttgagtgatagatgagagaatcatctagacatatccaaagcattgctatttcaaatataacattaaactgataatggtcaatacccttagagcaaacagttacaaggcacaagtgaatgattaaaaatgaataaagcgtatttacctgctttgggatgctttcgctagaagagaagttacgtcggcgctactaaaaacatcagcaacagtaaggtcagtgacggttgtgttcccttgtggatcatgctttatggtgtattgtttactggtagacagatcaaagttattagaccgaccaggtgctaacaaatcacgaattgtctcattgtatatttccaacattgatgcctgcacataggaaaaactctcagcaacactacatagaatgtacacttcagaatctgcattgcactatggatactaacctgcatactgtacttccatccttgagattcaagagactgacttgtcttaaaaatttgctccaaagaacgaggtatgatgcctttctgatcacgccctggtggacccatcattgtataagttttaccagaccctgtttgaccataagcaaatatgcaaacctgcatcatgcaaaaataacttaagcataccaaattgacaagtacttcaaaactgaaataaactagaaacatcagtcagagtttcaagataatggtgattatacaaatgcagaatgcaggtgatatatactagaaacatcaatgtaagatgttcacggcttttagcatgtatttgtgcttatgtggtggtgctgaagagataaaatttggggtgccaccatatcaattaaaacaactttcatttgttcttgaaataaaaaaaataaagttaggatatttgagttattagagacaggaacctcatgaacagattattcaccaatacttcattgttgtagtgaaatattcataccttgtacccatcaagtgcactttgaactagttgtgacatttccacaaacacatcttcttgtgaagcaccgtgatcgaaaactttgtcatatgagaaggaaaatctctgacctacatcaacacaaaacaataaaatgaagtctccgattaactttaccactgaaaacttagtgggggaaacatagtttctgtttagcttcaacaatgaatatgattttaccttggttcatcaaatcaataccacgcccggcagattcaactgatgttggatatgaaataagggcttcttctgcaccactagaatcgttgtcttgcaaaagtggtcggaccctacaaaacactctgatgtttcctttaagctcctgcaaatagaaaggctaatcagtaacaagtagcaatagcaagatgaaaaaatttcagtatttactcaaaaatttcttctgtcagtaaaatagagaaattgtttttagtaagaagtgctagtatgctgaaacaattaccaatattgtattgtgcagtttctttcgtagcttgtcagcttcaacaatttgaaattctgcggatgccaaacgttcttccagatcttttattatcaccttttgttcttcatatcctgtcatcgcctcaattgcagtaacatcagcaagctgcaaaagtaaacaattagatcaaatgtcatataatcatatctcacatgtaaatcagcactgacaaaatattatttctaaccttcagtttatttgttgcaactgcaagttgtttctgcaaagtttgaatctgttcttgttgcatactacatgtttcctgagcagaagcataatggtgagccaaatagttgcgcacagaaagtattgatttggttaatctgaaaccactaacctcaaaggctgacacttttacactcaagctttcacagtcttttgtagacttgcctgctagttccttgtaattagcaagctcagcactcaaggtatttacttgagaaacagactgatcacggtcttctctaatttggtgtagctcaattctaaggcaatccacttctttcataagttgttctttcattctaatggcctcttgttgagaagtctaacagaaatcaaaacaattaaatgtttaagtgaaacaagaactatactgcccaaaaaaattatcaattcacgaaaaaacacaactcaccctagaagaatccaaatggttcttcattgaattgtttaaatctttcagagaagccattgtttccatcatggcactcttctcttttgcagttttgagatgatgtccccactcttagaggcatcagcttgaagattactgttgtattgctgcaagctggtgttgtactcctgcagtcttttgttcgtgtcttggaccattttcagctagttcacaatttccatccatcagaaaggaacattatatatgactcaaattcatgtaagactaatagaacatttctgaacacgtacttgctcactaaaccgttttgcttcatggctgactctttccaggtccaccgacagcaagtcgagggacgcctcagccgattccctttgctgcctctccttctcgtaggactccacagcaagctgccagtttaaaggtcaacaagtgtaagccgtggctgaaaccaatcacacaggcacacagcacagtacataactatgcagctcaatcatgcgatagatgagttctaaccatcctgtcggccttctccttgttgaagctttcctccaacgaatcgcactgccgcgtcaagttcaggtgtgcagcttcagctcttccagatcactgctaagctgggcctctggaagtacagtaccccaagaacataaatgaccagaataaactcagtcactacgatgagatggtactctgatgaccaaacagcacacatgaatgctcaaaacccaaaagagtaccatcttgttctcttggtgtgatcaaataaatacaaaaaaaagagaagtgcattcgaattcattacccaacttggcgtgctgggcattctctgcatccatcgtactacggagcttctcctgctcgaccaagtagccgtcctccaactcaatgtaccagcggatgcaagctctcagcttcttgatgtactcactcatctgctcagttctcccctgcacaggtccaaccaaattcaggaaacccgccccccaaaaattctcaaacagaacgaacgccaagaaatcccccaaaagaacccaccttgtagtcggtcttgctcttccccttcatcttctcggcgagcagccgctccacatcctccctcccggtgaactcgatcacaggcgccgccggcccagccccgccctcgccgccgtccaccgacgccgtgtcgctgttcgtgccaccgccattgttgattgccgagaggacattgcggcgcgggccaggcttgacccccatcccccgccgcgcgttgcccaagttctccttcttctgcaacaacaacaacaacaaccacaccccacaaatcgaaagaactaagctcccatgaatcaaccctcccccaaaatagg

SEQ ID NO: 31446 - DNA, 13298 bp, Oryza sativa
gacaaagccgcgctttagatccgaaaaacctcgagaaaaaaactgcggagccgatgaaattggggaaggattcgaagtttttgaagccaccgagcggagattaccctcgatttttcatggatttctcgcctcgctcggatctgagcgagagatgtgtgggagaagagagagagagaggaaggagaagaagaggacgaggcggccgagctatttcgaaatattttgaacgctgacgcatcaggggtacccaccccacccctccgatttcgatttatttacacccaatgccactggtgttagtttaaagcccaagccggcggtgaccaggtctaagtggctggccggctcgggcagggtcattcgcgtaatatgattggttagtcaggggtattttcggtatttctgttgaacggtcaacttcgatgttgtgggcttcgagattcgcgtcgccttgggccttgctgataatgggccgggccgggccggggcatgttgcgacgttgctctcctcgttttctttgtccttttcgggaatcaacagcttagaggtgccacgtcttgttattaagcttttgacagctttttcttcctgaaatctcaacgaatagttaagctagcttgtcagtcacctcgcgcactggaacctgagaatgatcggacaatcgacgcgatgctaattagaaatttgctgtttgttagtattagtaaattggtgtctcgtctcgtcaagttgcgagattaggtcttaattgccttgtgccttaccggtttaggttgcgttcggtagagcgtattcaaatcttatttgtcttacgcaatacgagaagatcattagtttataattaattaaatacttaattattatagtttctttaaaagactattttaaaaatatatatagagaagttttttacaaacagtataaaaagcgtgtcatcataagccaacagacagtaactgaaaagagcttaggctcccattggttcctctatatagaattaaccgctgtcaaaatttaaattttagagtttattttaatttttttcattgaacatatctctactattataaaaatttaagatgtttttatcggtattttggtacgtcatatgtgtatacgtcagtttttaagtttgtttgcttttaaaaatatgtatccgtatttgattcggtttttaaaatcgtccacttttggtaatacagaagaaatcatataagaaatttgttttaaaaaacttgcatgctaacttgagatgattagactcctaaatatagctcatgattttctaaaaatatataaagcgaactctcacagtgaatttcattttaactaaaacatataacaataataagattaaaatcgacttcacccgttgtaacgtacgggcatttttttctagtatatagaaaaatttaacctataaactattcttttctaacgcgccgtacgacgtattttcgacaattggcccacagacgagggccttaaagatggatttgtgaagggggtttggtgtaatgatgcttggcgtacgttgtcagctagccatttactatttctggtgctttattagttgggggaaaagagcatgaccgctgctgtcccctctcaaagctcctgagttttttcgccttaaaaccacgtttcgtccttgccaaacgtggtccactgaagtgccagtgctttgttgtttgagtaatcgagttataattggtacagtatctgcgagcttaatacagatgtcaccgctgttctggattgcaatcctgttttgattagggagtgtattgattaccttgtactcctacataatggcaccgatagtggcctagcgatgcccagtgatgcgttctcttgcagttcacgcaaaacgtgacaatggtatagtcgatgttagaccggtgtacctcttgccaagatgtatgtacagtagaacgccgtaccagactaccagtttctgctagctaagcgtacgtttctgattaatgatagattctagaaaaagaaaacaggtcccatatcgatcaagcgggctgatttaatactccctccttctcaaaatgtttccgttgacttttttaaatatgtttgtacatgactccatagaacgatgacgacgacgtctgtgctgcaaccagaaaaatacaagagaagaaacagaggaaaataatggccttcgttttctttttcagaaagcggctcgtagtactgtattttagtataatgtatgtacatgtcccagccgacactgctgcgtatacacggtagcggaagattgacggatcgatcggtcgcgggaaggtgacgcggcgcgcgcatgtaagctcgggcgtcgctagctgccgatcgatcggtcgccgtcgatcgccggagcgggggcagacacagggcgctgctgcgtgacggcgacccggggcatgatcgagtcactcgttcgctcgccaccaaacctggctttgtcacggacgggggcgtcggaaaggaccacgcgaccgtgggggaagagcagaatgaattatgtgcgcgcgcagggcgtgccgccgaaaacgaccgcgcagccgtcgcgcgtcgccgcttgccggtgccgcgcgtggcgggtgggtggggaggagacgctgcgtgatgtcgcgcttgcgccccccgtcgcacggttgaggtcgtgattttcgcgcgatctcacggagaagtcgtcgtgtcgtctcctacgtacgcgcgacgccggcgggggaagcgctggtccggtgggccggctagccgcgaacgattactagccaactgggcctcgtggttcgcgagaggaagaaggccttctttgtttaggcctatgagctggaaagtctaagctcttaaggtgtgtttagttgagctctggctttgaaaaaaatatctgtgggctgtagttttcttaaacgattttgctatatctcactcgaaaatttttttcttatctctcactcgattttctcattcaaatttacagtgcattttcttgtaagttacagtgtaatttatgaaacttacactgtaacttttgtaagttacactgtaatttttgaatcttcacatgtaaattttaaattttgtattggatttggtctttttcttgaggatatggtaatttaatgttcattatggtgtttcttaattgctttttgctttttattatatctatcggattttaatataaagattaaaaatctgtgtgatacgattataaaaatctttcgaaagatgtataggtactcccttcttaaaagtagctggggaatatgtacggtggcttttggaaaagctcatttggttcaatagctgtggcttttgaaataactagtcccgctgacagcgacccccacatgtcatacacacgttgaaataaaagaagagggagagatggatatggcaacggcggtgtcgtcggcctcagcggtggcagcggcgtctcggcgaggaggagcggtagcggcggttcagcgacgaagaggacgcacggtggtgaggagcggtggcgccaggaggatgaggcagtggtgacgccaccgctgtcggccacctcaccaccttcgtctcccacctccatggccgacgagcgaaggggcggcggcgtcgggaggaggaggcgtcggtcggggaagggcgggagcggcgctggcgtcgcgttgaccggcgtctgttgaggaagggcgggggcggcatcgatcagggaaggacgggagctgcgccggcgtcgggttgggcgtcgtcggttggggaagggcgggggctgcgccgacatcaggttgggcggcgtcggttggggaagggcgggggcggcgccgatggcggacacccaatgcgcccgatggccgacgctcgccccatgaagtcacgactcgcgagaaggaggagacgaggaaaagaatatcggaccgttttttcataatggcagaggtgggtaatttttccctcaaaagcacttggagcaaaagcacttatgcttttgggtcctttggttgactcttgacttttgcaaaaggaaaagcaggttgaaaagtccaaccaaacacacccctagtgtatatttatagttaactattgtataaattaactattagattgactatagattatttgaagcttatagtaggctcttaaccttatgagctggaaagtctaagcttaacaaatatgcagttctttcgtttgtactcatcatcaaaaattatgttgaagaagtttttttttcttacgctagatagagttatgaccctactattaaacttagtacttcaatccattagcctataaatcatataaactaaaaaggcgacttaaaaatccaagaaaaaattccctaaataaagaggctctaagtatatttttcttccctcatctcttgcttctaattgaattgtctccttcaatagtaaaattcggatataataagtttgatcacggttaatttaacacatcagtagaaaatcgattttcaaaccatcaaaggagtcgatttataccggtttttgaagttggagagtgcgatatacccggttttgcggttgattgatgcaatttgaccgaggtctttcaaattagacttattttctttgctagagggaggaaaaatgggccttactggtccaaatttagctagattaatgggccggacgtgtactgtaactggccagcccagtcactcgcatcgtcgactacctcttgccatcggttctcccgggaagttttgcggcggcctagggttttagcattctcacctcagcggcggcggcggcgggggacaccggattttccgctccgatgcctcgtcagcacgcgccggcgttcacgccggaggcggcgtcggcgtcggccaccggcggggccggggagcggcagagcctcccggcgctgcaggcgaagatgaagcgcgacccggaggggtacgaggaggagctccgccagctgcggcgccacttcgagtcatcggtgttcctcttccggcagcaggcggcactggcctccacgtcctcgtccggcggcggaggggaggtggccaaggagctcggcgacctcgcgctgttcctcgcccacgtcgcgcccttctacccggacgacctcgctgacttgcccgaccagattggtggcctgcttgacaccaacgcgcgcgcgctgccgtccgggctccgtgtgcacctcgtgcaggcgctgatactactggtgaatcggaaggtgacgcctgtttagttcatctgttcatttcacattaagttaaattttgttcaaatcgtgtggattggaacgggattatcgtatgactgtagagtaaattctcctcgtatacattgctttttgatgtttagattgttgatctggaggacacaatggagttatttatggagcttcaagttataggggaccgggctgtcaaaaaactagcattctcacatattgtacacagtatcaggagaatgaatcagacccacaagaatgaagccaggaatcgtaaactgcaaaacatccttttcacattcctacaggtttgtgacataccactataccacacttgcactgattagtattatcgggtttaacatagtggcaagaatacattcatgattctcttcctacctcgtttagttatgcatcttgcttcgctgtttcccagggcgaggaagagtcgagagcaaagagggcctttactattctatgtgatcttcaccgtcggagggtctggtttgatgaccgcacagcaaatgctatatgcaatgcttgtttccatggttcttctaagtacatactgccagcatctttgtgtttattaataggtgttgatctaaaatatatcttttacatgcagaattatgatagccgctatttcattccttcttgggtatgaaaacgttgagcaagaagatgatagtgatgcatccagcagtgaagatgaagctcaaaaccctcaaattattcttagtaaagaggatgtttacaaggttatttgaatttttaccattatttcgatttatagtgttttacatcttttttctgttacgtgccttctgatataatgtattttattgtcatattactttctcaggcaaatcacaagggcactgctgctactaagaaaaagaagaaagctaaattgcagcgtgtgattcgtagtatgaaaaggcaacaacgtaaatccactgaggacactggctccaattattattcaccactgacgtatttaaaggatcctcaggtgggaaatggtgtaatcccataattgttcagagtgttatcatttacatattgactgttatattgaagctttcgttttttggctgacagggttttgctgagaagctcttctctcggctccagaaatgcaatgagcggtttgaggttggccccattccttgttctgaagattccttgttctgtaaagatttaaaaagttatatataattgtcagaactatcattacttagtacttttagctttctgctgaagttttatacatgagtgtatatagttggaaccagcattcaagtaggagaattggaacccagatgtgcaatagtttattttttaaacacaatgtctgttgtgagttccatccgatggttaaacgaaaataaacgttaattcaaatttagagaatgttggttgggtgcttgcaggtaaggatgatgatgttaaaggttatagcgaggactattgggctgcatcacttggttttgttgaacttctatccatatcttcaaagatacgttcaggtatgttcttaacttggcatgtgttcttcttgtagcaaccttatggtagatataatgtttatctatactctatactaatataaaagatggtagtggtggtggacccacggactgtgagttgcgtatctcttagcccccacatgccatagatcccgtcgaaaggaaaatatgacaatagaatattatgaaaattttcatctttacgaaatgacagcaaaattagcataatgataatataatagacaattagaaaaaaaaaccgttgcacctcacgtgcattatactagttcatactagttttgataataagttttctacctttctgtgatgcagcctcatcaacgagatgtaacaactttacttgctgcagcagtacaggcttgccatgatatggttgaaacacttttgctcttctcctatatttcactacttatatcatttcttttgctttgtccaaattcagctaaattaatatgcttcaatttcaggtgcctcctgatgcagttgaaccactgtttaagcagatagtaaatcaatttgtgcatgatcgttctcgcccagaggtttgcataacactcatcacatatctaatatatttaagtattttccaactaacatggcatatttctaaccaatctcattttaggctattgctgttggcttgaatgttgtgcgagagatctgcatgagaatacctttggtacttaccttgctcaaatctgtactcttgctttctagtgctactgacctctgaccagacaccccttaaatttgtgtgatggattcattaaatttttatggtggtcatgttttgttgtacctaattcctgtgccctggacatgctctagtagaaattgtgatttcatttttttactagtcttaaatgactggttgcgtagtccaaactccaaaaggatgtgatagtcgattgctacaggttttaagcatataagtgtaacttaatgaagaattgaaaaggtataaacatggttttaccaggccacatttagtcttgtgtagcctgacacgttagtcacttatgcatgagaagttgagaacacacatgcaggtttgtatactacattaccacctgaggtactgtgcgggttgtaagatatttaggaagatattcttggtctatttattttattcatctagcaggcctctgttaatccttctgttatacctgcagttgatgaatgaagatctactccaggaccttgttttatacaaaaagtcccatgaaaaagctgtttccattgccgctcgttctctaattactttattccgggaggtcagttcttatccttttgcatattctgtgatttctttttgttcacttcagctaaaccttcttttggtttgggttcagatctgtccttctctgctagtcaagaaagatcgtgggcgtcctgctgatccgaaggctcgaccaaaagcattcggcgaagcaactatcgcttctgatgtgcctggagctgagttgctagatgaagatttttcatcagaaggggaaggctcagacgatgagtctgatgcttttgattctaatgatgagaaagagttgcaatctgctcgtggtactaaacaaaatttggatggttcgtctgaagcaaacaagcttgacacagatgaaggtatgaaagaggaagatcaactatctggggatgaagatgatacagaggaactagatgaggatcaagacatctctgacaatgatagtgaagaaaatgatgatgagctagaattggactctgatatggatgaggagaatgatgtatctgaatctgatgatgatgaggaactcagtgagaaattggatgattctgatgaaggctctgatcaggatgatgacagtgaccaggatgataagtcaaaaaacagcagtcgcaaggcaaataagagaaagttgagtgattatatagggcaacttaatgctgcagatgcaagccttcgagctctgaagaagttggcaggagccaagaaggctgaagcttcgtgcgatgaagctggtaaaatcttatctgatgaagattttaagcgtattaaggagctaaaggtatgggagttttttccagctgtagttcatgctgtggagctttcttttgggaaagaaagtgaagttgtgtatatctgacattgttatgagtttcaggcaaaaaaagaagcaaaactggctctggcacaacatggactcggcaagggccatgacacaaaatcagtaacctttaaaatgccttcttctgatcagcttagtctgaaacgggttgacccatccaagcttgaggtgcattttctctcttcccctcccgcattgcactcgtgccagcgcgctcatgcacacacatccacactttgcttatatgaacatcttcctttatgtaggctcacataaagagaaagcttacgaaagaggagagattagaaatggtgaaggctggaagagaggatagaggaaaataccaagcaagaacagctgtgaaacagaaaaaggtattcgtttatatgatcctcctttttggtgcttattttgacctatgttggctatatggcacaaccttgtgaaatctgatcatgaattgttctttcgtagttgcttttattccttctctacttatatgcttctcattgcgttttagaccggtggcttgagcaataggcagaaacaacacaagaagaaaatgcccctcgctgcaagcagagcgaaggcagcgcgttctcgacaggagaagaaaaaactgcaaaagcgctcgggaaagcaattcagaggacggaaggcgtggaaatgagggattttttgtacttgcgtttgccaattcttgtggtctactggccaaaattttgactccttcagttaatgattttcgtatacaaatatggtttcacaaaccgtgtatcatcgatttttcaagtgctggtgtattcttttgtgagtggagagaatgaagccggtatatcatcgctcacagtggttgctctatgaatttggacagtactcgtatccagaaggttcagcatcacgtgtcctcctggcccagtgtctatacgttgcagtgactccagcgagagccacaattacgatatgataaatgctgtctctgtttctgctttgatgagactgtttcgattaggccagcaacctcacctctcctatataggctgtgtttatttcagcgtaaattttggattttggttaaaattagagatgatgtggctgaaaagttatgtgtatgacaggttgacgtgatgaaaaagaattgaagtttagatccaaactttggatctatacacacagacggattcagatcatgcgcagttatagctattactgcaacttatattctgtgctacagtatttatgctacagtacgatgaatagtgcacctcgctgatctggaccgttccatctacatccgttgatgaaaactggtaccgcctaaattgcagtcccagtagcgactgcagctgatccggattcaacacggacatagtacaccctcttgttgcttcgatgagactggtccttagcacaatcatcaaaccactaccattatatcagtgcttggtgttctattgggttaaggaattctcgatcgttctctgctagtaggaaatcgagccgactgaccagcgatgtcggcggttgagaggaagacggcgtgcgtcaccggcggcaacgggtacatcgcttcggcgctcatcaagatgctgctgcagaagggatgtgctgtcaacacgacagtcagaaaccccggtgagattcttcttcttcagttcataatttcgtgcatactcgtgcatagatttgcagtagcatcagtggttttaacctcgtttttcttttctttttttttttaaaaaggaatttggttttagcctctgaaactgctgctacacattgcaattttgagtcgcagaaaacatggagaagaactcccacttcaaggacttgcacgcacttggtcccctggcggtcttccgcgccgacttggaggaggaaggcagcttcgacgaggcggtcgccggctgtgattacgccttcctcgtcgctgctccggtgaacctcaagtcagagaaccctcaggtattacatagccgtctacaacaatttgattaagtttatagaaaatttaataatatttataacatcaaattagtttcattaaaaataactttgaatgtatttagatggtatgtttgttatatgtgagaaatgttctgtattttttttatgaacttatcataataaaacataattagaaaagagttaaatcatcttatagtataaaacggaggaaggggaaacatattttaagattatctttatggatttagctagatggtggttgccactcctcaagtctcttatggttgccaggccattaatgatactaagtattcctccataaaaatgtctctttgcacttcactcttcattgttggcttatgcttacatttacaagctaacatttaaaatttagaacttaattttaagtttgatctttttctcatcatagtttatttttatttactaataagcgatttaaataagcgaaacaatgctactttctgttgcgatgacacagacacatacacagaatcacatacacgcactccttctgtctcatagaaaccatcagtactagatgtgacatatcctaatactatgaatctgaatatatctctatccagattcgttatactaaatgtatcataatcagttatagattttttttttgtacgaagggagtagttttgttttttacttggtcagcctgatggtaatgacagaaagaactggtggaagccggtgtacgaggcactctgaacgtgatgaggtcgtgcgtgagagccggcacggtgaggcgcgtggtcctcacatcgtcggcggccgccgtctccggcaggccgctgcaaggcgacggccatgtcctcgacgagtcgtcatggtccgacgtcgactacctcagctcaccagccaacaagacatctcccggaaaggtacacacaaaattacagattttatttaacacaggtcagtcaatcagaggctcagagcccattaaatcggccacatgagaacagctccgtgtgctgatgcaatcagcgtttacaatttcggttcgaaatttccggcaagcatttacttcatccaaatatttcatattttttttaatttagaaaaaaatatttaaattcggtcaagatttgtttaaatttcaaacttttttgggtccctgatagatttgtgcatatcgaaaatattaagacatggatgcaatgcaggcgtactcgctttcgaagttctttcagagaaggaagcgagcagggtcgcggaggagaacggcatcagcctggtgaccgtttgcccggtggtcaccgttggcccggcgccggcagcggaggccaaaccgtgcgtcgccgccgtcctctccttgctctccggtgataactaatcgaatcaagaaccggccggtccatggcaaatgcggcaacgaaaagcaattcctgtgaaatttatttgttcatctcttgattttctttcaggcgaccaggagatgatcagcaccgtgaagctcatggagaaggccaccggcgggctaatgctggtccacgtcgacgacctctgccgcgccgagatattcctcgccgagaagccgccgccggcggcggcggcggcggcggcggagaggtacatctgctgcggcctcagcgccaccatgctgcagctcgcccgcttcctggcggccaaatacccggagtacaatgtcgacgtcgccgcgtaagatcgagctgatctcactgagtaataattccccatgcgtctccatgatcttatcgagagctctgacgatggtgaactttcatgcagcctcggcgacctcccggagaagccgaggatccgcctctcgtcggagaagctcgccggagaagggttcgagttcaagaacaggacgctggacgagatgtacgatgatgccttcttggagtacggtagagccctcgggattctgccatactgataacgatgttgttcccctcgtatatcatctgtttctctggtggtgattgttagactttgctctaggatcacctaggttagatctagtcgggtggttctatttgggtttgatgaacgacattgtagatgaaagggagagggtttagataccgaccggttgaggagttcgtggaggaagaggcgccggacatcgtcgttgtcgtcgcggcttgacgtggatgcggcgccggtgaggtcgacggtgatgacggctgcggcagtggtggtcgtagacgtcccggcgatgaggcgtggcgcggcggtggcgtttcccgtcactggctgcgccccctctcgatcggattagggttttgtggggtggagttggcggcggcggtgaatctcgtaccatgtgccgtgccggcctccacccctcttttatatggcgcagtgtgacgggggcccaccagccattgggctgggcgcccccgatcagggcgcggtcaaggcccccttgagccgttgggctcaaggggagagagatctatctaacattctccc

SEQ ID NO: 31447 - DNA, 225 bp, Oryza sativa
atgcccctgagactctttcttctcctcggttcaatctagcgagcgtgagaaggtgagaagagaatcggcagcgacaccggcgccgccaccaccactgcgccaccgctacctcagttccagccgccgcgccgaggtcctccccagctggccgtcgtactattccgcgcaatagtgccgcctcctcggggacatacaccatgagtccatgacatacaacctccattc

SEQ ID NO: 31448 - DNA, 4142 bp, Oryza sativa
cctgcagcccggatgatagtgtatccccatgtcataatctttaatcaactccagccatcttcgttgccggagatttaagtcgggctgggtgaagatgtacttcaggctcttatgatcagtgtaaacttcacagcggttgccaataagatagtgccgccagattttcagagcatgaaccactgctgccaactcaaggtcatgagtgggataattggtctcgtgtgggcgcaactgtcgcgaagcatatgcgaccactctgccttcttgcatcaacacacatcccaatccttggcgagatgcatcacagtagacctggaagtctttcgtctgatctggcagaattagaactggtgcggagactaacttcttcttgagttcttcaaaactttggttgcactcagctgaccatttgaatttttcatctttctttagcaactgtgtcatgggcctggcaatcttagagaaattttcgatgaaccgacggtaatagcccgcaagtccaagaaaactccggatctgagaaactgtctttggtggggtccactttgtaactgactccacatttgatggatccactgccacgccttgagcagaaatgatgtgacccagaaatttgacctccgataaccagaagtcacacttgctaaacttggcatatagttggtgctccttcaatatctcgagtaccaggcggagatgctgctcatgttcctcttctgattttgaataaataagtatgtcgtcaatgaataccacgacaaacttgtcaagaaactccataaacactttgttcatcaagttcatgaagaaagccggtgcattggtgagtccaaaggacataaccgtgcactcaaacaacccataccgagtggtgaaggctgtcttgggaatatcctcttcccgaattctcaactgatgatagcctgatcgtaggtctatcttggaaaacaccttagctccttttagctgatcaaacaggtcatcaattcttggcaacggatatttgttcttgattgtgacctcattaagggcgcgataatccacgcacatcctcttggtcttgtctttcttctccacaaagataaccggagcaccccaaggtgaagtactcggtcggatgtaccctttctgcagctgttcgtcaacctgcttcttgacctctgctagctcattagctgccattctgtacggcctcttgtaaattggagcagtcccgggtgccaaatcgatccggaactcgatttctctcttcggtggcattgtagtgaggtcttctgggaacacctcaggatactcttgtactataggaatatcctccaacttcctgggacttttctccactgtttctgtctgaccctcaatagcagcctgattcagactcgctacggacttctgcgacgctggggaacggaaggtgatcttcccccctttgtcgttggttagggtgatggtgcggcttgcgcagtcaatcactcccttgtttctggtcaaccaatccattccaagaatgacatccaggtctttagattcgagaaggatgaggttggatagaaacggtgatcttttgatctctatagtcaccgaggggcagtagtgtgctgtcctcatatcatttccaggggtatgaacctgcatcggtattttaagttccactaccgataatccatgtgtcccagcaaatcttttggaaatgaaagaatgcgaggcacctgaatcaaagagaactgttgctggatatgagttcactggaaacgtgcccaacacgacctctggtgctgcctgtgcttcctctgcagacacatgattggcgcgggcctggatgaacctgggtccagtgcgattcagcttcggacacttgccagcaaagtggccgtgcttgccacagttgaagcagggtcctggctttcctacagcccccttcttgggttgttctgactgaactgacacagttggcggatctgactgagctggtgccattagtgggggtggagtcgagttgtggttgcgctgcttactgttgttgtgactgccaccgttgtaatcgttgtcgaagttactcgggtgatagggacggtgctgacagacgatcagggtggaaggcccacctagctgtcccgtcatgaagcgaggcttctgattgttcccctgaggaaagctgatctgagctgcctttctttttcggtccattttgttgcgttgctcttcctgacgaatagccttgtccacaagcttctcaaagtcctcataaactccggagattagctggttggtcaattcatcgtcgagcccaaacaaaaacttctcctgcttctcagcatcggtgcgcacgtcctcaggggcgtagcgcgcaaggcggttgaactcatgcaagtactctgtaactgacatggttccttgctggagcgcacggaactctctcttctgttgtgccataatcccttcaggaatctgtgccttcctgaagctttgacaaaactctgcccaagtaacctccgttgcatctagacgggtcgccacgtagttatcccaccaggcagaagcgggaccttgcaactggtgtgtagcaaaagcaactttctcttggtcgttgcattgcagtaggttcagcttcttctcaatagcacggagccagtcgttggcctccattgggttggtggtgcttgagaaagtgggtggctggatacgaagaaagtctaacagtttggacacgtgtgatggtggaggaccaaactgctggttctgttgcgcctgctgcaacatctgatggtaatgttgctgcatctgttgcatcatcattgtcatcatttgagtgactgttgggttttcgggcggtggagatgatctgctgccagatgcaccactgacatgagctccatcggtctgctcttcgctgcccctggcgtcgctggagtcacggggatcattccttgtcttcaccatctggaggggataggtagaaataagagaaaggaagaaaacggatggctcggaaactaatttttcttatgaaattaagtgccattatcttaatctggattaaaacactgaaaaagaggcacacaattcctaattaaggctgtcataccactcacacatgatatcgaccgccgactaacccacaagcaacaaacctaagcacggaaactagcaagcaaacaaaactaagaagacgataaagctaagggcggcgactctgaagcttggagcggcgcttgcgatcgaagaacaggtctgacatctaaagagtacagagggataggaaccaacacatgctcaaaaccaaattaaataaagcaacaaatgactaagtaactcgccgagcatgatgatttttatgcatagaacatttttcatgaacccggataaagacactaatgcgactgactaaaccatagcttaatgcataaacttgttgcatggaaaatgatgcgcataaaattgccccatcgaacatagacacgacctaatgcatatcacccgataaattcccaactgactgtcaaataaactccaaataaacttttaccaaaccctagactgtccctagtcgagaaatccaattaaataagcgaccaagatttttcccacaaactcagaagaacaaaaccccaaaatttttcccgaaacaaatccaagtgcaaaaagcatatgcagatgaagaggggttcagagggctcttaggtttccagttggcttgtcctacggtcaaggtcggctctgataccaacttgtcacgcccagaaattcacgaaccagaatttctaagctgaatgtgcattaaacccctgtccaggaccggccagggtacacaaacgacaattgttgacatacagatccacgtcttacaaaaatataaaagattacaaatgcagcggaaaaagagaaaagcgagctaagcctgaagacttgactcctgcagcgggcgactccattccacaggcatccttgacggcagcgacgaaaccaacctcttcgagacatcttcaactgagaaggacttcaactctggtgtgggggaaaagagagcaagactgagtactacccactgtactcagcaagtcacaccggaagaggaggtatgatgcaagatatatccaagggaggctaaaggttcttttgcataaagccgaaatgggggatcc

SEQ ID NO: 31449 - DNA, 9873 bp, Oryza sativa
gccgtctcccgtcggccgtgccggcgaggccgccttcgggcgcgccccgcggctgccaggtggggcccggccgtcagccgcccgcgcccgcgggtgcggctgacgcgtgggacccacggcgccggccgccgtcagccgcgtgcacccggtccaccgtggaccgagaggctgacgcgtgggccccactcccgtggacccggtccgcgcgccctctctcccggctgacgcaataaatgagtttttaattaaaatttaaatgaagaaattcgtaaatatccatttaaagagcatataaacttcaaatggctatatcttggccatttgaactcggaattggaccgttcaagtctctaatttttccttaagaagtcaagaacccatttttgtgctttgtttctgctgttatgtggagtttattagagtaaaagccgtttcttttccgttggtcgtgtagacgctgcagcttcggaagatccgctcttcgtggaagttgaagccggtgtttgggaaagcgagcaaggcaagtcacatcatccttgagcatattgaatcccagtttataaaattattttgatttaaattattgcattaccgctttatttaaattcccgcgttatcactgttttatttagccatgcctatttatcgttgttaagacattattattgctattgttattattaccttgttcaccctaggaaaataaaaccccaactagtgggtactctatttatggttccactagtatgaacttaggtagatgcttcgctggttaattaggcaacattaggtgattttataactttagactttgggaattctcatatcatttggacactttggaattgttggtttatggtggaattggacatacacctctcttcccctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcgtggcagagggttggtgccctgctgcttggggctcagtcctgcctgcctgtcccgggggttccggccgtaggcaggattgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggttcacggccttgattaataatactgtgtagctctaggatcgtctttataaaatggctttgggcaactaagtgacttttaaatgccgtttactgcaaaacttaacccctatcttattatccccttgtactcctttgcattaattgtgcatctccggtgtggcctgctgagtactgtggttgtactcattcttgctcaatcttttccccccttcagtaagagaagctttggagaagaagtcttaggtggagtcctggcttataccccagttgagcgcctgtgaagatggagccgtaggcccgctagtccgctgctgtttatttttgtttgtcaggcctgaagtacctttgtaataatgtaaatattatcgatataataaagatgtgtcttttataccatgtttgtgtggtgtacccggcttttcctgggacggggattaatacactggtgttcgggaaaaggcaattttcccggtcgcgacaagatggtatcagagccatctcgactgtaggataagccaagtggataaaacctaaggacatattttataaataaaactatttgcgaaagttccttttttttctccttcccctaatgctatttgcaaaaggtttactcccttcttccttcttcggatttccactagtactagatggttagtttgcgaagaagaagatgtcgccaattgttcgccgaagctccggaagactgcaggatccgctagcgaagtggaggaagcagtgaagccagctgtgaagcagtgaagatcttggagaacccgtcgcagaacctaagccaccctgtagggtagtgttgttagtcgtgtgttccttgcttgtgtgtgtagcgcgtggtttgcatcggggggttgtgatgtaaccatgctaggttgtttgcttaatcaacttgcagaataagtgaaacaaacaacacatcaacaaagagagttagttcctttaaggtcctgtccctagttctggtctattctttcctagcttgtttcctctctcacctcaatccctgtaacagatgtttaacagagaaaaaggaaagaatgtcagagggtatgcctccagtaactcaagttttcaactcaatccaccactggcctcaagagagttaaccagggcacacccttggtccattccaagcatgccgcttagttcacagctaccattggttggaagtcaagaccaaaatcagtatgtgtttgatcgagcatttgccacccaggtcaatgagcttccaatgccagaagaggatgtccccttttgtcacgattgtagagaacaaggacactatgccctgaattgtccatgggtatatgccaaagaagccccttcctttggtttaacagggcagacatcgctaaaccagcctcctcgcaccaagtcaagcttgcagcctagtgtgcaaagtagagagcccaatggagagaatccattgaatcccgggaattgctttcctcctagcccttcgtaccacgtggggtcacgtactaagcaagccaaaggcaagaagagtaagaatcagaagagaaaagcgccgatgcgaactgaagaagaagtacgtaagatggctattagcagcaccgaatggcctcccgcagggataactattcctagacgtcaaagaggaaataccttccgaggtgcacgacagttgacccagcaccttctaagccatggtggcagagtatctgatagtgaagggtcagatcaagtctcctcggatgatgaagatgagtctccccgacatctcggtgaggaagagatggaatcaaaagcatgtatccgttgtggagaaattggacacattgctagcatgtgtctcacactctgcgcttattgtgaagaagaccatccaccaggggagtgtcccacccgcaaggtcacatgctttctgtgcgaaggtacaaatcatgtgcccaaggattgccaactcagtgtgttgttgaccaagaccgcagaaatccaacgaacgaccctacgattgtctcgtcagctagtcagctccaacagcaacatcgacgatatcatccacaacaccaatgctcctcctgctccacctaactctgcaataaatcatagcaataatatctttagcaccaaccattctcttgaccgacagcctcacaaagagttgtcttcatggaagaagttgtgtctctccccgacctactccaggccaagcaagggcaatcaacctcaggagggcgataccaagcagaaaaccgtcatccgcttcaaccagcaatcagaaggaagcttctcctgcgaatgatagcattatgcagtcctatcacatcatcacagaaccaatcaaggatgatgcagtcactagaacaatgccagctatatctctccggaatcaaaatgagcagccatgtttgtggttttcagtttgctacttatcattgtgtaatcgaaagtatgcagcaatcatgtaataaacaaatatattcatgattttaaacaatgagcttgctatgtttagggatgattcatgttgaggatacaatgtaccaatgataagcaccttccctttttgtttaaggcagtgccttgtattcgtgtaataagggagaaatgggtaatacagacaagttctaagaggattcttgtggaagatgcggatatgtgatcatatgtataattgtttactgacaaggagacctagggtctcgtgtcagaagaactatattataaactcgagttaataaccaacctgttgatggaaaagaaaaccaattaaactgtgttgggttaaaaagccaatgagacagtagttggggataggagtttggatacgccttttacagatcaagataaggattgttggatgaaacccataagggtacccgccatgcctctacattgataagttcggatatacctgcaaacagttaagaagatccaggagacatcaatatttgagaacatagtagtcgatggttggtaattagtctatcaggtatcagaaaagggtcaaaggtgatatggcagaagaacaatttggatgctccccatctcgaggaagcactaaagatgatcatcggcaattaaaccctagtggcatagatacagatagcaagcaacgtatttccttgaaggtagtcagtgcagctttttgacgaaccacatcaaggtttcacggaaaggcagcaagccaaaggacctcatcgtccccagaagcgtccgcaatccacattaaagaataccacctgttagagataagccgaaagatgattgataaaagagattggcaaagacgttctccagcatgaaagaagtaggccgaaaggtgattgataaacagaaacatgctctgcatcgctcaaggaagacccctgatagtaattgccccgcaacagtcaccttgtcattaagtaagcaagatgacctaggtaaaagtgtttctatgaaggcaaagagtgaaatcttcaactcggtatcagatgctgcacggagtgaaaagtgcaagcaccggttaccaggcaacaccatgtcttgggagattgtcacgcccagaaattcacgaaccagaatttctaagctgaatgtgcattaaacccctgtccaggaccggccagggtacacaaacgacaattgttgacatacagatccacgtcttacaaaaatataaaagattacaaatgcagcggaaaaagagaaaagcgagctaagcctgaagacttgactcctgcagcgggcgactccattccacaggcatccttgacggcagcgacgaaaccaacctcttcgagacatcttcaactgagaaggacttcaactctggtgtgggggaaaagagagcaagactgagtactacccactgtactcagcaagtcacaccggaagaggaggtatgatgcaagatatatccaagggaggctaaaggttcttttgcataaagccggcatttcaaagcagtagttgaaagcagtaaaacagttgtagtaattaatccatattaaccaatcactgtccaacgttacaccacgttgcaacaggcccaaaccaccacctgacctaaccagttccaaaagctaactagggtgaaactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggcagccgatcaaccggacaccccggccgacccaactccatcacgcccaccctcgcctggatacgtcggctagagaaaagctacactacaagcccagccgttgcccacgctggcttgtggtaagtacgataaattcttccagggcatcccgcgaaccggtccttaatcgccatgggcacgtctagcaaaaccatgcacccacagcccaccatgtagtgtattttaattagccaacaccattgcggtggcactaatccaaagctattgccaataatcaagtctatgctttaatgtggtccccttttgtgcactagttgaactaagcatggctaagcatctcctaaaccaacatctagtcattttaatacccaagttatcattggcataagggaaacaacatatagctgagtaataggacccatcccacatgatattgtaaaacaatgcaatatttaatagaaatgcgggacatttgtaaattaggtacaatatgatcaattgcaatgtatgacttgccttgctctcgcactgatggaaccacagcaacgtcttcgagaaactgcggatcgacgaaacgggcgaaatctacgcgacaaacaaagcacacaagcaaaacatgctataagactactgaaacaggaaacaaaaccatttttaatggattctacacatttttcttgatttactgagacttgaatggacttaaacggagctcggatgaattagttatgaattttagaagattcactgtgtttttactaataaagaaaaagtccttaattaattattgcgcaatatattccagggctgacgtcagcacggggtggcgcggcgccgacaagcggggcccaccggtcagcggcacggggagagagaggggaagggcgctggtacacgggcccactcggcagcggctcaaggggggggcacggctggcaagcgggccccacggctccggctccacgagccgatgtaccggccaggcccggcatcaagccggccgggcggccatggcaaggcggcggcgcgggcatgcgaccgccagcgacggcgagcggcggcgcgggcggcgggcggcggcgcgagcggcggcgcgggcggcgggcggcggcgcgagcggcgacgaccgaaagcgacggcgagggcgcgaagagggcggcggcgcacggggaaaaaaaaagaaggaaaggaaggggagggagacctcaccggaggggcggcaatggccggcggagaaaaacgagggaggcggcgaagaccggtgatgccgaggtgcggacgagcgacggcgacacctagggaaagagaggagaggaattagggcggaggaaaacccccacagcgaccatccacgccggccggagtcggaggggagagagaactcaccgacgacgcgagggaaatggggtttcggtggtattccggtgacgcagagcagcggccgggaagggtcttgcggcggcgaagctagtggtggcggtggcttagtgcggcggcggctctagcgacggcggcacacggccggagtgcggcgacgggcggcggcgtaagtggcggcggtgcgagctcggtagggggcacgggatggagcggtgagagcgaaaaacgagagaggagggcatggggagcattttataggcggagggggaggcggacgtggccgggaggcgctccgatttcgccggcgacgtgggggaggagagagagaaggtggggggagattcaaaatcgaatcccgcccctctcgtgcgctggcgcggccgggagacgcggggagagggcggcgacgtggcgtgggcgcggcgacgtggcgtggcgcggggaaagcggaggaagtgggtgcggcggcagcggtttcggcgggacggcgcgagcgggagaggcgggaggtgggagacgggtccgacaggtgggccccacctgtcggcgaccccgggagggagggaggcgggcggccggctgggcctcggcctgcggccggcccagcagggaggagggggaggaaaggaggagatgggccggcggcccatccgaaagaaaggaggaaaaagagaaaaaaaaagaaaaagaaaaaagaaaaaggatttttttttcctggaattaaaattgcactttggtgatttttaattggttaaaattatttctagggctctgaaaattccactaaaaatcctgttagcatattttgacatgtagaatccaagaaaaattccacatgccgattccgattattatttgcatttattactttagggtttctctctaggttaaattaaacaatttcttcggacgatttattttatgaatttagagcaagggaggggaacttcagggcgtgacaaacctaccccccttaaacagaatctcgaccccgagattcggaagagctggcgaagaggtgcggatgggcggccttcaattcatcttctctttcccaggtggcttcttcttccgagtggtggctccactgaactttgcaaaacttgatcaccttgtttctggtccttctctcactggtctcgaggatacaaatcggcttctccacataagtcagatcttcctggatgtcaatgtgctctgagctagcttgttcctcaggtaccctcaaacacttcttcagttgagacacatgaaacacatcgtggataccaaccatattagatgggagctcaagctggtaagcgacttcacctctgcgttccaagatcctgtatggtcccacaaagcgtggtgccaacttgcctttggtttggaagcggtgtactccccgaagcggagtgacacgaaggtacacataatcccctgcttcgaaagtaagctctcttcggcggttgtcagcataactcttctgtcgagattgcgcaattcttagcctttctctgacagtcctaactttctcctctgcttcggttaacacttctgtcccaaacagttggcgctcacctgtttgatcccagaaaagtggtgtgcggcactttcgtccgtacaatgcttcaaacggtgccatttgcaaactggactgataactattgttgtaagagaattccgcataaggcagacttttatcccaggctccgccaaagtcaagcgcacaggctctcaacatatcttccaagatttgatttactcgctcggtctgaccatctgtttgcggatgataagccgtgctgaaattcaaacgagtccccaattcttcttgcagtttctgccagaactttgaagtgaactgactccctcgatcagatactatcttcttaggtaccccatgcagacacatgattctcgagaggtagagctccgccaaccttttgcccgtataggtagtgtgtactggaataaaatgagcaactttggtgagtcgatccacgaccacccagattgaatcgtgccccgacgacgttctgggcaaacctgttatgaaatccattccgatttcttcccatttccattccgggatctgaaggggttgtagcagtcctgcgggcctctgatgctctgctttgactcgctgacaaacatcgcagagtgcgacgaattcggctatttctcttctcatgctggcccaccagaatttctctttgaggtcctggtacattttagtactgccgggatgaattgaatactgagtttgatgagcttctgtgagtatgagatccttcagttctttgtcgtcaggcacacacaatctttctcccaaccagattgtgccattctcatcctcatggaaatctcgagcttttccaaccctcatattctttttcagctcagctatttcaggatcatttacttgagctgctctgacttgatccacgagcgtaggccgggcctctagggcagctacgtacccgtgttctacgatgcccaaatttaggtgctcaagatcttgctgcaatttgtcacacatgacttcggtatatactgcattgcaatagctctttctgctcagagcatctgctaccaca

SEQ ID NO: 31450 - DNA, 406 bp, Oryza sativa
tgcagcccatcgagagaggggacggtaggtaaagtacaatcgcgccgggtgtcgtgtcgtgcaccgtgttaattgggggaaaaagtacacccaaggtccctcaacttgtcagcgagataaaaaaacatacttaaaccataaaaccatatatatatatagtcccttaactaaacaaaaccgatcacccgagatccttcggtggttttgaccccgatttcggtctatgtggcggctgagtcagcatgggaccaacgtgggtcccatatatcaggatgccatgtcagccggtcctcggttcctcctctctgttgagcgcgagcgcgaggcttgcaggcgagcagatggttgaggactctgcgagctcggaccggtgcacgacgcggaaggggtccgggtgaccggcgag

SEQ ID NO: 31451 - DNA, 181 bp, Oryza sativa
tccttcttccacaacaagtgcctctgcggaccgccgctccctactccctgcaattaaagctcccattacttaattactagctctgtggtgaaatgatacatcagcaatgcaagcaaaataaataaataaacatatatatatatatatatatatatatatatatatatatatatatatatat

SEQ ID NO: 31452 - DNA, 11093 bp, Oryza sativa
atagtggatttattgaggagcaaccttagcatcgtgttgaagcaaaagtttgactgcctcttgctgtccatgaccagcagcccatatgaggggtgtgccggcatcgctttctgattcaacatcaacccccttggagagaaatagtttcataaggtccaggttccctgcagatgcaaacaaaaaaaaaaggagagtggtgttggacgcatttatagaggcgttggcacaatcaaaatgggagaaaaaagaaaagagtatagaccatcaatccatggaaagaatgaagtgaaatggcaaatagatgatgaattttacctatgccggcagcatggtgcaatggcgtggctccgagggaagaagcaacggaaggatctgctccatggtgaagcagataggttacagtttggagatgggcttggcgcgtagcatggatgagtggagtttcacctggtggagtggatgtaaactgatggatgagagattgtgaagaaatcagatgagagtaagagatagtgatagttagtagtaccatcgtcgtccttggggtcgacggggagggcgaggtcggagatgaggaagtgacagacgtgggtgcggccctcgcgggcggcgaagtgcagggcggtgcgcttgttggcgtccttgacggcagcagcgacggcggcgacgcccttgccctcctcgtcgagcgccgcagcgagctctgcaatggcgcatgaggagaggagatgagaagaaacgcaaggaaagcaaaggagagagagaggaaggcatgggggcacctactcttgagggagtcgagatcaccggcacgagccgcttcgaggaaagcttgcaccttgctccgagctgcagccaatgaattcgaagcgacctcagacctcagacctcagtactagtactaggtcaacagttgagttggaagatggtactgtacctgagagggcggcggtggcgtcggccatggatgatggaagggagctacccgacccgagcaggggggaattgaagccggaagggtgttccagaagcttttgaagacaaaacggaaggtgaaggtgcgggcgtcaagtctcgagtaggaggaagaagaagaaagcttccggtccgttggctagattttcttttaagggtttgggccaaaataaacccggcccatatcttgggctttctttttcttccttctctttctcatcaaatcatatcaggcggctgctgttttgtaagtttgttttctttcatatttttttcctgttataagatctctactggagtaccaaatatcagcatgtcacatacaagatacagtagcacatcttaacagacataccaaacgaatcatatactgtatatcatacgagatacagtagcgggatcttaacagaaattccaagcaaatcatatatcatatgacatatatacagtaacagaagtctgaaacgaatcatggccctaagctggatgaaatatcggcatatgtcatacaagatactagtaacaaaggcaaccaaccagttgactcgtcttcataaaattaattaaccaagtactagtactcttggcattttaagttaaaaatctcgacatcaaagaccaaggtgttgccctggatgatgcattcatggctatagatagatagatacataggtgcacatgttttcctctcttttttctacaaaaatttggcctcctcaagaacaaacgagcccagccccgcacgtatatgtgttgtccatcacatcactgctactgttatctcttctctcctactgtacaacctaaaactacaagcaaagcaatggagagctcctggcagcaccatcttttaacttaaataaaaacacctcatcaactaactcgtcgaacttgcaagaaacccaagtccaggaagcctcagcccaccaaatctgcccgtgcttgtgtttgttcctgtgcttgtgttccttcctgtgcttgctccagttgaggatgaggctccatttgaagattcaggagatccttccctcatagacgacgttctggtcacaacactccgctgctgctgcaaacgccctaatccttccctactagatgatgctttgctcacaaaaccccactgttcctcctgcaaaagtccagcaatagcttcgtttcaatcatggaaagcgcaagaggaaactgaaattgcatgcaacaaagtgcaacatcaaactgaaaccacacctgtggcacctctgccctaggtgatggttcacctgcaggtgcggttgtcggcagagctggaaaagcagtagattgaggcaacgaagaaacctgcaaccagaaacacatgaacccaagtcaacaaactggggcatgttccgaccatgacaaagctgggaaaagtgcaagcctttaccctcctaacaactcgctctgaagatccaatagctggaggaacggatgctgctgggacctgaaaataaaaacatctcttcagaataagcatataggaaaagaatatgcttatagttgaggtgcaactggttttgttaaataaagcatagaagaagcatggcattaaggaatcactagaccattcaaacttgcctggcgaatagtggctttctgggtgaactcaaccaagtcagatattccattagccgtatgatcctaaaaggattttaagaagatagcattaggagcatgtcgatgagtttgttggtaatatgtagtggtaacatgagcttctacttttcctaaaaaaaaaaacatgagctttctactcacctgggtgtattccagactcacaagctttgattcctgcatgatacaagatacaaaaaatgtacacgagtaatattcagtaaataaggtagaaatctggatattcagtaaataaggtagaatctgttccggtacgaggcacataccagactccgaactacaaggttaactgattgtaaatcctcttggaaagcactcagatccccatggatgactgtgacctacaagtcagtcatgaaatgccattaggtcgccgaaaatgcatcaaaaactataaaagtaaacacaaaaaataaaaggaaaaacagttccaacctcatcccttgtcccttcaataatttcttgtgtttcatctaaactgatatccacacgatcaatccttccagcgagatgtttccttgcagactgaatagtgaaaatcaaaggccagtaagatgttttggttggaacaatgaaaacatggaatcacaagtaacacatttgagttcagcgttgctgaaagaagttaaaaacttacagtgacatcatctgaaaccttgtccaattggctgccaactacattgcaagcatcagataagccacgcttcgtgacaaacatcaaatcagaaagtttccagccctgcaaatctatgtaactttagaaactagctagaacagtgaaacaagaaatggcaagcagataggattgtaataatatgcacttgcgtccatgatctagaatgacggacagaacaataaacatcaagatagcaactagaataatcaaagattatgtcctcctcattctgtacttccattgaggtgaaagaatcaaacattaccttccacttaatgtaggcgtagccaacagccccagcaacaaccaccgctgttatagtaaatgtaccaggtcctacagaagaaggatttacatgaatgtcgttcaaggacatttgagaaagaatgtgtgtaacctagaggggcaaacatatgtaattgtgtatgtttaaaggcaaaagagcatgatgaaagtttattagcaattataaaaactatcacgtgtccaagaacctttataatgcagcgaataatataatgataatcagtagtgcatagccaagaccatgacaaataataataaggaaagaaaaagaaaagaacatgtgaactgaatcgcaaaatggtatactctgtatatgaacagacaacgcaattgtagctctgtcgaacatgtagatataaaaacaacagaccaagtctgaaaaaaaaatcgaaaggtaatagaaatatctaacactctaaaatcgcattaattcttagcaagagatgtcgacatcggggcatacacaaagtctagtgtcatgtgaaatttatgtttgtatgatctgtgacccatgcataagtctgtaactaaaacatagtaactagtcagcaggaacttacctgatctagcagcattggtgacaactgtaacaggccttgatcctagagattgtatctcctgtctgagatggttgacctgagataatagctgagcggtgtgtgtatcggtgttagacgatgtatctttcccttcgtttccatgcttcttgacaaactaggggggaaaggaatcatgtgacggtgagttataagatatataatcaatatagcagtagtattctgggttgatagttagggcatggaggggcaataatacaataccttggcagcaccagaaagtacctccccggcactagggagtttggcatcaccacctacaagaactgatccaagaattcctgcaggcaagcaaacaacataaacattggtaccgagtaaaactagtatagttatttagtgaaggcgtaattatacttaagataaaaagaaaggcaggatcagcctatgtactggggaagccactaagttgggggggatttgacagtggtgtttcatgtagcagtgggatacccaggtaataagttcccctctggtttgaagcgaaagcttagttgaactaaacaaaccccggccccggccctaaaaggctagatcaatctatgtattggaatctggtaaagcaaaatactccgtacaagatgagcaaataagtgggatttgggtagtggtattccctagaagtgggagggattggtttggtaatctatctatgactgcgccatggttgcaagtggcatctactcctatctatctatcaatctccaagtcgaaagtcaaccggctgggctgggcgacgagaagctagctagggctgcgggtggacctcaggagggagcagacggcggaaagtgactcaccggagccgacgaggatggcgacgttgccaagcaccatggcggcgcgcgaggagaagcccctcctgcctgtagctctgcttcaatctaacggcggcggcggcggcggggacgagggcggcgaccggcgagagggaggacagattaaacctctcgatcgatcgatcgactactttttttttttccctagactagtagaataaagaaagaggaaaattactcctacttgtttgctagagagagaatagaatactgtaattattaacggggcagggaggccaaggggagatctcaatctgagacggtcacctgttgaagttagacagtatattacccgttttcttttttcccacgctcccctctaatcctattttttttacgacactgccactacgtttttttaatccgtcccatttcctttttatcacaaaattgcataaactgcctcaactttaatcatccttgttttgatattctacctcgaaacctatttatattgcaaaaaccaacactgtcgctttgaaaattgctcattcccaagctagatcgtgctcatctagtgtgattgcgtgataagtccaactcaaacttgttcttagccaaagattagtgctacttccatctcatctcgtgacaaacaagtctctcacccaacctagagtcgaggaatagcccaagaataaactcaagtcggactcagctcgtagccacactagaagagcctgacttacatgatatatatggtcagcaacgaatacgcatcacaagaaaaaaagggtcgaatcaactactcccgtgtgtgagggagaaatgtaggggaatatagtataaggccctgtgtacttcaagggggtgaaaatttttagcgtgtcacatcagatatatggatacacatttgaactattaaacgtagtctaataacaaaataaattacatattccgcatgtaaactacgagacaaatttattaagcctaattaatccatcattagcaaatgtttactgtagcaccatatttgtcaaatcatggcccaattaggctttaaagattcatctcgcattttacacgcaatctgtgtaattaattttttttgtctatatttaatactccatacatatgtctaaacatttgatgtgatatggtgaaaagtttttcgtgggaactaaacatggcctaagtttgtatatgcaatgtactataagaacattgtttgagcccgtaattttagaagtatagagcaaataatccacgtcaataatacgttgaataagcagaaaagatcacgtgtgttattttcatagttgatagtttttttttactatccttttattcatgtccaagcacctttggttactcactctagactgttctattattccgcgtgagacagggattagaagggattgagtaggattaattccgcaccttaatcccgatgggattaaccaaagaaggccttaggataagtttagaggcattttggtaatttgataagggcaaataataatactcccttcattcgaaaggaaaacaaatatagtactagagtaccatgaatctgaatactatattaggttttttttttaaatggagtagtacattggattattgtaaagcatattgtaggtcaaactacaaagtcctcggaataataatatggcattggcaataccagatcaaagctcaatttgatgatagattgtcttcattagatcagtaccttaaacctgaataatactacagcttcttggaggagaaggaccttgtcatcttcttcttcctccttccagaagaggatattagtatacgcttgtcctctcatagcacatgaaccaaacaacccattcttttgtgtccggttacaaatatattatttcatcctttaagaaataaatgtgaacatgtgaactgctatatgtcgttgggctactcaataaaaaggtgattgatacatcatacaagagggggaatctaacgtgataatagtcccataacattgctacacttttgttgtcttttgcatacccacacacaaatagaaaccttcaagttacacaggtcatcatactgttatatgaactttcagaaaattaaaactgcaatccaactctgcagccatcattcagtcaaaaattattccagcctatcatcaaagcataagcaaaacctagtatcgagccattattgtacaaaaccaagtgtcatcggttcagtatagagggctagaggcggacatggagccaattctaaaccatgttcttaggatcaaaaccaagtgtcatcagttcagtatagaggcggacatggagccaattctaaaccctgttcttaggatcccgcggtggatgagttcccagcatcatttttcttcatgtcttcaaacttatcaatggcgacctgcagctcatctgtgcctcccaccgctctcatggtgtagtaatacacgccgaggacgaaagcagacagtcctccagccaccacaaagttcttggtcttgggtgccaggctgccgaatcccgccatctttagtttgcaccggttgttgcagaaactgaagaagagaatgttacagaaacaggaagaagtggtgccacactgatgccagttgacctttagccaaggcacagagctatatgggatatatgaatttaaactgaagatagatatggtttgctgatgtagcctcaagactaagaccctgtttagatgcgactaaaacttttaagtccctatcacatcggatgtttggacactaattataaatattaaacgtagactattaataaaacccatccataatcttggactaattcacgagacgaatctattgagcctaattaatccataattagcctatgtgatgctacagtaaacattctctaattatgaattaattaggcttaaaaaatttgtctcgcaaattagcatttatttatgtaattagttttgtaagtagtctatatttaatactttaaattagtgtctaaatacagagactaaagttaagtccctggatccaaacaccacctaaactagtgtttgtctttaaatcacagtataactaaaagtgggaatttgtaatacaagttccgattatactagaaaacactcgagctagtcagtgctagaatatcaatcctggacagaacccatctgctacaagtgcagctggcaatggcaagttcgagagcataacattagcttacttagcagtggggaggggattgaaccataccagaacatagcctagattgatttggacatggaaaaggaaaagacttacctcacagcagtaaattttgagagattaataattttagaccaaagaaagattagagatttaaactaggtttgatggttggagtttggctagactagtaatttcgggtgtttactgtttagggagagtatttgatctccctaaaataaaaaataagctatcatattcagagtgaagggccttagtattagagcgtagaaactcatcatcacctgtttcagctactgatgatgttagtacactaaaatcataaatatctcagagctccttttatactggatttatagtggtacccaaaaaccaaaggcagtaattgtgtagaaagcaaagattttcatattatcggcacagacaggtctctgtattgtttttttttgttcagattcagagttggtttgtaaaaagactccctcgctctaatatactcctaggcagagtaggaaattgactaggaaaggatgtaagcaaacatcagatccatcgcaataaactttggcctacaccatgcatgagaatgagatgaagaaatccccaaaagatagataaggatgagcaagtctccagatgagagatccggctaagttttttttttacctttggcgaggagggagggagggctgttgggggttggtgaggatgcggcggcggaggaggagagagtggggtggaggaaggcggcgccaggcgagcgagagagagaggtcttcgtcttcgaggatgaggaggtcggtttcctgttcctcccactcccagtgggccaatgggccttgctgggctgggctaaactgcaagccggcccgatgagatgaacttcaccgcaggagcgcgccaaggccaaggagaagggggtgttgccgttgccgtggtggtcatggtcgtcgtcgtccatcttttttccagtggcggcggaatggccgcagcagtcgcagcctcctcaacagctcttcatcctcggcggcggataaccgaccggcttcctgcaaaagatagcaggcttcatcaataaataaagagaagaagtgatcgttaatacgactcatcaacgcatgcaacgacctcaagtactttgttgacccttgtctcaaatctcaccgactttgccaactatactacttcagatcaggtttgttcatactccatccatatgcatcccatcccgacaggcagaggggcggacaaacataacaaacttaatttgtgacgagtttgttgaacattaattttctcctcttgtttgaatattagtaatggagagcagtaataatcacacaatatatagttcattgacaaatagaacaaaaagtaacactttatataggaatatatcacaagaaaagaagagaggagattggtcggcagtggcacagtggcaggcaagcaagcagaacaagaggccgggaagcaggcgccctttcttttggatgcatgtcgttggaagcaaacaaagctttagcatccaatttccagtgatccagtccaaccatggcgatggaggaaggagaaggccacaggagagcaggatgtagaagatggcgggagggaatggcagaggcccgcttcccgccaaaagcctatctctgcgactcgtgtctccgtgtgcgtgtgcttgcgtgctgttactgtactccatacagtacgctggtgaggtgatgtgcgtacacatttttttggtgcgtgcagccgtgcacgttgcaccccactaccatccctgcttttgcgctagtaccaccacattcctatgcagctcgtgatccagcccttacagagctacgagtacaatttccccatctttgatgatttccctgtgccccttcgtaactactccctccgaaaaaaaaaaaaaaaaaaaggaaaaaagacaaaccctggtttccgtgcttaacgtttgaccgttcatcttatttaaaaaaattatgaaaaaaattaaaaagataagtcacacataaaatattaatcatgttttatcatctaacaacaatgaaaatacgaattataaaaaaatttcatataagacggacagtcaaagttggacacggaaactcgtggtttgtcttttttgacggagggagtagtccatccgtcctctaatataacaaattttaacatttcacttgaattgtttaatcattcatcttattaaaaaaaatagaattattatttattttatttgtgacttactttattatcaaaagtactttaaacacaacttttcgttttttatatttacacaactttttcaaataagataagtggtcaagcagtgcaaacaaaatatcaaaatccattatattagaggatgaagggagtactccctctatcaaaaaaacgaatctaggattgtatgtccaaattcgtagtattaggatatgtcacatccaatactaggttggatttttatgggacggagggagtactcctatacaggccctgtttagtccctaacaaaaatttttcaccctgtcacatcgaatatttggacatatgcatgaagtattaaatatagaaaaaaactaatttcatagaccacatgtaaattgcaagacgaatcttttaagcctaaatgcgccatgatttaacaatgtggtgctacagcaagcattttgctaataacagattaattagacttaataataaattcgtctcgcagtttacaggcagaacctgtaatttgttttgttattagactgcgtttaatacttcaaatgttcaaatgtatgttcgtatatacgatgtaacacgccaaaacattttacccctgaaactaaacagtgccatatttgaaaggaatattt

SEQ ID NO: 31453 - DNA, 2330 bp, Oryza sativa
ccacctgatacacaccactatttattacatactctttatttttcagattcgcaactaatatgcatcatatctaactaaaatttttttatattttaaaatgaatgaataggtaagtgattttgatatttccaatactcataccctactatgagagtatacattaatatggtttttcttagacaaaacgatattgtgtttgatttgtgttataataggtgtataatatggtcctcatcggatggccaaatgttttggctgatcagccaaaactgcctctaattcagctaaatttcaatgtatattggttagcttattttgcttaaatggctgatcagccaaagcatctggccatctgatgaggccatatatgttctaccaccatttagttacagtttacagtagacttaggtttttttaaatcactgcttgattaaaaccaataaaacaacttataataccttaaagatagtgacttactatctataattgacaataatacgcataactattattttcttctcaatgctttataagttgtatgtagtctttgtgtttttctcatattgaaaaatcagaatgtctaaaatcaactttgatcgttgcgtcgatcgaattccacacacatcattgtcgagaacaggcatcaaaccaaaacaaaaattgatgttagagagtaactgagccgctataggccatagccatcgaagccgatctgtcgaagacagaagttatccagaacacccattaacatgaaacctacaatacgacatctcaaaaaatatcatagcatctagagtatcatcgtcactattctaaatatcctaaaaaccataactaagttttcagctagagagtccacactgagacacgggatgtcagtgatatcacctttaggaaggtatatggcatccacaaactattgttggtgttgatgctcttagcgatgatagtcccagccccaggtatgcaacgatacaagcttgacctcctcttccatgtcgagtggcaacaccagctttcctaaccactacggatacgatcaaggatggcttgccaatgcaccaggccacaagataatgagagtaggggcttgtttggcacagctccagctccagctccaccctcctggagctcagtcaaacaatttcagctctaccaaaactaggagtagagctctctcacaaaacgtattagagctgtggagctgggttttgacagctccacaattccactccagacttaactcctagagttatatttaggagttggagctgtaccaaacaggccctagttgttggttcgctccgccttttatgctactgtggagaagctaacatgtcgaaaacaatcttacagcaaatctattatattagtagattagttttaatataaattattcttgggccatttacatgtcacgctgtaaatacattcaggttatctataatttttatatatttaagttaaacggttgatattattatttgtaagagttttgtaaaaaaaaatagatgtaggctgtgtttagttggatccaaagtttgggttttggttgaaattagatatgatgtgactgaaaagttatgtgtatgacatgttgatgtgatagaaaagtagtgaagtttagatccacacagccgtagtagtgctcattcagaaataaagctgtagccgaagaaacagcaggttgcattttcggtttcatttgtccattttatttaaactaaagagagacaacactgacaggaaaaggacaccagttttcaagagtggaggtgctactactactagtggctaataaaatgcatttcccactggtaataatccatcaccagtgagaaagaagacctctttaattgtattcccaagacaacaagacacggaggcgcaggcagagcaagaggaagggaggaggaggagcactcaccaagaatccaataaccaagcaaagatgctgccgctgccgttcctgccaccgtcttagctggcccccctacactggccagggccaggatcatcactgcacttgtgcacagtctctgtgaggagaggagggagtagagaaacctccccaaaacccatcctttgtttttgcacttgcaacggcaaacctacctccatggcgatggcaatggcaatgccgtcgtcttccccacccctcttcttctccttgctcaatctcatgctgctgcttcttcttcttgcaccctactgcagcgccgtctccgtccccaacaacaacacccaccaccgctcctcctccccaacccaaaccaccttgcagcagctccactctcccgactctcctcctcctccacctctccccaccc

SEQ ID NO: 31454 - DNA, 4763 bp, Oryza sativa
tcttccgccgcgtacgccaccgccaccattcccactcccacccaaacgctcgctcgccctcatcccgttccggagccaccaaccaccaccacgatgacgacggagacggcgatgaggagggacgccgcctcaagccgccgccaatgcccacctcctcctccaaccccagcaccgagttcctctacctcggcaccctcgccgccccgccgcaacagccgcccccgaccacctcccatctccgtccgggatcgccagagctccgccctctcccgccgctcccacgcgtcggcccaccttccggcgagttcgcatcccggagctccgcctccgaccccagcaccgcgccacccgccgccgccgaggcctcctcctcctcgctatccccttcctcgccgtcggcctcctcccccacgctcggctccagccctgtccatctccgcccgccctccatcccgcagccgcgtggccgagcccccaatccatcgccccccaagcggaggccgcagcctccggagccaatggcagcgcacgcctggaaccccttcgtccccatgccgcctcaagcacctccttcggaagaggaggaggaacactcgccgtccgagaagagcatgcgcaagtcgcggcctttgcactcggataagctaaagcccgggtctttgcagtaagatgcacccccaatgcaaccactcaattttgatctcaacttgctaactttttttttaaaagaattatttcgatttgatggcttcctgttgcttttcctgttaatttgcagcatgaaggatgagatgatccacctatatctgaacaactccatggcggcggcgatgccgagggaggtgtgcttactgggcgctccgaggtgccatggcattggaatgctggtgggagcattgggtatttccaaggagcaagtgcgcgaagccatcttggaaggtatgtgtggctgcttcttcctagcaattggatttggcgcgcaatgttgtgctcttgaattatgctgtctaaagttgtcatctttctgaatgaaactagtgttcacctattgtgggggcctttggaatgggtggctgttaccattggccatatttgcgatgcattattatgcccaccatcaacgatgaatagatgatgcatggtgcctctgtcctttcaactttggttgccttttcaccagttatattgcacaatttggttcagtgattgtttcttgccctgtgattgtcccacatggcctgattagctgactgaaatagtttatttcacaacccgcccttttgacataggtgcacatgaaatttccttgttcccttgtgatcgtctgatctcttctttgtagttgcctcctctttgtgtaaagggggaaaaacacttgttttcagtattttgcatcctctggtatcaatatagtactggccacatttttccaatattgccatattggtatagactttttttggtgactatgtgtttccctgtggtgggcttctgtattttgattcagcaacgtagatctgcattcaagttgttacaaacatcatagctaatcagttattgagcctgataacattatttgttcacttttcatgctatgccttaatacaatatgggtacggtttgcactgttaattcctgccgtttgggagttgacatggtttaatttgtgtttgctggatataggtaatgcacatggtttgggagttgaagccttgcgaatgctcatgcaaatggtcctcaccaatgaggaagagcttaaactgaaatatttcaaagatgatctatccaccaaactttgccctgtggaagcttttctaaaggcagtgctggatattccatttgcgttcaagagaatggatgctatgctctatgttgccaacttctatttggaggtcaatcagctcagaatgtcatatgctactcttgaggtatagttgagcccttggttgaatattttgtacaaattgttttgcaccctttgttgaaagaagcaaaacaaaactttcatatgcaattgggtattatgcatatcaatatttacacaaatgatttgaatctgtgaacggaatagaccctcacttactgtttccttgtttatagtattactcatctctgagggtttcttatcgtttttcatacaggcagcttgccaggagctgaaaaacagcaggttgttccacaaggtccttgaggctgttttgaactttggcaacttgatgagtatcgatacaggatctccgaattcacatgccatggaacccaacactctgctgaagatcgttgatgtgaaaggagctgatggcaaggctgctctcctgcaatttgttgtccatgaaattgtgaaacctgaaggccacagtccggtgtgcaaaacgaatgcaaatactactcagcagtatgatgtggaatacagaaaacatggtcttcaggttgtgtcaaaacttgcggctgagctgagcaataccaagaaagcttcatccatcgatatgatgaagctcagcagagatgtttcagagctcggcgtagggcttggaaagatccacgacgtgttgaggctaaacagcatggtgacctcagcggacagcgcgaggcggttccacaacacaatgagcatgttcctgaggcaggcagaggaggagatcctgaagctccaggcgcaagagagcatctgcctgtcttgtgtgaaggaggtgactgagtacttccatggtgaattgagcagcggcgacgaagggcacatggcgagagtttttggcagtgtgagggagttccttgccatgctggaccgaatctgtaaagaagctggagaggagatgaagagcagcggctggatgatgggtagagactggaatatggctgccccaatgggaatgacaacgccttgagctgcagcaatgctggcatatttgttatgttacggtcatctcatctctttgttactaataattttgtagcatatatgaatggagattatgtttcctagcgtacaatcaatggcacctataactatatgtatgtaatgtactccatcttcttgtataaagtactactagtagcaagcataccggtatggtatggatcttttctattttatcattccttgggtatgtctattttgatgataatgcttagcggtggtttattggttcttgttcttcatctctagcgggatgaataagctcaaaattagacatggtttaattggtgaagttttctataggtaggtaactatattgatgataggaaatgtaaatggactatcctggtaaaaaaatatttaatgtttggaacagaatctgattaaacttttacagtttttctgataataaatacccgtgccaagtatacctttaaactgaatatttagagattttttatggttgaaatttgaaaatcttatcacgaatatcgaatattttagaccaaagtgtactaaaataatcaaatattactcatatagtattagatttgtttattaagagacgaagggaatatgctaaatggagaagtttagagtgtaaatggtggagatttgaatggatttcgggttaaggagttgtagtggcgtctatcaccaacagcaaagacttgctggtgaactcttcctttgatgggagttaacactgttacagagagagaagagaaggtcttcttcttcctttgatttgtgtcgatcactcttgcccagctatgtatgcctagcgccgccgccacgtcgatttgcctcatccaattaattgcaaaaatcgattctccactactttcttttgaattttcttttcagttcagaattttcttttcagttcgtcattttttatcctgagttttatggattgcttcgattttgataaaaaatcgaaaaagaggatcacttcgattttgataaaaaaaatcaaaaaagaggatcgagtggatcaaaatatctcaacaattttggagattgagaaagattcgaccgcatttgatggagaggatcgacttcgtcatggtacggacatgagactgttcgagcagggcctacaacaatacttgtgggttgagctgaaaagaggtaggccagacacgagactgtttgagctgagcctacagcttcacttgtgggctgagccgaagagagatatgccgagcagtgaaggtagcagctgaaaaggaaggaaggaatgaacgttcggtccaaaaacaaggaagcattcggtccaaaatcaagggagcttaatgtacatgataaaaaatgtttttacccgttgcaacgcacaggtattttttttattactacggataatagatttatttattttgagacggagatagtatgctaaatggagaagtttagagtgaaaattgtgaagatttgaatgaatttcgggataaagagttgtatatctctcgccaacaacaaagtcaccaactaactaagttgttagacttgttggtctaatctaatcggagttaacactgttacaagagagaagagactagtagttgtttggtcgtcttcttccttcgactcgaagagatcgatcactctagtcttccccagctatctatggcgtccccctgctcccaaccctagctcacccatgggatccaacactccaccctcccgcgccgccctcgagcccttcgccaccctcgaccccgccgccctcgccggcctcccagcctcctccccgctcaccgtccgctccgccgccatctcctccccatacctctacctcggcaccggcggcggcaagctcctcctcttcaccctcgattccccc

SEQ ID NO: 31455 - DNA, 8068 bp, Oryza sativa
actccgtcttcgtcggcactgcctcgggctactcgctcttctccaccacgaacgcccaaggtggcgatatattcacgctccctgagtcctccaggccacccagggtgaagcccctgtccgggggcgacgaggtcatgctgctcgtcgacaatgtcggggtcgtcgtggaccgatcggggcatcccgttggaagcagcttcgtctttaacaccacgccggattgtatagcggaggtgtacccctatgttgttgttgccggggactccaaggtagatgtctacagaagaaagaacggcgcacatttgcaggctattccttttgcaaggcctggtacaggtggactaattgtagcgagcgaggatgccggaattggcagcgacgtagttgtgattgctacggcttataaggtaacgtaggtatgtcaactcatccatcggtgcaacttgactcaaaatttccaatctgctctaccggattgcttagctactgagctgcgttctgtgtttgttagtaatactcaataattacaatttccaatgacaagacaatgattttgtatgctcaagtgaaaccctgacaatggattctctcataaatgtgcagcgccattttatcatgtcgattttgtatcacacactgtacttatggacacatttattggcttggccaggtattttgctaccgtaaagtatcagcggtggaacagatcaaggcactactacgaagaaagagttatgcagaagctatttctttgttacaagagttcgaggccgatggggaaatctcaaatgacatgatttcctttgtgcatgcacaacttggattcttgttgtttttcgacttgcgtttcgaggatgctgtaaatcatttcttgctctcggaaactatgcaaccagcagaaatatttccattcatcatgcgggaccctaatcgttggtcagatctggtatgcctcattaccacatgttaattgtaatgctgtatctcctcgttgatttctataaggcatattttgatttaaaaagtcaaacgttgtagattttgaccaaaaactagacaagttacaaataccagttcaaaatgttttcacacaattttggttctatttagaatatattttatgacaaaaaaaatccatgctcaaggtttaacactgtagactctttgaaatcaaaatacgccttgtaaaatccactggccactgggtataaataagacaactgttttaacacattccttgttttatgttttatcctgtaatgtgctcgaggagctgactaactgcacaacctttctcatgatactctcttaaccttttcttctgtatgtgaaaagttcatgttgaatgctgcaacttcttttatctctttaatgtggttttcaatggataagactttattaatttcttgatatatgaacccgttcctcttgagtatcaacatgagctggttccttcaaatttgagcgtaaagcttatattggtaggcacatctgttaagttttgatctgctagattaatttgtcaacatatttttgtaattgtcaaatggaatctgtagttttcatcacctaacatactgattaagttctcaagacaaactgctcatcttccactatgactggctgccttttgtattcagcagttttttatctgattgtgaactttgtaaattttaggtgccaagaaagcgttattggggcttgcatgctcccccaaagcctcttgaagaagttattgatgatgggctagtaacacttcaacaggcattgtttctcaaaaaggcaggtgtggacacagttgtggatgatgatttcctttcaaatccaccaagcagagctgatctgctggaagtagcaatcagaaatattatcaggtttgctcattcacgacattttttattcattacgaattgcaaataagctgctccatccagctgatgtctgaatgctatatgaaactaggtacctgtgtgcatcccgagagaaggatttatcttcttcagagatggaaggggttgatactcttctgatgtatctttatagagctctcaatcttgttgatgacatggagaagcttgcatcatctcagaatagctgtgttgtggtatgtaaatcctttaaacatctgcaaccttgaagcgtttaagactgttacacacctacgatacttaaatcgacattaactcttcatttgagaacagtacataactacatatagttcagtgatattcttatgtgttcaaattaaaaaaaagatacaataaaaatactatggtggtgcaggaggaactagaatcacttttggatgactctggacatctgcggacgcttgcattcttatatggcagtaaaggaatgtgctccaaatcccttggtatctggcgtatcttaacaaggaattacagcactggtttgtggaaggatcatgcaatcctacctgaaactgactctcttgaaacttctgttggtaaaatgtctggtgaggaaattgctgccgttgaagcctccaagatacttcaagcatcatctgatcaggaccttgttctggagcatcttggatgggtatttacttcacactaaggacttcatgatcaatgatctgttccactttgtgtacttctactgactatttgcgtttaggtggcagacattgatcaagagcttgcaactgcaattttaacatctgaaatgagggaaaaacagctttctcctggtaattgctttgttttagataaaccactataccagtgtgccttttatggcttatccatggcagatcaacacaatttccagttttttttctccttttgacttatgaatgtgtatataacatagtgtggatggtagtaggcatatgtaatcatggatcgatgggctctctttctcctattttagaactaacaatattttcactatatcagcctatattgcatccagaaaattgtgtttgctacttagggctgctaggaacttttttgggtgtaactaacatgcgttaacatttattctggatgattgttattctacagaaaaggttgttgctgccattgatccagagaaggttggcattcaccaaaggtacatataatgaatcgacaaaatcattacaagttagaactcaagattccatgatgatcctccaatgatccttgttaaaaaaatgttaaatagtaacagagtgaattatgggtatacgttgtgcaagtttgttcattatacaattgcatgatcataaacaatgaactaatagcagtttgtcaggcttcttactaattacttggtatcttgggatccatcaccactgtagagtgacctgaacattgatacgattgattgatgatcttgtctttccatgccagattattcgagtaaatgctgacaataatagttgtaaccaaggggggcctgtttggatcaattccattcctagtgttaccaatttttttgggcaatgacaagatttgtctattgccaaaaattttggcaagaatgagtgggttctaatttgtatgggcataagagtgatgccaaataatttggcaatggcagttctttaggttgcaaaccaaatgggtgacaaatttcttggtgttgccaattatttggcatggttgaattggggtataaatcaaacaggacctaagcgtattctaaatatatacgaaggaaacataatgaggctcaatgaaataacatattatgacttgaagctactgtatcatatgcgtattatattaggtagttcttaatcaaatatagttaccatttgcatgtttctttgaaagctctatgtgttctatgccttttgtactcttgctgaataaattcctcagcttttatgaaatctgaatatgctaagttttgcagatatttgcaatggttgattgaggaacaggaatgtgatgagcctcactatcacacgtcatatgcattgtccctctccagatctgccatggacgcagtccgttttggatccaacaatgaagagagaaacaataaagaatttgattctgatatgcagttcatttatctattgagggaaaggttgcaattttttttgcaatcgtcagatttgtatgacccagaagaagtgctatatgtgatttcagaatttgagctatggctggaaaaggtgattatacaatttatttcttccttctcgcgttccatgccaggtcattttgtgtcctacccattgaaatttatgcttgcttgatagtcctcatcgcttatatctgacatatttgacataaaaatctctttccttctggcaggctattttgtataggaagatgggccaagagaacattgtacttcagatattagcgctgtaagatcctgtgctgcatttattttttattggtttgttgttacttgtaaatttcagcagtaatgttttgtttaactggacttgtacacccctacaagttctgttccctaactttcttgttggttcttcttcatttatgatgaaggaaactggaggatagtgaagctgctgagcagtactgtgcagagattggtcgagatgatgcctatattcagtatgttattacctcacttcagtatttattacatggtggcttgttagtattcttggtacattctctatgttttgatttgattttagcttttctatgttgacttattagtattactagcataatttcatgcatcatgaccttggtccttagttcatattctctacatcttcctgtgaactcaggctgttggatttgtatctggaccccaaaaatgggaaaggacccatgtttacagcagccgttcgacttctccataaccatggggaatcattggatccaatacaagtgttggaggtaccactttcttacagaagtatgatcagaatctatttgatgatattaatttgttatttgtgatgtgcatgctagttaacatgggggctagtgtttctagcccttggtaatttatgatcatggggagtgagtctagaaaagcaatttgtgttgtcccagaaaaaatgagtgtgcacttgttccttcagaacaggattccgaaccatcaaatggtcattgcctgaatgttgtatttagtatttattacctttttgggttcctgatattccttaatcatcctggtctatagaggtctgctgtgatccttctctttaggagttgatatataacaaaaggtaaatgagatgtcctgtttgttaatctctgtgtattggtctttgaaagaaataaagaatacatggataatagaaaactggtgtaggggcatcccaccgtgttcttttatgtttatattatcgctgctattggtatgatcatcctattttgtgctacttttattagaacaagaattctgaagcctgagctataattatttttgccagagattatctgctgatatgcctcttcagctagcatcagatacaattttgcgaatgctgagagcccgggtgcaccatcatcgtcaagggcaggtaaacataatcatttcctgtttttcagccaatgtcttctattgaaatgtgactgtttgaggaactattctgcctctgcactgttaatatttctcttgaactcaaacttgctcccaggttggtcttatcttttatgtgaagtttgacttaccattttttctttcgctctatgcctatggataggtagttcataatttatcacgcgcaacgaaccttgatgcacggttgaccagattagaggagaggtcaaggcatgtgcagctaactgacgagagcatatgtgattcatgtcgagctcgccttggcaccaagctgtttgtcatgtacccagatgactcagttgtatgctacagggtatgtcaactcaaaacaattttgctgtttggtttgctatttacttctttgaatgaaaacgtgattggttgttagatgcatactctggattattatccgataatgcattgcaggtgaattctctcgtacaaaagcagcattatcaaattagctgtgcttagcaacttggatattggacatctatggtttacttggattgcctaaccctttgagaaatgagctggaactgcttgtgctattattttttttctagcagctgcttttgtttttaaaaaaaccatgcgcataaagtcgtctaaacattttaacattgtgtttttcagtgctaccgaaatcaaggtgattctgcatctccacatggacgcaacttcaggaaaggtggtatatttaaacaaagctggctcgttagtagataacaaagttacaagacaaggaaaccatggatgtgcgtgcctctgtttcagtgctatgcgtcatgaaaggagagcatatataatttggtggtgaagcctcccctttgcatttgaaggagcattcagcagcgatacggtctgaaaccatctgaaatgaagcattatcgttgatcatggcgattggagggaggcagagagagcagtggtcctggaaggtgataccgtagcttccggtggtcgaccagaaaccatgatgtttttttgtccataggattgttgttttgttttgataggataagatgggctacataattttaggtatcgctaggatttaatttacactgtagacaaaacataaggccttttgtgtctaatagaagaaagaaagatggagagcatttgcccctgttggaacaattaatgtgctgcaggcaataacaatccagttggttggccattacgattcctgactcctgtgctgagtgatgagaattcagtgcctcctccctcactagaagggctgttaatccgtgaagcatgcgtgaatactggtgttgcaattggccgtctgcaactatctgtccacgcaagtaagcatccatcgatggaaaggccggcgaaatactagtaaatgcatatccatgtcagtcagattcagatcacatgaggttaggtccgcaatgcaaatgctactactgggtgaaatatctgagcaattagtaagtgaatgtcgctactgcattggcgttgcatggcctggcctgcctccatgtatctttgtcgcgcacttgcctgcgctttttcccaatattttaatccaaaattatctatcttaattagcttctttatctctgtctcagtagtgcaggtgctcccaacttaataaccttttaacacctgaaaaagaagatctcttttcagtcgagagagagagcagggcccaggcgaggctatatatacacggcattgcatgcaccatatgcatctcaatatctcttgcgacctcactccaattgcacaaacatacatacatacatacatactcgatcagtcggcaattgattaagcagctagctcaagctggtaaaattaaacgaccaatatatatgatgatgatgatgaccatggatgtgaagctcctgctgctgctgctgctgtccgtcctcctcctgtctgctgcctccatggccaaggacgacgatgagcagcagcagaaggtgcaatgccatgaggacgacgaggcggcgcttctggccatcgacgacgccctcgggaacccctacaatttggcgtcgtggacgcgcaacacctcctgctgcgactggtacgacgtggactgcgaccaggactctggccgcgtcgtctccctctccgtcttccaggacaccaacctcaccggcgccatccccgacgccatcgccaacctcacccacctccgcaccctcctcctccaccacctccccagcctctccggccccatccccgactccctcgccgccctcaccgacctcacccacctcaccatctcctggaccgccgtctccggccccgtcccctccttcctcgccaacctcacctccctcaccatgctcgatctctccttcaactccctcaccggcctcatcccgccctccctcgccgccctcaccaatctctccgccatcaacctcagccgcaaccgcctctccggccccatcccgccgggcctcttctccaacctgcagctgcaggacgacgacgacgaggtgtacctccggctgtcgcacaacaacctgtccgggagcgtcccggcggacctgctggccgcggccaacccggcgctggtggacct

SEQ ID NO: 31456 - DNA, 3109 bp, Oryza sativa
ctaatcgctacttaaaattaattatctgaactccttggtaaattcctactatcatttaaaagttttgacctgggctactacaactggaaaactggtaatgtacggagaacgagtgtaagtgaagagaacaatgttcatgtcgtcttgcaatatgatcaatcaatcacccaacttttatatatatttccaaatgtccttgaaaaatgacctttggagtggatattgctactataaatgtgtttcattcaacttaatttacaacacacaataaaactgattgtaccagcaaatacgaagttttctaacgggagtatcttaaaaaactgtcgcaagtttttttttttcaaaaactttcagatgtatctgtagtataattgaagtgtaattacattgtactaactacaatgtaattacgatataacttattaataaaacttgaattcaacaatggtttggttacatagtactgagatcttatctgaaagttttctagcaaatctatttctaattatatgagctaggattgggccataacctgggccagcccattacgggttgggccttgatagtcgtcaatccatggtagaaaaaagcagcccacaaggccatgggatgccaggcttcggacaatggcctagggtacccgatgcccggaaaagctaatccccgcgcgcgcgttgccggcgcatactccggcccacacggcccatgcacgcacgcgcgcacgcctctctctcttttttctttttcttttggcgcaccgccgtctcttcttttttccttttttttttcttttttctgccacacgggagaaaaaatcgtaattagtttactactccctccgtcctagaatataagagattttaagttttttcttgcaacgtttgaccactcgtcttattcaatttttttaaaaattattatttattttatttgtgacttactttattatccacagtattttaagcacaacttttcattttttatatttgcaaaaaaaatttgaataatacgagtggtcaaatgttgcaagcaaaaactcaaaaccccttatattgtgggacggagggagtaatgattagtctcctatttttactactgattagtttactagtaatttttaaatcttaacttaaaaattttcaaatttggacttgaaagttttcaaatctcgagctaaaaattttcaaatctggacttgaaagtttttaaatctgagctcaaagttttcaaatctcgagttgaaagttttcaaaattttcaaatctggacttgaaagtttttaaatctgagctcaaagttttcaaatctcgagttgaaagttttcaaaattttcaaatctggacttgaaaattttcgaatctcgagttgaaagtttttcaaatgtgagatgaaaagttaaaagtttttaaaatttgacttaaaaaaaaattcaaatttcgagttaaaattttcaaatctggatttaaaattttgaaaatttgacttcagaaatagatttcttttcaatttgttagttaaaaaatcttgtgaaaaaaagaaaatcctaactactactgtcattatcttaagctataattatctaaaactaattaattgattagttaactatacctcctatctttagtcccgaaacgcgcgtggggggcgcgcacgccccaactaggccccccccaatgcctgaatcgcactaaacatgcgtgtgcttatgtaaagttaacaaactaaggggaaaaaaaatcaaagtgtcttgtaatatgaaacgggatagtataaattttagataatgggaaaatgatcattctgtcatttgtaccatacgcatcatctccaccatagatactccctttgtctagaaatatgagcatttatagaagtcttatactctgactatcttaaaagattatattttttgaagctagctaatatctgacagattagttcagatgtcaaaggatgatcatgcctttcattaagactgttttctatgcttcgacgctcggctaaacttttggcatagccaagctctaatacgggacatttgcaactgacaattggaggcatggtctctacttaagcatagaagagaaacgaagatgataaagcttaattttgtggatggagcgagtagatgcacaagataagaatagaaaactggatatttgtgggacaagaagatcaataagcaagcagaagaatattatttgtcctagatcaataaggtgctctgtccctgcacaggcgtggtaggcctgggttgactctccatttggacaagtttggcaatttggcactgccaactttgaccatttcattctccctggctttcccgtgcttgctacagtatttgtattttatctcctactcctactttggcttggctggctccctggcggcttcaagaaactgcgtctgcggcgcctcacactcacatgcatgtgcattaaatgagcagagctgtacccttctcatccgcatgcacgcttgcatgggtacggtggtcaatgttttttgttgactcgctattgcatgcgttggatttttttttcaacttgattcttcttccttgcgattaattttccaaataatttcatacaacaagtcaacaacaacagttgattaataccaaccatcaaattaatctccctctccccctttctctctatataacacatctcatcatctagctcactcactgaaatgcccaactaaattggagtggaggctactacctaattaatacgatatcctacaagaacaagatgcgcgccatggtcgtcgttcttgtgctcgccgcggccggcgccgccgctgccaccacgaagaagaaggagtgcaacgccggcgacaaggccgcactgctggccatcaagaaggccctcggcgacccctaccacttcgcctcctggacgcccgacaacctctgctgcgaatggtacgacgtcacctgcgacgacaccaccgaccgcgtcgtcggcctctccgtcttccaagacgccaacctcaccggcaccatccccgacgccgtcgccggcctcacccaccttcgcacccttacgtggcaccacctcccccagatctcccgccccatcccgccggcgatcgccaa

SEQ ID NO: 31457 - DNA, 1104 bp, Oryza sativa
atatatatatatatatatatatatatatatatatatatttgtataatgattttaataagtcaaaaacagattgatgcatttggaaggaatgattaataaagctgtgttcaattgtttctgggacaattaatcttcaatcttttttttcgccgggacggcgaagaatgctgaccgatgtatattaaggaaaaggggaaaaactgtacaaatgcagtacgtcagagcaccgcctttacaacaaaaagcaaattacaaaatctgtaatctttctaaagctggcactgcagcaacattcaacgaggtaactagccctgctgatttccaagtttcccattcatcacacatggtcgcacacaactgcgtgaccgacgaggccgttccctcgaaaacccgtgcgttgcgctctttccaaatcaaccatgtaacgaggatgaccccggcgtcaaacgtcttgcgatcgatcttcgcaacagtttgccgggcagcgagccaccagccggcaaagtccgaggacggcggcgagcagtagagggtcaaacgagcctgaacctgcacccaaacttgctgcgagaaggtgcaggcttggaagatgtgttggcaggactctccatccttagaacaaaggtgacaaattggtgcaagcttccagcctcggcgctgcaggttatcagctgttaaataggcattgcggaccgcaaggaacatgaagaacttgcatcttgctggtgcgtgggatttccagataatcttgccgagcgggcaggatgttctaccggccgaaagaatagagtaggcagaccgcaccgagaagtcaccattaggtgccgccttccatatcatagagtccgtacttctggagtcgagagaaatcccggctgtcggtgacatgggaccgggggtatcttgactagaggtttggggcagctgcagtcacccacgtggcctgaccccctcgggggggtcgggcccgagggtgatgtggccgcccctccctttgtctccccgaggggtcaggccgctcccgtttcggccccgagggctggggcgccccgaccccctgtgggtttggcgccacgtgtgtgggttaggtgagcacagcggcgt

SEQ ID NO: 31458 - DNA, 27964 bp, Oryza sativa
  unsure (1)..(27964): unsure at all n locations
ttttttgggaaaatagggggagtcccaccccaaaagaagagtaggtaaaattggtgcaggtgggatccccttgaaatataaaaggaggaccttgcccacttaagaacgggggagctggggaaagaggggggagaagacctgagctcgtagaggagagaaagaggaagagggtttctagagtttgaactctcttgctctccagctctttgtaactccttcatacacagatccaccagaacacaggagtagggtattacgcttctcagcggcccgaacctgtctacatcgcccgtgtcttgcgcatttgctctctcacgaaacattccatagatcgagtgcttagaacctcacctagcgcccccggccgaaccggcaaaggggggcccgcgcggtctcccggtgaggagccccacgctccgtcatctggcgcgccaggtagggggcgcgtgtgtttttctaagccctcgtcctctttcgtgtgcgccaagcttctcccgctcagcccaatggccgaacgggcagtggcgcacaacctctctccgagcgctagcggtgacgacggggagcagaacccgcgccgtcgagctcgtactccaccgcccccctctcgccgaagtcttaggcgggaggaggcgctcgagggggtcgaaagatccgcgacttcgccgcccacgagcgatgaagaaggacggcgagacggggagcgtcgcctcctcgtctacggcgatggcagcacgccccagggcacgctccaagctgcgggcgcgctcttgcgtcacccgcccgtcgtccccgatccagagactccagcccgacgttggctggatgacgtggccgacttggtcatgacggcgcagcagcgcctaggcgccggtgggcggtcctccgccgccaaggcctctggcgctgctaccgccggctccgtgtcgtcgaggggcgccattccctcgtcaacgcctccgacccaagaagatgtgcgtagggggccggatgcccgcctcagtatcgagcgccggcgcaatggtcgtcgtgctgcccacgcaacggaaggcgcttcctcgtccggagcgccacttcggttcgggcgcgggggccagccccccgtgcccccgcttggtggtgtcggctgtcgagcctttgtggcgagcattcggaacgtccgttggcccccaaggttccggcccaccatcaccgaaaaatatgacggaagcgtcaaccccgccgagtttctccaggtctacacgaccgggatcgaggccaccgggggtgacgacagggtcgtggcgaatttcttccccatggccctgaagggacaggcgcggggttggctaatgaacttgccgcccgcgtcggtccactcttgggaggatttgtgccagcagttcaccatgaacttccaaggcacatatgcgcgcccaggtgaagaagcggacttgcatgcggtacagcgaagggacgatgagtctcttcgctcgtacattcagcggttctgtcaagtccgcaacaccataccatgcatccccgcacacgcggtaatctacgcgttcagggggggcgtgcggcacaaccgcatgctcgaaaagatcgcctccaaggagccccagaccaccgcagagctttttcagctcgcggaccgtgtggctcgcaaggaggaggcctggacctggaactccaccggttccggtgtggcagcttcggccgcccccggatccgccgctcggttagggcggcgggacaggaggaggaaaaagaggtcggcccattccgacgacgagggtcacgtcctcgccgtcgagggcgcttcgcgggccacccgaaaggggaggcctgcgagcgacaaaaagaaggaggccggcgctcccagcagggagcgcccgaccggcaagtggtgcgccgtgcacaacacctccctccacgacctcgcggactgccgcgcggtcaaaagtttggctaagcggacgaggaagtgggaggaggagaggaggcaggaacgccgtgagggcaaggccccggcggctccctccggcaaccggcgaagtgaggccaagcagaaggcccccgccgaggacatcgacgatggcgacgatgatctagggttccaggagcctgggggccaccatcgccaccgtcgatgggggagcgtgcgctcacgcttctcgtcggagcctcaaggccatgaagcgagagcttctggccgcggcccctacccatgaggcgacgcggcagacgcggtggtcggaggttgccctcaccttcgaccagaccgaccacccgccgtgcgttgcccggggaggacagatcgcgatggtggtttcccccaccgtttgcaacgtgaagttggggcgtggtctcatagacgggggtgcagctctcaacatcctttcccccgcagcctttgacgccatcaaggccccggggatggtgcttcggccgtcccagccgattatcggtgtgacgccggggcacacttggccgctaggtcatatcgacctcccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctccagatgaagatgccgggccccggtggccccatctctgtccatggcaacctcaaagtcgcgcttgcttgtatggagcagcgcgcggaccacctcgccgccgcgtccaagcccgagggtggcaacgagaggctcagcacctccgtcccagccgccccgaggcagcggatgatcacgtgcgacgaggtcccggtcaaggaggttgccctgggcgacggcccgtccaagaccacacgaatcagtggtcttctggacggcaaataggaagacgcgcttgtctccttcctgcgggcaaacgccgacgtcttcgcctggagaccggcggacatgcccggggtccccagggaggtgattgagcaccgtctcgccgtgcggccgagcgcaaggccggtccggcagaaagtgcggcggcaggccccggaacgtcaagacttcatccgcgaggaggtggcgcgacttctggaggccggattcatccgagaggttatccatcccgagtggctggcgaacccggtcgtcgttcccaaagcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgctttcattacccccataggaacttattgttatacgacaatgcctttcgggttaaagaatgcgggtcctacttttcaacgtactactcgaatttctttgggtagccagataggacgcaatgttgaggcctatgttgatgacttggttgtgaagacgcgcaaccaagagaccttactctcggatctagcggaaactttcgaaagtctccgctccgcccgcataaagctgaaccccgataagtgcgtgttcggcgtgcctgcgggcaagcttctcgggttcttggtctctgcccgaggcatcgaggccaaccccgagaagatacgagctatagagcggatgcgcccccccagcaagcttagggatgtgcaatgcgtcaccggctgcatggccgccctaagtcggttcatatcgaggctgggagagaaggcactgcccctatttaagctcctcaaacgctccgggccgtttacctggacggaggaggctgagcgggccctcactcagttgaaggcgtacctcagttctcccccagtcctggtcgccccggagccagatgagccgttgctactctacctggcggcaaccccgcatggggtcagcgcggcgttggtcgtggagcgcaacgaggacaaccctcactccgtgcatccccaccctgcgtcgactcgacccgggagagagcaggcaggagaggcccccgagccgaatggcggcccgaggcccccgacggccggagctggccctccgcctgcttgtccgacggtgccaggcgcccccgacccccaggatggccccggggccactgcgggaaggccgcgcctgtcgccctctgaccccgaggtcgtcggcacagaagccgagtgcgccccgcgtggcctctcggacgaagaacgccctggagatgcggcccctggcgaagaggatcggcccccccaaaaggtgcatcggcccgtctacttcgttagtgagaccctccggacaccaagacccgataccctcaggcccagaagatgctttacgctattctgatggcttcgaggaagttgcgccattatttccaggcgcatcgggtcacggtggtcacgtcttaccccctcggccaaatcttgcataaccgagagggtactggacgggtggtgaaatgggcaatcgaactctctgaattcgatttgcgctttgaaccacgccacgcgatcaagagccaggccctcgccgactttgtggcggagtggaccccagcccctgagcccatctccgtccccgaggccagctcgggcccctcgcagctgcctcacaccgcctactgggtgatgtagttcgacggctccctatctctttagggcgccggtgcgggggtcacgttgacctcgccaagcggagacgtcctcagatacctggtccgcctcgactttcgggcgaccaacaatatggcggagtacgagggactccttgcgggactcagagtggcagctggactggggatccgccgcctcctggtgttaggcgactcccagttggtcgttaaccaggtctgtaaggagtaccggtgctctgacccgcagatggacgcttacgtgcgccaggtgcggcgtatggagcgccatttcgacgggatagagcttcggcacgtgcccagacgggataacgcggacgccgacgaactctcaaggctcgcttcctcgcgagcccagaccccaccgggcgcctttgaagaaaggcttgcccagtcgtcggcgcgacccgaccccctaggggagacggacgcgcctgaacggcccccgaggcccgtcggagtccaggcctcgggacccgaggggagcgctcccagttcccctagattgattgcttggatcactgaaatccaggcgtacctcgcagataagactctacccgagcaccgcgaagggagtgaacgcgtccagcgcatctctaagcgctacgtgctggtggaagggaccttctatcggcgcgcggctaacggagtcctcctgaagtgcattcctcgggaacaaggtgtcgagcttcttgccgatatccatgaaggcgagtgcggagcccactccgcctcacgcaccttggttggcaaggcctttcgccagggtttctattggccgacggctctcaacgatgcggttgacctggtccggcggtgcagggcgtgccagttccacgccaagcaaacccatcagccggcccaggccctgcagaccatacctctttcgtggccgtttgctgtctgggggctcgatatcctgggtccgttcaggcgggccccgggcgggttcgagtatctgtatgtcgctgtcgacaagttcactaagtggcccgaggcttatccggtcatcaagatcgataagcactccgcgcttaaattcatcaggggcatcactgctcggtttggggtgcctaaccgtatcattacggataacggcacccagttcactagtgagctcttcggtgactactgcgaagacatgggcatcaagctctgcttcacctcccccgcccaccccagaagcaatggccaagtggagcgcgccaacgcggaaatcctcaagggcctcaaaaccaaaaccttcaacatcctcaagaagcacggcgactcgtggatcgaggagttgccagcggtgctttgggcgaaccgaaccacgccaagccgagcaaccggggaaacgcctttcttcctcgtctacggcgcggaggcggttctcccatccgagctcaccctgaggtcccctcgggccaccatgtactgcgaggctgatcaagatcagcttcgcagagatgacctcgactacttggaagaacgaaggcggcgcgcggcccttcgagccgcgcgctaccagcagagcctgcggcgctaccatcagcgtcacgtccgggcccgatcactctgcgtcgacgacctcgtcctacgccgcgtccaaacgcgtgctggactgagcaagctctcaccaatgtgggagggtccgtatcgagtgatcggcgtcccccggccgggctccgttcggctggccacgggcgacggcacagagctgcctaatccgtggaacatcgaacaccttcgtcgcttctacccctagtgggggtcggttgtcaggtctcgggctcgggccaaccccgcgcccccccgggcgtgcagggttggccgggggctaccacatgcatatccttatcttttttctcttccgtatttcagtaaaagcattttcgatttcctgaggattgtgtctatgctatcgtttccttttgaagaatcttggcttgaattagcacgctcgtgcccgaccctgccctcggtggcccgggccggctaaaatcgccaaacggggcccagaaccgagccgtgccccggggcgtggtgaactccggggggggggggaatcggcaaaggcccacaatcgggtcatccataaccctcggtcaccacgctcccggcctggccagtctcgacacgcggatctccccaggcactagccccgacccgcgccacttgaggttgggacctgggcacgagccctcgttcaagccaagacacagaaggaccgcggcacggaccatcctcgtctcatacacacaacaaacttaactgacgcagaaatttcctctttacttgattacagattaaatcagtctatacaagaagggggcccgaaggcctcggaagaagaaggaaaagttattaagattggcgggggcctgggggctcactccgacgcccccgggccgtcggcctcgtcgtcgctgtcgtccgcgccgtcgtcaccgccctcctcgtcggagtcgagcgcgaacgcgagtcgaggggctgtaccctcgaagctgtggacgatgtggtcggcggcgtcccggaccctcgcacgtgcgccatcctcggttccgggagggaactcttccagcgctgcccacggggagaagtcagggttcctggcctggtagcttgccagtgcgagctccaccgccccccgggcgaggtccctcgaggatgacttgatcgcctcctcgagctcctcggggagccgctggagggtcccggccatctctgagaggcgctgggcgaggcccccctggttggcggcgtatttcatggtccgcccgccccagaggcccacctgccgcccggcacggtctagacgggagacggcgtcccgaagcatgccaggccctacctcgcccgccaagcggagggcttcgacctccccggcggacgagtccagcgcgccctgcagctcggtgatggtgtgttcggcggctgcgaggcgggcggctaggtcgccgtcgcccgcggccgccccaccgctgcacgctctcgcgtccagctccttcgctcgcgcctcgaattcagcggcccgctgatccagtgcggccctctcggcgcgggcgccttccagattgaggcgcgccagctcctcccgccgctgcgccgcagctcggcctcctcgagagctcgctcctgctcagtgagctcgtcctcgcggaggcggagtgcggactcctcttcggcgcaggcggcctcgtgcgccgccagcgttgcctcccggatggcgacggcggcctcgcgacccgccagttccctctccttcgtgtccagggcgcgggcgcgctcctccagcaccgtggcgcgagcctcaagggcctcttcgcgctgccgggacgcgtcgagcttcttctctagctccgccgcctggctcccgtataggaggcagaggtcgtcccgcaccgcgttgaacacggcggtggcgatgagggcagtctcccgctcgtcctccacttccctggcgatctccgccaggtccctacgacgggcctcgagctctgaggcgtgccggcggtgtgccttgcggcccgcctccaccatggcttccaccgagcgccgcccctcttcgacgcgcgcccacgccgcatcgacctccgcccgctctgcctgcaggacctccatctgggctcttaacccgtccaacaccgtggtgttcgcagcggccaaggcctgcaagaggggttctgcgctcagtggggcagcggaaggtaaaggggagagccgcctcggtgtgggcgccgcgcggctcggtccgccgatggacgtgccggactcgggggcgttccccgaggctggctcgccccaagcatcgcccgaggggtcgggcccgagtggcgcgcccgcggcctcgtcgtgggcggcctcggaagtcgtcgttgcctcgggcggagtcgggtcggggacttggcaggccgccctgcgtacgcgcgccgcctccgtctcccggacggactcctcggcccggcggagtctggcctcctcccaagcggcttcctcagcctggcgagcccggacggcctcctgggcagcttcttcggcttcccggaggcggtctgcggcttctcgccggtcagctccccgcctccgggcctccgcggtcgccgtctcctcggcctcagaccggccggacttggaatggcgggaagggcgcgacgggatctcgctgaggcagaagaaaaaccagaagacgaaaaacgggtgagtgaaaactcccaggcgccccgggcgcaccgctggagcggcgcgatccggcgacgaaggtaatcgccgtacaccatggcccccgtgagcccctgggatcgcaaaccagccaggcggtcaagaacggcgtcgtagccgtctcccagatctaccggcgcccgccagctggaggcctgcgccgggggctggctcggaagtcggaggcgcgcttcgtcggcgagaggggtgtagaaccagtcgctcttccagtcgtcccacttcttgcgaaggacgcagggaatgtagcggttcagcaccggcccccgcggctggaagtagcagccaccgactaccgacggtggcgacaccggctgtacggtgaagaaccaccggaacagccggagagatgggcgcaccccgatgaacatctcgcataggtgcgcgaagatggccaacgtcattaccgcgttgggggtgaggtgcgccatctggagattataaagctccagaacatccatgaagaaagaagagaatggcgggaccagccctgccattgcgaaggaaaggaagaatacggaccgccccgggtagtgtggtgccgggcgtccctcacccagcgcgaccacctcccggccggtggcagattccggcatgaatcggcgcggcagcccggcctgcctctcgctcacgatgcgagaaggcggcagcacgctaccgtcgagcggtgcggagccccgtgccatgacaccggcggaggaggggcttgagagcgagtgagtgcggcgaaggtagggcacaggaaacgagaagttagaacgcaagcggcgaaggcaaggggaataatggcgagaggaaggaaacgaatctcttcctcggcgtctttatacccttaccaacgctatgcccggctcctcgcttcccgcgcccactatctcgccccctcgtttctcgcgcccactcctccactaatcccgctcgcccgtttgcggcgcacgaggcggatgtgcggccgtggcagtcgagatggcatatatcgtgcgcacgttaactacgctcgccgaccgatgcaccatcatcacatctccaggcgaaacgaaccggctcgtcccaattcgcgcgctactcaagtaatgtagcggtcttgaagaaagccgctcattattatcggtcggtttttcccttgccgatgcgcgcgatttgcgaccactggattcctgcccgcctgtagagaccggccccacctgtcaccaggcctaagaagtggcgtcacgcccgagcgctttcctcgaggagggcgatcgccctggcataacgccgggggctactgtcggtgacatgggaccgggggtatcttgactagaggtttggggcagctgcagtcacccacgtggcctgaccccctcgggggggtcgggcccgagggtgatgtggccgcccctccctctgtctccccgaggggtcgggccgctcccgtttcggccccgagggctggggcgccccgaccccctgtgggtttggcgccacgtgtgtgggttaggtgagcacagcggcgctcacctaaccgcgtttattgcgggttggacgagcgccccacgccgcatttaatgcagcgcagcacactcgttcggtccgtgacaggtcacagtgtgtgaccggtcacataccggtcagatcgcgggttaggtggcaacaggcggcctttcgcacgcctcgccccgtcccgtcggaatgatgagagcctctatgcactcgtccctagccggagccggcgtgctgactcctggagttagcacgtcagtcccggctagattcataccaggcttcatcgcaaccattacaaggaagtcattttatgaagaagggctgacgtgtggcatgctaaactgacgcgtggtagacaagaatgaccggtttgtgactggtctgacgccggtcacgtcatcggcagacaaccgtgctcccacgttgcgcctgcttccggcggagtggaggtaggtatggcccatcccatcagagggtcattcggacaacagccatggcaaatctccgcccattaatgagggagtaacagggagatccccggtgtcaggcgagtgatgacgctgggcctcactcaaagacaagctgtgatttagcttccaggcgaaggcgcaagccagttttttcttttttgggaagatagggtgagtccccacccaaaagaagagtaggtagaagtggtgcaggtgggatccccttgagatataaaaggaggaccttgcccacttaagaacgggggagctggggaaagaggggggagaagacctgagctcgtagaggagagaaagaggaagagggtttctagagtttgaactctcttgctctccagctctttgtaactccttcatacacagatccaccagaacacaggagtagggtattacgcttctcagcggcccgaacctgtctacatcgcccgtgtcttgcgcatttgctctctcgcgaaacattccacagatcgagtgcttagaacctcacctagcgcccccggccgaaccggcaaggggggcccgcgcggtctctcggtgaggagccccacgctccgtcaccggcgatcacgtacccgagcgcaaggtattcctccatcgcttggacagacaggccgcccctaatatctgcaatctaggagttgttgcagagagcggcagccactgtgatgtcactcagcttgacgaaggagaaaagaattgggaatctgtactgcactgatcctccgtctggcaacaagctatcgcaccaaaacgaggtagaggctccgttccccagcagtactttgctactagcggcaaagcagtgcagtgactttctgtcagctagaggtgcaatgcgcgtccaagaacactctggctcagcgcggcacagccaaatccaccgagtgcgaagcgcaattcccattaggcgtaggtttctgatccctagtcccccctgctcgatagagaggcaaagcttctcccaagccaccaagctgcaagagcccgcagcatcttcatcacccttccaaatgaaaccccagcatttcttctcaatttcgttgatcgcccaggctggtagttccaagacggacatgaagtagagtgggagcgccattaacacatgcttgatcagggctagacgggcatctggagataaaagcttgggcttccagccagccaaatttttggcaagcctatccatcatcagttggatttgcactttcgtcggtttacgcacagaaagcggcagccccaagtaaacaatcggcaattgcttgattgggcatgtcaacacctctgtgacctcttcaatttgaacatcagtgcaatggatcagggtcaacgagctcttggctaggttggaaaccaagccggtggcgtcacccatcaacttgagtatgaagtggatcatcagcgcgtcccgccgagaaggatggaagaagatgatggcatcatccgcatagattgaggcgcgaagtggcaaggaacccgtagcaagtggggaaagcacgccacggctcgctgccgtggagcagagagccgcaaatgcctccatcacaatgacgaaaagcaacggcgagagtggatccccttgcctgagtccccgagctagcttgatcctttgagtgtctctaccattgatggtgacggtggttgacgaagtgaaaagcaaagcagaaacacagtcacgccatcgagcgccgaagcccaaatgtcgaagcagctccaaaaggaattcccaagataccgtatcaaaagcttttgcgatgtcaatcttcaacagcatggcaggcgttttggaccgatgcaactttttaactacaccatgaacgtagaggaagttctcttgtattcttctgcgcctaataaaggctgactgtgcaggcccgatcaattcatccattctcggggcgagacgaagtgctagaattttggtcaggatcttggcgaaactgtgaatcaaactaattgggcaaaagtcagttagttgattcgggtcctctttcttgggcaggaggatgatggaagctgtgttgacgagatgtaggtgctgggaattcgctctccacgcgtccccaaaatattgaggaaatagttgtatgcagcctgtagcttatcttcttcagtggtagcatagacaccatcatgacagagggtaggaattgctttctttcttcgacgtgcattgatcttaaggcgaaaaaattgtgccgttgtgccgctatgcttgaggaataacaacctggctcgctgacggagcctaatgtgctccagggaggcgagagcaaggcatcgtcccttcaaggtagcacgcagcgatcgctcctctgccgagagaagccggtcgtcctgggccttgtccagctgaagaataatttcatgagccactgcgagctgctgccgaagttcgttgattcgcctagccccccacgaacgaagagatgtggcagtagatttcaacttgagatggagggaggaaacagagttggagcccgacggcgcagccgcccaagcttgccggaccacttcctcaaacccatctagcttggtccagaaagactcaaacttatactttctcggacggtgcatcatgttatcgcaagccaaaagcagagggcagtggtcggaagcggacgaactgagagcttgcaaatgggcatcctggaaaatttcctcccattccccattaatcaacactttatcaattttggttaaggttggctgctcttgttcactgctccaagtataccggcgcctgaactgataaacttcacggagctccagaacgtcaatagtttgtctaaacttgttaatcagtctgcgattcacattgccattgttcttgtcaccctccgaggccaacaagttaaagtcaccaaccaccagcagctcctctagaaaaaggattttgtcgccgtcggactgcggcccgtagacattggtaagccttccaaattacaaaatctgagagagagagcgaccaccttcctttatgcaggcaagaaacagagaagagatcactcctccaagccgtgaacaggccccctctagttccatcagcaggaatgaaatccgcacagtctaacacaggaccacaagactggttctgcaaccgctggtccaaaacagccaatttagactcttgacaacaaaaaatggacgcactagaagttctaacaacatcagctactagggaccttttgcccctaacattccaaactaaaagactacaagacatagagactcatgggcttccaccaccagaaaacagagcaatcaggccgccccgcagacagggatcgccacgctgcacagcgccgcaagtgcctgcacatgagacggcgcgaggggtgatttaaacagctccaggtaccgcaagaggtcctgctcttcaaccttgttctcgttgtcgacgacgccgagtcttttcatcacgacgcgttgcgcccatggcggtgtgtagggagctgggcgagagcggtgtcttggctgccgaggcctcttcccaaggatggatgtcgccggcggagtcggcctcagacatggcggcggcaactgaagcactgagtggctggccaggctgcaaagctgggccactcgagggtgaagtgcgctcctccagcccagacccagacggctgaagcgggaaaggtcgtgggccttgaagttctctccggcggcagtagactcggtttgggccgaagaagcgccaatccggcccatcttgagattcctgggggacgtcgtcgaagtaaacaagcagatagaagagaggaagcacgcacacacttgtgagttgtgagtcttccactaacgagttcaagtcaaagcggttggcgccaaaactgcatactcgatccatctgactatatatacttactacacgtaccaacaaccaactcaggatataaattaactcagcaaggaaaggaaagattaagattatattggatggaaatggcgcgcgccgtcgtcctgctcctgctggcggtggcggcgttgagctgcactagtgcggcggcgtcggggccgagctgccacgccgacgacagcgccgctctgctggccgtgaaggcggccttcaacaacgcctccttcgagtactggacgcccgaattcccctgctgcgactggtacggcgtcgactgcggcgacgactacctcccctccgacgaccgcgtcatcaacctcgccatcacacgcgacgacaacatcaccggcaccatccccggcgacgccatcgccggcctcacccgcctccggtacatcaccttcttcaaggtcccaggcatcacgggccccatccccgccgcgctcgccaacatctccggcctcagggtgctcaccatctcccacaccgccgtctccggccccatcccgtccttcatcggcgacaagttcaccgacctcggaatcctcgatctctccttcaactcgctcaccggcgccatcccggcgagcctcgccaagcccccgaagctgaactccatcgacctcagccgcaaccgcctcaccgggagcatcccgcggctgctgctgagcaaggccgggcagcaagcgttcctgacgatgtcccacaacaacctgacggggaggatcccggcggagttcggcgccgtcaacttcgtgcagatcgacctgtcgcgcaaccagctcaccggcgacgcgtcgatgctgttcgggtcggggaagaaggagctcgtcagcgcgtacctgtcgcgcaacgcgctgagcttcaacatgtcgcagctgcagctgccggaagagctgaatttcctggacgtgagccacaactccatctacggcagcatcccggcgcagatggccaacatgacggacatgcagctgctcaacgtcagctacaacaggctctgcggcgtggtgcccaccggcggcaacatgcccagcttcgatgcctactgcttccagcacaacaagtgcctctgcggcgcgccgctttctcactgcacccattgatatactcctatatgatatgaggaccataatcatccacctacaattaatgcagtcttaatttgctgcttgcaattagtaatcgaataatcctagcaaagcaaagcaagctaggagtagtatataaataagaaccttcgatcggttcaggttcatgcgtgatgtaatgttttgttcgtgcttgatatggagtacctatctcaggccaccaacacatagtatgtacaccattcgtttcaaaaataaatcaattcctagctacaaatttagacgtagtgttatccagattaattcatagataggatttgattctttttataacggagggagtatgttttaaaggttgggatcaggttttgctttttcgaattaaccgatttgatcggaagtcactgatataccaaaattttgaacaaaatttagttaaatttgaacaaatattaccaaaattcacaaaaaactaaaaattttcagccgaaataatatcgtattagaggggttcaaaatgaccgaaattttggaaattttagtccgaaattttcagccctggttgagatgcctgcgggaaataatgtctgattcatactaagagtatgaagctacgtttatatggacatctttggcatagatttggatcccaagatttgtcaaagctgggtattcttaggttcaaaaactatggatgcagatcgacgtttacgttgataacgtttaatatatcattttattttcattttagatgagtttatttttaaaaagttaaatcactataatttagcgtaaaaactttaaatatatcgtgatttgagatctgaaattctgacaaacaggacgagaattagtgaattgtgttgggcagatgtaatagcatatacaaagatagagtctgttatgggtcgtatgtattgatacataacactagagactaacattctatttgagataacaagaacttttaaccattaatgcaccggaataatttttttcttcttttcttttctccacccttgtacaacaaaaattcctttaatacaacatttatcatccttcttttcttttcttttcttcgccctttgagtcattgtcatgcgtagtaaaaatattttcttttccttttctctttcacatcaccaaatttatttcttgttataagctaatagagaaaacccgttaataaacactgttgtatctaaagaggatatcaaggcccatccacgattagcggaagggaaaggccaatttgttggagaaccctcttgagtttaagatggagagccgtcgattaaaaggaaggagcccccgacccccgtcactcgtttcattctcactcactgtcgcccccccctttccacaccaccaccaccaccacccccaccaccaccaccatcccactagcccaccacctcctccacacactactacgcaccaccctcccaccacttactctttctatccacctcccactacatcacagatacacctcaaaccactcagccaccattcctatctccccaatccccctttatatattatctcccattacttactatcaaaaatcaaatccaataaacttcgaattcaatcaantaattcacctctacctctacttttattatatactatttcatatgtacaaagttaatttgtagtacgccacaggcgattgtccactgctttctttagcttgctatatccttctcatcttcttttagctatccatgctctatgtatggccatagcagctcatttctagcttgatgggtggtaaatctgctatagaaactctgtctttcaataatttcaaaggcagattttgtatcactatctttcaggaataatcaattgggtatagctagcacccttcttgattatttagtgtttaaatttggacaaaagcaacgtggtattatttgagcttagctatactttatcaaaaaaaacatcgcaagtgcaagtttgggatcatgcaaagtcaatatctaattcctgtaccatgtattgcagatcatcctttttttttcttcacaaaagtgatccttggatttcttcaaacatggcatctccgggtgaaatgtcagtaagcaatccattacgcttccaaggctttccttgtaatctggtaagcgacctttgcacaacactggatggattttttttccccataacattgttgtgtttcttatgtgtctactctctatgtagggaaaaagaaatggtttcattgctgcaaggagttctggactgagaagatctcagcagtgcttccatagacacctttgttggccaggtgttcgaagagcttcagttcctaatgtccgattgctgccaactcctggtgctttggtttccaggggacttgacagttcattggttcacaaatctgataatgcatcagaagctggagttattcaattatatcgtataccatatcttcaagacagtgagacaattgagctgctcaggcaagtgcaagcaaaggtttcttctaatattgtgggtataaagaccgaacaatgcttcaacattcaattggataatgcattagcttcagagaagcttgcaacactgcagtggctcttagcagaaacctatgaacctgataagttacaagcacaaagctttctggaggaggaagtcgctaggaacccttatagtgtcattgttgaggttggtccccggatgactttttcaacagcgttctcaaccaatgccgtctcaatatgtaaatctctctcattgatggaagtaactcgcttggagagatcaaggagataccttttatgcttggatcctggctatggtccacttgatgaaagccagcttaacgactttactgctttggttcatgatagaatgacagagtgtgtttatcctaagaagctcacatcatttcattcagatgtagttcctgaacctgtccgtattgttccagtcattgaaaggggaagagaagctctggaagaaataaatgtgaagatgggacttgcttttgatgaacaagatatcaagtactatacccacctcttcagagatgacatcaaacggaacccaaccactgttgaacttttcgacattgcacaatccaacagtgagcacagcaggcattggttttttaatggaaagcttgtgatagatggagagaccatgccgagaaccttgtttcagttagtgaagagtcccctgaaagctaaccccgataataactcagtcatcggatttaatgacaactcaagtgcaataaagggatatccagcaaatcagctacgcccaacagttccaggctccacttcaccattatctgttatgatgcgtgagcttgatattttattcacagcagaaacccataattttccatgtgctgtggcaccttatccaggagctgaaacaggtgcaggtggtcgcataagggacacacatgccactggaaagggttcttttgttgttgcttctactgctggctattgtgttggtaatctccgaattgaaggtgcatatgcaccctgggaggatccatccttttcatatctgtcgaatttggcctcccctttgcaaattcttattgatgctagcgatggcgcttctgactatgggaacaagtttggtgaacctctaattcagggatttactagaaattttgggacgaggttgcttaatggggaacggcgcgagtggctgaagccaataatgtttagtggggcaatcgggcaaattgaccatgcacatatatctaagggggatccagaaattggcatgctagttgtgaagattggtggcccagcatacagaattggtatgggtggtggtgctgcctccagcatggttagtggacaaaatgatgcagagctcgatttcaatgcagtacagcgtggagatgctgaaatggcacagaaattatatcgtgtggtcagggcatgtgcggaaatgggagagagcaaccctatcatcagcattcatgaccagggtgctggaggaaactgcaatgtggtgaaggaaataatctatcctaagggcgctgaaattgatatacgatcaattgttgtcggtgatcatacattgtctgtcttggagatatggggtgctgagtaccaggaacaagatgcacttctggtgaagcctgagagcagaagccttttagagtcactttgtgaaagggaaagggtttcaatggctgtcattgggacaatcaatggatgtggaaagattgttttgattgacagtgctgctgtggagcatgcgaagttaaatggccttcctcctccaacccctgttgaggatctcgagcttgaaaaggttctaggagatatgccccaaaagacctttgaattcaagcgagtctctgtagtcagtgagcccttagatattgcccgtggagtaacaatcatggatgctctgaagcgagtattgagtcttccatctgtatgctctaagcgtttcttaaccacaaaagttgacaggtgtgtgacaggtcttgttgcacaacagcagacagttggacctctccaacttcctcttgcagatgtggctgtgatcgcacagacatacactgatctaacaggtggtgcctgtgccattggagaacagccaacgaaaggtttacttaatcccaaggccatggcaagacttgctattggggaagccttgactaatctggtttgggctaaagtttcatcactttctgatgtcaaagcaagtggtaactggatgtatgctgcaaagcttgatggagaaggtgcagatatgtatgatgctgctgttgcattggctgactgcatgattcaacttggtattgcaattgatgggggaaaggacagtctttccatggcagctcaatgtgatggtgaggtcgtcaaggctcctggaaatctggtcatcagtgcttatgtgacatgtcctgatataacattgacggtaactcctgatttgaagcttggcaaggatggagttttgctgcacattgacctcagcaaaggaaagcgccggcttggtggttctgctcttgcacaggcttttgatcaaattggaaatgactgcccagacattgatgatgtcctgtacttgaagaaagcctttgaggccgttcaggaattgcttggtgagcgtcttatttcagctggccatgacattagtgatggaggtcttattgtgagtgttcttgagatggcatttgctggtaattgcggtgttaagctgaacattgactcagaagattctagccttcttcaagcactatttgccgaggagcttggccttctacttgaagtgcatttgaaagatctgagtgttgtgaaacaaaagcttcaagcaggaggcatttccgctaatgtaattggaaaagttacagcatcaccagatattgagctggttgttgatggcaggctgcatcttaaggaaaaaacttcagatctcagggatatctgggaggaaacaagcttccagcttgaggggctacaacgtctgaaatcttgtgtcagacttgagaaagaaggattaaagcacagaacatcaccatcatggtctttgtctttcactcccaaatttacagatgaaaaactgctgactgcatcctcaaagccaaaagttgccatccttcgtgaagaagggagcaatggtgatagggagatggctgctgcattctatgctgctggattcgaaccatgggatatcacaatgtcagacctcttagctgggaagtcttctctagaggattaccgtgggattgcgtttgtcggtggttttagctatgcagatgttcttgattcagctaaaggttgggctgcatcaatcaggtttaaccaacccctcatacagcagttccagaatttctacaataggccggacactttcacccttggggtgtgcaatggttgtcagctaatggctcttcttggctgggtaccaggatcagacgttggaggttctcttggttcagggggggacatgtcccagccaagatttattcacaatgaatctggtcgttttgagtgccggtttactagtgtctctataggggcctctcctgctatcatgttcaaagaaatggaaggttctacaatgggcatttggagtgctcacggtgaggggagagctttcttcccagatgaaaatgttctagctagtgttgtaaagtctaacctggctcctgtgcggtactgtgacgatgctaataacataactgaagtctacccattcaatcccaatggctctccacttggcattgcagccctttgctcccctgatggaagacatcttgctatgatgccacacccagagcgttgcttcatgatgtggcaatatccatggtctcccaaggattggcagcttgagaagagtggtcccagcccctggctgcgcatgttccagaatgctagagaatggtgttcataatgcaggtacagcagacttgaattcagttcttaagcataaggttttccttgctgaactcagtttcagtttaatacagccctagcgagctgcaagttaactgaaactacatgccactgttacattcaacattgctatcttcatcaaattactatctgccgctgtttattcaacattgctgtcttcatcaaatggcatgcgtagtgatttatgctactaattaatcatgatttgtatgtgctatgagtcatttgtctggcatggcaatatatgtgttagatatcctgagtctttgattctataatacactgttctgttcctgtttccaactcaagaaaacttcagtacattggtggctggtgctaggaatgaagtaccaaatgacatccaattttactttgttttttcagttgtgtaacataccgggacctaattgatggtcatatgatgacagaagcttggagctatggactcttttggatacttaaaccttgctggttcgatgcactcagcagtcagcattgttgttaccgaggatcgaataagtgggttcatcgaaataattaaaagcagattctgtgattcttgcttgcagctttgagttttgctgctggtttgaaactaggaatcctgtaagggtagtagtgttttattaggcagaggcgaggaggcctcaggcctgcaatatgctggtaatgagaataatcatgttggcgctgcagtgctgctttgggaattctttgactagcagaagaggatacatgcccgtaattaaatgtaatgtgttgttcgattatccggtgatactaaatgtcatctttcttctgtggctatccttttcaggttctgctattggatgcgcagcaatttgcagtcctgctgttgatgaaccgtattgtcgaaggtaatatgggattatggattgttgattttacaggtgtagatttacatttgattgtacgcttgtttaccggttactgtcagtggcttttgggggttttgtgttgttgtttgaccacccaacccaacaccaagaggtttcatttcaccgtgcgatcgatacatatggggatagacacaagagaattggagaagtcaaaaagttttttaagcatttgggatgaattagtaatagaacttgtgtgctgagttgtttcagggactaaatatcttgtgtgctggattgtcgtgcacttgtgttcaaataatgcaggtagaagtagaacaaggcacttggggcaggaggacacaaattgtagaatgcgtcgtttgattgttttgttcaaagcggttggcgccaaactccttccatctgaacaactcgccaatctgattactccctctccgtctacatatatatacccccacacccacatcgttcaagataagctgagacaaaatcgatcggaggtcgaaatggtgcgcgccatcgggcccctgctcctgctcgcccacgtgctcgtgttcgtggtgtccattgcggcggcggcggcgcccgtgcgacggccacgctgcgacgccggcgaccgcgccgcgctactcgccgtgaaggcggccttcaacaacgcgtcctacttccagtcctggacgcccgacatcgcctgctgccactggtacggcgtcgactgcggcggcgacgactacgactacgaccccaccgacggcgaccgcgtcctcagcctcgccatcatacgcgatgacaacgtcaccggcggcataccaggcgacgccatcgcccgcctcacccgcctccaggagctcatgttcttcaaggtccccggcgtcaccggccccatccccgccgcgctcgccacgctcaccgccctcagggagctcaccatctcccgcaccgccctttccggctccatccctttcttcatcggcgacaagttcaccgcgctccagtctctcgacctctccttcaactcgctcaccggcgccatcccggcgagcctcgccaagcccccgaagctcatctccatcgacctcagccgcaaccagctcaccgggagcatcccgcggctgctgctgagcaaggccgggcagcaagcgttcctgacgctgtcacacaacaacctgtccgggaggatcccggcggcgttcggcgccgtcaacttcgtgcagatcgacctgtcgcgaaaccagctcaccggcgacgcgtcgatgctgttcgggtcggggaagaaggagctcggcagcgtctacctgtcgcgcaacgcgctgagcttcgacatgtcggagctgcggctgccggagcggctgagcttcctggacgtgagccacaacgccatccgcggcggcatcccggcgcaggtggcgaatctgagcaacctgcagctgctcaacgtcagctacaacaggatgtgcggcgaggtgcccacnnnnnnnnnnnnnnnnnnnnnnnnnnnnnnnnggttncagcacaacaagtgcctctgcggtgcgccgctcgccgcctgccattgatgtttgatccagaccttgaaactgtaaccactactgtactgtagtaataatcactgagcaataccaaaaactataggataaattaatgaagaagcaaccagctaatgctaataattaaggtccattcttgatgaacatgagtgaaatttagtgtcaatcaatcttttgagtgtatgtccatactgatactttgagctgagcagccagcctggtggcaaagcaaagtccatctttggtcagcatgcatgcagatgcagatggaggtgcagcatactatatttgacttcaattttgacctcctcacttgtgctttggttgatcttttgcaaattaatttccaatgacagtgctaatcctcctaaccaaactcaataattcgatcagattagctagccccatgaatatatagccagtcccatggccatggaaatggaaatgctgcttgctaagaataagatgctcctcctcatgctctccactctcctcgtcgccgccgcctcgaagcaatgccaccccagcgacagggcggcaaccacctctcccggagcatcagcatcccggcggagttcgccgccgtcaacttggcgcgcatcgacctgtcagctcaccggcggcgctgttcgatcgggcgagggaaggccgcgcaggccatcgacgtgtcgcgcaacgcgttggagttggagttggagctgccggagcaggtggtcaccgtggacgtgagccacaacatgcatcatctacggcgacgaagctgagcaggctgcaggtgttcaacgtcagcctctgcggcgaggtgccgacgggcgtggcgagcttcgacggcgacgtacgtgtacagcctgcagcacaacgagtgcctctgtggacctccgcttgcgccctgccattcaccaccaataatcgagcttgctgattgagaatacgatctatctttaattgaaccacatgggattacaaaatctttataaaatatcactgccaagtactagtgctttgattgggattttggtcgtgtttagttcctcctccaaaattttccaaaatttttacatatacgaacgcacatttaaagtattaaatatagaataataacaaaacaaattgcagattccacctgtaaactgcgagacgaatttattaagcctaattaatccgtcattagcaaatatttaatgtagcaccatatcgtcaaatcatggcgtaattacgctcaaaagattcgtctcgcaatttacatgcaaactgtgcaattggttttttttcgttcacatttaatgttctatgcatgtctccaaacatttgatgtgatggaatttttggaagtttgaatggaattaaacacagcctttgtgttatttttggatgagctttgattggtactttagagggaagtggagtggataagaaatgtatacaactgaactgtgttcagcatactccatttctagtttggtggagaacaaatatttatactacctctgtcccaacaattcataggttattgaatgatgccttatttcacaaactccatctcatatttactccctctgtcacaaaataactcaacctaggatgggatgtgactctatctggacaatcacatctcattctaggttaagttgttttaggacagtgggagtacaacttaactacaggtgactcccaaaagatagcccaaattcgccgggatatataatgatgatctgggtggtttatctctgcctcaaaatgaaggcacaacaaaattgaccgcaccttccaaaagtgctcctcgaggaaatcaagcaagagcgctaacacaaatatttaaactacatcgaaatactaatccaagagtgcacccaacctccaacacaaacattatcatctgaaacatgatggtttcttttctttaggcctcagataacaagtacaaaaatgcatactctgccatcatatcccaatttttcagtcgtgcgaatgaaaaacaaacaaaacagcattttaagtcagactcccagatgctccaactacatggaaattacaggatttgggcggggggggtcaacttctcggctatgctaatctcgccccttgtgatgcttgacaggtacaccagtgcaagattatcctgcatcaccaaatggtgcaatgattatgtacaagaaaattgaaaatgatattcatttactcgcataccgacaagctaaagcactaacctgaatcctgtcattgaaaagcttgtcaaaagcagctggtgacaattttggcattgaagcaacagcatcagagatgaatctcccaattttattgtccggtgctacacgcccctcctacataggggtggaaaaagcctttttaacactgcactacataagaaataagagaattttgccccaaaaggttcttaccacgacatcatcaacatatttgtagatctcgtcaataaggacatacagcttttccatggaggattccattccttccagatcattggggagcttctccacaattgtagatttcaggatgtcaactgtcacaaaagcaataataatgaccaacacgaaataaatgaatgtacaaccaagacaaatgcaaaaaacacagaatagttttcctccaacaggaaataaatgttccacaatactaataccctccactatttggataactaaaacaaaaggaaattataaatattcaagccataaggacttcaaagctgccaaaagaagactttttttttttgcttcaggttttgcaggccccatatagatttctagtgataacatataaacctgttaattcaatgttgtatacctctcatcctaagaacttaagatcttactgtataacatataaattgggtagagaaaactttaaggtaatgggggaaaaagtatgggtcagcaatgatgactgtgagacatacatccaacttttcctgcttcaagcatcctcagatcaaggggaatctcttggaactgcgcagcaaggtgcctatctccaagagacaggttggatgagatataggctttgattgaagcatcgccccttgtgaacccagtgtcaacagtgagatgaatggggctctgtacttctcttgagtaaaaatcatggataagcgtacttcccccagaaacaccgaagccagtcgagaacctgcatacagatgtactgtattactgctcattcattttttgaaatgtttctttcctactctgaaagaaaacaaattacagttataacagcacctctaagtttgcattgtgggtactgttaattgtcgcacagcactaggtaaaaacag

SEQ ID NO: 31459 - DNA, 22176 bp, Oryza sativa
ttttacatgccccaccgtttgcccaaaacttattataagtcgtaacggtttattagcgattaaaaaataaaacttttattcatatgttcttagctatttaaaagtaaatgctgaaaaaactatattgaaaaatcttaaaataaaatttaaaattgagttttaaaattcaaattttaactttaatttattctttttacatatgagtaaccaatagggctcctacatgtttgacactttttttaaaaaaaaaagataacgatggcacttcattgattaagtagcatcaatacagaggatctcacgaataaactcccgagtgacagtagatagctattagagtaagataataatagtatagctcacttcctactattagttcatcttaaagtcaatatatataataattagctataaggttggctacaattttcttctccgctctctatctctcacttatacatttaatgtatttgtcttggagattgtgttaagctagctcttgcatgagagccaacacccttgtttttttctacctctctcctccacataagcttatagtacacttatagctcattattatacttgctcttaggctgagacagacgaactaaagtgcgtgccaccaagtacaagcgattaacatccataagagcaagtataatagtaggctataagccggctaaatgctgaggtggaggagagagaggagaagcgggctgtaaacttacagccggtttggacacaagaaccaataaactctgtgagagagacaagtggaccatgtattaattgtaaatagctacttcctccatttcacaatgtaagttattctaacattttccacatttatattgatgttaatgaatctaaatagatatatatgtctagattcattaacatcaatatgaatgtggaaaatgctattgtgaaacggatggagtaactattatatagacaggctgaaagaagactacaaagaactttatagccaacaggtcggctgtattattagtcttactctaaaagtacaagcgacactgatcttcctgatgtcactcaccagacagcctactcttcagatatcccattctggccattgaatccttcgggtaacagagaggcaatccgaacccaaaataacatacaacctacatgtttgctattgacaagggagaaacaaaacatgtactagtgaagtattcaattcatattattcatcagttgcaaatggtatttactagtatcacgcatgttaaattcgctggttgctgtaacagtgaattaccgaacaaaagaataatttgtcactgagaattgtcattttggcacggtatgtctgaaaccgtccaaggttctgctatgatgttttatgtacaattgtccaaggttcgtcagaagttgcccaagaatcaatcaattccatgagggcacgaatgaacttgcttatacattacatcagaaaagcaaagaattcccccttgacaacccaacattttatcaacacctgttgttagcactaagcaactacagagcaacatcatcagttcaacttgtaggcccaactgtgattcttgaggtaggcttggactgcttcctttatagccaggttaggaaccaattgatgctctttcagaggctctcgtgtcaccgggtcgaaattgcccacctaaaacccaaaaggaagattgcagtgactgagcacattattctcatttaatttcaatttaaattatagtttgtgtttagattgaatcctactatagcttaaattagatcattgacacataatccacccaatatatgaactacagcagtttcatatttaaatattgcagcattgtgctgattcaaatattccactagttcgatttttttgggcctccctgctgtgttcctttcaaaaaaaaaaactagttcgattttgacttattctttttaattatacaatcaagtatttcatctgttggagacattatttgtagatgtagccagctaatacatggtccttctagtgaaatattagcaacaacatctaaagatatgcagagccaaaaaccttctgaaaaacagatagcaaattagcaagggaggtgtaccttgcaaagatgttcaaggattatggacctctcatacgttataccactgggtgtgatcactggatctctaaaaatctcaaaggttatttggcagcaaaggtagtcaggcacctagattttcaggtagcaacagcctaagatcacagagaaaaaaaatatgctagcacaaagatgttgaacatgagataacatagataataatattacatctgttggtgtatcgtcgattgtagctttggtgaagacttctgataacaatttcagttggtctgtatactcattggttgagccatctcccacaagtgtgccactaagaaagtggtgctcctgcaaagcattttcacatgcttccctaattgtccatgtgacacagtggtgttagaaagtttaaagcatcataaattttagataataaagggagtgtccaggttgttataggagtaaattggccacccaataccaagattcacactacagttaatctgcaacacaattatgaaccattattattcaaattatttttcatgcataacatacttaaactttgcatcttacaaactctcttagtggagtgtatttcccaatcttggtattttgccttcgcaagaacctgccaaatgtcctccgccattttgtcccccaaattcgaagacttaagaagatccaaagcctgttttacatgataacataagcatggtattagcaatagcatggcaagagatcaacatcccatttcaacatgaatgtagcaacaaaatatcaatatgtaggtgcgtgaagacacaacattagcattcattagtaaatatccccttcgattccaaatgtaagtagtattagtcttctcaagccttttgtaaatgcaagtcactttaggcttttttttttcatcttttcttccatgattgccccagccaaaaaaattctacccctttcacaaataaatgagccatcctttccaatgtagtaaaatgaagggaaacaaagtcatttaagctatttctcaattccaaaattctttgtttatgttaagatttgtcctaaacaataacatggtgaagagctcaggatatgattcagaagaagctgaagcaaacttacaagggccatagaagtataataacaaaccttgttgaattccttgatagcaagagcacattgttccttctcaagcatggcacatcccagcaaatagtgaccctggaccaaagttgaagacctgtaacaatcacttgatttatgtatgaacaagggacattgagatgatgttaccttgaccagagtgtcatcaagggcaagagctctcctgctatcctcttcgaccttagcccattccctgtatcacattaaaaaagaatcaagttttttcccccaagaaagagatagtgagggaggggaagaaacaagggagagaaatacttgcgcttgaaatggcagaggccccggttgagccagtagacggcgacgtcggggcaaagagcgatagcctggagatcgtggagttaatcatatcggttgccaaagattgaaaaaaggaaagggaaagggggagctagggattggggagggggaggggaaagagggaggttgcctcggtgtagcagtcgatggcggcgccgaggcgggccttgttgaagcaggagttgccctcgatccgccggagctccgcttgcctcgctaccgccacgccatccgccgccgtcgccatagaagcagcttcttggatttggttggttttccttcccgttttgcttcggtttgaacacttcttcctcctttttcttttctttaagaaattgattggaacttggagttgtatgtaatctgagaacgcgtcatccccaaggaccaaaaaaaggagacgatccatcccaacaagtaatcctaccgtcctatcttgttgagtgccacatattgctacatgatcacacattatacgttagccatgtcgcaatgtttggttgcttattttaattttggaaggccacgaattggtgctccatgggctcacatatcatactaaacgacatatttacaaataaaaaataatttatgaataaaatatttatatatgtgttcttatagcaatttaaaaacaaaggctgaaaaataaacttcgacgaaaaaacctcaaaatcagctctaaattcaagattacaattttaaattttggccgctaagcatatgcaaaaggaaaaggatgaggtcttattctctagccaaacattgatatacttgtgtggactatgttatgtgtgttatgtcacacttctggcaagcgagtcatgtcaatcttaagcaacaaccaaacaacccctacctagccaatgatacaactgggggggggggttgggagctctaaaaaaaataagtccttagggtctctctctcccaaacaccccctaacggccacatccaagcctggcgacaaaaagctcagactagactaccgcctaaccaatctaggagttggttcggccattgagggcatgtgtagttcgcaaaaagaaaatttttaggtattacattgaatgtttgatcggatatcggaagaagttttcggacacgaatgaaaaaaacaaatttcataactcagctggaaaccgcaagacgaatattttgagcctaattaatccgtcattagcatatgtgggttactgtagcatttatggttaatcagggactaatcaggctcaaaagattcatcttgtgatttcccccctaactatgcaattaggttttttaatctatttttaatgctccatacatgtgtccaaagattcgatgtgatatttttgaaaaaaaatttagggaactaaaccaggcttgattacactcctttgtttgttttttaaaatatataatgcctttgatttttcacatattttaacctaagtattattgttttctttttcttcaatacacgacaatgttaatatgtaacatatatttaaccatgtcttatttaaaaatatgttattattatttattttcttgcatatcgttttgttataaaaaaactttgattatgatttacatttttcatatttgtacaacaatttttaatgaaacaaataattaaatatatatctaaaaggtaacacggtcatgtatttatgcttttctaaagtttgtttgttactagatattactagtctaaggaaaagttgttccttttttaaatcaataaatcaatgccatggaatttttgtttagacattttatttttgtgattactaaaaaaagaaggcagcaaacttacatcaggatatttcgtattattaaagaaaaaagtgataataatactaccataaaggaaatacaataatctcatccgcatatttgtggtgccatcttaacgagtagggataaatatggatgaaacgtaagcataaagatagcagaaaataaaagaagcatcatcttctggagaaatatgccatgccaatacgtcgttcagacttaattccagtttgctactacattcataccagccttcctgtgctcattattctttttctaagcacaaaaatgttcaatcagccccgaacaggacaggctaacaatggataataatatgtatgtagtggctacatttcttcaggattcagtttccacgacgatgggaaatttcatttagttaccattgatctgatgaaaagccttgcttccaagaaccaacttcttgaagcgaactatgcagcccattgcacgctcgaattcctgctctccagagcaaagctgaaccgacagtgatccggtattcctgtccatgagctgctgtttatgcacaacccggtggacctgagaatggcttccttgatgttgcagccatctagcttgccatcaaaaccatccaccttgattattttgccgatgtaggcagtcggtttcgccagcatcgatatgccaccatgactgccagcaacatcccagccacagccctcaagtgtctgttcatagcaaaaaaaacagagagatgaagaaaccgccatacgtagctgcaaaaatctcagagtctttcagtcaaaaaaaaaaaatctcagagtctagtatgtctagtaagttgcagcattgtgcaaagtatgcctagcaaattctagccagatcatttcaatgtcccaagataggtctagctagtttttgaatataatatcatggaaacataaagttactaatttcatattttaagccctgccgttgatcttacttccaaagggatcagaattgtgaatgaaagcttaattggaagtatcattcagaatgttatgagaaggtaacctttatcaagtggtcagcacgactctttagtgtgtccttctgctccataatgagattggagaagtgttcatccttctgattcttgaggcccagtagttttttgaaagtgtacttcagcgtactgtggggacgactcaagcttgggaaactgtgaaatgtgtcaaccaaggatgagtcattcaaaatcagaaacccaaagtcatgccctgcagcagtcagctcaaaggacagttctccgagaagagctacagagaacgagggttttggacaattcacagcagaaagacatctttccaaattccatcgactccagccatcagtttggaattccagaccagagaaggaggtatctattactaccctagctccatatttaccacaaacagaaaggagctcttgaatatcactgtcactgtacaggaaaccagtagggttaattgtggggccagaaatataaacccatggcctagatactgtctcaagtgtgtcagctagaacccgtggttcaatcttgaagcctgattctaactttgtcggaatagtcagcgtatttgcattcacaaactttgctgctgagacatagtgaccattagcgcccaaggggaaaagtaaggtgccctggtcttggatgcagcaaagggcaagcttgttgaagagtgcaagacaggtgttgccatataatatttcagaacaaccatctgctgggaaaccatagctatctttcaccagctgctgaatgctggaacggacatcagtttcagactcagtaatgttctgcctaacaaaactttcaaaaatggaggcattcactgcagaaggcactggcaagaagctgcgatctaaatccatatgaatgacactggattttttggagtcaggaatgaaaaattcagcttcttttagggtagacatagctgaacttgaaaatcctatcatcttctgaggtatcacttctgcaggcagtctctgaaaaagagcaagaaaaaaaaataaagaccacaaaccaaaaaagatactttaagttcacaaaaatagtccactggaaaattattaacttcgcttataattagacataagataaaataaggtaaaaacacatcaaactcttctaaaaaatttagctgtttactatagtgtgttttatccaacaaaggaagaccaattcataaattaagaagtagctggtttctgccattacatatccaagatcaccataaggatgcgtgagattaagaataagagacaagtcatgtttacttcttgttgtggatgccgatcagcaatttgaaatgccagtagctcatggaaaagacaaccataatagtgctggctgatctgagacgtatgcccttccaatagctcaatagtttgtgataatgccctataaacagctgcatcttcagaaatggcaaaagcaacctccagatcagaataaacctgcaaggatttaatccaaaataagataaagcaattgaaaagaaaacaatatagtagagaaatttaagctcactcaattaaaattagctgctgcaatagttacaggcacctgattctttactaaaccgcatagtatagctgcatgggaaggtagggtctttccagcaaggtattttaatacaccattagagcttggcaaactagacaactccagatgctctgaaatatcgatgaataaccgagaaccaacatccttcgttacacttaataagttctcaaaagcagcacttgtgatagcctcaaactgagccatgccagtaacaaccacctgaggcttcagtttcctgatcaactcaatcaacaaatcagattggcgtggtgcctcaattacagtaactgtatctttggcttttccctgaaattcaaaaggaggtagcagcatcaacattattgcattctataatagaatgagtgtcttatgagtcttgtccatactttcttctccacttttccttatgaaaaagatatttttaaaacaaaagaaagtaaaacaaagaaaaagaagatgacagagactactaaagtagagctcagatgcgccaaacaaattctggtcaatgtgcacaagactcactcacagaaaagagagaaattaaggtacctcaattgctaaagaagttaaccattgctttggcaagtgtctggtcagatgttcatcaacgatcgcaagcgctggtgagaataatcgaagagcattttctattgccacagcacgggaagggaaaacaacaacattctggaggacgataaaaaatatcaattattttaatttctaatgagtgaatgtaactataactataacagacaccaagtcttacatcaggagttaatgggatatggtggtagctcttcataaatccagcaacaagattccggaagtttaaacaaccagctggtggttcacaaggattgtatttattctccttcaaaaaactagctaggtatgctaggaagggtattttttcgtcagcaacagaatcatcatcaaaagacaaatccagggagctgctgacttcatggaacccatctttaagaaactcaaatattttcttcacctgaaagttatatgaattagtatttttcctgtcattacattgcttttagaaatctaaagaatacacaaggaacctggttgggttggcgaagttgacagctatacactgacaaagcatgtgaaatacgaccaccagatttcatgtatgcccaagctgtgcgtgcacagacaggctgatccccaacaagatccatgaaaaactcaaagcgatgccggctatttttctcaatttccactaaagctgaaatatctgtgtcagcagcctgcaattaacccaactagttagtaatatgactaacgatggtaaataaaatggacatgtgatgtaaaagcataaactcatcgatgaaaagtctaggcctagtaaaagatattgtgaaacataaagtacaatttcttgaccaaaccagcccataatgtcagcatgaaagacacctgcataataccagcatctgattcataacagcatcactacctgcataatttttgtttgccacagttttgtgatccgaaatccacggcgtcgaaatagtcgttcgcagacaccttgtcctggtcgaccacccatgttaaatatcataatacccataggctttatgactgatatcccttcttcaacagcccgagcaatcaacccaaggccaaattggtcctcaacaaaaccctggatgcaataaagtgtgcactaagataacaagcagtggattactggggttaaagaatatgaagatctatcaagtgtagaagttcacgccttggtcctatattccaatagcttggagataattcaccattgttattagataaattgaatggattatatttcatgcatatttattcattttcactgaggtgaatatactgaaaatattcttcagtttacctgaagagcacagtagttactcaatgaatacaagaactcctcactggaattttcagttacgatctttgacattgcttctggatttgggttaagaatctgaaaagggaggatttggggagtaagagttttccttccgtctggtttactataatttcctttcaaaaaagaatatattagcatgactgtacctgtggtatgcatccaacaatgcgatcaagttcaattttattgtctctgcagtaagagagaagatcagattcatagaattctactctatccagcaatgttttcccctccccgtcgtagattgggagaccatcgtcatctagtgcattcaagtaaaggtttatccatgcaatcttgacagctcttgggtttatatccagtccatagaccttcaaaagaaacaagcaatgctcagcttggattgtggcaaaaaaaaaaaaaggttgaacaagtgaggtaacatagagcaagtgctaattaattagatacagtggtacatgcagtttaaaatatcaaatgacatgttagttttccttactattcattctcaaaggacgccaacattttaccaagactgaaacagttctgtggtatagagcagtgccttactttcaatagttgtttctagacgtaccaaatcaaggtagaccatcattggattagcaaaactcatatcttgtgacttagtaaatgtctaagtgctgtagctcccacctctgtacagtagcaatgaattaaaaatgtacacaggaaagagatgccaaccttcgaaggggaccacttttctgcaagtgcaatggatatccaaccattgccacatcccagctcagctactgtcttatccctgaaaatggaatctggatgccgattgaggccctcatagaaagtgaaggaccagtcttcaggaatgaaaatgctaggtatttccatcatcgttagcttcttcctctgctggaatcctataaacagttgataaatttgtaagttatggaaaccaaacaataaataccatacaagaggggataaaaaggggtaatgtattggtataaaaaaataggaaggttttaccattgagccaacacacataaatataacaatgacaaaacgatagaagaggattcatgtcaggtccatactccagacaatgagacaatctaggaaattgctcagatttaaagactactacgctgtccaatattactactagttataataatatggttggttgacttgtgtcctaactttgttgttatgagataagttaagaaccaggctcatatgccatgcttttgtccatatgatgataagttgggcaaaggtagttctgccaaggaataaattagaaaaggtgaataaccttcagcagaaataaaaattgaaaagagaaaaaaggaaaaaggtacaggcagagcattgtggattggtgggtctttattttaatgaggcaaacagaaggcataaattatccaagtagccacacgaattgttcccagaaactgaacatatgggtcaaatctgtcctagcacatgcatccttgaaatgcttacagcagcatcacacgtggtaagcaatttggccagaaccaacagtatacaattgtcatttataaagaacagtgtgcacagcacagttgttgattccaatctaggttatcccttttctttaccatgggaggcagaggctcactatatgtggtgatagcatacttgcttggctggtcagttgcgagtggtgacaaaaccattactagcaactaactactagtagtaccaactaccaaatagcagttccgaattactcaattagccaagcagccaagaaaagattttagcaagaatccaaattactagcaaatagagtagtagtaaatcgtgaaaggtatttagttaccaaactgtaaaaaaattattagaagcagatggaggaatctgcgaacaaccaaagtagccagggcgggtgacatgacaagacattcgaagggtttttctaaacccctgaattcgccaaggggaaaggcgggagtggaaatggtggatatatacctcggaggtggggatcgaggacgacgtcgtggatgcggaagtggaaggtgcggaagcattcctccccggcggcggggccggcgaaacggcggcggacggcgccgaggaggcggcgggcgtcggggcgggaggcggggtcctggaggcgctcgagcacggccttggtgcgccgtacgccgcgtcgccggaggccgcgcacgtcgccaggaaggactccacctcggcggcggcggccattggattggttaggtcggagtcggatcggatgaatcgatggatgagatgtggaaaggaggaaaactaaaacaggcggaaaaattggcggggaggtcggagggagttatataccgccgtggacagtgacgaaggagacaggggtactaccgtaatttctcttctcttctcttttctcgtacgagtaggagtagagtatatactcccgattctgttacacttttataggatcatcgtttggcttatatttaagaaaaaaaaagctaaacaatatatttacaaataaaaaataatttaggattaaaatttttatatacgtgttcttatagtgatttaaaagtaaagattggaaaataaattgtaatcaaaaagcctaaaacaactctaaatttaaagttaaaaattcaaattttggcttataagtataagtataagcgaaaagatgaggttgttctcattatttcttttcctcttttttattttctcaaaggtattactattagggttttttttgaaaaactttatatttttaaattcaatacttctattagtagatcatgagtagtcttctttggtccctatcaaattattctcaattgcttttggctgtaaagttctccaaaataaaagggaaggtggaagaaactcatggctgtggcctttgtgggttaggtgaaatcttcaaaggtgccaacttggtggttttttcttcctttttgaacatgaatgctaacttgttgctatgttgatttattgtttttttcctcagctctctaaccacgttaagcaccacttattttgatgagtgcgaggtatattggatcttctcgaagacttgctccattgaagctgaaagatatattactaaataacatggggaaatacacttttctcggttttttttctaattggaaaaaaaaagtatgctacatatatgtgtggcatgaatgcaccatataactgtttgtttagctaaaatacttactgcacatttttctttgctctgtgtttgataaattcgtatgtgttgctcgttcaaatatcctatatgattataattataaaatagaaataaaacccatctacgttaaaaagtttaaaatatatgggataatcatggggaatgtttctaaccggtacatggttttggaataaaaatctaacgccatgccacccattcccaacgtaaatccatttatctcacatcgacacggcactctatccttttcacatcgttttttaattaatttcctccctatttcatgagtgcttgtcaattccttctccttattttccaccttagtcatggcaggcgttggccactgctcggaatgaagtaagaatccatatataaatcaatactttttgtgaattttttatgtttcgactattttgacttgatgtttcatgagttagataaaaaaatctgcaacaggattttgatggtgtttcttaccttttcatctttaatcacgtggatctataaattaatgttttgagaaatgcccaggagtcttccggctagcttcataaggtggtgggctaaacgacctgggttcaaagcctcacccctcctaattatttgatattaggtctttccctaatattctagtttttttttataaattaatgtttcaacaatgaaacccgatgtttcgtgtgttaaaaagaaaatgttttaaatgtgattggattgtgtttaaccattttaatattcatttttatgaaattttgtcggtgtttaaattcaagcctgatgttttttttttcacaaattgaacgtccaacatgtagtcacgtctaaaacatcgagttcaaattgttgaaatatcgataaaattgtaccatagtcacccccatctctctacaaagccaactatgtagcatgccctacttgtctatccttaagtgttgctgcaactttttaagtcaaaaccaaaccacatattcgaggattgaattaatgtatgatcaactaggcacaatcattgatggacctaccttatgctctattaatctgggaagctggggtgagtataattagctacagagagaatgtaaagatgcttgagcttcacatttttctggctgctaagtcccaaaatataaatggtacttatctaaaaaaaatataaatggtgggagctaaagattctgaaagtagcaatggatacgagacgcttcaccaaacaggaccttaatttcttgcatgtgtggaacgtacggtagctcctacatatgaatatatatgatgctagtcatagctagcgtttcctcttaatcttttactagtatgtttttggaataatccacggaccgacaaatgatatgggtggatcggagggggggggtgataaggccataaggggcagacaagagagagaaaaagacatgtgtcaattccatatataatatgtggaatacatatatgcatgatcgatcgatgattccatggatcgattggatccttgtgggccgacaggtatggtagtaaatattcgctgatcgaaggatggatcggagtacgttggagatgactggacggcacgcaattgaaattccatggcagggactaattgcattgtcatgtcgatctatagatgtacactacagtagtatatatatgtatggctagctagaaagtgagtacactatagctagctttggtattatttgtgatgatcgaacgatgccttaattccttgtagaatgttaatttgtcaacaagttgcatatgtctgtgattggtcggatgtcgccgtcgcgcgctctgcattattcagacttttgagatgatgtacaagtgatcgacaaggaccgtttgctagcttattgttttggttttttttttaagaagaagaagaagaagtagatgaaatgagaggagagatggaccgatgacgaacaggccggacgttatattagttcagttgactctgatcgatccatggatatagtagctagctcctcaggcctaggcgcaggcagtcaatttaattactttactaattactactactactactactactactacttaggattggagtaactaaaaattaataccgatggaggtgcatgaacgatcgatcgatgcagtcatgcatgcagatgatggatcgatcgatcgagcaaaagactgactagctagctaattactccaattgatggatggatgcatcggagtacctgagaattggtggtcgtgggcgcagtggaggagggagaggtcgtggatgcggaatccgtagcgcgccagcgagtcgccgctggagcaaaaaggccggagcgccgtcaggaaggcgcgggcggcgcggcgagtggtcggctcgtggaggcgccccagcaccgccttgagctcgccgtaggccgcgtctcccgacggcgcgcaccgctccaggaacgccgccaccgccgctgcatcctccacgccggcgctgcccatacctatatagcttcttgattgctttcttttgttttgttagtgtcgacggtgagctcaagcccggcctcagctgcatcctgcatgcatatatagtatagctgccctgcagtgcgcgcgtaattgtggagcccactacctacttcaccatacaacacatgtctctatatatacatcgataccaccatctaatcgattttcatgttttgctatctatatatctctccgatccactccctgcatgtatgtccatactaatttgtacactcacacctataaactaattaatatacaaacacaacctctatcggccgggtaggaggagcatctttgtagattgggttttgttatatttttttgacatatgtcgatcaatggagaaactattctaaactctaaaggggatatcctctcgttatttgcatgttaatcgaatagttattaatttttttaaaaaattaaaagatgtattaatatgtaatatgtcactccacaaacatacagcatacaagttcaaattcaacttctacatatcacaataaaaaaagaaaataaattagaactaattaacgtatatttatagtcaattttttttcgtttgtgacatgtacaagttaaattttaactttttttagcgaacacaagttaaaattttaacttgtatatgttgtggagtgatatatcatatattaatatatcttcttaatttttttataactatttcagtaacatgtaaacaatgagggggcgttccctcaagagtttaaaatccactctccgatcaatgtgtgatgatggacaaacaagccacttactcaaaatggcggagtcagtatttagacctaaagatatggagggatctaatacactactacctacatcccaaaatataaagctcaaccacttctaacatgaagaccaacaaagaatttaattacctccttaattagatcacatgcgtacatacaagtaatatgattggggtttaatggtagaggatttaaaataaatcaaatttaaagaataaagagataatagctactccctccggtttcattttaattgacactttagacaatgacacgctctacaagatatacatttgaccttatttttctattataatatatataataaataaatgcatatttatttttattatagtgttttgaaagaaaaatctatatatgtttttctagtttctttaaactaaatatttttaaagttattgatggtcaaagttataaaagtttaatctcaactttatccaaaacgtcaattaatatataaccagaaggagtatatactttatattatgacatgagaaaaaatgatactaatatctgagatagagagactaatatttgaggttgcctggcctcggctcgtcccctgtttccgcgctctggccactcatctcatggatatgatgatgtttggtcccgaatcccgatcgatgcaaattatatatatgcactgtgttttcctttgtttattgggtcgctaacgtgtttgtatcgtccctgtgaaagagacagagagatcgatcgatcagtaggcggcgtgtgtaaaatatgcgtgattgatcgaccatataaatatatggatacgcgtacgtatatggtggatgaacagacaatagcccgagagtgagaggtgcatgttgacgatccatcatgataatatagtactcctctccgtttcgacatacaaataattttagctataaatctaataaataattatgtgattaattaattcataatcaaaagttactatatttaaaatatgatgtattaatatttatatatataattaatatgccttgcatgtctaaaaatgatcgatgcatatatgatgtatccactaaaccaaatcaccgattgtcactcgcctaccactaattaatgatgtagccaatctttaaaggagctagagtctgagcatatacgttaataggaattagtgtgcgctccttcgtacgaacgattttatatttgtgttgacggtatataatccacccggtcatcatcatctcaattctcgatggattgatcgatgaataggttttttataagggagaatcccgatcgatggatcagttgcaagttattttcacctatcatcgatcatatatcaacccatcatcatatagtatgtgccaatcaagaaaccagctagcgatcggatagctgcttccaacttgttattaatgcatatacatgcatgttctacccatgtgttaattagatgttgcaatcataaatttacgcgagaggcctaccatgccagaatatatccacacgcgtgtgtataccaattccatccggtttattaatccttccgttgcacagtaccgctccatctcacaacaggatcatttttagcccctcctgtttattctagaataagttcggtgttgaacagtaattgtatcggagtttataaaaatagaagataaatatatcgagagtagataaagaaaatgaataatcacattaggatttttgggatggtgttagaatagttaagcaaaagtttttttttgagggtgggggggggtgaagttggtctgattgcaagtctttgttgggagctttagttgaagataaattacctaaatctgttttgcaggtcgtgtacgatgcaacgctggaaggagattgtgctccgctgaacaacgttgttaaaaagctaagctaatggaatagatggcacaacttgggcctagagatgttttgccagatgacttggggattggatagtgctgttgttgactggtgtactgggaggagaggttttttgctgtttactctttggttctccttgcgtggagatgggcagcgttactgatgtgttttcgttttccttttcagtttgttttcatgcaagactctgttatgtttcaggctttcttaaaaagccgggtagtgaaaatttacatgcagtcttaaaaaattagtaaaaagaatgaacttatttttgtgagggagggattactataagtttatcctaggtcaattaattttaaagtttgataagtttataaggaaacgtagcaatatttagagtatcaaattagtttaattaaatatacattaaactcggttataaaaatatcaatttaggacaaactcaaaatagtttataatacggaatgaatgaaagaaagcccggtagattaagcagccagcaggctgaaaagaaaggccatgatctccttgcacgaatgtctatgtatacgaataagtctattatatctccctcaacattttgattccgattgaatcacatctctcaaccataaatgtctctcatgtcaaattaactatctcggcggtttgggtaacggtttctgatagcttggtttgttgacccctgctccaaaatgttgcaatctaacgaatctggatggaagtaggatagatcaaatggcatcttgattgtaatattttaaggcagagaaaatattatataaaggagtgcaatattttctcccacaccttatagaaggcagtgaattagtgaaatccatacatcaatcgtatgtaacatctgagtcgtgagtcgtgacttggtgtggaagaagagaatagctaaaagacatagatttacgtacatagcattttattctgacatcacaattttggagcgacgtatctctaaggcaagtattgtattcgttccaaaataaacagatctaatataagattatcataataactaaatagaaacactacgaattatgatatgtcaaaatcttatgctaagggggtgtttagatccagtagcgtaaagttttggcgtgttatatcggatatacggacacacatttaaagtattaaatgtagtctaataataaaacaaattacggaatacatttgtaaactgcgagacgaatttattaagcctaatcaattcatcattagccaatgtttactgtagcaccatattgtcaaatcatgaagtaattaggcttaaaagattcgtctcgcaaattagtcgcaatttgtgcaattagttatatttttagcatttatttaatacttcatacagatgtttaaacgttcgatatgatagggtgaaaaattttgaggtgggatttaggtggtgtttagatccaaggagtaaactttagtccctgtcatatcggatgaatttggagtattaaatatagattacttataaaactaattacataaatgagagttaattcatgtgacaaattttttaagcctaattaatctataattagcgtgtgtttaatgtagcatcacatagcctaataatggattaattaggctcaatagattcgtctcgcgaattagtccagggttatagaatgggttttattaatagtctacgtttaatatttataattagtgaccaaacatccgatgcaatagagattaaaaggttttaatcccatctaaacagggtcttaaacagggcctaagtttgtttgtcttagaatcaaatttcacatgaggatacttttgaagctgtcatatttatttacaagtgtcagcttcatatgatgatgcatgctaaatttattatcactgtattttatcaactatagtatactagtaatatgctcgtactaacgttacggtagtatttattaatgcaaatcaaacaatcaagagaattatatgttttggctatcaagcataaaatgagataggtttagttttttagaaaaataatgatattataactgttccatcttctgaaaccatgtaattcctaatgtacaactttgataatcagtgagtagacataaaagtccacaccatccatcaccatccaatgtttgatttatatctcgtttacaatagaattcattatttacaataagaagtttaccatttttcttataaatcataaataattagcaattcctattcacctcccatcaaacacattttcccttttattttgtcctgttcacatgacctggtcaccattagaaggagcaacactactatcttttttgcaaatcggcaaatccatatttctctcacctacgaaggcactggccaccttcgaccatcaacccaatggttttgtcggtgccctttctcgctgtggccaaaagtctgtcaactttatggcgcttacatcatgttgtttgattgtgctctgaagaaaaatcaaaaagatctccaattagtccaatgagtagagcaaatacatagagccctttggggaggttcttctacattgcaggagaaaatattatgtttatcctgcataatacgattgattccgcggatgcttctcaatcatgttttttaggctcagctggacaaataactaaaataaaacatttcataagaatgatatcagatgaccatagcaatgttatattgcaaatttatcttaaaaatatccaaaatttctatataatcatcttatagtgcatggcatttctcaaggatcaatctgcatgcaaacatcaaaatggagaatgttctgagtagattctctatctattaacgatgccttacagcatcttgcagtatgaggcttaatttgcatttctcaagagtagtggcaattagctccggtattgtagattgctacaaaatagaagtggctaacaatcagaagaaagaagaaacacggtaaagaaataaataccttcgggtagtcacaggaccatcattgcatgcccaaccctgaatcaggtcaatctggatatacatttgaattgaactgtcagaagagactaaccagttatgataatgcactcaacaaataataataagctaattttagttggaactgcaatcgttttcctcaaaattagtgtgcactcatcaggaattggtactttggtagtgcagacatatcatggtatcaatatcagaattagccataagttcgtatcagtatttttcaggaaagtcagggaaaagcagacaatcaataggcacactacttactccgttgaaagaaatttcagcattgttatcacaatatgacattctagttatcctgagaagctatatttataatttttgcattgcaaattattgaactgtaatgctatcttttccactcataagcagtgaaaagatatatatccaatcagcttggttaaaattctcatctcacctatatatacagaagaaaatccatcaggtttctttaaataattgtaaaataaacaaaaaacaatcatatattactcgatatcaagttgcaaattgctagagcccctgctagaatttaactgtctcaagaaacccaggacacggaggtaggggatcggcaggattgaataccaaagaggttctgcagctgctccttggcgctgaagttgcagtgcttgacgtcacacgtcaggctggaggtaattcaaccagtgcagccgacctggtcgatcatgatcccctccttctcggccatccaggtggtgaggaactgtgaatacggtcaggacgccacagtgccacacccgtcggcgcggggtgacggcagcgagacagacgccgatgcccggttataatcctatcggcaaggatgacggcgcgcgaggcgagagaggatgacggcgtcgattggccgaagcggaggcgtcgggagtcggccgtaatgcgtacgggagggcggaggatcgatcgcatgcgag

SEQ ID NO: 31460 - DNA, 13615 bp, Oryza sativa
aatgagtaaaacaacttgttgaactatagggtagatgtgatatgtaagaattgccgtgaaggcaagcaaggagcacgaatcgcgaaggggaaggaacggtggagacaggtggttgattcggctgggaagtcatctaggagtgagtctcccactagactagagtgagctggctttattgagagttgagttgttgttgttgaggaggaagtgaagaagaggcagtagaaagaagtagcagtagcagaagagaagggaggaagggaattggatagatggcggggaccggcgtgcggaggaggagtacgactacctgttcaaggtggttctcatcggcgactccggcgtcggcaagtccaacctcctctcccgtttcacccgcaacgagttctgcctcgagtccaagtccaccatcggcgtcgagttcgccacccgcaccctccatgtatgtccatctttcatctccttccttcctgcttactgtacttaccactagctctagctaccctagctgcttcgtaattcctttctcaatcaattcaattcctctttctcctcgcgcgatctaccattttctgcaagcaacccctcctctaccttagatccgatctttctcttcaaccagcaattcttttttattttgacaaatccagatcagggatccaatctgcaatcccctctctgtcgcattctgcttttttctcctgctaaaaaaaacgtgagctttgctacctagatctaccacacatgcttctgctcaaccatgatctactatcaccaatttcatcaattccacatctacctcgccactccactacttgcatcattttactccactaatttcgtttaacacacagaaaacagtttctttcttcttcttcttcttctttttttttaaaaaaaaaaaccagaggaggaactcaatacatacatacataataatatggagataggagtaacaagttgctgcagctcctgcttaaaaaataacaacagtgtgtgagcggagcgctcatccacatacatgtgggcgatgacgaggtgccagctgcgtgtgtgccttatgggatccaatggcttgattgtgatatcctgataggccataatcccaactgcgccaccacctttactactcgttcatctcactgtcacactcaattctgtacctggcttagcaactgcctgacagctactagtacctctgtccacagtaatagtttaatttccttttaacaaaagtaatactttccacagtaatattaataacctcttaaagtttctttctttctttcttgttggacctgctaggcttgacagtgtctagctgcgaggcttaagctgctaaatgctaatgacaatcagcacacacttgttatataccgaccaagaaattgaaaatggaccaacacagagaattgtgacaccatgctctatgatactttgaagatataatagtctgcagttctagtcagattgtactaaattgtacactttgggatagcaccctctaatgaacttaccatgataaagtaataaacttccagtgccatatgcgtcatgcttatttggagtttggccttcaactcatcagccagttcagattctttccaagttccaaattatggcctctcctcccaattttatcttttttggatagttactgaacactagttctctctattgaatgtaaacaaatgcattagcgttggaaaaattgaaactgatccatttgcatgaaatctttgacttgatgtaggtggagggcaagataatcaaggcgcagatctgggacaccgcaggtcaagagcgatacagagctatcaccagcgcttactaccgtggagctctaggagcagtcctggtctacgacgtgagcaagcccacaacctttgacaacatcagccggtggctcaaggagctccgcgaccacgctgatgcaaacatcagaatcatgctcgtcggcaacaagactgatctgaagcaccttcgggccgtcgcgacagacgatgcgcacaagtttgctgaggcagaagggctgtcctacattgagacttcagctcttgaggccacaaatgtggaggaggcattccagctgattctcggtgacatttacagggccatcagcaagaagcccgtggcatcagatgaaggcggggcaggtgccgctggaggtgtcaaagaagggaagacgatcaatgtcgctgccggtgatgccaatagtgaaaagaagcaatgctgctcaacttagaacgaatccttcagtttcagatgtcatttcgtgtaccttgtgtggtgcttgtgattgttctttctttttaagtttattaaagcttcgttgattcattttgtcagataaatatttaccttgctatacctgacagtcatatattacctaaagcagttaattactacatatacagtagtatcatgtcaagatcattggttcctcctgcattactcttgtccattttttcagggttgcatcagtcaacatcctgctaataagcagaaactgacaagcctccaaacaccagcaaatgacaagagtgacaagcttgcatcaagcatcatgatgttcagttccaacatcatgcatcatatatattaaatttaggcttataaactgttttaacaaaccgatgatatcacaaactgtggcaagtaacgaacactttgtgcacgcatgatgatgttgtctaatgctaaagtatcatccaatccaatgcttttttttccagccttgtgacgaaatgaatcctccaacatttggctagtgccatgacaggaacggcgtcttgttgagttcatgatgagcagcagctactgctgctgttctgctgttgaatgggctggcctctcatgtgatatggacagttggtttcctctccacggcaggttgggttgccatcctgcagaggttgcacggcaaggaaattcactagtcagtcaggtagacatagacccctcgtttgttgttgaaaggcacggaaaggaactaggagtacaaaaggtacataaactgcatcatcggcatttattattcaacatgaagagggtcctattattttcagcttatgaattatggattatcgtgggcacgtttcccaagttcctaaatggttccatttctttaaaaactttcttcaccagcatttcttagaatttttttaaatcaacatttcaactttctaatattaaatttattcatttgcaccctcaaataattgtcataaactttcatcagctataaagaagcaatattcagaatggtcatagcctaggaaatcaaatttcatggtcgagtgcaaaactggaatttcctttcaaaggatggaaaggttcatgacaaaatttgagaaagaagttcaaaattaagctagggaaaaatatgggcctccaaggctccaagggtgcaacaaatggattactcctaccttttcttgatgtctgacgacatggttaagaaagcttcctccacattgatggattcctttgcacttgtctcaagaaaagaaatccctaatgactctgcaaaagcctgcaattaaacattaacatttcagtcagttgataccatgttcagtctttagtcctgaagagcagagactgaaaatgcattcaggaagatatataccaagaacatacaaagatataggtctacaaaagaaggtacatgctacatagtggtttctggaaatattttcacaaccagggatacaatatgacaatatcctttcaataagctcaatggatactacattgatctatgtatgctaacaacagacatctctgataagttgatgacagcaacaatcagtgaatatgacattctaagtgtagcatgactgcagaaatttcctatgatttctttaaaactataaattaccttggcttcttctgtatcaacaaccttactgtcaaccaaatcacacttgttcccaactagaagcttgcatacactgtcactggcatacctatcaatctcactcaaccactgcttcacattattgaagctttccatgtctgtcacatcataaacaatctgaaaaagtattgtaagatgtattaactccatgcgtggaagtctagatcttgaaaagtagaacacaacatataatgcaaaaagaaagaaggaagaaattcaattcaataacaaccaatgtaaactgtaaacctattcagtcaatcgtaaatcattcagtactacatcgcggaagaaaaacagtacagctaaaaaaatcagtttaagattttaaagatcttataaactgcaaaaactcaataggacttacaatgattccatgagctccccggtaataactgcttgttattgtcctgaacctttcctgacctgctgtgtcccactgaaaaagaaacaacatcattataataatttgagggctgaacaaataaaggtatatttcataaagcaatgtgtgtcctgatacatcaatactcaccaaacaattaaacattaagaccataatttccaattgtttatgtatatatgtctacttggcaagcatgtgtaatctaaatctgatgtgaactgatgcagtaaatcagctgcttggcaagtacattgtcccaactctaagcttttctttagggtcccaactataagctctccctgactataactctaagctatgtggtcttaattagctagatcttgaaaacctctcctatcaactgtaccagttccctccaaaaacaaagttgctgaacagtccagttcctcaaattagtttaggggtaattgtcaatgcatgcctgcatggtaattgctccatttcctgtccattctcccttcaacaataataggaggaaaatggcaggtcaacaactcagaaagcatggacaagttgtttcattcaagaatattctgcacagatggcaaaattcttaaattttacacccatcaccatggttctatcattgtattcctctaagattacaattttggattattggaactagcaccacgttttagaatatccagagagtataaacaaagggagtaagaactgaaaacaccggtccggcgaaaaggaactgaaaaccaacttatgactcaagttttgacaggataatgctaagggaggatacaagccaagcatccctaatccatagtagattgagttccaaagtttctagaactaggcattatcatcaaaagtcatgcatcccaggcatgaattaatcgtgcaattatctaaaaaatggattggtctgaactcgcataagagaattgtctcgatgaggaatgaacttacaatctgtagcttcactgtcttcccatcgagttcaatggttcggattttctgaaaaggtgacatattcactaacaaattaacgaaatttgattcagttagatgatagcaactgcagaattcaatggttcatcaatagcaagagaagaggaagatttgtactgacgaaatcaacaccgatggtactgatgtaagtgtcgatgtacgaatcgtcctgcatgaatcaaacgaaccggaacttgtcaggacgagaagttaattaaacaccgaactgtgctactctattgaaataaagaagagaagtttccgagcgaaattaagatggaggctttcttacagcaaatcggaggaggaggcaggacttgccgacggaggagtcgccgatgaggagcagcttgaacaggtaatcgctgcatcagaaaacgcaaacaccattaatcgcagtttcacaaagaggggaaattggagacgacggccgcggggcggagagtcgggaacttactactcgatgctcatggcgtcctcttgggttgttgggtctcgacggatttggaggacgaaaaactaactagaattctaaaaaggcgaggttttttagcgaaggggaggaagagacaggtggaaggaggatcacaagaagaaggcaaccttggaaactaaccaaggaagcaaagcgaacaaaaaggttgcttcttttcttggtgcggtcgcatccgttttatcaggccataaacccaagtcaggaactcccaactcacaacaaagtgggttcggtttgccggctaaaaaggaatttttaagagtcaaaaaggactgggagcttttcattgacaggtgactaagcacagtcaatttcttcccttcagagtccaaattaaagttaggctgtcttgatttgtgactcaaaattactatatttatcttttttttatgtccatattcatgtatatttattttaggacggagaaaatactagtacaaacttgcatgatacagtatattgtgaaattttgtatgataatgtaaagtggtttggttgtggtagatcttttttacttattgctaccaatggtgtattattattagttaaagattgtaaagctggtgaaagcttgacatataaaggttttgttttcatctagtacagtagtagagtatttttttttcttttttgattgatggtgataaaaaaatcatctctcccagttgcaacttccaaatttggccggataaggccagcccacagcccaaaatagtgaagcgatggggctaaatgggccaaagaaatgaacggcaactcccaattcacttcacttcgtagtagtagtagtaggagacgacatccatggccgccgtcgccttccgcttgggacagcgcgtgcacgccgccggcgaccccgcccgcgtcggcaccgtgcgttacctcggccctgtcgacggccaccccggagactggctgggcgtcgactgggacgccggcgccggcggccgccatgacgggtcgctcgccggccgccgctacttcgttgccgccggggaacgctccgcctccttcgcgcgccccaccgcgctcagcgccgggatcacgctccccgacgccatacgcaaccgctaccgtgtcgaggaattcaccaaggaggaacaaggtccgcatccctcgattcctcggcttccaaatccaaatcttgctgctcttcattccaccagctagcttctttttcttttttttttcccattccacttattaattttttgctaaaattcatcctagtacatactttctaccttctatgcgttgtaaatagcattcgagaaatcggctacacattttttttgttgcattatacaacttaggctcaagcatccatgttggcatgtgtatatgtactagttcttgaatttgacagttgctcattgcttgagagcatgtatgggacacctcgtgttaaaatttcaaaatcatgtgctattggtgggttggcgtaagattttccagctactctgttttcttttccctgtttcaagggcagaagattttccgttgcttgtaaaagcaatatgcatacacctttttacatttataatgatacccgatataaacattttgttgtgtccagatgaaatgtatgtcttctcatcaagtcagaagcgcgtgtcagtggaattggttggcaagaacaaagttgaggaaaagctgaaaaacctcaatgatctgaccagtgcatctgtatcctacatgggagtaagctcaattgggccaggagatgaactaaagaatttggttccaagtacttactatcctttaatccttaaatcatctcttttatttgattgttttgcaacccaacgatacatgtcaagcttcctgatcttatatattggaaacgttaccttccttagagggaacacaatgtatatattttggttgggtcactggaggctctgcagctaaagcatttagttcactgcatattttggcattggaaatgagataatggaatagagtttatagtttcttaacgtatgcaaaattaaaagggtggtaacctaaagtacttcgtatttgtgtcactttttattctttgagtgtaaatttgagactcgatgtactgaccgactgtaacaacgtcggcatctacaataactgagttgaaataccttttagctgcattttcttattaaagtttcctttagcaaactaaatatgtgttcaccccacagctgggtcattttcaactacaatattctcatatttcctataaagatgacattatgtattggctcacctctagcatctaggttctgggttaagactagtcccttaggacctaattcagttgtatcaccattacataatctatttgaaaatggcatgaattctcttaggccattagtaggcactgagcattggagggatgattttactagtaaacattcattagaaatttgctggcaggactgtcatgcatacttggcctatgtttatcctgaattctgatgagtactgacaatagttttgctcgtttcagatctcagacagcttgatttaactggaaatcttctctctcagtggcaagtatgtacctcaagagactaacattatggttagcacaatttttaattagtatggatataacatacaaaacttcataaattgaaacatgcacagcaaaaggctgtatgctcttcattacaatggtgccacattgtgctgttgaacttcattactcataagcttggagtttattcaaatttatgttattttgacctagaagtaaaacttgtggtatatccctgtattggattattaatacttttcatgtgcgttggtaagctatgtaatcatcaccaaccatcttatctttttcacctctgttgaaagcacatttagcatcttttactcacttgacagtacaggtcacgatttgcttgatatcctgaactttcaattgttttgttatgttttctcacaattgatgctaatgttatgtttcttttggcatttggctgaacagttttgttctttcacaggatatattctctctgtgtgaagctctggcatcactggaaattcttgatttgacaaacaataccatggagaatgactttactgacagttcatctgtcaagaatatccgtgttttggttctcaactactgtggtgtaacatgggaactggtatgccccttggctgacacaatgaaacttctatttattgatgccaatcacagtataagttgatgtttatttatgtgaacaggttgaaaagattaaagtctcattttcatgtctcagtgaactccatctaatgacgaacaggataaaagcaatgatggttagcgtttcttcttgtccatttttttggcatgcattttatgcctactgcttcatttactgttattcatccaaagtaaaacagaaactcttcataaaagttttcccctggttaactggaaatgatccatttggaaatttgaataggtagtccttccaaatcttgcaggccaaggttttccttcttcaactttgtgtacattaagaaacagctttgaagaactaactataaactatcatgtgtccgcttatctagactccagttggaaatattgttcaaggtttcgatacactgcgactcttaaatttagaagacaatcacattgattcatgggatgaaattgtgaaactatcttacttaagaaggtacaaatgtataactgaagcttttgtcttaagttaatgttacttctgcatttcagaactgtagatattgatgtttttccttcttttttggggcagcttggaacagctccatttgaataagaacatgctaaaacatgtaacatatccatccaatcctcctccactaggatctcttggcgatgcagctgttttgccttttgaaaaactacgagttcttctcttaggtattttttgtgatctggcttcccttatctattccataacaaaatatcgaatctaagatattttctgtaatatctggcttccgttatctatttgggaaaattgatcatgcgccatgaaatgttttccataatattttctgtttaagaactgcctttaattcaagtaagttcaaaatgacttgctaatgatcactttcaaatgcctcaggatctaaccagatagatgaggtcctttctgtggattcacttaacctctttccgagtttaacagtaagcaagtttctttctaatggtttgtgtttattattctgaaatttagtattgatgttcaattccttttctatgaggtttgaacagttagaactgcaagattttgatacactgcgattcttagatttacaagaatgttatgatgtacaccacactgtatttttattagttatggcttagcacgccaatactaatatctacttttctaaaggatgtcaggctttctgataatcctgtagctgaccctgccaagggcggcgtgcctcgatttgtgcttatcgcccgactaggaaaagttaaaatactgaatggtagtgaggtatgttgagtccctggatgtttcttgagcatgtatgttgtacaaatatgttacttcatctttcttttccatatccagataagtccacgtgagcgaagggaagcagagatacggtcagttaatcccttctgtaaatttattaccttcttttatgatgtatagggcctctgtatatggctagccatccattatttacatgtgtgtttatccatgccaacggtgaatttttcttctggttttctagaaagtgttcttgcacttatctatattgtcttgcttttctcgaaggaataccacaattacgatatctgatacttttgatgcaaaaacatagatatgttcgccttgttatgggaaaagctgaatcatatgatcctgaagagatcaaacggctgcaccctaggtaaggttgtccaatttcccttctttactttttgacaccacatgaccatgatataaccaaaggatttttcactacatatgccattattttgctgcaaaggacacatgttgttacttaaatgatttcaccacatgagctgtgaccttactaactagaaaagctctacctagtcaattccagcctatatgatctcagttatacctgttattcaacaattaggattatatgtctatcttgatgtttacacgcgcttccaaatttgtgttgcttggcttcatttgctaaatttaacttccctgggactaggctgggacagatacctgatgatagtgacgcaccaattattaattggattatgcttaggcaataacgatttgtcaatgcagatttgctgagctgaaagcctttcatggtattgaggatgagaagccgagttcaaggacttctggtcctcaaaaaatggcttctgggcttataagtaataatgttgaactataattaaggcaagagagttgtatggtatgcatgcgaggaagtgattttttcttttcctccgttgcacacaggtatcaccttgaaatgcgtagggccatctatgggtgagaagcaaccattgacaaagaagctgcctcctgcaactactgtaagtacttcttgggtcctattactacttattagctgtccttttttcgtggttgagtctttgagaccagcagatagagaaaaacgattctcttttttcgtatgcacactttccgagctgctaaacggtgtgtgctttacaaaaattatttatagaaaagttgctttaaaaaatcatattaatcaatttttcaagtttgaaataattaatactcaattaatcatgtgttaatgactcacctcgtttggtgtatcttttcaatcttctcctttcctttcctctcaaacacaggttggttatgtttagctttcacatgcgagatattagtggcaacttgctgatagtgatataacatgctctcctgttttgctacgacggctaaattgcctatgatttgcatgttataggttggaaagttaaaatctttgtgcgagagcttctttaaactgaaggacgttaaactgagactgtatcttgaggaagaggtatggattatttgtgctgtgtatgatcattgctcatgtattaaaatgttgtcgagaaaggaaaaaaaaaagaaaagaagaggcagaaagctaggtagggtaaaatacttgcatgctggaacggctgggatctgatcgatttgcattttgacagggttgccctatgccgcaattcttcgaggaagacacggtttctctcatggagcttgggatcggcacgggatcgaccattatcgtggacgaagaaagctagcctaatctagtttactggcattctttgtgtgcgttttaatttgatttatttgagtaaatttggtgtgttgagctggagaaaacaaagtccctgtaacatggtacaaatgctcaagtaacttacactcggcagcttaacgccatcaaatgtgtgtgcatgtacgtgctctcgagtctcgactcgaccacattatgagtcatgacagaaagacaatcattcttgctgtttagtaccttttgagcataatggctggttatagcaacttatcttgctgtttatcttttaatcataatggcgggctggttatagtaacttttagatgtaaatctaggcatatttttttatcaagatatataattaaaagttattatattgtaagacggatggagtactattttttttcttgtttgcacaagaaaaaaaaaactggatgtagcatatgattctccaagccttttctatctgccgcgtcgctctccatccagcgatggtgaattcgtcaaatctaccccatagttcaacaaatgatttcagtcatcactcattctttcggttctcacgcaacggtctagatcgcatctacggaattgacattgtgctatcttcaggattgggtttcactagaatgccatcctaaaatatggcttcgctaaaacaccattttcaaaccagtacaacttgctggaatgccatttcttcctctcttttttttaatcaaattacatgaattttaccttgtttttcttgatgagctgaccaaaataccccctctagatttcatcccctctttcgttgctttgttcccatcacccgtgaaccaccgccccattctccttggctcctttttgtgcttgcaaaagacccaaatgttgatatcatgaaaatgaaattatctctcagttactatgatgttcctcaccatttgagaacttgtttgctgtacctgaatatattccagaagataatgagatcaacaaacaacgtttgataaatagatggatcgcggaaggattcattctcgaagaacaagggttaacagacttcatatgaagttggtgaacgctattttaactagctcatcaatagatgcttgatccaattccaaccagttggttcaaagcatggtcaagttgatggcatcattcttgatttccttgcatgcaatgcaaggcttctgaagagaattttgttaccccattcgattcaatgatgatacagagcaagggcttgtttcagacaataaggtggtcagggttggtaggcttcgttcgtgtgaataatcagaatggacagcacggctgctcttctccgtcggcgggcagctgctcttcctcgccttcactcacctcgatcgatcggcacgcggctgtgaggaagcagatgatgctccagcgcgccacctcgatcctccccgaacagccagcctctccttgttcatctgccagaacgcgcgcgcccacgagcctcctcgccgacatggctgcgccgccccttcctccattccatcgcagaagcacagccggcggacgacgacagtgtgccccgctt

SEQ ID NO: 31461 - DNA, 14893 bp, Oryza sativa
ttgtattcgtttgagagttgtattttagcgaagccacatttttcgaagatggtataatatcaattttctcgtctcgacctaccactcctgtatctctgtatacgcatcacacgcccacagtccgctccacgttctgcattgctcgtgatcttcctctcctccctttcaaccaccgccgccgaatttcctcacaaccatcatcatcgcgattgccaacgatcccccacctcgggtttgtcgtcgcggtgaccgagcccccgccaaccgtcgtgccgcgccaccctgtctcgctctagcgccattgctgattcgtcagatcgaggtctagccgccggctttgtgccgcccaagagcaggaagaacgcggggttggtgtgagggatcctcggctcgatcgaggcgcaacccgttcatgacgtgagcgctcccggccgttgggagccacgtcagccggcggcctccgccgtcgagcttttcctcgccgaccgacaccttctccctacccattggcgaatgccctggaggtttaggttgagatgggagtagaggggagtgaggtgaaagaagattgctggttggcttgtgggggccctacactgactcggccgccacgtgaacaacaacaacaattaaaagtgatcctgttaaaactcaacgacaagataagggaccttagatgaacttttttgggatatgaaaaaactccagcctcatgggcctgtgcatatgacccataccgcggcagcagagcgctgcacgacctccgcctccgcaatccgtcccgtcccgtctcctcgcctgccgatctccatctagcagaggtggcgccggcgtcctcctgctcccgccgcattcgctcgccggtgagcatcctaatccatcccatccggcctcggcctcggcctcgaatttcgtctcctcgcccgccgcttgcgccgatccccatcctgcgagcagaggtggcgcccggcgtcctccttcaattcttccaccgcatcgtcgctcgccggtgagcatcccctccctacccacaccgtacctcatcaggtattctgcgttatccctcaaaaagtttggggttcaaccgaaacagggttagatctgcctctgcccagctccacctacttccaacttgttgttaattttgatttccatttttattatagcagatgtaatttggtcatccaaacacccttagaacgaaacatgtaagctcacataatttgtgctcatccaaactcacataaatttcttaagaagaatctagaccacaaactactcatagtcacacaaaatatctttttatcaaggtatattcttataagaaattttcattccacaaaattttctaaaggacatactgtcacacttggcattaatctaatttaacttttttttctttatcaggttataaattttctaaaagacatttgtgccacttgcatgaatctaatttaacattctttctttatcaggttataaattgaaaccattgaacgtactttgtcttcccgtccctaaaacattgtgatatatctataatattttaatgtttttaattttaaaaataatttagactaataatatagatatttaaattaggtaattaataaattcaaataaactatagtttagaataaaaatgcaaaatgatatgtgccaagtacaatctaataacaataaaatgttagaaacaatattaattcaatatttttataaattttaagtacgattcatacttaaaattaaagaaaaatataaatttatatgtaagtgagaacataataaaatgtaagttaaaatcattaaaggaaaaatattattaataaacaatgatgttgatgtatttctaaatattttcacgtattatttattaaatgtcaatgagtgaaatgtatgatttaccatgcgacagattaattattaaaattgtattgttttcatccgttgcaatgcacgggcattttgctagtccacctaaattaaaccaaacaaatggagtagtatatactaagggaatggtaattatgcatatgtaacaccaatttacttgaaattttaatatccaaaaactagatagataggggttaatatgtaaaagtgcctttctccattaaattaattccactttcccacctcacctccaaaaactatcaactagatagataggggttaatatgtaaaagtgcctttccccattaaattaattctacttccccacctcacctcctcttcgattgatttgaggagataggggttaatatgtaaaagtgcctttccccattaaattaattctacttccccacctcacctcctcttcgattgatttgaggaagagattcagtcaccttttttgtcagatcttgccaggtgttgcccacacgctcgatttcgtcaactcttccgctcccatctttccaagcaaaaaaaaatctttttcgcgcaagcaatccaaatccaaacccaaaggtggagcctttcttccgatttaagccacccaccctgttcacaagcaatccaaatccaaacccaaaggtggagcctttcttccaatttaagacacccaccctgttcacccccgcttccaatccaatccctccttcgtctccttcccctacaagttgggttggatagttgcacttcacccctacaagttgggttggatagttgcacttcaccgtttcttggattgtttcatgctgcaaggccagacatttatttgttccgcgcgatttgatcataaaaagttgcaggttctggtttcttggtgcccgcaacagataggctattgcgttttgctggactcttctttttcttgaaaagtttgccaagaaaatgtcatttttcacgaggattggcgtttggccatggatacagaacaaggtcgtcgatcccctaatgcaagtagttagaaggtaagttttcccccttccatccggtgtcacatcttgggctagatctgcttaacttcttcgcgaaatggtttgttttcattttgtccttgcgttgctgacaactttcatgtaatgttgtgcaggggagctgagccgaagcaactggctttctctgctgctcttggtgtcacccttgggatctttccgatatgtggtaaggagcctctcaagcctcagcatgtcttcattgtaccagatttttctcatagtttaactgaacaaaagaagatatccaaattaactgagttaagtggccttagacagccaaggaggttatgattagatacaaatttgcgcatttaagctgtgtagtttcattgtggcttttgataagctggggcactaacttttttttattcttgaaacaatgacttcctgctccatggtcttgaagaaatagcacccaatcctttttggtaaattacagatacatgtagagtacgtgtatttaatctgttgtgaaattcgaagttcagtgttgttgcgatgcaatggtaatagtggtctgggtctagaaagattaattctggttgttatcttagaagtttggaggatccgttttatattctcgagcacttgtaaatatgatgtggagtagctaccgagttaaaaagtttcacaatatttctgtggtgatgatgctcaatcatgtctgtgtataatcctgcaagtgaaactgtcaacacttttcactgtgtggcatgaagttgtaacttgtaagcatcgtgcctgctgagctactggtaaagtggcaagcatgtcatatattcctcaaaacaacatgatgcatcttgagctttcatgattgcagggaccactgttattctttgtggagttgcaatagcaatgttgggaagtagctgcaatgctgttactgtcatggttctaaatttcgttgttactccccttgagctaaggtaaacttgtattaaattattgagaagcccattcctgttgtgctatctctttgcatgttcttttgtatatacgccaaactttgttcataacagtatggtggtcttttgcatcataaaatagtcttagacgtctgtagatgcttgatcttctatgtcaagctttgctctatgatacgaatctatgataggccaggctatctgatttcttttgagtttgtgtagcctgagttcccctgtttggtactctggtattatcttgcttacagtttgcatctttacatattataatcctcatgtgcatacactcccaaatccatttttgtgttcttataagctatttatggcttttgtaaatgcatgctgttgtcatggcttgcatctgatgccttcggtatgaatatttgaatatgttacaagttctgatgtatccatgaactgctttacttcaggtctttgcctttgcactttcatttatatgtatattttctctgtaaatgactaacggtacctagtgcaacagtgtagatttatgacccatgacaacctttgaattgatttaccactgctggtgaccttgtcattttgccagattcctcacttggtttccatgtgtttggctttgctaattcattactgattatgttttgttcagcttgattgtccctttcttgcgtttcggagaagttatcacaggcagtggacacttccctttgacttcagatgcattcaagaaggttatcactggccaggcctcaaaggatgtgatgctcagcattgtgcatgcggttagtaaacaaacttcatctattatccatctagctgatgatatggccattgctttgcctttgaggaaacactgacatgagttctactgccaatgcggatcacagatgctcgggtggctgatcgctgcaccgttcgcacttgctgcgctgtacatggttttcaccccttgtttcaagcttatggtcgacaggtttggcggcgttccgtcgagtccaaggacgccgatcaaattagtgtagccgtgatgtggagagtgatctgtccaatacaacgcttctgaagctgtatatatcaattataatttgtcatgtcctcagattgagattggtccctgccaacattttgctgggccatcctggacgcctgtatgaacaaaatctatcttcagaggcatatatgatgattcagcgtattgcattcaggcgtctgcctgggttatatttccttctaaatttgagtcaaaactgaagccttctcgtcgacctggtttagtgtttcgctcttcacagccatggtacctcattgagatgagcattcatttgctaatttgcgtttaattgtggatttgtggttcatggcaagcaattcaaaatgcttcctaggaaatctgcaacaaacctttctttactgtctctagattatgtttttgctcctcaattgatgatcacagaaagcctatgggctatggtacaatctcatggtagtatctctgtggatggaaacttgtagctgtgtcatcaacaccaacgaacaacgtggtgatcagagtacattagttaacattaacgctcatgtcaacaggaaggaaaccgacatcacatacacatcagaagagatgcacattcatcaacatgattgttcacgcagataatatggcattatgcctacagacttgtgctttgttcttgccagtttcgtcaaattcatctagtctatggaaagtcactgtagccaccagataagtaactattacaaacattcagtgtgttcaaatcttgttctaaggttacccacaatcatacgtggttctacacaaaatactatatatatatataatcattaaaattgtttggattcatctgtgtattatcccgtcgttggatcaacccaattttgcaaaggagggtcaagccttgagctgcttcactgactcgtcaacttactgattttggatgcacactagaacaatctaaattactcccaagtttcatagaaactcaagctctgcatgctggcctccaaattctcctacaaatggaaataagcaggatcagaagactaactttttttctcgaacgtacaggagagctgcgtgtcattccattaaacaaacagtacatcacaacctacattccattaaaacagacacgccacagaagaaaaaagtgacccaaggacactagagatctaaactatcccgagttcctgacccataaactctcaagatctttagctccagttggcatctacatcagaagatatttcacaatacatgctacaatggtttggttttgcagcaatgagcccaacaacggaccatgtgtggcagaaaccggcacaatatccagagaagttccaacagtcctttttcatattcactttctctatgtatcttaattggtcgaaatagtgaaacttaaacgacatggttcaggatcatctggtttccaacagtaggatctatacatgttaattctctccttgagatagactggaaaccgtgaagtttctccttaaagcgttatgttaagaagggtttgaagattattcgttctaatcaagagcacttctgcataatgacatgtggacttggcaagcaaccacaatcagtgttcacaaaatgcccatggtgttcgtaaatatatttacataacaaaagtatcatcttgtcttaaaattattatcaagtagccattcaaaacaaagatctaaatagaaagcacataccactgatattgatctgaagtcatcagagaacaaatcttgattggttgtttccaaatttcttcccttctgggcatggcgcatgttttccttttcttcgtaaaaataaaaatcatccagaattgatgttccctggtgatatgccttgaaaatcttcaacatttccagaccctggggcagcccaatctacatagaaggacaaaaggtggctggataaaaacaaatcaccattccaaatggttaaaaaaaatcaaagcatggaataacagcatttgacatcatgtagaatattcataatctgaaggggaaacctttcttcaaaggactggaaataaccctggcaccctgatatagacacctaatttaaaatagttaagtgtccatttcattttcaaagatatggaatactttttagtttctatgttcttgattgaaccaatataaaagagactacgactaaacaaattataaaagagagtattccatttctaactataagaaccctttcaaaaaaaaaagtctcagaacaaagctacaagcatggtacctcctgagtgtccctgctaaaagtaactactttgccttcattattttcaagagttatatgtttgaagaaccgatttggaatgtcctttataatgtgccacattacagggaaaaatccattccatttatcctgctgccaaaagtccatggtcttcttgaaatcaacaggacctaacatctcagctaatcctacaaactgcccactggtattaacctggaaaaaaagggatcataataaaattaactatcttgaaaattggacagatgataaaacataaaacagataataaggaattgcttcaggcacatgtagtaaccatatgataaaaatagccatacaacagacgagatatggagctgcttcaagagcttttggttgtcacatgataaaacggacttaaagaagacaaaaaatgcttcaggcatatttggtgaatggtatccagtggatcaaatcttctagagaagcccattactcaatctaatggcaggacattgtgaccaatatttcaggtaaaatcagctctttcagacggtggggattatgactgagcaagtaattctactgaaatcttaacaatacaaagatatcagaatctaatccctcctaatcaaacaagctcaaaggaaattcaatgtattgttgaaataattaaccaagtcaaaaagaaaatctggagcaggttgtctgtagaagctggatccatggctatcaatcactatagttttcttaagaatactcattcacgatgaaaactaaaatcataaaatgtccgcaagtgaagagtgaagatacaacagccaatcatctcaattcctaaatagaagacaataaactaaacacaaacaaacatgcactaaaaaaagcaccggcatgtctcacttaactatcatatttaagcatcaaacacaacaggtactaggacgccaaataatatatctcagcgttattttaggtggactttttcttaataaggatgatacttagaagaagagaatttcatccttactgaccgaaaagaataggaatatagggcaccttttgccctgctccttcattaaaatctgagcttcatgaaaagcagcatccagcttattgttaccatttggagtgcttgcccaaacattgtatttgatacctttatgaacatcatcttcgctatatgactttatcataaagaactttgcatgctcatactgaactgtgaactctggtctattaatttgatctctacagaccaaaggagggatggcattattcttgatagatgatgttgaagaattatttaatttatttgcccgggggccacgaacttgatcccttatatcctcagaatttctccataggttatccttattaatcttgtagtgatcggtgctgcttacaaccttgttagccaccctaggttttgtcatagtacgtctgcttgagataatgttgacttgctcattcctaccacccctggaaatattatctcttaaacgaccattcccataagaagcaccttgctggtagttcgacaatgggcgtgcctcagcatcatggcaccactgaccagaatgcaaggggatcttatctcggtagtgccaatggtgagacaatgatgggattttatcgccatagcattgtctgactgatgtggtttcagcactataatcccatattcttgaatatgatgatgcaacattgccattacacttcttagaagatagcgatggtatctcatcaccatagaccagccctcttggtagtgatgggcctctattatcaaagcaccattgacgtgaaattggagtgatctcatccatgtagtttgcccctttggctgtctgtttcaacaaaaaaattgtcacggtcaaatactcccgaattcaaatgatcttaattattttctactgatgccagatagagagatgtatatagaagtaacaactctattatgattaacacaatcaacagatgtacctcaaggtgttcagaagattgaccattgaagtttgagaaggcagtaaattgatcaggtcttctgtactgtttggaattatcatcttggctaagatcaactttaacttcatctcgataccttatatgaggaacatcagtaggatatgaaaggtaatttgaccttgcactgaggatgttggttttggttctcatttccccgactatatgccctgatgcatctggactatttggcactacttttaatgcagaagatttttcccaagaacagcttgaaggggaaaagtaaggctgctgcccatgatatactcttccaagtgtcctggcttccttagaatatgcatgtgatccaaggtcagtagcaaaattggactttgaaggttgttcttgataatcctgagaagggagttgtttcaaaacaaaacaaaaagaaaaaaggggtcacctgatgaacaaagctttacgtttcaatgcagtgcatgttatccataaattgcatattaacattgaaacacaattgaattaccacattgaacctggatgatggttttatttactataatatattgattacagctactaacaaaggaaaatttttcacaacttgcatcactcactgtaaatatacattgattctaatgagaagcagagcaattttagcctttggtcaaaaaatagtgatgaataaagggcatgtttcaaatcaagtgaaactttgaagtgtggctaaaaatccagcagctactcctaattaattaaaggaatataattgctgctttgcctccctgcctttgatctactacctccattttttaatagatgacgccatgactcgtcttattccaaaaaaatagtgtaaatatgctaaagtacaagtcattcttaaagttttttaatgagaaaacatgtcacaacaaaataactgacatttatataaaatttttgaataggacaaacggtcaaacatcatgtcaaaagtcaacggcatcatctataaaaaaacagagggagtaagatttaacctaggtgggtggtatgcacacctgcatgaccaaccaaccaacttggctacagtttggtccttgcttttattgttaacttcaactgaactaaaattttgaaataatgcaaacaacttgaaattctatatcaattgctgaactgattgagtgattagtacagtatattagggtgttatttctttacctacaaaacttctttattagggatgggagtgggtcaatatatgggtgcccattgagccactctaattcaagcaagctgatcaactaaaattgcttttttttttctagtttatgttgtgtatttagttgaactagtgtggatcaaataggtatccatatatttaccctgtgacccattcccatcccagtatttatgtttcagcaatatgtcccttcaaatgttcccatcaacgatagtagaacagatagttttgtaccataccaagttcaatgaacccctgtttgcatgagatagaaaatggtcagcctttgtgcatttcatcccatctcctgaagaatgagacagaaaatgggtgtcgttttcaagtttcatgacatcccctgcagaatgagacagagattttcacagaataaaacaaggtgtacaaaaaacagcctcaactagaatatatttatttggaaactgccggatgcatacatggccagtatgaagagatggaaccttgctgaataaccacgtcattcttggttgtgcttctcacagagctggaggtaacattttctgtttctggtgatgttgataacactaaggttggccaatcgaattcttcctgcatctgtcaatcacaatagaagtatgtaaatggaagaaaagaactgataataagatggttatttcttgctgttattattattcaaatattgcaactggcgaacaactacggcaaagcatcttcaaactcatcagcagaagataggttgcagtaagattattgcagagggtgatcatatttctcttagaatttcacatggaagcagctgcatgcacattttatgcaatcgctgcttctgtagatataatccgacatcaatcagtcatcagggaaaataaataaaagatcatcaggcagaatatatatgtatatataagctagcctttaaagagagatcaatcttgaatactcatttgcctagacggatcaaaattcaatgcgacatttcatcaaatatttatcaagaaagccatgtttaaataaccaaacaatatattctctagattgtgaaaaatggtttgacaaggtgactttgaacaaaatccttgcatcagctatatgttatgagaaattctccctttacttatcctctgcggaggactagctggagcagagttcctatatgtatttttctgttcaaatgggtgataatgtgggattattacatggaaaaaggaaatgtaccattggcagtaaaccctcactcattcactccaccaggccaccagtgagtgaggcagggagaacagaaagacgaatgaacaatttgataatcataatagttatgaatagtcagccatttcccacaaagggttacaacccttacttctcccagcagcagatatgtaactgattgccataattgattgaacttttatttgctcgtttaaatgagattgttgatagggcaatagaccaccgttacataatcaatctgatcaaaacataacgagggcagaaaaaggatggaaaagttatacaactcagtcccctcggtaaatcaacgctcaaccacaaaagatacaaattttatctctgaacaaggcaacattgtccgattacgccctaaatccaaacgattaaaatggtcttataggtgatcaaacctcaccagttaaaatcaggtgagcacttgcacacagttatggcccccagtgtgatacaaaaagggaatctttaacccaaaaaataaccccccaaaaaatggttcttttaccccggaattgtgggggaaatcggcagtggtacccaaaaccacgaacaggttgatcgatcttgccatcgattattagaaagaaagaaagaaagaaagaaagggcatgaaatagaagaatggagggcaggaaataatgcgataaagaagagggaatcgaaatgcaggaaggaaggaggagttcaccgtgcgcgtgcggcgaatctgatgacgaggatgaggaggaggaggagaaggaggtatcgctttgttggaccttggctcctgcacgtaccctctcccctgaatgctcgtgggaagggtaaaaaaagcttcttccgcttcctcccttcccttcccttgcaatctctctctctctctctctctctctctcttctctcttctctctctctaaggagtactaggtagtataggtataggagtagtagggcttttgcaactgcactgatgacattacatcgaatctgggccatccaatgcacaaaacaacggctcagatattgcatttaatgccaccaatcatccccccaactctcggtgcactggtacaggcctacagcttgtgccctgcgccgttggatcttgtataccgacggctcagatcaagcttgtgaggtgagtctgatttttcttttttatttttcgggtcaactctcgtatccttatcctgttctaggtttcatttcaatctctggtcttgtttagatttcaactttttttttcaaacttttaacttttccgtcacatcgttccaattttttcaaactttcaattttagcgtggaactaaacacagctcctgtaacagtctagttttttttaattagaatttgctcttgtgtgaaaaagaagttactttttatattaacacatttcaaatttagacgcttgcgcacataccattttttaaaaaataaatgggcatatattggtattgacgaagtcatcatgagaaccttaatgttgacgggtttgttgtgtaccacgtaaagaataattagccataccgtgttaagtaagacttgagtgagctagttaacctacgcctttttgtggcatgtgtaaaatatagtattttacaatctaacagtcataggcaatttttaacaattataagcgattttaaacttataagtttgcttagctgaggtcgcaacatgttttccatgtgacgggcttggttgtgtgctactgaactacttgttaacccgattgttcagaactcttaatatgatcaccgagaaaaaaaattgatgcttgtatatggatgcttttactaacatgttatgatctagctgacattggagttcttgtcagatattctaggagcagattttggtgtccttgaaatacattaatctgtaggatttttaactacatgaaaccagtttcctccttttaaaagctaatgaggtaaacacttaataatatcaactgataaattatcaatcctgcaggtgctgaagctagccctcaagtctcaaaggaaacaagtgctgaatttgttatacttcttgagctaattatcagtgctggctaactgaatttctgaatcaaaaactcatcaacatgaatttacatacatcatgcagaggcagagccagcaatgacaggtagagtacatcagtgcagttatatatatggagatgcccaattcagagctaggagccatcactcatcagtgccacttggctcttagcagcacactcacatgcatacaaggaacctgaatctgtagatggctgatgatcccatccgggccaagcagccgcatccctatccagactatatggccacaacgcctcacaacacatggaccatgcatcaaaatctggtacagaattaataatactggtgcatctatggatgttttgtggctccaaatccttcaaacggcaagtcgctttctttctttctttcttctttccctgttctgtctttcttcctaggcttaactatttgggctccatcttcttcttgccactctgaattcagcttcaggagcatagatagcaatatagcatcatggagctttctctgatcaccttcacagcaactggtgcagcagcagcattcacttcacccaagatcaagaggaggatgaggatggcaccaaccatggcatccaaacctggagccaaagtgaaggtcttactgaagatcagtactagcttctaattacatttgctcctaacttttcttcaatttttgggaagcagctggcactacatgttctctgaatctgaatgagctgtattgtgcactgcaggtctctgccggttgcaagacgtgcagaggaaagggagctgtagaatgcccaggttgcaaggtaagtatatatgatctctgcaaattaaagcaaacaagtgagctaggtatgaatgccttgattcgatgactgaaatgatcaactgatgcagggcactggaaggaacaagaagaatggcaacatattcgagagatggaagtaggtttatttatacaccattcatgactcatgcttttgctatatgttactcctacatttcttatgtctttatatcaactagcaaatgaagtagtattaaccaaccatgtagtatttatgttgtgtgattattatgtgttcaggtgcttcgattgccaagggtttgggctcaagagctgtcctagctgtggcaaggaagggctcacaccgaagcagagaggtgaaagatagaacaaattaattgacaagaacaatacagacaccctgcacttgcatgccagtatcattatggttaagcttgttttgatgtaattatctagtggtaatttcttagctatagattag

SEQ ID NO: 31462 - DNA, 430 bp, Oryza sativa
cgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggtccggtggctttaaagcatttgttgctatctaaattccatttaaggtcgtaccttatcgcccagcatcat

SEQ ID NO: 31463 - DNA, 8570 bp, Oryza sativa
ctagtgtgcaaagtagagagcccaatggagagaatccattgaatcccgggaaatgctttcctcctagcctttcgtaccacgtggggtcacgtactaagcaagccaaaggcaagaagagtaagaatcagaagagaaaagcgtcgatgcgaactgaagaagaagtacgtaagatggctattagcagcaccgaatggcctcccgcagggataactattcctagacgtcaaagaggaaataccttccgaggtgcacgacagttgacccagcacctcctaagccatggtggcagagtatctgatagtgaagggtcagatcaagtctcctcggatgatgaagatgagtctccccgacatctcggtgaggaagagatggaatcaaaggcatgcacccgttgtggagaaattggacacattgctagcaggtgtctcacactctgccctcgttgtgaagaagaccatccaccaggggagtgtcccacccgcaaggtcacatgttttctgtgcgaaggtacaaaccatgtgcccaaggattgccaactcagtgtgttgttgaccaagaccgcagaaatccaacgaacaaccctacgattgtctcgtcagctagtcagctccaacagcaacatcgacgatatcatccacagcaccaatgctcctcctgctgcgcctgactctgcaataaatcatagcaataataccttcagcaccaaccattctctgcaccgacagcctcagcaaagaattgttgtcgatggaagaagttgtgtctctccccgacctactccaggccgagcaaagggcaatcaatctcaggagggcgataccaagcagaagaccgttctctgcttcaaatagcaatcagaaggaagcttctcctgtgaatgatagcaatatgcagtcctaacacatcatcacagaaccaatcaaggatgcagtcactagaacaatgccagctatatctctccagaatcaaaatgagcagccacgtttgtggttttcagttcgctacttatcattgtgtaatcgggagtttgcagcaatcatgtaataaataaatacattcatgattataaacaatgagtttgttatgtttatggatgattcatgttgaggatgcaatgtaccgatgttaagcaccttcccttcttgtttaaggcaaggccttgtattcatgtaataagggagacatgtgtaataaaaacaagttctatgaggattatttcggaagatgctgatatgggattatgtgtataattgtttactgtcaaaggagacctagggcctcatttcagaggaactatgttctaacctcgagttaataaccaacctgatgatggaaaagaaaatcaagcgattaaccaaagagacatttgtttggactaagagtttcagatgtgtcttttttggatcaaaggcaacaaccgccagtctagcttttgacgaaccacttgaaggtttctctgaaaggcagcaggctcaagtaccacatcgtcaccagaagcatccacaactctcggagtgaaaagtacttagttgacaaaggtcgaaaggtgatcaaggtcaaaggtgtaaaggaatacgttgaatgctaactgaggacaacatgaagagaatagtgggaagtaaactgaatgtaaagaaagtgaatccgagttgcttgttcatgggagctattcccagttatgaaccaagtgatatgttcgaagatagtttacagaggtcagattaaaatcacatgtaacagcgaacccgtcgcagaacctaagccaccctctagggtagagtcgttagtcgtgtgctcctttgcttgtgtgtgtagcgcgtggtttgcatcggtgggttgtgatgtaaccatgctaggttgtttgcttaatcaacttgcagaataagtaaaacaaacagcacatcaacgagaagagttagttcctttaaggtcctgtctttagttctggtctattctttcctggcttgtttccactctcacctcaatccctgtaacagatgtttaacagagaaaaaggaaagaatgtcagcgggtatgcctcaagtaactcaagttttcaactcaatccaccactggcctcaagagagttaacaagggcacacccttggtccattccgagtatgctgcttagttcacagctaccattggttcgaagtcaagaccagaatcagtgtgtgtttgatcgagcatttgccacccaggtcaatgagcctccaatgccaaaagagcatgtccccttttgtcatgattgtagagagcaaggacactatgccctgaattgtccatgggtatatgccaaagaagccccttcctttggtttaacagggcagaaatctagatgagatcaaacaaccagcaaatgaaacgatattttagaaaaaaaaaaccagtcaccagataaatctagaaatactaaatggagtgtttttttcattggtaagtgaacacgagtttttagtggtataaaagtaaacatgtaacaaatttgatattatagaatcatatttttcctttttcccaatgtgatgcattttcatggaactttagaagtaaaaccacaaacagcaaattgaaaaggacatcttcgaaagtcaaaaccaattaattaataagtagaccttttttggtatagctgttacaccaaatcgaatcgattaatatttcctttagcttcataacaaattttcacgtgattttcacaggaccagtactcttacggcaaaatggtggtagagattacagaagtagagcaagcctcaaagagagggataccactgctagttcctgttccacccgtgaaaacatgacttgttcttgtgtttttgtaacttagggaagtttgagtcgtgtccaatgtggaaaagtttgtactacgggtataaatacatgcctagagtcgtgtattaaaaaacaacaaatcgtaatatactctcggcgcatcgcaaccttttacttatctactttttcgataggtttttgcttcgaatcaaggcatcgagtacaattttttgacaagaagcatgacttgtctcaacggtttaagttggcaaattagggcctcgctttagatgttctattttatcttatacacccgctggttaccatatatcttaggttattctacctggattattcgatttagttatatcggtgttaacagcaaaatttggcaagatactcagggtcgaggaacaaatcgaggcggatttggcatgggaaggagttgtttccaaatctgggtgcgcatcggctaaaggctatcactggtggagaaaccatcttttgtcggttggccgaattccacaatagtcccgaatgcaataaaaactggggctaaaaatgatctttagtcccggttcaaaagggtaacgggcatatttgatctttagtcccgggtggtggactaaagatgatctttagtcccggttcaaatgctgtcagggcatgtcaggcccccctgggatcaccaaccgggactaaagatcgtaactttagtcccagttggtaataccaaccgggactaaagatcccggggatctttagcctcggttggtaacaccaaccgggactaaagtcccaccccctatatatatgtcttcctcctcctccagctgcccgagcaagcttcaaaatttcttcaaaaaagaggagaggtcatgccaaaatttctagtgaatttattttggtgattacatacaaatcggaggtgcctaaaaggtttgcaacttcatcctccaatgttttttttttgtcatattacatttgcagcaatattttgcacacttttttgtctccaaaatttagttgtaagttgatgagagagaaaatttgtgtggggaagaaagaatatatagaaatttagttcatttgctaaagaaggttttataaaatagttgagaaggaaaactctagtgaaaattaatcttaaataatagaaaacaaattaaaatgaaaattaaaagaagtaaaacacattaaaattagtttaaaactttagaaatagtaaataagaattattttgtgtaatattttatgatttttgtatgaataaagatatgtcattattgtatgactgttgaaacagtttgtaattatcttataattattgtatgactgtcattattgtaggaataattatttgcgtacggttttttttgactcatgtagatggatcgacaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatacaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccaaggaggtctgcgaaagtgaaaaggaggcccataaattggacaagatgttggaggaccacagaacttcgttgtacccaggttgcgagcaggggcacaaaaagttggataccactctggagttcttgcaatggaaggcaaaaaatggggttagtgacaaggcatttggcgatttattgaaactcgtcaagaacattcttccggagggaaacaaattgcccgagacaacgtacgaggctaagaagatagtctgcctgctaggactggaagttcagaagattcacgcatgtccgaatgattgtatcctatatcgcggtgaggagtatgagaacctagaagcatgccatgtttgcaaagcactacgatacaagattagacgagacgatccaggaaaagttgacgggtagctaacaaagaagagaattcctgctatggtgatgtggtatttcccaataataccacagctaaggcgtttgttcaggaacaaggggaatgctagaatgatgcggtggcacactgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccccctggttatgcatgaagaggaagtacataatgatgtcgattattattcaaggccccaagcaacctggtaacgacatcgatgtgtacctaagaccactggtcgaagatcttaaactgttgtggaagaaggaaggtgtccccgtgtgggacgaggacaaacaggaggagtttaacctatgagcactgctgttcgtaaccatcaacgattggcctgcactcactgcatggatgaaacagaaagtacgtatcttaagcactgtaggaaggttgtatacatgggtcatcgtcgattccttgcagcaaaccacccagtacggaagaaaggcaagcacttcgaacataaggccgaccaccgtacgaagcctaaacatcgcagcgggaaaacagtgttcggaaaggggcctggaagccagcctatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcaaaagatacactggaagcacgtaatgatctaaagcatatggaacaacgaggcgaccttcacccggaaccaaaggagaaaggaagtcattacttgagtgcagccagctacactcttagccaggcagaaaaggaaagcaggttgggatgctggaagagcataaaggtaccatctagatactccacgaatatcaagcgaataataagcacgaaggagaagaagttcacaaacctaaagtctcatgactatcacgtgttgatgacacaactgctaccagttgtaataaggggtatacttccagacaatgtccgggcaacaataacaaagctatgtgcattcatgaacgcaatttcacagaaggtcatcgatccggatagattagaagcccttcaaaatgaagtggtgcaatgtctcgtcagttttgagttgatatttccaccttcatttttcaatatagtgacgcatctgctttgtcaccttgtgaaagaaatcagtattctcgggcctgtgtatctacacaacatgtttcctttcgagaggtacatgggcgttctgaagaagtatgttcgtaaccatgctcgtccagaggcaagcatcgccaagggttatggaacagaggaggccatcgaattttgcatagaatttatcgaagaccttcgcccaatcggggtacctgaatcacgccatgaggggagactaccgggaaagggaactctcggaaggaaagcaataatgacggtagacaacaatttattccgcaaagcccatttcactattctgcaacactcttcattggtagctccttacaacgaggagcacttggctctagttcgcgccaggaacatcggtaagtccgatgcatggattacacggcatcacattgatactttccccgcgtggctacgacaatatctcatgggcaacgagtcgatcaaccaacaacttgccttcctggcgaggggaccgtctgggtcgatcgcaacattctagggatatcagatcaatgggtacatattctacacgagagcccaagacatgaagagcacgaaccaaaacagcgctgttcgtgtcgatgccatgggacacgatggaacaactgccacgtattacggtgctatcgaggacatatgggaatttgactatggtcctctcaaggttcctctgttccggtgccaatgggttaggttgactggtggaggcgtaatgattgatgacagtgggatggcaactgttgaccttaacaaggttggatactcggacgaaccttttgtccttgccaatgatgtaacgcaagtctttttcgtgaaggacatgtctagcaaaggaaagaagggcaaagggcctgacgagcctaagcgtcaagtggttctcccaggcaaaagaaaaatcgtcggagttgaggacaacactgacgaggattacgatcagttggatgggcaaccccctttcacggtgacgattgaccctagcatcctcctatcaattgaagacaccccttactcatatagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggttttaacaagtttaaatcatgtatatgctagttatatgtgatacttacaatttttaaaagttttaaatcacgcaggtggcaatttcatatatatgttcattagagtttttaacatttaatttactatcattcatatgctaattataattgactagagaatttttaaaagttttaaatcacgcaagtggcaatttcatatgttaattagagtttttaacatttaatttactatcattcatatgctaattataattgactagagaatttttaaaagttttaaatcattcatgtggcatttacagatgttaattagagtttttcacaatttaatttactatcattcatatgctaattatatatgactattcgaatttttaaaagttttaaatcatgccaggcatttacatatgttaattagagtttttaacatttaatttaatataattcctatgctaagtatatatgatgattacaatttttattaattttaaatcatgcagtatgtacatacatatgttaattagagtttttaccaatttaataatatcattcatatgctaagtatatatgattattggaatttttattaattttaagtcatatatttgcttattaagatttatccacttaatttattacagaccaaaataatttttctaaggaattgtcattaatctttgtactttaaataattgtaatgcattatcttctattttagaaacacatatgtaagggaaaataatatgcagggctataaccagtagtcccggttcttaaccctaaccgggtttaaaaagaatttggaaatagcgggaaaagatcattagtccccgctaatgagaacaaccgggagtaaagatctctttagccccgggggtactcccgggtggtgagaacaatcgggaggaaaaaactttcctttaggcccgggtgttttcaacaagcgggactaaagatatctttagtcccggttgttctcatcaaccaggactaaagatccgggggtatatatattcccggtgggccctcgtcttctccaccaacactta

SEQ ID NO: 31464 - DNA, 5029 bp, Oryza sativa
ccgagaacgtgaacgggaacgagaacgatcgaacgaacgtgaacgagaaggagaacgagcgaacgaacgtgaacgtgaatgagaatgagcgaacaaatgtgaacgagaacgtgaacgagtgaacgaacttgaacgcgaacgagcgaacaagaacgagggaacgaacgtgaacgtgaaccagaacgagggaacgaacgtgaatgagaacgatcgaatgaagacaaacgagaacgagggaacgaacgtgaatgagggaacgtgaacgagcgaacgaacgagaaggagcgaacgaacgtgaatgagaacaaacgaacgaacgtgaatgagaacgagcgaacgaacgtgaacgagggaacgtgaacgagcgaatgaacgtgaacgaacgtgaacgtgaaatgcaatatatatatgttacttcgcgtttatcctaatacatctttttgtatcttgcagaaaagacgtgttgtcggagtcgtccctcaagccggagtggaagagctagccctagaaggaattcgtgcaggcaagtgacgtaataatataaatgattgttatatttgtaatgcaattaagattattatatttgtaattagacttagcatataagattgtgtagtgttctaatattatttgagttttaatataagattattttatttgtaattagacttagtatataattattgactatgaattggtgcgactcctagcaattgactattttagtgttaattagacttagcatatacgacagttacacttagcatacatgactattttagtcttagcatgtaatattatttgagttttaatataagattattttatttgtagttagacttagtatataattattgactacggaattggcttgtgcgactcctagcaattgactattttagtcttaattagacttagcatatacgaaagttacactgagcatacatgactattttagtcttagcatgtaatattatttgagttttaatataagattattttatttgtaattagacttagtatataattattgactagctagggtcgtataatatacgtcacctagacttagcttatatcatgatttgtaattagacttagcacgtaaggttgtgtagggttctaatgtacgacagttacacttagcatacatgacttagattgttaaaacataaatgtctcatgacttagcagatgtttcttgtatcaacagatggctgaccgcgatgagtaacagatattatacggtacaatcgcgaagggaagcagccagtactagaatgaagaagagtggaacgaggatccaaaccagtacttgaatgaggaagggaacgtggagagggatgcggaggggaaccagcaggggcacgtggaaagggatgtggaggggaaccaggaggaggaggctagtggaagtcaaccctccgttggacagaagagggcacgcgggcaacgaggtgcagcgaagaagcttgagggtcggcacatcataacggaagtggaagaagatggacgtcctagtgccccggccgaagctgccaagaactatgtacgtcacagcggttgggttgtgcgggataacgtgcctatcagtacggtgtactggcgaagaacaagggcacgcggagatcatgagagctttgtcctagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatcctgaaggggcagacaccgaacttcgacacattcccaaagctaagggatcactgggacgagttcgttgtatataagacaggtgaacaagggcaggtgatgatggaaagaaacaaagaaaatgccgccaagaagaagtaccatcaccacttggggtcaggaggctatagcgtcgcgatgccgaagtgggaggagatggaggctagcttgcttgagaggggtatcgaaccggcaactgctaattggccgaaacgatcgaagttctggtactatgctcacggtggaacgctcaacccagctgatggctcactggtcttcggcgatcagatacgagaggctgcgcgacgactaacagatgtagtggaagcctcctcacagggcacattccaaccggacagagatagggacgagctgacactcgccctacagactccagagcatctaggacgaacacgagggaaaggggtgattccttggaagattggtttcaaggaggacatccagacgtacaggagtcggatgaggagcaagagagataccgaggcgaagattgcagatttagagtcctgggtatcgagctatgagctcaacatgcaagaggaggtggcaaggaaggttgatgaacgcatggccgcacatcggtcccatgatccccagccgaccattcctcctgcaatgttgagcccgtcaggaaaccatagcagctacgcctcaacggggcaagtaggatcacagagcatggacgccatgcaaacccaggatgaatcgacctgtcctgttgatgacatcactcagcggacaccatgtgagctgtatattcctttcaagaacttatcaataaaggtaagctcgtagtttatatattttagatttggccattccgctagttgctgcttatatatgttgattactaataaataatctctcacgacatgaaggtggcgtcgggcatggccatcccaacggacccttcaggtacttaccactgcaggccgattccagcaggatactcgaaggtcgaagttgagttggtcgaaggagcgtacgaggacctcgagctagattaccctggaggagacggtgagacgcatctacgagacacaagccatgccattattctatggcacaggcggtacatcatcctccctgggcgacaagcggcgtctcatggaccatctcctccggctccgccatctcctcctcaggatcctgcaccgtctcctcctcatgctccgccagcaccgtctccacttcaggctccagcaccgactgctcctcaggctcctgcaccgactcctcctcgggctcctacacctactcctccgcaagctcctcttccggcaccttcaaagtcaagggccccctccagctccaccgcctgcccacacaagggcaacaaagaaggcgaaagttgacgccgccaagaacaaggacccggggtacgattgcacgcaagaggagcttgacgtttacgtggcatcagaagtcaagagacaattcaagcctcgaagtccagaaaagaagattcctatagacccgagtgtcaggaacttcttcaggggtatgtctgcacctgtcaaggaggccatcaagctatcggactatgagcgaacgctgaagaaagcatcttctggaaagtccaaaccagtccctcagcttggagagcaaccaaaccatgatatcgagccgttggtgaccggggaagacatgacgatagaagaatttattactgacaccggtctaactacggatcaattgctaggagtcgaaccaatagaaaaggcggaagtgaaatacatgtacaaactcggcaaaccgcttgtcaagcccgagctggtgcagtccctacccacacaaatgtacaagttccatcagctgtacatggagatgagcgccaccggtagagagatgatcggagcgaggatcagggacccggacttcttgcaaggagatgacattctctggatcaatttcaagggaatctacgaactataccagctggacgccctcgacgtctctattatgagttgctggattttgtaagtatatcgttcagttagatttcttaattactacgtctcctttaattaattaggtccttgtatataagtagactatataaaataaaatactcccttttatcgttgtagaatggagattcaaagggcctgacggcggagggttttcgatactggattcatcgaccctcggaaagtaaacgtcgcaatgctcgaccaatatccgcaagacatagaggacaatctcgtccatctccttcaggcgcagcattacaagacgttcatactgttgccgtacaacacagagttagtttaattttactatcttcctatataccaaatttcattcctgtacgaacttgctaagtgtttcatatgtaatgcatcccacgcacattgcagattccactgggtgcttttactcttcgacctgtcggcctgcaccgtcaacgtatatgactcaatggataaaaaagagtctacgtttgacaaggttttcgaacttatagacaggtactgttataagttcctctgttaattaagaaattcttgttatgttaattgctactatgaatcatatctttaaactccatgtagggcttggtatcagttccgtcatttggtccgcggcaactggagagaaagacttaagcggaagttcaaatttcctgtgggtaaacatgctctacatttatatttctccgattcaaattaatacatacaagtgtatattaattagatctcacgccgttaatttgtcatttatttgtagtgcgcaaagcaaaagcagggaactaacttgtgcggctactacgtgtgcgagtattgccactgccttgtagaccaaatcatcaccacaagagagctcgatgtacgtacaaataaattcaaaatttcattacgtaacgatttcttgtttaattactaatcaatttcatacattcatatagtttattcgcatgagggataacctgaccacacacaaggaatttatcgcggcggttcaagaacaactcatgggattcatcaacgaagaaatctttgatcccaagggtgaattttaatacgacggaaacacaattcataggtcttagcttatgagctagtgaatactaatacgtagaaatcgtagctagctaggacatataatggatagttattaatacatgactacatatgtttctataagcatgtgtaaacattttctataatgtaaata

SEQ ID NO: 31465 - DNA, 1187 bp, Oryza sativa
atatatatatgtataaatccatatatattatgcatgtacatatgtactgaagcatatatccatataataatatatatatatatatatatatatatataggcatatatatgtattggaacatatatatgcatggtttatatatatatatatataaaccatgcagcaacagggccatgcaaaaaaaaaaaggccagctctatctttagtcccggttggtaacaccaaccgggactaaagatggctcagccggccacgtggctgagccattaccaaccggaactaaagatcgatctttagtcccggatatttcacccaggactaaagatagcgatctttagtcccggattggtagtcccggtttagaaaccgggactaaagggggttacaaaccgggactactacaaagggtttctccaccagtgtatactggcctaaacagaatcggattcagccagccgatacaagtaggttaggcgatacatatatttttgagtttaagttgggttcgtatggaagacttggaaataattgccatacaaggatagatccattacaggtatttgtatatattaattaggaatatttatgagtcatgttagttagagattttggtaagggcccgccataggggattgtccaagtgttttgtaacttagggaattttgagtcgtgttcaatatgaacaagtttgtactacaagtataaatacatgcctagggtcttatagaaaaaaccaacaatagctcaatatactctcggcacatgccaactttttttacttttctactttttcgatgagtttttgctttaagttgggcatcggcttcgattttccagcaagaggtatggcttttcccaccggcatgcatagtccggatataggacgtcttattaaatctcttactacatcatcacaaatcatatgtatgtgacagctcaattgatttaaggggcaattgcacctatgccccactttcacagccaattgctgttttaccctcagtttttagggtttacagttttacccccactttttgaatctgaatcaaccgtgtagcccactcctaacagccggttttaacggtgttagttgtaaaaaaaggacatttaaacccttggtgggtaatgcatttttgccctttttttcagctttgggggaatttgccctaatttgtgaattccggttg

SEQ ID NO: 31466 - DNA, 589 bp, Oryza sativa
  unsure (1)..(589): unsure at all n locations
ctcctcaccgagccaccagttttagcctcaccacacccgcaggagccgttgttactatatgtatcagccacctcncaggttgtgagcacagtattggtcgttgagcgtgaggaagaaagccacgtccagaaagtccagcgaccgatctactttgtcagcgaggttctagccgactccaaaacaagatatcctcaggttcagaagctgttatatggtattctgattactacagcaggaaattatctcactacttccaaggtcacttggtaacggtggtcacatcgtttccgctcggcgatatactgcacaaccgcgaagcaaacggacggattgctaaatgggctttggagttgatgtctttggacatatccttcaagccccgaacttcaatcaagtcccaagcattagccgacttcgtcgccgaatggaccgagtgccaggaggatatccccgcagaaaagatggagcactggaccatgcattttgacgggtcaaaaaggctttcgggcactggagcggaagtggttttaatttccccagctggagaaagattaagttatgtgctttggatacatttttccgcatccca

SEQ ID NO: 31467 - DNA, 1568 bp, Oryza sativa
gactcattcatgtctccacacccaggttatgccccagtcccctagattgaaatatgacaacaaacatttgctatgggcggggggtccgcttcgaaaaagctgtcagcctgccccgctttggaagagcttcggaacagtttttccctagttaggtaacccggttttgacaccatggcccctatgaatcatcaagctgcagcttcgctaccaggttatttacaaaatgaaagaagaaaatacgaaagaaaagcgtccattgtctaatggataggacagaggtcttctaaacctttggtataggttcaaatcctattggacgcaatcttatttctatctattctttaaataactatactaaaaactaagaaaactttttgcatgattcaaatgaaaaatctttctcaacgatttctcctctactaacaagagtagacatgcaaaattgttgtttgttcctgaagggaaaaccgttcgagctgttcctgaatagcttccttcaaaaggatttccgcttcctcggtgaatgtcttgctagaagatagaatttcttggaattgaggtttggtatcttttaggtgtttacgtagctcatccagacatttctttacctgtccaatttctaaggaatcaagatatcctctcgttccggtataaatagtagctatctgctcttccactgggagagggtttgattgggattgtttaagcaattctcgtaatcgtcgaccccttgccaattgattctgacttgttttatcgagagcagaggcgaattgtgcaaaggcttgtaactctgcgaattgagctaattccaatttagatttgccagctacttgtttcatggctttaatttgagccgcggatcctactctggaaacagaaatacccacattaatagcaggtcgaattccagcattgaatagatctgcggataagaatatttgcccatctgtaatggagattacattagtaggaatatagtcgaaaacgtctccagattgagtctcaactattggtacatcggtcatactttcttcccctaaaagagaattgaatttagcggctctttctaaaaggcgtgaatgcaaataaaaaacatcccctgggtaagcttcgcagccggggggtcttcttcatagaagggacatttgacgataagcttgtgcttgtttggagagatcatcataaattattaaagtatgccggtacataaaatactcagacagggccgtataaggagcgaggtattgtaatgtagcaggggaatccgccatctcagctactacaatagtgtcttccatggccccctatttttcttcttgatcccaactcactactaagcaagttcgaacgaaatgcatatatattatctctcatatcagatgtgagtccccgcctaacatacactgacttatcgaggttcacactgtctcgcgggtaaagcaataaactctcttttccaggtcagtcaccaatcattccaaacgtggcaggaattggacaaaccgaggcccggaatgtaacccttctaccaatagtgtgagagcactattcctccaaactctata

SEQ ID NO: 31468 - DNA, 382 bp, Oryza sativa
gacatatatcgcaggctgactgggacacgtttgttgcggatcgtacaacagctaaagcattggctttgaggaaaaaaatgtccgagctcgcgaagaagaacaaatatccccatagattggggtcgagcggatacgctggtcacgtcgatcaatggcgggagatcgagcaaagatttgccgcggccggtaagcccctgctggtagaccccatggttgaacgtagcaagaactgggtttgggcgcgcagcacaggtcaagtctcggatgagggagacatactattcgagactccagacatagaagaagtgactactaatttgcagcagatagtcgagaaagaaagatcaggacagttcgtcccacggagggagagagatcagct

SEQ ID NO: 31469 - DNA, 9723 bp, Oryza sativa
  unsure (1)..(9723): unsure at all n locations
atgcgaaaatagatcttcgcatgcggtccatataagaagccgcatgcgaagatatattttcccatgcggtcgacctaataagaccgcatgcgaagatctattttcgcatgcgggcgtcttaagtagaccgcatgcgaaattcaatttccgaatagctaaaataatatttattctagcattttggtgattcgtaattaatattaaattattgagggatttattatcgtatttcggagtagtaagcatataagataagacaagtgccgcagtaacaaacatgtaatacataaccattaattcaattgtaatttacatacaaatatataatacaagtggcacagttttttcatcatatgtataagtagtgtacatgttattgcatatgttctttctcccactctctgagaggtttaaatttgtcgtccattgcgagttcactctggttgtcgtagaagagacctcttgcgttgcagacatcgcgacggatgaatcggcagaggtcagcggccacgttcaagatagtagtgtggttgaatcgttgtgcaatatatgggatttcggggatctgcacacagaaaggaaaataaaacggtactcagtgagaagtgtgtgcgagatgggtttctttgtagagaagagttcgatgacctactcggttactggttgttttgtacctcccatttactctgagcatctcgcacacgtaataagcacacaagttggttcctggtggttgtttgtagcactgcgatataattatggggaccgatctcagtagatatatttagtatatatgtactattcgataattagttgtattggtataaatttgatagtaccggccagccagtcctgacggataacttcttctgggatggaatatgtactggtccacctcttttgcggtagtacttgtgtgctctgtttgaaggaaacaattgttttattagtagttagaagactggtgatcgacctaaacaatttatagtaatgaaatgtttatcacttacaaattcaaaatagtgaggaattccataaatgtctccttgtcatagtgtgcggggtccaatgatatgatcaattggtctttcggatatacaaggaataatatgtagtggtctctacatataagataggcttattggagacagaaaattccgaagaagataaattaattaaacaaaaagaagagagagcttacgtgaactggtaggggaccattaagacatctttgtcggcgtgcgccaacattgctattgccaagtatgttgctacttctagcttcttcctcttgtgcaatgtcttcacatattcttccttttcttccggggtcttgccaaccaattgctcgcagtcctgtctcagctctacggtgtgttgtgttttgcatattcttgttggatcgacgtatccaacctttgctccagttctatcagcttcgtggaattgcatactgtacaatgaataaagaagaaatgagatttggtttatttgtttcgaatgaaacgtgcaacatgtaataaagagtttagacttacagacagaaagccgcaacgagattaacgtccattttatctagcttgtagagggcgtaaaggtcttggaaagagataaaaaatatcccattaggaccactcatgaaagcgccttccgggacggcgacgcttatgaaaccgagacctttcctagatgccttcatataccattcgtgcattaccctcatttcccatggtagcttgttcataagataagttggcaagaatggcttgccatactcataagtttcaggcacatcggcagataaccaggattgcacttcatcttgggccgctagtactgacttctgggagtctgacaagacgtgagatactgacttctgggagtctgacaagacgtgagcaagttcttttctcttctcagaattcctgaaagctgaaaacatgaacttctccttatccttgtcaatctcctttgggtcgtatgtcgatatcaactttggaattatacgacgaggttccaaagtattagactttggttcggatgtagtaccatctggtatgtgcacttcttctaccagagcagattggggtgtaggtggagaggtttgaactgagggcggagccgggggagcatgctgtttagttggggaggtgggagaggcttgaactggttgcggggtcggaaaaggcggttgttgaaaaggggagggtggtggtgtaggttggcaaggcggtgacctaagcggtggtggtgacggcggatgtcaaggtgacggtggttcaggaggcgacggtggtgcaggagcggcagcagtcattgcctgcgatgaggatggggttgaagatcctgctgcaagaacggccgcgctcaggaatatgtctctgcggtgccacaagataaactgattcactgcatcaccgagaagttcaatcccctcaggtgcaggtatgtctagttccaaggaaacgtggtcgctatggaccttggcgacctgtacccttgcgtaatcctcagggattgccgtgttgtggaattgacgtccgggtatcgctaaacccgttgcaacctccttagtctttccagcgcggccgattggtacgacgagactgcacggagttggtccagttatactatccacagggaaggtacttgtctgcactgagcctacactgctgggtacattagttgtttgctgtgcggattgtgtgggttgctggctatcagggaataaccttggaaatgctgtcgggttttcagctgccaacgagtagaagtgttccttcacttgcgcatagatcttgtccgatagttgttctttgtatttgtctctcttcttataacttggtgcgtcttgtggaaacccgaccttccaacttgtctttgaggacaaaccccttacacgtccagagtgttcagccgtccccaacgccgcagtaagctgatctctctccctccgtgggacgaactgtcctgatctttctttctcgactatctgctgcaaattagtagtcacttcttctatgtctggagtctcgaatagtatgtctccctcatccgagacttgacctgtgctgcgcgcccaaacccagttcttgttacgttcaaccatggggtctaccagcagggcttagcccggccgcgggaaatctttgctcgatctcccgccattgatcgacgtgaccagcgtatccgctcgaccccaatctatggggatatttgttcttcttcgcgagctcggacatttttttcctcaaagccaatgcttcagctgttgtacgatccgcaacaaacgtgtcccagtcagcctgcgatatatgtccataatccgtaaacggtgggagattcttctgaacataatcccgatttagatcggacttccactgtcgccatcgatctcccatctttttaagtgcgtaatctctccccctaacctctgatccaggagggaacacaaaatacttctgcaactcattccagagaagtgtcttgatgttgtcgtccactgtttcccacaacttgacattaatgggacaacgcgtcctgactagagtgccacaggcgttgctgaacttggaccgcactatcggtggctcgatgggcttcccatcctgatcgagagcaatcacgttgtaagtttccttgggtaatttattcttgcttctctcaccacgtctttttttcccactcccgcctgcacttgtagatgtctccgtacgttcaggtgcagacgtagcggtgtccatctcaacttcttgctctgtcctgttcctcccggctttacgtttcgagcggcgtcggactaccatctgcacagaataggtaactctatacaccattaggttcatgtcacatcatagttagggaataatacatggctaacgattttcatcacttacggcctgttcgataggtatgtagtccggatcatcatcgcggggggcgacttgtgttatttccattggaaacgggtcacttggtgtgcgccacgtttcttcactagaagcgcctggatgcttattgctaccggaattttgaggagcgttaccttcttgaggcgctattggtgcgttcgatggaaccttttcgttcgacatcttccaacttgacgtaaaaaaatttgacataagtcccaatttaacgcaatttgacataagtctcaatttgacataagtcccaatttaacataagtccgaattatacataaatctcaatttaacataagtcccaattatacataaatctcaaattaacataggtcccattttagcataagtcacaattaaacagaaatctccatttgacataggtgccaatttaacataagtcacaattatacataaatctcagtttaacaaaaatcacaattatacataaatcccaatataacataagtctcaacttaaacataagtcacattttaacatagctgccaatttaacaaaagtcccaattatacataaatctcaatttaacaaagtcccaattatacataaatcccaatttaacataagtcccaatttaaacataagtcccaatttaaacataaatctccatttaacaatccacaattaaacattctcaaaattatacaatccacaattgcacatatcacaatccacgatgcacaattaaacaatccacaatccacaattgcacatttcacatttctttttttaaaagtaaatgttaccgagcgacggcggggacgacctggcggcggcgacgacctggcggcggcgatggcaacggcgaggggggagaggtccgtgcggcggcgacggcgacctggcggcggcgacggcgacggcgaggggggagaggtcctggcagtggcgtcggcgacggcgaggggcggggcgacttcggggaggagccggcggtagcggggacgacttggcggcggggacgacctggcggcggcgatggcaacggcgaggggggagagttccgtgcggtggcgacggcgacctgccggcggcgacggcgacggcgaggggggagaggtcctggcggcagcgacggcaacggcgaggggggagaggtcctggcggcggcgacggcaacggcgaggggggagaggttctgacngcggcggcggcggcggcgtgggcggggcgactttggggagaagccggcggtggcggggacgacggcgatggcgacttgggaaattttggcagcctggcggttagggtttcgcgggagccgggacttagaaaattttggctccccgcgctccctatatataggcacagatcatcacatgcggnnggctttactgnnccgcatggcagnactcttttnnnnnnnnnngtgttaagccggccgcatgcgaaaaagatctttccatgcgggctgttaagccggccgcatgcgaaaaagatctttccatgcgggctgttaagccagcccgcatgcgaaaaagatctttccatgcgggctgttaagccagccgcatagaaagatctttttaccaaaaaaactcatatttttttttctctataagtaaactgtccatatatatttttttcccaatatttcgccacaattatacattccaaatgtttttggcactaagaaaactcatgaaaattgctcaaaactcgtaatcaaatgttacatgctaatgattacaacataagggggacctaaattcatgcacgtacatttgctaatgattacaacataagggggacctaaattcatgcacgtacatttggaatacaatgagaactaaaggttacgaaataactatgacttaataaccttggcaacaccatctgctcgaacgtacgacatatttgcttcatcgattgttctctcaaccttcttaattcgcataggaagatcagtaaacaatggtacatcgtcgaactggttgtaatcattggggtcttcgatgttgtcgatgccgacgatctgttgctttccggatatgacaatagtttttctttcatctgaagggtccttcacataaaacacctgagccacacgctctgctaaaacccatggatcatccttgtggcctgttttactgtgatcgactatcgttagcccgtagtcatcaacggaaacccctattgtgtctttaacccattcacaacggagcacatggatctggatgtttaggccatagtccagttcccatatttcttgaatggtcccataatacgacctcttttctccactcgtgtcaatcgcttcgacacggatcccactgttttgtgatgtgcttttcatgtccttcgtagtcgtactcaaggtaaatccattgatgtcgtaaccttgccatgaattgacaatacttgaaggcccacatgccaatctttgtaaagtaagttcctccacagaatcaccaactggcaggtttagatctttcaaccacagaggaaagcgacgcttgtgctctcttgatatccaatcattggaccgccctgggaagcaggctttgatttcttctaggtgtcgctcaatgaatggctcaacgatagcgagctgttgaagaacgctgttgtgtgccgcggacacctttttgtaatcattatcgaagaactgcttcctaccaacagtaccccttccagacaatctaccttcatgtcgatgaacaggaatgccaatggcattagcatcctttatgtagtccatacaacactcgactgcctcttcagttgtgtatccctctatcattgatccttccgggtgagcgcgattgcgtacatagcctttgaggatcgacatgtaacgctcataggcccacatctgatgtaagtataatggaccaagttcaataatctgagggacgatgtgaacgatcaaatgctccatcatatctaaaaatgatggtgggaaatacatctcaagctggcatacagtctcgacggcaaatgtctgaagcggacctaattccaaaggatcaaatactttttgcgaaattcgattgaaaaagtagcacaactttgttataaccacctttgtatggactggtttgactgcccttatagcaattggtaggaacactgttagcaacctatgacagtcatgcgcattgtatcccgaaatggacaaatcctttattgatactagcttcctgatgttcgatgcgaaaccagtaggcactctaaccccttgtaaacatttacagaaggcttttttctcatcaagtgtcaacgagtaacaagcaggaggaatctcggtcttcccatttggcagcagtactgggtgaaggtcatgccgtatggacaaatctacaaggtcgttacgtgacttcaatccatccttcgttttactcgggatgtccagcaatgtgccaacggtgctatcaaacacgttcttctcgaggtgcataacatcaattgcatgtcgaatctctaggtccttccagtaatctaagtatttaaagaaaattgagtgcttcttgaaaggcgacgcagtaccgttgtcaccatcagctttcttcctctttactgtcttcttctttccctttccatatacaaccttaatcttctttgttatctcatacacgtatgtaccacctcttgctactggggcagtgtcattctccactgtattatcgaacaatctagccatcttacggtacctatgtctttgtggtaggaaccgtcgatgtcgcatgtacactgtcttcaaagacgacgtcaggtatttgtatgaagttttctccagacatatcagacatccagtcttccctttaatctgcccagataatgaaaagtttgcaggtaggtcattgatggtaacgaatatgattgcacgtagattgaagtgctcccgcttaaactcatcccatagttgtaacccctctttccaaagctcctccatgtcctccatcaaaggctcaaggaaaacatctatgtcgattccaggttggtttggaccttgtatgaggatagtgagtagaatgtactttcgtttctgacatatccatgttggaagattatacattgtgagaaggactggccatgtgctgtgcgagctgcttaagtcaccaaacgggttcattccatcagtgctcaacgcaaaccttacattcctaggatccttagcaaattctgggtgttttgcatcaaatgtcttccactggcgagcgtcggcgggatgtcgaatcataccatctattttccggctctcttgatgccatctcatcaactcagcatcagtcgggtttgagtacagacgcttcaggcggtccttaattggtaggtaccacatcaccattgaaggaatcttcccgcgcttacccttatcagaatctggatcggtacactctgaatctacgggcccattccccgttttataccgacttgtgccacacgttgggcaacattccaattccgcatattctttacggtataatatgcagtgattcttacaagcatgaatcttttctacaccaagagataaaggacatatgagtttcttcgcttgatacgtgttcgatggtacaaagttaggcttaggaagcaacacacgcaacaaactcatcagatcattaaaacttgtgtccgaccatccatgtttagccttcaatctcagaagttcaagcactgaacgcaagactgtgaaatccttatcacatcccttcgtttcatcgtaaagaagatccttcgatgccttctctaatgcttgccaattctccaatcctcgtgacctgcccgctagcacctctggttcaacatggcgtagcatatcctctaaatcaaaaccaccatcgaaatcatcactatcggtggaaacatcgacaatcattctttcacgcgacatgtcttcgattataaaattctctgcctcattcatctcgaaacttaactcttcatcgtcatcttccggattggcgaattccccgtgataggtccaaaccttgtagttggcggtgaatccgtactccattatgtgacccaatatttcaccaggatctaccaacaatttctgattcttgcaatgacggcacggacaaaagatctttgtcatattctccctcaaagcatgctccttagcctgatcaataaatttagatgcttccttaataaatatcggctgcgttctccgcatctcatacatccatgacgaccgatccatctaattatataaaggcaaaaaagttacagataaaaaaatagaccgcaggtatttcatacaaaagtttaaatgcatttgtctcccaaaaaaaatacaacaatacatgtaactagtatgtacaattgattacatgcaaaatttgcccatcaaaacatatattttgaagctagattttgcaaaaaatagttggaacaaaccttgtcaaaatattaaaaaaactccactttccaccaacgaaatataacaaaaatggagccaaatgaagcaagatagagagttcttcacctttcgtatagagttcaagtaaaaatttcgagttgaaaacctccccccctaattggtgcttgctttaggagagagaaagacttttcgttttcaaatggtcaagctcgggcctggaggagcatatatggcggatcatcgcatgcggctaatcaacccgccccggggggggcggtttttgcaggcgccgccacaagcggcccgcatggaacctaccgaccccctcgtacagaaaaacgatttttgtagtagtggcagttgcgggaggaccccggcggcggacgacagcggcagacacgctcgatttttgtggttttttttggatttttgttttcgcgtgcggtc

SEQ ID NO: 31470 - DNA, 6219 bp, Oryza sativa
aaaccttttttggcccgtctagaaaaaatatttttctactgatcggatatcccctcgtatatatttttcttccaaattccaaccaaatactttaaaagataccatttgaaaaaaaaatgtcgtcgatatataatgggagaagggttacacgcatggtccatccgtcgatggagacgtacgtacgtaggaggacaggaagctagggcatcaccatcgctggccagctgccagctgcggcgcatcatgcatgatcaacatgcttggccttatatatttcctttgcattttcctcatggacacagtacactagtagtcattaagccgtgaaacaatacttatgcacgggataaatgctactccattatttgacgtacaggtacaaaagcaagacttcaagggcatgcccgatgattcccctaggatccctttttaaatcaactgagctgtgacatacatatgtaaagtaagagatttactaagaaaaaccaaaataactagatcatgtatgagatttggttttacacagcacataagacatcatgagagatgattggtgttaaatagctttagaaaaatgtcattactattcacgatatcagctgagtgccactgaaattttgcaaaattaaaaccgtgccattactgtcatattttccaccccttccatcttccttcttctccccatcaagcggtcgtctacaaagaggccaagccgtgagctccggtggagcgggcgaggctggcggcgccaaagcccatggagcgagagaggtcagaggccgaccagcgagctccgacgaaataggcgaggccgccagcgccaaagcctaaggagcgaggaaagtcaatgacagagaaggatggcgcggtgaggatggcgtcggggacggcggagcaacaagcgatgacggcaataactggcacccgtgaagatcacgaaggcagagcagcaagtgacgacaacggagaccaccatcacctctccaaccacagtaaggagtaggaggtgaagatggcagcagcgcctggattcggctgatgacggtggaggctagatgcggcctcctcgaagctagcacgaggagaaggtgattatgcgacgcttggatccagcctccccagagctcgtgcaaggaggaggtggtgaagatggcggtgatgtcggccggggagcacgcgcgcctgaatctggcctccctggagctcacacgaggaggaggaggtgaagagaatatgacggtgacgcttggatatggcttccctagagctcgtgcaaggagcaggtggtgcagatggcactggcaatgatgccggccagggagcacgcacgcctggattcggcctccccggagctcgcatgaggaggagttgaagatggtgacggcatcggccggtgagcgcaccagggcagtggggggaggagcagtaggcgtggcagccgttcatcgaggaccagcaggcatgaccgaactatagggaggagaagagacgaagagaaggcaggagaggagaagagaaggaagaaggaagaagtcggaaggatttaaaatgtgacggtgatggcacggtttccattttgaaaaatttcagtggcatctaaccgatatcgcgaatagtaatgatatttatctattatattattataatagctttgaaaggaggtatcacgttcacttgggggctagaaatttccacattaatcagagaaaaatgaaagaagaatccaagtaggaatacaatttaaaaataattgaaatttggaattaaaaataagcaatattgaaagaagagtccatataagaacccaatacaagattaattaaaattcagaataaaaataaaataaaataagaaattagaaaaatgaaaaaagttaaagtagaaataaaatttaaaaataacttagatttggaatttaaaataagagtccagataataattaacccaatatgaaattaattaaaattcggaataaaaaaataactaaaatacgaaattagaaaaaaataacgaagagttcatgtacgaatataatttaaaaataacggtaattcagaattataaataaccaacattgaaagaagagtccatagaagaaaccaatacgagattaattagaattcagaataaaaaataaaataaaatctgaaattagaaaaattaaaagtagagttcaagtaggaataccattttgaaacaacataaagtggaaaagaaaataagaaatataaaaataatagtccgtataaaacacagtacgagatcaagtaaaattcgaaataaaaaacaaattgaaattagaaaaagaaaaataacattttaactaggaatacaatttataaataaataaattgctaatagaaaaataaagactattgaaagaagagaccatctagaacccacgatgagattaattaaaattctgaataaaaataaaaaaattcaaaaaatataaaaacaattataaaagttcaagtaggaatataatttataaaaaaaatatatcggaataaaaaatacaaaattttgaagaaaaatatttatttagaacacaacgatgccaaatgacaataaagatggaagaagcaacatgcctctaaaggagtagagtggtgacagatgacgtgacatctacaaactattaacaaaatcccaaatagaattccaataacgattaataggagggacggcggacagaccgttaagtagcacaatcacatcggttggcgggactttcaaaaggtaaaaaactaaccccaatgataatcgtatccagtattaaaatctcaatgacaataaataggggaggcagcggacgagcagtagagaagtacaattgcaaagccaatgatggtttggcgggacttctagaaagtaaaagatgaatccaaatgataattatgtttgatttttaaaatcctgatgacaataaagagatgaggcaacagacgagttgtagaggagtgcagtgttagtgtttggcgggacttccaagcaacatgcatgaaaaagattagagtggtgacggttgatggcacatctaaaaactattaacaaaaccataaataaaattctaatgatgattaaaaggagggatgacggataggccattaagcagcatggtctcagcggttggcgggacttctaaaaagtaaaaaataaaccccaatgatagtcatgttcaattttacaatctcaatgatagtaaaaagaggaggcaacgggtgagctgtagagaagtacagtggcaaatcagctgacggtttggcgggacatcaagaaagtaaaaattgaatccaaatgataattctgtttgatttttaaaatcctgatgacaataaagggaagaggtaatgggtgggctatggaggagtatagtggcagtgcttgatgagacttctatacgttataaaaattgaaacccaatgagacaataaactctaaaaactataaggttcatctttcaaaggttcgaaggagaatgaatagaagtagtggtagatcgagcaagcaaataaagatgaggtaacaaagaaggggcagcaacttgtgtgacttttaaaacctataaaattagaaacacgaggatgataaaggtttggtctttcatagtattaagacaaagagataaccatcccaaaagtgaaaacctcactcttgtggtaactgattttgaggccagccatctcttcaaagcagtacaagatgaattttgttgccacaatttcggttgtcatcattggcaatgaacaggactgtatcatcaacatattgaactccttcactcttggaagtgtcaaacattgcactaaggcaacactaacaagattagaaatgagagggaacaggggggtctccctatctaagacccaagtcctaaagaagtcagttctttccccattaatatttatgcaaactttccctcccatcacacaggttttaatccagctaatccacttgtttggaaagccccttctcaccattacctctatcagaaagtcgcagtttaccttgtcataagctttctcaaagtctattttcattataatccctttcagcttttgggttcacttttcatggagcacctcatgtattatcacacacccctccatgataaacgtcccaaggatgaaggcaatttgtgtagattttttaattagttaagataagataagatagatagataaagataaacataaagataaattttataatcgaacttatggcaaacatagaattccttttatttagcagggtggagggactggatatgtccatctcaacataagacataccatcatacatccatagtgctggtgacaacattttgagtttgcatcttgcagtgctacaatacgaaaccattctagtgatattattcgcaaatcatcgcaactacgcactagggagttatatatatccttgaattggagcctatagcttcctggaattaatgcagaagacgcaatgacctcgatcaaactaagcaccaacagacgcacatccatgcatgcacgcaacgcatggcccgtcataatggctcggcatagagattgtccggcagcctggtcttgacgatggggaggagagggatcttccgtggcgtggtgagcccgatgatctcctccatgctcagctcgccagcagccactccatcggggaggctccaggagaaggcgtgcagcaggttggcgagggtgagctggatgactttgagaccgaggctgtacccggggcacatctgccagccggagccaaatggcagcagctcgaagtcccaccccttgacgtcaatcccgctccccatgaactataagattgagctcaacacgaatgtcacccctgaccagcgaagatataatgtgcctacaacatctctagttgctgctatttggctagaaggggatgatccggtgagaacttttgataagcatgtgatggtgtgtgccaaaggagagaaacctactatatcaaagcataccatggttgcaatgacctattggcatatcctttatataaccctaacggcgaaaccagatggaatctcaaaatgccgtacgaaacacccaccaatattcctgacggtatggacattgatgcaccaagtgttgcaccaatgggtggtaacgtgcacttcagtgaagaaaacacttttgtcgagcctcctggtaagtacacacctagcttgtatgagaccttgtcaatgcctatatacttttattccattggaattaagtagatttcttgattttgttgcagagaatgatgacgttggtgatactttatacgatgaagacactaatgaggtggagaacaggtcatgcaagcgaagaaagatagatttgtcactgcaagagagtactattgctttaggctataggttaggaggggacttttcaacattattttatttggaggtcgtctctttcagcaatgggccgttgacatgtatgtaaagatagagtctatgcgccttgattggtattctaaccctaagaaccaaaacaagatacgagctgagctgtactaggtgaatgaaataaaattcatattcaataatattaaaccatatcccattcaaaaagcgatgcttacaatgtatgctcattttaccgatactaattttgtagggtgtagtcgatgtgatcaattctggagagacaaggggttcagagataggaacgaggattgtgctacctcggtcttttcctggtggcaatcgcgacatgcaacagcggtttcttaatgcaatggttcttgtccaacattttgggagaccagactacttcatcccgatgacctgtaatccaaactggaaggagataacagaaaatctttatcgtagccaacagccgcaagatcgaccggaccttgttgcaagggtatttagggccaagctacgatacatgttagacttgttcaccaagaaaaagtatttcagtgaggttcaggcatatgctcatgttactgagtttcagaagcggggcctcctacatgaacatatcctgttaaccatgaatccatgcagtaagttaacaaacccagatggttatgataaagttatctgtgcagagataccagataaggaaaaataccctgtgctacatcatctggtcataaagcatatgttgcacatcccgtgaggtgagctaaacaaaaagtgcgcctgcatggtggacagagagtgtcgcttcagctttcctcgaccgttctgtcaag

SEQ ID NO: 31471 - DNA, 15658 bp, Oryza sativa
  unsure (1)..(15658): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactacgcgttatatattttattnttcaaaactgcgccttaattaaagggnggcaccaatacccgccttttttcctccttggttaattggttaaggaaatttaaaaaaaaaaaaaaaattaacccaattttaaccccccaaaatttaaattttaaattttttttttttttttttcccccccccccccttttttttttgggctttgctatttgaatgcttacctcagtgcaagagcagggaagaggtttgattgctaataaaatgagtggaagaaggccgtcatggaagagtttggggtccaaagccacaccttctttctccataggaacagaggtcaggagctgccggcagggcgctgcttttaatctgactgatggctcaagataagttggagacgtacttgagatggataatttatgtatttcgctatttcgaatacctaaactcaagcggtgctaatttgctaatccaagccttatcaataataccaacacgccatctgatccaagattagcaacctctctttctctaatagagggaacctcactgacgcattcagggctctgcagttgaagcgttcctaccatccatatatagggaatccataccgtcggcttgtcgatccgggatcacccaggatcgggtggaaggtcggagaagccagtcttcagtggtgcttccatggcagttggatagtagatcagagaggcaggccagtagaatatggagttgtttttgttctcttgttattcttttatggctataagtctttctgtcttggattcgtaatgtttggccattaggtttgaattgccttctctttctgtcttccatttgaattctgggacttatcctgcaatttggagagtagttgatatggtctttcttggctttggctttcaaagtgcagttcgaaaagagtgagttgctgtcaatggcgggaatgaaatatataaggatagggtggaaaagagtgctccatatccatatatgtgcttggagggaaggccacatctttaattgtattctttttcgaggtcatcctcttcagcctgtgttagtagtgctagttttgagtttctttttagtaccttccctatttaggggttctatagaaaggcttagaggatcctaaagtgtcagtttatgttggaattgctttgctcttttctttctttgatgcttggaaggaaggcctataaccaatcaatagtaaacatccctcacccaactaccagtctgtttagagaaatgaagaagcgacttgggttgatttagacaatgttatgtatcgagaaactcaaggccactcttcctccgggctcgaccaatcaataatagaacaactcaccaacacaagcaagttgaacgagtagatcaatccatctgcctacccgcttaatcagcgtagcaggcatgcccacgggaggcaccctccaaatcactaaaagcagcactataccaccacaagtagagaatcccaatgcgcttttcactaggaagacgaggatgctattctttaaagaaccgagcttgacaagcatttcccatccatctttccccttcttgatgagcgcaccacgactcattcaaaagagagagtaaaaggaaggatttcccatgccaaaggatcggaacagatcgggtctcaatccatccgtacttgcaatttcatcatgatccttatcaacagagctaatcgatacatttataaacaatgataccttgctttgtgtttcccatctgttcaagtggataatcccgattcggttttcgagggttcgctcgtcatttattcgtagtaacgtcgtattgcctatgtagctaaatcgataggaataggatttctcaaaggaaagggcgggtggacatacgttgcgggtgtccagttggcatgggtttgggttccgctcatcaactcgaacggtcaatgctggccagatacctgcatcgttatacgtcacaagttggggtggttgaacaggaaaaacaacaacgctttccttttatggcactgctcaatccgaataccagctactatacccttttcaaaatactagctttttcccttttgcctccccctcacaggtaagatattttttattccctggactagtacgcgtacgctatttatattccttgcgcaagagctattcctatcctttcagccaaagcttcctgtcggaaaacaggtacgattcactagaataccctactcaattaaccaacaaagagagaaaagaaggtatttgtgaaaagagaaaagaagtagttgtgttggcagtagatgggttaatggaacaattcaaacttgaaagagaattctctctagagagggattctgaggtaaagtagctaaaataaggaaagcaaggtgtaaagcggtaaggcattacgctgtggtcaatcttcagatatagagtaggtaccgaaccggagtcagagtgaactgcggtatttcattcagtcagcttggcttttctatagttggcctttttgtctaccttcttgagtcaatgtcacattggtccattccggtcttcagtaagtcagtgttcaccaagcaagctggagcacctttcactctcgggcataaaggcttttatccaattcattcacaggaagggtagaaggagcttcaaagcttttagccgccgttggagctctttcttttggccctacgaatgaaataagcgtgaaatagcagtaagcggtggtggtgaggaagtcagtcaggttagaatagaactagccgacgctttgctttttcaaagataggatccctatgcttttgggaaggtatgccacaccccgtctccacaggcaaaagtaaagccggcaatgggtatttttaggtctctgccgtaaggaattggatgtcaagacgacgatagagatttgagctgtaaacacaagaagtaaatgacaaattgggagttggggttccttaacttaagttgacggtggaacccctttgaacaccccgcctaaatgggaaggaagctctagaaaaggagctcgcagttcctcaataatagactcgcacctgggagaaggggatcaaatatataaggttgaatgaatggaaaaaaaagaagaataagtttgacccgagtgagtatggaccatacgctcatctttcttctcaatctacacctcgttctgtgagagccctgtcgaaacaagatttcggcaatactaaaagggggtggctatcaagctggaaaagtgtctgggtttggagacaaaggatttatacaggttcaggccttcttattcaagaagtaataccctactcctgtccggggatgaatccgccgagtgtattattggatgtataatctccaagaaagttgatgtcccaggaaggactcggacccctccttatataggggaaggagtccgtattacaaggtataactcatatccttatcagaatatgagagtacagataaaatacaatcgtaaccgactaagtctcagggtatttccttgacgtacaagttaagaaacaaacccgagatacaaataaagatattctatctatattcggtatcctatatccagtctaaatataatcgccgtgtagatatggggtatccataatctccacagtagcccccgagacctttgcagtcaacaatcatagctttctcaaaaataataatctgagtgctttaatttcttcctgctaaggcctgccgagtagcgaagacaaagactgtaaagggcgaaaagataaaaaacattgtgcatcgaatagatgcacctaattaggtgtagcccccgactatatgattagttaacaaactaaacatgtagtcgagaacaaaataatagcataatcatgtatcatatgacaaaagcatatgcggcgcccaacaaggcatttagccgactactttccagccatagtaaaaagaatccgagtgaataacactctaaaaagttcacaaatgaacacatttgacaggcatccgagtagaaaactctaaagataatccatcaaatattataaaaattatggtaattaataagtctaatagcctaggctatgactcttcaccataattaaaataggcatataacacgccaagagaatgaccattgtaaaaacaagtcatcccaaattaacccagacagcttttgcagcctaaaaaagctttcaaaaatagtataacacttttctgtcgggtaccttttaatttgcattgcgataattccgaagaattatataaccgcattaaaaaggattttatcagcattgggccacaccattgtgagcataaattgccaaagcaaaaatgcctaagtccctaaggagcacaacgggccacgctgttaataatattgggctgaagtactgttcaggcctaggcccattagcacccccgaaacccttaacagaaaatcccgaagtctaagcggcgcttcgtcttccccgccggaactctcgccattttccccattccttgctatagtacagaactgcgccggcgaaactagggttcaccattccgctccaatccaccttcaaaaagttcaccaaaatcctccccgcgactcaccgcttcaattccacatctctccccagccatccctcgaatcagatcagctcattcggatcaaatcgatggcggaagaaaaagaaagctttgaaggccaatgggcgtcgtccgacgtgacggaggaaaacttgaaggagatggtggcgcacggcgttctcccagccaaggagatcatcggatggtggccagcatgtggtgaagctttcccaacccccgatacacatgaggtcgtgcttttttctcactttttctatggcggatttgctcttccaaccacaaagttcttccgtgggatattgaacttctatggaatcagtttacatcatttgaatccaaactccatagtccatattgcaaatttcgtccatgtctgcgaagcttttttgggcattaggcctcattttgctctgttccgccgaatcttcttccttaagccccaaccaaacaaaaacaaaccatgcgtagttggaggggctggatttcaactgagagggaccttgagccaaaagtatttttctatgcccttcaagacttcaaacaaaggatggcacgccaactggttttatgttcaaaatcccgagcctgctcttcccgagtactcctgtcttcccccagtataccaagatacctggaactctcttcccatgggagatgaagctgcccaagccttagaactgatggaacgcatgttgaagctcaaagagcaaggcttacagggagagcaaatcactcggcatttcattaagtgccgattagctccaatcaaagagagatctcgcacagcattcgagtttgacggcaagcatgatccaaaccgtgaacacccagattctctggattttaagatcatgaaggagaggatgtacaagatattctcaaacgccattgtcgtcagttattcgcatctgctgccagtcgtgccatacaatgcattcaatccacctccgctggtatgtatcagaactcttcaaactgtgatcaaaacataattttgtcttcttgttgaattaactgaccgtggaggcatttcattcaggaatttgctttggtaaagtctgaccccccaatcgctcaacgccgatctcctcgtcatcagaccgttcaggggagtggaggaccaaaaatcaggtcagactcccaatcccaaactcccaatctgactgggcagacaaattctcgcaagagaaagcttatgctgaacgacgacgaaggcgacgacaataataaatttggggataagggatcacccaaaaaattaccaaagcacactgctccgaagaagaaactgtctagccgccccatgccaaagtttacaaaatcctccaggtataaaccatccggtaccgtttcacttcgacatgcttctctcatgaagataatattgaaaactagaaggaaactttgcaggaaaccgtccgacatagatccatccgggaaggattctgatccggctaacacagagacaggttcatctaaagaagctgggccgactactgaggaccagccgactggcgcccagacttcagctgataaggtcaatccatgtgaccagcccccaactggaaaccagtcggcagaagcagaaaccgcaaaaaaccaagagcccccgactggcaatcagtcggaagtaggtccagatcaagaaattcctgaagttgaagttcaggctacaacttcccaaggaccggacgctggtaacgacccaacgcttgggtctccagataaagggcaaggatcacctcacgctcaaccggaaatcacctcaggtaacccatcttctcaagtaatgccaatctgaataactccgattcgcttgtctaatgtctgggaatacatcaggaccactaggcggtgacggagaggaaatccctcgcataaaggcagctgctgactctcgtccccctatcttaatcaaatggtgggacgagaacttgcaacctgcaggcattgtcataaatcgacagaaagaagacgaggaggtgcgccagctgaagaaagcactcggagaagctaccgtattgtaaatgtaagtcttccaggtggctgcccttggtgaccttgttttttctcagcaagactaaaccgtgaatcatcgcgcagagaatccatctccgttatgaggccaaaaccacaactttagaaaagctggttcctcatttagggacccttgaagcagttagggatcagctacacgaagccaaagagcttgccaaaaagacagagcatgatctaagagaccggattacccaactccaggattcgaactttgaactgagtggctcatcaaaaggtaacctcaagatctgccccattaatttgtgctgttataattgtatcctcaaccgtctggaatccaaacagtgcaagctgccaagatagctcaactggagaaacgaattgaggccttagaaaataacaaggcagaattggctgcacaaagggactcggctttgaaggaggttgaaggtattgtcagccaacaacctaagtttctctctttgatgcagcagatcattgacataaatttgtttttgtagaccgcaagatcaagtcccaagcccagttcgacgtcctggttggcaagatcaaaagacttgaaggagccagggatgaggtcgccaatgccgctaccccgcttgtccaggcgatgttctataataacaatggcccgagtagatttcatgcttccgaagtgtttgacaagctgagaatcgctccggacacctatttcaagaacattagagaagccggaagcatgggagcaggtttagcgttagcaatgaccaaatccctgtaccctaagatcgatattgatactgttgatggttttgcggactggacaagcgaagaggctgcccttgatcttatcaacgacgctcaaaaagcagccgacaagattgctggtgacgtcgtagatcggtttcaggataccgaccttcggccgactggtaacaataactctgatgatgagaagactgatactgattaaatgtaaatgtatcgaatgccgaatgatggaggcacaatttgtacaataccggtatatttatgctgtgcttggtgtttctagcttagctgttgatttcttaaaagcctttatcaagctttgttgagcctaaaacccgcaaaagctattaaaaactttcagtcctcgtaaactaagtagaaaaatcaaacaaggcaatgatagaccaagtaagcaaactgaattgataaaaaatcacactccattattattatggtagcccccgactgacaacctcaagaagaaagcttgatgttgacagtcaagatagggagatacatggataaacttaagcgtagaagcgacgaagatgtttgatattccaggaattgtcaacaagtgtaccatcttcacgcttgagtcgataggaacctggccgggtgacttcagagatgataaatggcccttcccatagaggagataacttgtgccgatctcgtgtagtttgaattttcctcaaaaccaggtcgccgactaggaaagcacgggatcgaacattgcgattatgataacgtcgcaacccttgtaaatatcgggccgactgaattaaagctgcgtcgcggacttcttccaatcggtgcagatcatccactcggtcctcttcgtagcgttcttcgcgaaaattgcgaaagcgcaaagattcgaattcaacttcactaggcaacattgcttctgccccgtagacaaggaaaaaaggtgactggcctgtggcccgactgggtgtagtacgcaaagaccaaagtactgatggcagctgttccacccattttcctgcatagggttttagccggtcaaaaactcgcgcttttatcccttgaagtatcatgccgttggctcgttcgacctgtccattgctcatgggatgcgctactgaggcatagcaaattttaattccgaagtcttcgcaaaagtctttaaaaactccgctagtgaattgtgtgccattatcggtgataatccgattaggcactccaaacctatgcacaatgttgatgaagaaatctcgagctttatctgctgtgattgtgacaaccggtttagcttcaatccacttggagaatttgtcaatggccacaaagagatgcgtgtaaccgccgactgcctttttgaacgggccaaccatgtcgagcccccaaaccgcaaacggccaagacagtgggattgtttgcaactcttgagctggtagatggatttgtctggcgaaaaattggcaaccttcgcacgtgcgcacaattttgtcggcgtcggacactgcagtaggccagaaaaaaccctgccggtaagctttgccgacaatggtgcgtgcggcggcatggtttccgcatattccagaatgtatgtctttcaacaattgtctcccttcctctagagatacgcagcgttgcagaattcctgaagggcttttcttgtatagctcggcttcatgaataacataaagtctgcttcgccttgaaatccgctcggcttcatctttatctttggggagttcttgagaagtcaaaaatcatatgaggggctctctccagtcggcttcaatcatagctatgttatgagtgtccgcaacttgagttgtttctttctgaggtacggtcggctcataaaggtgttcgacgaatacatcggagggcgccgcctcgcgcttggatccaaagttggcaagtctgtcggcggcttcattgttgtgtcggagaacgtgactaagctcaagtccatcgaatttgtcttccaatttgcgttcctcttgtcgatatgccgtcatgttgtcgtcaaggcaggaccgctctttcataacttggttgacgaccagctgtgaatcgcctcgaactattagacgctttatccctagggagattgcgatccgtagtccatggaggagcgcctcatactcggcgacgttgtgggatgcggaaaaatgtatccaaagcacataacttaatctttctccagctggggaaattaaaaccacttccgctccagtgcccgaaagcctttttgacccgtcaaaatgcatggtccagtgctccatcttttctgcggggatatcctcctggcactcggtccattcggcgacgaagtcggctaatgcttgggacttgattgaagttcggggcttgaaggatatgtccaaagacatcaactccaaagcccatttagcaatccgtccgtttgcttcgcggttgtgcagtatatcgccgagcggaaacgatgtgaccaccgttaccaagtgaccttggaagtagtgagataatttcctggtagtaatcagaataccatataacagcttctgaacctgaggatatcttgttttggagtcggctagaacctcgctgacaaagtagatcggtcgctggactttctggacgtggctttcttcctcacgctcaacgaccaagactgtgctcacaacctgggaggtggctgatacatatagtaacaacggctcctgcgggtgtggtgaggctaagactggtggctcggtgaggagtttcttgaaatcttagaaggccttctgtgcctcgggtccctactggaaatcgtctgttttctttaatagcttgaagaagggcatcccccgctcgccaagtcgtgaaacgaatcggctgagcgccgccatgcatccagtcagcttctggacgtctttctgggagcttggcggtttcatgttgaggatagcagtaactttctccgggttggcttgtatgcctctatgacacaccataaaaccaagcagcttccctgacggtactccgaaggtgcatttttcagggtttagtttcatcctgaaagcgcggatgcttgcaaaggtttcttctagatctgagattaaatcatccttctgcttagtcttaacgactacatcatccacgtaagcttcgacattgcggccaatttgcatcgagaagcatctctgaatcatacgttgataagttgctcctgcattttttagtccgaatggcatggtgatgtagcaataggccccaaagggcgtgatgaatgaagtcttcaagcagtcggattccttcagtcggatctgatgataccgtgagtagcaatccaaaaaactgagtagctcacagccggcggtcgagtcgactacctggttaatgcgaggcaacccaaaaggatctttagggcaagacttgttgaggtcggtataatcgacacacatgcgccattgcccagttttcttccgaactagaaccgggttagccagccagtcgggatgaaggacttctttgatgaagcctgctgctaacagcttggttaattcctccttgatcgcgtccttcctgtcttgtgcgaagcggcggagtcgttgtttaataggtttagcgtcttctttgacatgtaaggagtgctcaatcacctctctaggaataccaggcatatcagatggtttccacgcaaagatatctttattattttgaagaaaggtgacgagcgcgctttcctatttacaatctaactcggcgcctattacagcagttttagtgggatcagaaggatctaggggaatttttttagtcttggcttcgccttctccgctctttgagaccttggtcgcgggcacttctccttcgcttgccgtggttgcagccagtcggatatcttctcgggcagacgccatctcgcgagtctgggccatctcgcaattttccttgtcgcatgtgacggcttgcttgatgtcgctccgtagagataggactccccggggaccaggcatcttcatcatcatgtaagtgtagtgcgggacggccatgaacttggctaacgccgggcgtccgagtatggcgtggtacgctgtctcgaaatcggcgacttcgaagcagatattctccgtgcggaagttttcccgagtgccaaaggtgaccggaagggtgatctggccgagtggagttgaagataaccctggaatgactccgtgaaaaggcgcattgcttggttttaacttggagcgaggaatctgcatgtcatccaaggttttggcgaagaggatatttagtgcactgccaccgtcgatgagggttctgcgaagcttgacattacggaccactgggtctagtaccagggggtaccgccccgggtggaccactcggtcgggatgatctgagcggtcaaacttgattgctgtctctgaccatcgaagatattggggtgtgtcgggctgaacagcgttaatctcccgttcggtcaacttttgctttcttttagattcataagccaaggggccgccaaagatgtggttaagctccttgcggtggttttgaaaacctgccggggggtcgccatcgtccttcttctttgacgtgctttgttcttcgtcggagttcttccgtgtagtcttggtgtattgttccgcgaactgtttgtagacgaaacaatctttggccgcgtggttggagttaggatgatgcgggcattgggagttcatgatcttgtcgaatgtattgacgcgcgaatgctgtcgagaagagtgagtagcggttgcaacaagttcctcaggcttacgcttgcggtccttatgattgttacttccaccccctcccgtagccggcgtatccttttttggcttccaactggagcccgactgctttgatgcgatgacggcatcttcagccttggcgtactcgttggcttttttaaacataagtttgactgttttgggaggcttacgcccgaacttgccgaccaattcttcgtggcgaattcctttggtgaatgcggcgatggtaacatcgtcggtgatgtcggagatcttattgcgttgtttagaaaatcgccggatgtaatctcaaagagattctccggacttctgtataacgttgtagagatcgaattgtgtgccggggcgctcgaaggtgccttggaagttggcgatgaagtggtcgcgtaattcggcccaagatccgattgtaccacggggcaatccatggagccaggaccgggcggaatctgctaaagccactggtaaatagttcgccatggccttgctatctcctcctgctgcgcggattgcgagatcgtagacggtaagccatgattccgggttggtggtaccgtcatacttctctattccagtcggcttaaagccggctggccaatccactcgacgcaggtcgttggtgaaagtggctactccgtcaaggtcgtcgtcgtggcgatccggcgaatgatgatggcttcgagctgcccggcgatgtatgatcgtctcgcgaagatcgacggggcgacgacgaggtggcgaacgaggtcgttccactcggcgctccctatgatggtcgggaggcgagtggacagatcgctcgtcgtgacccctgctcctgcgattagatcctgcgccagcgatgctgaggcttggctggtggtagtcgtgagatcaaagatgagggactcagctgccgctcggggtgcggacgcttccggagttaactgggaccgaagccgcaatcatggtctttatctggttcaagatgttgacggcgtggtcagattgattgagctcgttttccttgaggagggtgtcgaggagggtgatcgcggcaacagcattctgttgaggggtgcggaaaaccggtgtcccctcaacgtcttgttggccgataagatctcgcgctcggcgccctgcttccaaggctcgtagccgccggtcttcagcctcctttgcagcccgctcacgctcctgttgctcacgccgtagccgttcttattcttgtacttgacgctcctcctccagtcggcgtcgctcggcctcgcgtcgtgcttcagtttcccgggcttggcgttgctcctccgtctcgttatcggccataaagacgccgaaatagagaggggtgtagttgtcttctaggctttcatcgaagtcgtcgagatccgggtcgttgttgcgaaagccgaactcattgtactccacgatctcggtcggacgcgagtcgacgccgggagagctccagtagccatccagctggtccgtcgaaactgagccgagtggctggaggatgacgccgacttccctggagctaggcgagatcggtgttgaagccgatttccgcctaggcctacgggatggggacgctgtggtggtgaagaaggccgccaaatcgtcggggagcttcattaggatcggtgggtaagccccatcatctcgatctgatgacgttggagaagatgcaatctcgcccgagtggtttgaagccgactcgattgagatggacttggagtagatttcagccgcgtttggaactccaaacgggactgagatccggctctctcccgactggtccgattccgagtcgaggagagagatcttgccgaagttattggtgacgaagtcgaggctgccgaaccgaaacgcctgcccgggtgggaagatgaggtcgtcgatgccggagacggaacccattgcactgatcggtgaaaagcttgacgcaacccctacctggcgcgccaactgtcgaaacaagatttcggcaatactaaaagggggtggctatcaagctggaaaagtgtatgggtttggagacaaaggatttatacaggttcaggccttcttattcaagaagtaataccctactcctgtctggggatgaatccgccgagtgtattattggatgtataatctccaagaaagttgatgtcccaggaaggactcggacccctccttatataggggaaggagtccgtattacaaggtataactcatatccttatcagaatatgagagtacagataaaatacaatcgtaaccgactaagtctcagggtatttccttgacgtacaagttaagaaacaaacccgagatacaaataaagatattctatctatattcggtatcctatatccagtctaaatataatcgccgtgtagatatggggtatccataatcttcacaagccctatcctcgtttcgaaataaaggaccgtagtgaggatcgatcccggataagtgagtcagtgtagggacagaggctgatgattctaaaggtgatttaaaactagaagatgactttatttgaaaacggaatccaaatatcaacaaaaagatgaatggaaagtcttgtcgatatgaattgatcttcaacccaatgacaatgcttcgatttcgatcttgacttctttcttcgatgcctgaagtttgtgttcgcatttcatcaaaggaaaagtgggctgtacctacatgaaggtaagagttgctcgtgtaaaagcaatatcttctatttgacttatctagtcgtgtcttgtcttgcacatactcggctcggtgaatggttcatcttcgattggcatggagcaagaaaacagattgaagcagagccagcacacctcagtgaatatcattatttaggacaagcacgaagaggaagagctttgtccttcggccttgaatcagcataaagcccctcgctgagccacttctttgacattacgtcatgatgaatagggttcgactcattcatgtctccacacccaggttatgccgcagccccctagattgaaatatgacaacaaacatttgctatgggcggggggtccgcttcgataaaagctgtccagcctgccacgctttggaagagcttcggaacagtttttccctagttaggtaacccggttttgacaccatggcccctatgaatcatcaagctgcagcttcgctaccaggttatttacaaaatgaaagaagaaaatacgaaagaaaagcgtccattgtctaatggataggacagaggtcttctaaccctttggtataggttcaaatccta

SEQ ID NO: 31472 - DNA, 1584 bp, Oryza sativa
aaaggcgtgaatgcaaataaaaaacatcccctgggtaagcttcgcagccggggggtcttcttaatagaagggacatttggcgataagcttgtgcttgtttggagagatcatcataaattattaaagtatgccggtacataaaatactcagccagggccgtataaggagcgaggtattgtaatgtagcaggggaatccgccatttcagctactacaatagtgtattccatggccccctctttttcttcttgttcccaactcactactaagcaagttcgaacgaattgcatatatattatctctcatatcagatgtgagtcaccgcctaaactacactgacttatcgaggttcaaactgtctcgcgggtaaagcaataaactctctcttcgagctcagtcacaattcattcaatctgtggcagtagtcgtagatagcgtagcccgggatgttagccatctacctatagtgtgagagtacttttcttcgaaactctataagtgtaagaaaagagtgcatgtacttttagtggacttgactttttctatagtgtgagagtactttctgttcaatctagtcgctccagatctgcccgagacatgcgcctaaggagaaattgtggtacgtaggttatgtgtctgtcttatgtcgtcctagtgatttatcatcggaatagctcagttcgagagagggggtggaatttgaaattcgaattggaaggtttgacagccaaggagcggcaaataagtaaatatcttcgacatagctgaagagaaaaggaataataatatctttcttatttctttcccatgacgactaggaacgggcaaatcaagaatttcacttcgaattccggacctcaacatcctgctgctcatggtgtttcacgatcagtattgaaaatgaaagctgaagaagttatcgaaactcggaaccacatgttcaatctttttttagcggtttccccagagatctttatcattaacgcaaccttcattttgctcattcatggagttgtatttagtacctctaagaaagatgattatccaccattagttagtaatgtgggttggcttggattacttagtgttgcgcgcctaggagggcagcgcgcttggggtgcggaggagctattatcgcctagctccctaacctaatgcggccagaccgcagggaaccttagcatggggggacgtcctaatccttttgccgccgcaaggcaggctaatcgtacgcagcaggagcaagggaactcccctggttcaggaaggcacatgagtccgaacgctattatgaatgtgcgaccgacactacactacgtaggtacctgtgcttgcaggtgaggcatcggtcggtcctaaaaacagcggcagctagctaggagttaacgaccggacgtgctgcaacctagggatcaccaggcagctctttcgctctatagggatatcgggggggcatagcacaattcttcttggacgagggttggtttgcccaggtgactgatcctgccataatatactcccgccaattctattgcaccggcaaccgaagtcaaacatacatacgacgatcttcatgcgtgaaggg

SEQ ID NO: 31473 - DNA, 5432 bp, Oryza sativa
gataggcaattgagagatagagttagcctattcgtagggggaatcaatgctccggaccgaatagttacctccttttctttctctggcgcatattagcttagcagcgctcaaaaggccctggttggttcctctcttaggccacactttccttaccttactcccgcaacactcccactccaagctacgcctggtgagcaagatgcattgcgatttcctcttctgtggacacaccttcggctcactatgacccgggacgggaagagaaagactttgatttttccggtgatagtaaagccaaagaccccaagacaaggtacaactgttgggaaggggacatgatcaatagaacctggctggatccgggctgggatagtggcgcccattcctaaccagttctgaaaaggttcgctcatgctggaggtactaaccacttagtgatcggtccgctagttcacgcaaatccgaagaagttatcacggacgagccacatgcagggaaacttgcacgtgtggttctggccgggctttccttcggtatctaataaccttgcttctgctcgccgctggcgcacctctcctaactattgcccatttattctggaataatttttttaggagggacaattttacatatttctgccaaatccttctattattaagtacggctggtaccatttcgatgtgtttcgattctttcgaaaaagagaggtttgatgcttctgaattcattgtattaattccacttcctactcgcagtatgctcttaatgatcccggctcatgatttaattgccatgtatttagctattgagcttcaaagtttatgtttttatgtgatcgcagcatcaaaaagaaagtctgaattttccacggaagccggctcaaaatatttgatcttaggtgcatttccctctggaaaattattgttcaggtgcgaccggactactaccgatcaatttttttaaacttctttatagacttgtagagaccctctatgtagttgtaattctagggcaatcgatctactttcctcatagccctaaggctgtgtctcgatctcctacgcgcgaaagataagatacgggggacggggtcctatggtatgggtcttcgacccttggtctaattccacgacagagagtcggcgtggcgtaaagtgaagattggggggaatagagctcaatccccgtctggggtattccgaaggtgtaacctaggcaacgaaaaaggggcccgatacttcaactaaaggagcgacctgttggttcaccaaaccccgacccagtgtcacacgttctccaggtccgaagggatccagtgcccaactaccgactcctcccggaattgcgttatcggagccgagccaggaatagccgttagtggacacctaccacttttcaccggttagagaggccctctttaatacattaagaaaatatgttcacaggggccagaaagactcggtcataggaacttagaccacctacgcgctggtaaacgaaaaccacctcgaccggatctaccgaacgaagaaggccgccccgtcgaaagaattaacacgccaaaagggccaccagctttcccccaaaaaaggggagatccgcagcttactgctcacggaaacatccgaccttatggtcaagtcgtccgcctatctttctgatctcattcgtttgtagatcgcataaaaagttcttcgtttttcctggccaaggccagttgggatcagtctctctaatccaaggagagcagaagtacacataattgtgtccaaaagtgatcatgttattgtctctccaagagtatatctaaactcgtcggaaaatacattctaggagtaggaggctcgtccccaaacgatctcttactacttttttgtgcttattctttctcgttggagttgccgcaacaactttttcagggtcctcatctgcctctccactatggagatgggtgctgtctgctgtagaagtcgaaataatcttcttctttttcactttagccaatatgagtttacccggcactagcagctttattggggaatttctaatcttagtaggagctttccaaagaaatggaaaagtaaggaattttccttaccattacttccgtgaatgtgaggactttgtcactttccttcatttttttctttatacaagtggtgttgcactttctgctggcgaactcttatttttggatcttccgcccgtggacaaagctccaccgagtagagagattttggatctagatttgaacgccccgctccctgacccggagccggaggtagagattgtccccggggacgaccaacatgtcccacccatacaggaggacaatcccatcacgttccagttacaaaatgatgaacagagggagtcattggagcaaatgctgcattccgtcaaagaaagatgtataatgaaattaagaaatgagctgatcgtaaataagagaagtagaaaatggggatcaacaaaattctgaaataggccttacccaccgccctatttcctttccaactctcaaagctaaactcttgagatagcacagcaaagaaagtattagcttcactcgttcttacttatgaaaagtattagcttcacccagtattatgaaaagtcttaatcatcctggtgctatatgaaaaaggccgtgcgtgctagaaaagccagagaattcagcaccgtactgccagggagtcccattgaaacgcgggacagaaactcatatatagtgtagtttctatgatttggggttcgaatctaccattggagagaaaataaggggttatgtggatggggtctcgcttggacgcaggggagatccatagatctggatagagtctttctcgctcagtaaagaagagtacgcgcgctacggcttacgcagtggatcttcgggcaaccaacccggcacatccaattccgatcaacaacttggaggtatggctgagtggcataaggcattggtttgctaaatcgacatacaagaagattgtatcatgggttcgaatcccatttcctccggcacggaagtagaacgggcgggcgaaattacgtgagagaaagaacctcagattgatggagtccgccgtcggatagaatagcactacttagtgactaggagcggagcgcccctttcttgttcttggtggcatctatagcgaagaagaccttcccgaacgagggccgtccagtccctgcccggctctcggttcttgagcaaactcctccactgggatgctcatagatgaagaaaagagactttaggcaagtggttctggtagctcagctggttagagcaaaggactgcaaatccttttttgcttgtttcagtgggaagagcaaggggcattgcccttgaaatccttcagtggttcgattccacctcagaacgaaagaaaatgcaagtgaaagagaattgtaggacaagagctgatggatgatagaacaaaagagatggatagaggcgagagagattgagtggagggttcgaatcgcaagattcctattggtgcggaaatgggtagaggtaaagcgaagcacagagaccagaccaccggatccctccttttcaattgacatagtttgaccagtgaactccctactgcgtgcaatagttgttccgaggacaatcaatgggtatataaaagaccaacgaaacgacgagtgagaaggataagggggagtagtaggaggagctttcattgaagtagaggtttcatcgagtgatgacgagagatagaatgagacaaagcataaaggggagagcgctttgccgagcatttagtagtcgttcggctgggggggttatctttaaagtagtgcttaaatcactacaggagcgaaaaaaaaggataagtagcgaaatttcgtcgactatttatttttatatgttatgtattccatatttgatcttctttttgaagatttccattttagtttttctagtcttttatcggatagtcctccccatagtacagatgttttcccttctaacttgttgctcctttcttatcactcttcccccaaaagttcaagacccacaggctctagctcatttagaagggctaaacttctatctgagcctttacgagcaggatccggagtgggttgcgttcattcagcaggagctgaatcacaacacccctctggaggacatacctgggcggctgaggctcttcctaatggaagaaaggacatccaatgttaggatggatctaattcaagaatttctagctctatacgcgaggaacggagccgtacttccggtagaaccctaccttttggagggggcgcttcgttcctatcttgactctatccgagcaacggatgatttctctattctccaggcagcttatcaggatctgcgggatcatgaggaaggatcatttttcttccgtgatgtggtttcccacaaccatgatttcctggaagcgcaaagcgcgaaaagaacgtggattgaggtggaacggaattcgctatattcaaagatagaacgagcccaagcaaggctcgaaagaaccgaattccaacacactctactgatcttccaattagaagatcgaaagaggggggggggaataatatgccgtataccactttttttttcaaaagcaagcatatgtgacctaacaggacttttgaattaactctgcgattttgaagatggaggaaatgaaagctgaagaagttatcgaaacttggtttagtatcaaggttcttctcttccagccctgagcccctctctgataaggcttgaaagttttcaaaacgaaaatcaaatgacaaatctggtccgatggctcttctccactaaccacaaggatatcggtactctatatttcatcttcggtgccattgcaggagtgatgggcacatgcttctccgtactgattcgtatggaattagcccgacccggcgatcaaattcttggtgggaatcatcaactttataatgttttaataacagctcacgcttttttaatgatcttttttatggttatgccagtgtcacgtcctgataaattcatcccgaaataaaaatcattttctaaaaggaataatagaattaattaaaattcgaaaagaaattggcaaacactaaaatacgtccaagaaaaattcgaatgtggcccggagaatttttgttaaattctccttggtctaaaaggagccctcaaattttagtggattttcagagcccaaataataattattaagaaataaacaaagttaaaatggttttataaaaagaaaaatcctaaaaaagtcttctttttcccccctttcccttactgggccggttcggcccaactccctccctttttttcctttcccccgggggccatcgggcttcttcccgggcgggggccgctgacgggcgggcccgcccgccaccctcgctgacgggtggggcccccctgtcatccctat

SEQ ID NO: 31474 - DNA, 2118 bp, Oryza sativa
ctctcccggctgacgcaataaatgagtttttaaattaaaatttaaatgaagaaattcgtaaatatccatttaaagagcatataaacttcaaatggccataacttggccatttgaactcggaattggaccgttcaagtctctaatttttccttaagaagtcaagacccattttgtgtgctttgtcctgcgtgttatatggagtttattagagtaaaagccttttcttttccgttggtcgtgtagacgctgcagcttcggaagatccgctcttcgtggaagtagaagccgacgtttgggaaagcgagcaaggcaagtcacatcatccttgaacatattggatcccagtttgtaaaattatgttgatttaaattattgcattatcgctttatttaaattcccgcgttatcactgttttatttagccatgcctatttacctttgttatgaccatattattattgctattgttattattaccttgttcaccctagaataaataaaaccccaactagtgggtactctattcatggttccactagtatgaatttaggtagatgcttcgctgattaattaggcaacattaggtggttttataactttagactttgggaattctcatatcatttggatactatggaatgtttggcttatggtggaattggacatacccctctcttcctctttcaaagcccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcagagggttggtgccctgctgctagggggctcaatcctgcctacctgtcccggaggttccggccgtaggtgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaggttagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgattaataattttgtgtagctctagggtcgtctttataaaatggctttgggcaactaagtgacttttaaatgctgttttctgcaaaacttaacccctatattattaccccttgtacccccttgcattaatcatgcatctgccggtgtggcttgctgagtactgtggttgtactcattcttgctctatctttctcccccccttcagtaagagaagctttggagaagaagtcttaggtggagtcttggcttataccccagttgagcgcctgtgaagatggagccgtaggcccgctagtccgctgctgttaatttttgattgtcaggcttgaagcgcctttgtaataatgtaaatattatcgatgtaataaagatgtgtcttttatatcatgttggttgggtgtacccctgcttttcctgggacggggattaatacattagcgttcgggaaaatgcaattttctcggtcgcgacagccggcgatgataggtggatttggtaattggtttgtccgattctgataggtgcacctgacatggcatttccacgattaaataatatatcattctggttgttgccaccaagtctcttgctcctattaagctcagccatagtagaagtgggcagcggcactgggtggacggtctatccgccttaagtggtattaccagccattctggaggagcagttgatttagcaatttttagtcttcatctatctgatagactactgt

SEQ ID NO: 31475 - DNA, 6327 bp, Oryza sativa
gaccttttcaagaaaaccggtcttcgggtatctaggcatggtttatgccatgataagtataggtgttcttggatttctagtttgggctcatcatatgtttactgtgggcttagacgttgatacgcgtgcctacttcaccgcagctaccatgatcatagctgtgcccactggaataaaaatctttagttggattgctaccatgtggggaggttcgatacaatacaaaacacccatgttatttgttgtagggttcatctttttgttcaccataggagggctcactggaattgttctagcaaactctgggctagacattactctacatgatacttattatgtggttgcacatttccattatgtactttctatgggagccgtttttgctttatttgctggattttactattgggtgggtaaaatctttggtcggacatatcctgaaactttaggccaaatccatttttggattacttttttcggggttaatctgaccttctttcccatgcatttcttagggctttcgggcatgccacgtcgcattccagattatccagatgcttacgccggatggaatgctctgagcagtttcggttcttatatatccgtagttgggattcgtcgtttcttcgtagttgtcgcaatcacttcaagcagtggaaagaacaaaagatgtgcggaaagtccttgggctgttgaacagaatccaaccacactagaatggttggtacaaaaccctccagcctttcatacttttggagaacttccagctatcaaaaagacaaaaagctaggcgcacctctcctaactattgcccataaaaaataatatatttaatattattatatattatatatatttgcccttataaaataatatatttaatatatattaattcaattttctattgtgtgaagtaaaagaagaaaaggtctaggctccgtcatgacggaatctaagataagaacctaacagaacgtaaaaaatgaaaaaagattctagactgttaatgtcttggctctggaaggagatcgcgtgcaagtaaactaacgtcgttcgttcggcgaccccgcctcacttcacttaacagaaagggggccctattgagaattacgagcatcgcataacagaaaatctatttacaagctattgattctccgactaccaattctcaggtctgtgcttcggttggagtcttggtccgcgggtggaggttcgcgagggggatattctgaaccagccgctatggcatattgccagccgatacaacttaaaagcgagaccaaatactctatactattactctaaacatcgaatgcaatgagaaattcttcgacagacggacttagctgattgatgtcataagcaatcttccacgtatagcgaaatcgagagttcacgctcagcgtgaaggaaagcacttctactttctcagagctccccatacagtggcacatcaccagccttgccttagttctcttctcgttcaatgctgtcttttcagcgctgatggaagcatgccaaggtgaagttgacgatctctttagcctttctccttctcttcatcttgccctatgagctcatgcagtgagtgccgcaggatgatttagttctgagcgagggcttgacccattgaggagggcatattcttctgcatctctcttgtcggatcgcctccccgtgtccacgtcgtcgaagagatagtctttggaccccaatttcccgtcgtagggagcactcttctgagcccctagattcgccgaaggatgagatcttgcctatgcagtaggatgaacaggaaagttctcctccattgagacccgtggaagactactactttttcttattgaaaaaaagagctttgttatcttacttgctggctagtaaacgctacccctacccttgaaaacttgtttacttttaagggccggagtttacttaaattcaagagggacttaaaggatttctaacttaactgtcctgcttactcattggatgaattgacagagtctcttgccctttaccttggatatacacaagattgctcattcgctgtaaccactagttctagaactgaataggaaaagctatatggcactcaaacagaatggatagcaactgaaactccaagaggtagtatactaatatacttttttccctaaaaaccggctttcctaagatgccttttggtctaagctttatatctatcctatcgctctcttgcttaaattaacttccttccttaactcagatctaaatggcttcctttggatcgacattaacttaggcgtaggtcaaagcacgggcatggaaaagggattatatggcgtgctgggctggatgaaagaagcaactacgcctacaatgagaatagcgggactcccactagctgacagagaactcccagccaaaatgaaactggacttccagcaatagcagcaatgtcactagaacctttcctactggagaataactagaagtttctggggcccttaaggtggaaaaaaatgattaaaaatcaaccatgcttactaaacaactcaatcatgcactcgttatgctccattcgaggtgtaatacctgaatcttcactcatcgagaacaagtatctttgacccagattaacatatccttcacaaatacaagctagcaagggataactgacaagataagtttatgcgtgccacctatcatttgatactgcctgatcaagtctttggatcaagtatgtttaaaaaaaggagtatgcacaggaaatcaagcaagaaaataaatagttgattgaagccatatcttctgtgcgcgttgtagtatgggtgactcttaggaaatcaaacaagtgagcgaagccctcatacccactcttctctcccctccccatacccatcaactactaggttgtggagagggcctcggtgtctctatttgctatgagaaacctacaaaaccatcttaagaaatttagtattcccctaccccttccttcctcaattcaaagtaaatgagcttggcttgattatcttcatccaatttagccattagaagactatcaagttctaagcgagccaaatctgaattaggtatggtattcactctctcatttaagaatttagaaaaatatggacttcgattcctgtcccgttagcatctccgatccgagagttgggatgactctgttagtttcggtcggaagccggacggtaatggacctacaacccttgcttgtggactagctgcagagctaacctttgttctattggtttggtggtgctaccaaaacaatttctttatgcccatcaaagaacctcgagatgctaatccacgaaaaacgatacgagaaatgcgaaagaactcaactacagaacgagggcgacccgtgaaaatacctcgatttctgactcgtggcattgaactctttcttggcaacttggacaacttacaacgatcccgcggaagatcgggttaaaaaattctaaagctttcgtctcaattcatatttagccgcgagcaatctacgtttgtgatctcgtatatgtcgcttctccgacatcttacttagtttccccctcatcttttagcaaaaagccgctccacagtagtaaagtctcatcttttgtattggccgaagtgacaatagtcacattgaaccctcgaatatgctcgaagatctcgaaatgatcttccagttccggggagaattcgcaaaactccgtttccataaagaatttgatggagttttcccatatttcgaccggagaatctaacatagacattactgtcaagattctgaccaaaaaatggtacattccatgccctcggagaacgctttgtcgtgcaaagtcactgacatatccagtgtctttttcggaccccaagaatggattggatcgaaacgactttcctgctttaaaataagggcccctttgtgtctgtatgaatctctgaccgcacaaaatctccataaccaattttccaaattggatttttaaatcagaggcagcttttggtactaatctgatttcaaacaatccaggaacttccataacattggcgtgattcagtttgagcaacagatcctgacgtaatacatcttcgtaatgaaaatggagtggaaacatcatggcttttccgctttttttttgagaatgagcactgtgaactatccgcttcaaaaaggatagttgatcgaaccgaaaccaacgtcaactacgagttattaagcgccgaatccaaataagtgtacttcctttacgcttgatgcaggatttacctattaatatgaagttcactcttctgctgacttgagcccagaagggaagcgactgatttccaattcttctttgctagtgcttgactcctgtggaattccattaacaagctttaaaagtaaagccttttatttggatttttgagatactagttatttataggttaagttcgatatttcactccgtgggccggctaattaatgaaagtaattcctggaggggaatcaatcgaagagattgcctgcccatgctacaattacttactctttaggactagagtgctaagctgcctccccggcaccaccactataatgaatggctcaaacaaataggagatgagaaagtcgagtagcagcactgatgggaacattttttgaaactagaatggttgatagtcaaataggagactcgcgttgtaggtaaggcttttcaaaaccctcgacttggctaacgccctttggttttgaggatcaatttgcccgtgcttgctggtgtcagggttgcagataagttgtttcggtgccatttcctttgttatgaatgaaaggcattttggagatttgctcagttgataccgaatttgaagataagcccttccctctcgtgaacaccttcgtttagtagatcggtacggttccattcagaagaaactattatacggtgtcccgtggagtacgaataaggcttgaaagttttccttcatattgtttgctagcttccttctccttgtttcctgcctttcattctttatgaaattcttattgattttctttgctgactgatgttacaccaagaatttatttaatagcgtatatatagcctgggcatcgataccagccttccgttcgcatgatattaagaaagtgcctactactcaatttcgcattggcaaatccttccacttgctatctaatgtagtatataaagcctttcttttctatttcttctattggctggtctgggggaagcggatcacgcgaagatctatagtgtttaagtccatctttctcttcctgcaagctactgagatatgcctcagctgcaggtgctttgtatctatctctggtcaagagttggcaagggataccaatgttgtcgaccacctacctttgagcatagcttttaccatattcctccctcgattcgccattcattccttcacagctgagtcaatagctgtgtcaactgaatgtagttctttttttaaagaacgaggccgctaaggtcaagggacctgatccagaacattgaatccaaccatcagcattcgcaagaaagagaaagaactcggttcaaagaatcgcttcggtctaaaaacgagtcttccaagatcatgtctatgtgaagagcttgaaccaagcgttcacacgcatacgccctctgaagattggaaagaatccatcagcgagaaaatcaaatcgtattctatagaatatggtagtggtaattatataactgctttgaggaggaagagggaaattgtcaataactgtttgcaagatccacgtatattaaaagaatatataaataaatatgtgcaaacgcactatgaaatccgttatagatattatagtcctaattggaataatatgtgcttattccacaataatatcgaattcaatcaaccaattgtgaggtttcattataattatataagggatatgctttctttaaggagtctctctcctatgaaatttggtgaactctctatgcaaagcagattatggacatctttacaaagattaacagaatcttcaaattatacattgaccgctaaatacacacacaatgtttagtgaatcttatgacaatccaatccaaggatggaacatcgtttgtatgtgggaatttctatgctcttgtcaaatttgggttttataccgttgtatggttcaggtatataccagttagcggtatagaagcgttacccgttgatctgtttccaaaaaattatcatgtctttctcaatgagagggcaaatgtgactgattatagtaaggtagttttcgtggaaacaaaggatcttactccagtagtgctgtctgcctttcaaaatgattat

SEQ ID NO: 31476 - DNA, 880 bp, Oryza sativa
ccctccctttttttgttccctccttatccttcctagccccggtttagcccgcccgccgttagtcgtcgcttaagcatcaccgcctttgggcccctgcgcagcggtctccaccggcggttgccgtggtcgcaacggcgcgtgcgcgtgcgcgcaccgtccccatgaccgctcggccggctttgtgccgagccgagcctagcctggccgccgccgcacagtccgatcggccccgggccgatccgggccgtcgatcccgtggaccggcggtggatcacccgcgtggtcccggtccacggtagaccggccacccgtgcgccgctgacatgcgggcctcgcttgtcggcgccgcaccccccccctccgtgctgacgtcagccctggaatatattgcgcaataaatgatttaaggtttttcttttatagtaataaacacagtgaatcttctaaaattcataactaattcatccgagctccgtttaagcccattcaagtctcagtaaatcaagaaaaatgtgtagaatacattaaaaatggttttgttccctgtttcagtagtcttatagcctgtttgcaatgtttgctttgtatgtcgctagattccgattcctccgacgctccggtgtactttgagatagtcaccgaggttcctccagcagcagagcaaggcaagtcatgcttgtcacttgaacatgttgatcctatagtgcaaatgctctattgttttctttcaaatattgcattgttttataatattactatgggatggttacctattgttacagccatgtttttggatatcttgctcctttgttagcttggggttatagcatgattagagtttggactaggaattgcttagccatgcttagttcaactagtt

SEQ ID NO: 31477 - DNA, 6546 bp, Oryza sativa
agtaggcttcgtccgtgccgtcgaggatgcctgtggagtggtgttcccgctgcagtttagtcaaagtttagtcaaggcttagctcctgttgtctttcttttcttccgctgcatttatgtaagactttatgatgtttgtaagacgtggatctgtatgtcaacattgtcgtttgtgtaccccggctggtcctggacggggattttaatgcacattctgcttggaattctattcgggaatttctgggcgtgacaagttggtatcagagccgaccttgaccgtaggacaagccaaatggaaaaaaacctaagagccctctgaatccttttcattgcatatgttctttgcaattggatttgttccgggaaaattgggatctgttcttgtggttcaagggaaaaatcttgtcgctcatttaagtgggatttgccaaaacgagtcagtctagggttttagtaaaactattgggatttattcgtcagtcagttgggatttgatgggtgaaatgcattaggtcctagctcagtaacatgggttgcaaggtatttatgctttgtttgttattattagtatgtatctaatttctcattattttatcgttatgtgagtctgtcttatttattcgctcttatgcaaactgatctatgcataaaatttcgctcttattcgattcccttatttgagtctttattgctttgtttaaatttggatttgagcatgcattgatcctactcacttgtcttctctagatggccggtcacccacccaaccaccgcggagaaggcatgatcgactttgtggcagagttggcacgcatgacactggtggtgggctaccccaacgcgccggagtacacgactattccaccgctcagtggcgagcttcctcaccgtgtcagcttggaggtccatggctacgtggggacttgcctcgctaacatggcagttgaggcgtcaggaggcacagcagatcacgcctgtcaggaggcagcctacttgatgatggccagactgcgggagcgccacaactacatcttccatgacacggcgtaccgcttccacccccgtcgagccaacggtgatgatgtcagttccttccgtccgacagccggcgagaacgacaccacctttggtcacatgtgtgctgtgatgaggggactggataggatgcactcggacctgcacaaggcgaccaaggccttgaacgatgggaagctcatgaggatcgtcgctctgaaggacgagatagcgcgcctgaagagggagaacgctcagctaaagggtcttccagcgccaggaggagtccggatccgcactacgccccgcaagactatgacggcacccgtgcgcatccagcttgcgcccaggaacccgcctccagcagcagctcccgcagcacctccagttccgcccgcagttcctgcagctccagctccagctcccgcgtccgctctctccttcgctccagcatcagccgccagaggtccagccagtggcaccggaggttggttgtctgctactcccagtggcagccgcgatctcagcagcaacagctccagtggctcacagtcaggcagcggcgagacgtatctgccaggctccaggagtcgctcagagggacctggtgacgagcaggaggacgccttcgactccaccgaccgcaggagccgttccgagcattaggctcgtttttttcccattagtttatcgactgtctagcttctgcttgttagtttgtgtgtttaggttgcttgtttggggtcagtcgacggtcgatatcatgtgcctatgatatggctgtcttaataaggatttttgcttgctcttttaagtgttttaattcagatcagaacaattgcagtttaaattcctttgtaataaagcttagttcctgagcatctgtttttcttcttttcccccgtctgcttttccctctagatggtctacaccaggactggcacccgcacgataggcgagggcagcaacggcgaagaacgtgctgatggtgtgcaccccagcagtgattccggcaatggtctgccaccacttcccgagaatccgacccttgcccaagttatggcacatcagactcagatgatggcagccatgatgcagcagatgcagcagcagcaccagcagatgcaccagaggatgatgcagcacgccgaacagcagcaccagcagtttggtccccctccccctcagtccaagttgcctgagttcctacgtgtcaggccacccaccttctccagcaccaccaaccctatggaggcaaatgactggctccatgcaatagagaagaagctgaatctcctgcagtgcaatgatcaggagaaggtcgcttttgccacacaccagcttcaagggcctgcgtcggcttggtgggacaatcacatggccacccgcccaccgggtactgaagtcacatgggcagagttctgccgtagcttcaggaaggcacaggtgccagatggggtcgtggcacaaaagaagagggaatttcgtgcactccatcagggcaacaggactgtgacggagtacctccatgagtttaatcgcctcgcacgatatgcaccagaggatgtccgcaccgacgccgagaagcaggaaaagttcatggcaggtctggatgacgagctgaccaaccaactgatatctggggactacgccgactttgagaggctagttgacaaggcaattcgtcaggaggaccaacgcaacaagatggacaggaagaggaaggccgcacagttcagggcacctcagggaagtcgccagaggccgcgcttcactcccgggcagcagggtggacctaccaccatgatcgtccgccagtaccgcccgttcaatcctagcaactttcctcagggcgccagtggcagtcagaaccaccatggaggtcagtccaaccgcggtgcagctccacgtccaccaatggcaccggcacagtcaggcccgcccgcgcaagccaagaaggagactggagcaaaaacagggtcctgcttcaactgtggcgagcttggccacttcgctgacaaatgcccgaagcccaggcgtgccgggccaaggtttatccaggctcgtgtcaaccacgcatctgcggaggaggcacaagcagcaccagaggttgtactgggtacgtttcctgttaactcaatccctgcaacagtactttttgattctggtgcaacgcattctttcatttcaaagaaattcgtggggaggtatgggttaaggaaagaagagcttagcacaccaatgagagttcataccccgggaaatagttcaacctcagtcagttttagcccttcagtgctaatagaaatccaaagatcaccatttctagccaacctcattcttcttgaatccaaagacctagacgtcattcttgggatggattggctgaccaagttcaagggagtcatcgattgtgcgaatcgcacagtcaccctgaccaacgagaagggagaaaccgtggcgtacaaatcactagtctcaccaaagcaaggggtctctttgaatcagattgaagcagaaatcccagtggacaccgtggagaagaacttgaggaaaatggaatatatacccatagtctgcgagtatccggaagtgttccccgaagacctcactaccatgccacccaagagagagattgaattccggattgacttggcaccgggaaccgccccaatttacaagagaccgtacaggatggcagccaacgaactagcagaggtcaagaagcaagttgatgagcagctgcagaaagggtacattcgaccaagtacttcaccttggggtgctccggtcatttttgtggagaaaaaggataagacgaagaggatgtgcgttgattatcgcgcactcaatgaggtcacaatcaagaacaaatatcccttgccgcggatcgacgatttatttgatcaactgaaaggagctaaagtgttttctaagatagacctgcgatcaggctaccaccagttgagaattcgggaagaggatattccgaagacggccttcaccactcggtacgggctatatgagtgcacggttatgtccttcggacctactaacgcacctgcattcttcatgaatctgatgaacaaagtgttcatggaatttctggacaagtttgttgtggtattcatcgacgacatacttatctactcaaaatccgaggaagaacatgagcaacatctccgtctggtactcgagaagttgaaggagcaccagctatacgccaagttcagcaagtgtgacttctggttgacggaagtcaaatttctgggccatgtcattacagcccagggtgtggcagttgatccgtcaaacgtagagtcagtcaccaagtggatcccaccgaagaccgtgtcgcagattcgaagttttctaggactggcaggttattaccgccgattcatcgaaaacttctccagaatcgcccgacccatgactcagttgcttaagaaagatgagaagtttaagtggacagctgagtgcgataagagttttgaggagctcaagaagaaattagtatccgcaccggttttgattttgcccgaccagatgaaagacttccaagtctattgcgatgcatcccgtcacggacttggatgtgtcctaatgcaagagggcagagtggttgcgtatgcctcacggcagttgcgtccacacgaagggaattatccaactcatgacctagaattggcagcagtggttcatgctttgaagatctggaggcactatctaattggcaaccgctgcgaagtatatacggaccataagagtctgaaatacatcttcacccaaccggacctaaatctccgacaacgaagatggttggaactaatcaaagactatgacatgagtattcactaccacccgggtaaagccaatgtggtggcagacgcattaagccggaaaagttactgcactgccctatgcatcgagggcatgtgtgaggaattgcggcaggagtttgagcatctcaacgtgggaattgttgaacacgggttcgtagccgctctggaggcacggcctacgctcgtggatcaagtcagagtagctcaagtaaatgattctgaaatagcagagctgaaaaagaatatgagagtcgggaaagcccgggatttccacgaagatgaacacggcacaatctggttgggagaaagattatgtgtacctgacgacaaggaactgaaggatctgatactcactgaggctcatcagacccagtactccattcatccaggcagcactaaaatgtatcaagacctcaaagaaaagttttggtgggtcagcatgaggagagaaatagctgaattcgtcgcactctgtgatgtttgccaacgagtgaaggcagagcaccaaagaccagcaggtttactccaacctcttcaaatcccggaatggaaatgggaggagattggaatttactttataacgggactgccccggacatcgtcgggtcacgattcgatctgggtagtcgtggatcgactcactaaggttgctcacttcataccagtacataccacatatacgggcaaaaggttggcggagctttacctttcgagaatcatgtgcctacatggagtacccaaaaagattgtatctgaccgagggagtcagttcacctcaaaattctggcagaagctgcaggaagaaatggggacccgtttaaatttcagcacggcctatcacccgcaaactgatggtcagaccgagcgagtcaatcaaatcttggaagatatgttgagagcttgcgctcttgattttggtggagcttgggacaaaagcttgccatatgcggaattctcgtacaacaacaactaccaggccagtctacagatggcaccgtttgaagctttatacggccggaagtgccgcacacctctcttctgggatcagacaggcgagcgtcaactgttcggaacagaggtattagcggaagcagaagagaaagtcaggatcatcagggaaaggttgagaattgcccagtctcgacagaagagctacgcggataaccgtcgaagggagctcacttttgaggtaggagattacgtgtatcttcgtgtcactccgctccggggagtacaccggtttcagacgaaaggcaagttggcaccacgcttcgtgggaccatacaaaatcttggaacgaaggggagaagttgcttatcagctagaacttccatccaacatgatcggcatccatgacgtgttccacgtgtcccaactaaagaagtgcttaagggtacctgaagaacaggctgattcggaacacattgatatccaggaggacctaacatatgtggagaagccggttcgtatacttgataccagcgaaaggagaaccagaaacaaggtcacccggttttgccgagttcaatggagtcatcattcggaagaggaagcaacctgggaaagggaagatgagttgaaagccgcccatcggcacctctttcacagctcctccgaatctcggggccgagattccgtttaaggggggtaggtttgtcacaccccgaagttttcctcccaagccaaaa

SEQ ID NO: 31478 - DNA, 15643 bp, Oryza sativa
tgaaaccaaatactatgataggattgattggattaaatagataggaatgattggattgaatagaacaactatgaaacataatagttgattgaatagaatgttggtctcacaagtcggtacggtgtgcatatccatccttggaagaagtagctccgtcccagtctttgtcggaacttgaatcgaggtaggcaaaagaatccttactcggaacgagcccaagataaaaggtctagtccaattttagtcttggttgtacatcggtactacgcacggtaggcatttcttcccgttatcgggacttgcacttgcccggccttagtggtattttaatgattttcttccccagcaaatcaagtaaatagaagtaataattcaagtcccaccgtggatttgaacatacttcgcttcgtggagccgaggattagatcgatctgaactttcatttcttccattcgcagtaatcgttggttttgtccaattccttcaatcatcactgttttgttctgtaattccatttcattttatctattttcttcaagaaattccattgatgtgcttttctattgctctcattcattcctattcaatctattcaaaactacgggtactggtctcaatgggaaagagccctaattcaatatgtcgtttctagagtatcagcaagtggtaagcggattacaagcaagcggcgaaggtttgaattgactagcttgatccctactattaacaaggaagaagtaagcaaagcaagaaagaaagtaagttcagtctcttatttcgaagttcgctgtgctcttgttcaatagacattctgctggaactcacctttatctttagagatgatgataaatattctttagagactcctctaaaataaaagaaatactttacaagaaaataaaaattatgtttatacggacggaattcggtctatcctttattgaatatcattgggcctgcctcctatctatcaactcattactctcctttgttctctggtaagctctcgcattgccttaaaacaagcattctttcgtattcaaagaaggtttgcttgcatgttctagcactggaagagacgaatattggttgccggatgctattcacatgttaaagcacaaaaggtacctcaaagtttatagttctaagctgaagaaatagcctgagtcaacttatcttctttacaacctccaaacaaacgatttaggaaatggaaattggaaccttttggagttacctagtagcattggaaaccttatgttcctttgataccttggcttctttgatttagtgattaagctacctctacctatatgtttgcttcaaaaacgttctagcttgcgtattctgatcacacaatggaattcaggtggaccagggtttgggacactaatctttaaattatagatgcattataacatgtcaagggaggcgccgagatatgatatgaccaaaggccttgttgttgttgcgagccgggctcgaactgacaaggagagtggagaggaatacagtagtagtagtcgggccaggggcttatcttattccttgtattcattggtctgtataggggtgtcacaccccgaagttttcctcccaagccaaaattgtaatttttataaatgaccctaagaaaatgcaggtgaaatcaggagaaaaccctaagaaagtaatgcaaataataatcggatttgacatgtggaatttttcttgagttctacatgtcgaaattcattaacaggatttttagtggaattttcagagctctagaaataattttaaccaattaaaattgagcaagcaatattttaattccagggaaaatcctttttcctttttctttttctttttcctctctttttcctccttttttttcgaatgggccgccggcccattccctccttcctcccctcctccttgctgggccggccgcaggccgaggcccagccaggccgccctgccgcctcctctctcggggtcgccgacaggtggggcccacctgtcgggtccttcccccacctcccgctgatctcgctcgcgccgtcgcgcccgcaaccgccgccgcgccctcgtctccacctcctccgggccacgtcgaccacgcccgcgcgtgcgccgggtgttccgcgcccactccttttcctcttccgctcgcgcctgcgcccgagatcgccgggattcgattttcgaatcccgcctctctttcctcccccacttcccacgtcggccggcgattcccgcctctctcggccacgtccggttccctctccccctatttaagcatcgccgtcgtcccctctcactttttccccatttcgccgcactctctcgagcctcccatcgctcccgcaccgtgcaaccccttgccgccgccttttccgctactccggccgccgctagccgccgttagggtcgccgccaggccgcgccgtcgccgccgtcgggttcgcgtggccgagatccaccccgtccacccctcctccgtcgaggttcttcgccggagccctcgttccctcgcattcgggtgagcaccacctccaccgccgccttcggccatggtttccggtcgccgtggtccatctccctctctctaatccctctcttctccttccttagggcaccccgaagctcgtccgcccgccgacgtcgtcctcccgtggcttgccgtcgccgttcgccatcgtcttcctccgcgccggccaccctcggtgaggcaccccctcccttttttttttcccctccctctccctcctagccgccgctttagcgccgccgcccgttagtcgtcgctttagcatcaccgcccttcggcgccttgcgccgccgtctccgccggcgtttgccgtcgtcggcaacgcgcgtgcgcgtgcgcgcgccgtcaccgtgaccgctcggccggctttgtgccgagccgagcctagcctggccgccgccgcaccgtccgatcggccccgggccgatccgggccgtcgatcccgtggaccggcggtggatcacccgcgtggtcccggttatagcatgattagagtttggactaggaattgcttagccatgcttagttcaactagttcaccatggggaaaatcatattaatgtttagactgttggttcttatgataatgttggattagtaccaccgctctggtgttggttaattaaaatgaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggtcctgcgacggcctatgcggcttccggattcacctaggcacgagaggggactgcccgctgccttgcgaggagtgggggtgaaacctgaggtgtggtgtgcttggttagagggggctatgcgaatggtcctgtcacggcctctttccggtatgtcgtggtgacatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtttcaccttagtgtaatcctttaatttggatagtttaggtggatggttgggcctgtcgcaacgtgggttagcgttggacagtggatagttaatattaattaattattacaactgtttaaatctttcaatctctatttataaatgctcgctttatgcaaatgaaccacttcagctcttctttgatgatttccctgcatcatatccctattccggtatgacttgctgagtacagtgggtagtactcagtcttgctctacttttcccaaccccagagttcgagttcgggtcagatgaaggtttctctgaggagtaggcttcgtccgtgccgtcgaggatgcctgtggagtggtgttcccgctgcagtttagtcaaagtttagtcaaggcttagctcctgttgtctttcttttcttccgctgcatttatgtaagactttatgatgtttgtaagacgtggatctgtatgtcaacattgtcgtttgtgtaccccggctggtcctggacggggattttaatgcacattctgcttggaattctattcgggaatttctgggcgtgacaaggggtcacatatagttggtgtgctttgtgaactgcgatcttgacggtgagactgataggaaaatgtctgaaaaatggggagaagccgagtaggataggactcgaaagccgagctattaattgaatcatgcttttgattgaacgacaaaacatcgatctgttaaagtcgataattctgattcgtcttcggggtatgccgtaaagatagccgagaccgaggataggtgccgatctgttttacgggcagtaagtaccgttgttcgaaaggaaaggttggcattgcctaaaccaaggataggtttgaccctaggattgggattttagaaaaaaagggatagcgctcgtcttttctctactctagcgtatggactcgtcccaggattgccggagctagcattaggtgagattcctttgattgaatttagcttgccatcatggtacgctgcagttagattaggaaccgtataggcggcctcatatacccggaagctttggattcacggatccgaaacaagacatattcactgctactgatatccctccctttgctttgaagccgaagataacgataggatttccggaaccgaaactattattaattataattagattgcgaactcaggagggcttagtaccagctacaactatcaaatccgttaaggagcagatcaattggcttagccgaaaccgtgcccttatcttttctttgcattagccgaggacaatactagggatgcgggaagttccgagaataggattcgattccccgatcttctaattgagttggatcggcctagtccagagggagaggagcaatcaacgctaattcgtattgcgataaatcgtagtcatattattattattggcgtacgtaatttctttactacgtctatcgctcgtaggaatatctctaaataggaatcgtagtcctcgtatgtacatgtttcgtattgtgataaagcacctatgccgctagaaatagtagcgccttaaagaaggcgttatttacaagatggaatagtgctacgtcataagcagaaagaccacaagccataaatgggttacctagccacataattacagacagggacccaactcttaggccagtccgaagggcattgatggaacaaacaaaggtagaagatcttgattctctgcaattcggcttcaacccgatggagctctcttcaaaacatatctttcggcgtcagtctttcctgccttaccttaaccccgctttcacgtggcgattcggtatgaggtttctctgatctgtttacggtattcttgaagctttctttcttggtcaccggacagagtgagaactgctctgctttctttccctagcacacacttagtagatagtaggcacaactccgctaagagctcatcgaacttgagttctagagtaagaccacagctcgatatggctcattcactagtatggtttaccacatgccagtgatagatctctctcaagtgaggtctggtatcggtgaagtcaatcattgaattgaagtggtagagtgcatagcggggcataaggccccatgtatttcttatcagtgtgcttataccttgaattcaattgatgctgttctagcttgttttaaacaagttatagagtttgttttggttccaggtggtcatcccaactcgaattagctatcgaaaagcagtacttacttgagtttcccgctttccataacgaatcccccactgaaagcaccacagggagtgtaaccggaggaggatgttgtcttttctcactcacccagtagtcgagggtgtattattacccgtttcactgacatctgccttcccttctctggagcagttatgtagataggagtggtaggaatcagcgagcatgttgccattcgaggtagtccaaccttcctattaattagaattctgggtaaccctatcgttgattgacggatcggagggactaaactgttccctttccttcccagggctaggttatctatttcctgttcgtgctgcgccatcagattaatcgtatcgtgatcctggtatcgctcgagcatctctttctgatgaaacctttgcccttgctttctccactacacctggtaacgcacagtgcttctttcttcgatctatccaagggaggcttattgctttaagcagagtatccagttctgcatccgttaatgatttctgaacatagagaaaagaattgatagctaaagttttcttttagtagtttagtcaccaatcaaaaaagtagctaggctgaagccgaagcacattccctagcgtacgagatatgccttttaggaaagagatcccttttatgagcaatggtttttgataatgctaacccctgttcaaagcaaaggtcgaagctggccaccctttactcggcatccgttctcatatgcatagatgctccgagaagcttcttttagttagccaagcgggtcatgtggatgggtcaagagatgcgtaaacgtgcccaacaaggggtaggtgtggtaaaagggtatgcgggttgatgtgtctttcaccttgctagtaagagtggtatccttattggcagcaataccccatttcagtttctggatttgcggaatgatttgaacccctattttaaaaaccaatctatttggcccggtacggttttccttcaataccactcctacgatagaggctgatatgactacgagcgagatatgactattcctatccttaagcgaatgctgaatgaaagtaaggtcttccctcgaagtgaaatgaaagcaaagggtattgcaaatcaactaattgttctctaataccacctcctcctatatctactattggttgactgaaaataaaccaaaagcaagggtggttgcacatcttctgaaaagataagggctcggtatcggctcaatcgaacaagctgaggtatataaggaatagcagaacatattgattatcctattggattggttccgctcagtcgagatatgatgagtcaatgggcattgagagtttcgattcaatgtgggaatgactaagacaagttaggcgaaacagatatgcaccatagaggtttatccaccttaggtttgtagacaagaatagtagtcacagcgagggatgcacataaataagatctgcactggtataagtgataggttttgggtaagctcgctcatatcgaaagaagaattcgaaggaaatgaagcataagctgtcaccactaggataaatcaaattgaatcctaggctgtttcgatagacaaaagaaaatagaaaaaagtagtgagtgagaaagaaataagtatgcttggaaacgaagtagcagatttttgagtagtcttttcttggctggtaactattcaaacagagctagccctctttcttgatacctatgtactgtccacatatagtactgtttcgtgaaaaaccaataggcattctacacagagaacaattcaaagctgactaccatatactactgtccctgctttacctgctgtccaagtaagtactaatttcgaatgcgaggttgtgtagcaaagctacaagccgaaagtcaagaatgaactgagttaactagctggtagcactgtcctacttgtctattcgttccaactattctatttgtttgcttgctggaacaagggaatatagggctgctgagctgtccaagtagaagtagctttcctactagttgttccaactaaccaacaagcaccggattgagcgcactagcgcgaaagcgttagcacgcgcatccgttttcttgctccactcataagaccaatctggtaaatcaagaaatgaagaggtattggtatatcaatgaacacactccatagagtttctgctcaaatcagagtgttggaaattaagaaacagtttcatcccgccttccactaatccccgcatttcgctcaaagctgctctctcatttcttcgcccttaggaaggtctctactgcaactgagtttgaaagcttttactcatcaaatatttttggcaagtaaagtaggtatcaatctgcttgaaagcctgcagagtccaattttgagtattttcagttagaatctagagtcagcctattcagttcttagcccttaagggtaaggcagggggtaatatggatagtctctgtccctgtattcacattccaccttcaacaaagtgttgatttcccgtaaagctaactgtagtcctttaagtaagtagatatcttaggcaagttagcaatctcgttatattaccaaggccttcccttctattgtagaaagagttctcagccatctaattgcagtgccagttgccagctatccagtttcatttgaagttgctgggggtccaaacgagctagttgcttttattcgtcctataagtccttccacaagcgagtcaatagggtgctggctagttgtagttgttggcgtgcctttcctttcatcttgaatattaataaatatttggataaattactttagaataagaagttcatgttttatagactagtaagataactaactagttaagtaatacgaatccatactaggaaaatgaaaatgtgagtcctaggcactggaattggttctcttctccctaatccctataagccagaaagggtaataggcttcagtgtaagcatttccttcaagcaagtcatctcaagtttgaaattctagagaatagctccgatcaacccattttagtttggttctgcaattcattcgcataaatgaaaaaaaaagcgagatgtgcacgaaagaagatcatagttcagctttaaaatggtggtgtccctgtgttagtaagtggttgaaatagctcatgggagtgtctgccccattcgataatggcatttatgatctagtggagtgagtgattgtgtggtgttcagtctaaggctttttgaaaagcggatttctcccttctctcatccatcgtctttgttaaagtatggaattctcacccagagctgcggaactcacgactctattagaaagtagaatgaccaacttttacacgaattttcaagtggatgaaatcggtcgagtggtctcagttggagatgggattgcacgtgtttatggattgaacgagattcaagctggagaaatggtggaatttgccagcggtgtgaaaggaatagccttgaatcttgagaatgagaatgtaggtattgttgtctttggtagtgataccgctattaaagaaggagatcttgtcaagcgcactggatctattgtggatgttcctgcaggaaaggccatgttaggccgtgtggtcgacgccttgggaatacctattgatggaaaaggggctctaagcgatcacgaacgaagacgtgtcgaagtgaaagccccagggattattgaacgtaaatctgtgcacgaacccatgcaaacaggcttaaaagcagtggatagcctggttcctatagaccgtggtcaacgagaacttataatcggggacagacaaactggaaaaacagcaatagctattgatactatattaaaccaaaagcaaatgaactcaaggggcacaaatgagagtgagacattgtattgtgtctatgttgcgattggacaaaaacgctcgactgtggcacaattagttcaaattctttcagaagcgaatgctttggaatattccattcttgtagcagccaccgcttcggatcctgctcctctgcaatttctggccccatattcagggtgtgccatgggggaatatttccgcgataatggaatgcacgcattaattatatatgatgatctaagtaaacaggcggtggcatatcgacaaatgtcattattgttacgccgaccaccaggccgtgaggctttcccaggggatgttttctatttacattcccgtctcttagaaagagccgctaaacgatcggaccagacaggtgcaggtagcttgactgcgttacccgtgattgaaacacaagctggaggcgtatcggcctatatccccaccaatgtgatctccattacagatggacaaatctgtttggaaacagagctcttttatcgcggaattagacctgctattaacgttggcttatccgtcagtcgcgtcgggtctgccgctcagttgaaagctatgaaacaagtctgcggtagttcaaaactggaattggcacaatatcgcgaagtggccgccttcgctaaatttgggtcagaccttgatgctacgactcaggcattactcaatagaggtgcaaggcttacagaagtgcccaaacaaccacaatatgaaccacttccaattgaaaaacaaattgttgtgatttatgctgctgtcaacggcttctgtgatcgaatgccactagacagaatttctcaatatgaaaaagccattctaagtactattaatccagaattactaaaatccttcaacgaaaaagggggattaactaacgaaagaaagattgaacctgatgcttctttaaaacaaactgcgaaggagattaattagatagacctttttatttttcgtcattcgatcacgaaaacagggattctggaacggccaagaatcccagcggttgttcgggtcgaaaaaccgagaacaagacatgccacaaagtggcagatgaaggcaggggggagagcctagtcctcaacctcttcttccccaaaaggtagttatgaacgtgccaaacttattggatttattcttggaatgctcataaccacctttactctttttttcattctttactcagaggaagccatgccgtttggagaagagcaccaagtggggggagtgtggagtccccgaaagaggagctttctaaaggcaagagaaaagctccgatggagcccttggagctacagggaccaccaacccttcgcagcttggacgatttgattcttgtgccactcagccctgaggagggcgcctgctcgacccagtcaggtactactccgccgccggccccgagtaactctgcgggggtcggtgcagccctttcttctattccggagtgcataaacaaggatcctcaaaaagcgaaatcatttcgttaatggcatttcagaaatgagtcataggcgcctgtacaatgacagaatagagagtcctttttttccagaatgaatcattctattcaaatctcacaagttctctttacgcgtcttctaggggcattgttgaacgcaatctgcaggaacaagaaatgattctttcttattttgaaacagaattcaaaataaaggaggatttaattcggttgctttatgaaggccgacgccgtgccgatagatacgttatacacgaaacgaaaatagccagtacggtggacgtgttcctttccaaaaaaggattatcaggagctcccagtgccgagggggtagttcaactcaagaaggagcggtactttctggaaaatcccgggaggaatggagctcctttgtatagggaactcgaagaactcttctaagggggccgcaagccgaaaaaaagcaaatctctttcgtgattttgtaggtgtaggtatatagtgaagtgataccgaggccctctccacaacctagtagttgatgggtatggggaggggagagaagagtgggtatgagggcttctcttgccatccatagccccctttctttaaaatgcaaagtggacgttcccgcacgaatctctggaatttggattcctgatattgatcactagaatcaagctttttatgaggctctctgcccgctatgtaaaataacctgactctaagtagttacatactactctatataacataaaaaaagcaggctacccataacgggagaaccaatcctcattgaattggatttatcaattcgaagggggggtcgtacaaggtcagcagtaccccctgtgaatccaccgcctgtatgataagttcttaatgttagttgagtgctaggctcttcaatagattgaaccgcaataatacctacggcttcccccaattcggggggggggggcaatctttgtttaaggatgttggataggtgattcatcaatgatgccgattgggaatctaaggagggggctccgccctagtaccgctatatatccatcttctgatagtgggtggttttcgtacgcgtagcgccttgctaccaagtgccagtagtgtaggagatccctgcaataagagttgtgagtgaaatcggttgcttgttgctagcgggaaggaaggaaaggtcagattaccaaaaaagccagctgcatgtatactcgtaggaaagacaagatcagatagaaccgatagaaagtaagaagggtaagcaatcctctgattctatttttatagtcgtccgtcatttgatcgatagtgcaagcctaaaagtcagctatttaaatagtcaggtattgaaatagcatggtattaaaagggtaccgaacttctatactataatagtaccgaaggccttttcttgtctcaccggatatgaaatgcaaccttctactaaaagtatgggggataatatattttatctaattagtaccctaaggatactcttttttctgcacgaacgatatagaagtactatctatgtatttggttacctatgacctattaccaacttaactatgttggtctttcccattgaatgtcagtcttgaaacattgccttgtatattcagaacagtaatgaaatgtctctgaatctggtatccaaacgttgtaagtcgtacccggttatacgtatcacccaacaacacgtcaaggatggtatctcttgaataggcgtatgaaagatttcttgcttctttcgaggaaccggacactggcgcttgggtaaggcgttctcgcagcaaaatccttcgtgaggtctatctactgggcttgagtttgaggtctacaccgtaggtagggtcttctaaaaaccacatgaaccttcactcttctgtctgaggagggcaaatataggtataaagcctgggcgagtgtctttgtccagcgcgagaaagctcggaattgaatgctttgaatgcgcaaaatgaatgctttggaacagttggtactttcagatcaaactctccatgatatattaggttgtttcaccaatctgttgaattggaatagagctcacgaccgtgaaacccctcgttgtttgatggcacctatcttgttcccttcggggagaaatactactcttgtttttcttgttcttctttctcgaagagatgggtgcaccgccttggagaaggtagcgtgcctccaaggtaggtggtacatatatatacatacatgtacatatacatatatatacatacatgtatatatacatatatatatatacatacatgtatatatacatatatatatatacatacatgtatatatacctatatatatacatacatgtatatatacatatacatatacatacatgtatatatacatatacatacatgtatatatataatcaaccatgcagcaaacagggccatgtaaataaaaaaaaatggtgcaccgatctttagtcccggttggtaacacaaaccgggactaaagatggtttggccggccacgtggctgaccgatctttagtcctggttggtaacacgaaccgggactaaagatcgatctttagtcccggttatttcactcgggactaaagatagctatctttagtcccggattcgtagtcccggttggacaaccgggactaaaggggttaccaaccgggactacaaacggtttctccactagtgtcggcacgccaccagaacgacacgtgacaagacaatgcacaccagcctcgcgataggctttcaccacccttgtgtggataagggtggactgtcaggcagtatgattgactgccatgccgcgagactggagccacaaccatctcgcagtttctcttatccgtggctgataggcgggcccacgggcgtcaaccgtgtttcaggcttctactctaagctttgctagcatgctcaggacacgcggcgggtcggcaaggtctccgttccatctaggcttgacgaccaggcccactcaccaagaagaaccacgaccaacatatacctaacccctatgttgaggcccatttgtaagaaaccgatcattgtgatatccccttgcaactataaaggaaagaccaaaggccacttaaaaaagagaggagctaagttagattctagcctcataacactgaagggttcatcctctactacttatatcaacactaagaactaattgtaagcttcatcatatagagcaagaacattgaagcggcctgaacctgtctaaacagcctatccctatactctgcacgattatcaccttgtttccgtgcacccgctgcctggccgaatcccaaaaaaggggtgccactcctcctcgctagaggagctaaggctatgacaacggaagttagatgtggagcgtgtctagtggccttgtgggtgagccgctaggagtaccgatcgtctaacagctaggaaaactaaactctccaaaaggctcaaaatttgccaatctaaccagttaaagataagaacgattgatgtaaaagaaataaagtagagcattacaacttagctgcgtgcatttcaacaattatggcatccatgactttgtcctagcgcagactcgagggcagcatagcaggacatgagtttgaggatgtgtatatagatggccaaatgggccggtcggcctggcctggcttgggcatgaccaggcctgagcctgagaatagtcgggctggcacggcgcaacctactgggccgggtagtgcctgcccacgggctgcattagcggcctaggcacaaaaacccaccgtgctcctccttagaataaatctatttagcttgcatggctggaaaaagtctattacgtgtccctcatttctttgggccatgcttattggctgaaataagtctattttgcctccctgatcattggaccttgccgtgcggggccagtccaccttgtcgaggtagaggaccatgcacacactactacagcaccaatttttccgtgcgggctagccaattttcgcctgtgggtgggcggcccgcatgcacccaatcgtctgggaaaaccgattaacaaaaaaagaaacaaaaaaatgaaaaaagaaaccctaaccctaaccctaatctgccgccgcctagccgaggcccgccgccgtcaccctcgcggtcgcccatcaccgccgtcgccctcgcggtcgcccgccgcagaacacatcaagagaagacatcacacatcaacaagaacacatcacatgaacacatctcacatgaacaaatcacacacaaaaaacacatgtaacaaagagaggagggggagagatagatccggtcaccggttgccgacgcatgccggtccccttaccctccgccggatctgcaagggaggagaggagagccgtgtggcaccggccgactcgtgccacctcccccgaatctgcaaggggaaggaggggagggggc

SEQ ID NO: 31479 - DNA, 7566 bp, Oryza sativa
gatccgccacccccaagcccccccccttcgccggatctgcacgggaacggaggggagggggcgcgcgccgccgccgctgtcacccgtggcccccgcgtgctctcctcccgccatgtgccgcccgatccaccgccccctcccccggatctgcaagggaaagaagggaagggggcgagccccgccggatccactgcccccaacccccctccgctggatctgcacgtatgggcgacagcctggagcctgtcccctatttttccttgcggtttcacttacgatccgtatgggaaaaggggggggggcgtccaggaaaatctattctgtagtagtgacaacccaatggttgggtcgggcctgcacaggactgacccagttaagccgtgttgtactagggctgggccgtccggccccaggccttttggcattctatggatgtgtacattgtccgattggggcagtatcggatgtacgggagcaatgagccgggaggggagtacaatctgagcatacaggatccggactcccgaacggacgcgcccgcgaggagcgacacgctgtagcagtcgacggataaattttggcaatttgaccttttaaaaaacttatttgaagaatagaccatgtcaaaaatttattacaaaaatatatcaaaacctcagcgctaatgggtttagcgctgagttataatatctcagcgccacatattttggcgctaaaaacctatccgagtagccactatacatcatatcattggatctgagcgccaataccacaggcgctaaggttttggtctatttttgcaatatgtttttgacatggcctattcttgaaataaattttctaaaaggatcaaatcactactggagaactaatttttgttgggtcaaccaaaaatcacaatagtcccggttacaaaaagaaccaggactaaaaatcatctttaccctggttgaaaagcccataaccattttatgatctttagtcccggttgataacatcaactgggactacatatcattttcagtcccggttgaaaaagtgtccgccctcctacccgttttattcccgtttggaaacaccaaccgggacttaaaattggcggataatatataatcccgagcacttatcctccaaccacctctacccttatcctcgtccactcttttcttatcttctccctttcctctcgctcttttcctctaacttatcctctcaagtgagcgagcaggcgggcacgcaagggagctagcgaggccggcgacagagggaggcgcggcgggcggcgacgtgcgcggtggtggccggtggccaacggcctacgcctcggttggatctgagttattttttttagaatttgtgattccaatgcagatttgatttgtgattaatctatgatgtatttgatttgtgtgcgatgtgaatatgtgatgtatttgtgatgatatttttagaacttgtgatgtaatttttttttatgaatttgtgatgtgtgtgtggagatgatcgatttgaggatttggagatgatccttttgttctgtgatttgtgaggatcgatttgggatttcacaatttggggatgattttgggatggagtgaaatcaattttcaatgttaaaaacaatgaaagaaaagaaaaaaactggcaaccggacctggcttggctccatctttagtctcgattggtaacactaaccggaactaaaaatgaatttttaatcccggttatttcacctcccggattcatggtgccggttgcataccgggaatattgggggttaccaaccgggagtaaaaccccctttctctagcagtgaactgtcaaaattttggcaaaaactttacggatattttaagtaggtatctaatccgtaaagataaagataaagaataaaataaacataaaaataaatttgatcatcgacttgtggcaaacataaaattcctttatttaggatggagccattgatggactggacatatccgtctcaacaaatgacttaccatcatacatctatagtgcaggtgataacattttgagcttgcatatcttgcagagctactgtacgattatttaaaccaccctagttctattattcgacgcactagggagttttatatccttgaactggagcctatagcttcgtcgaatgcagaagacgcgcatgcatgcacgcacgcatcgacgcatggtgcgtcatgcatcatggctcggcataaagatggtcccgcagcctgggcttgacaacggcgaagaaaagggatcttccgcggcatggtgagcccgaagatcttttccatgctcagctcgccggcagcgatgccgtcggggaggttccaggaaaaggcgtgcagcaggttgcgaagggcaagctggatgaccttgagaccgaggctgtacccggggcacatccgccggcccgtgccgaacggcagaagctcgaagtctcgccccttgacgtcgatctcgcttcccacgaaccgctccggccggaactcctccggcgagtcccacagcgacgggtcgcggctgatggtccacgtgttgacgagcacgcgcgtgccggcggggacgtcgtagccggcgacggtggcgtcctcgcgagacatccggggtatcagcagcggcgccaccgggtgcatccgcatcgtctccttcatgatggcgtcgacgtaggggaggtgcgggatgtcgctctctgtcaccaagcggccactgccgacgacgttgtctagctccttggtggccttggcgaggatcgccggattcttcaggacctctgacatggcccatttcacggtcactgcactggtgtccgcgccaccggcgacaaggttctgcacaaggcatatatgccaaacggtgcactgtatcaaaatgtcgtcctaatagttatatcaaaaaataggataaaaattagacaagacaaaattactatatttattagaaagaaaagttaaattcgacttgcacagagggaaaatttcaagctgtgaacactattatttttttttcacgtgactacgacgagaccgtacgctggattgttactattagtctacgacgaaaccgtacgctggattgttactattagtctagtacacccaaaagtgcatgcattttttttttgttcttatagaattttctcttaaattactcatccgatttacgatccgatttcatgattatattttttatgaaaaaatacaaattacttttataatttatctaaattacttttagattttattaaattgcttcttagtcataaaagtaaattcactgaagcctgaaagtaatttacatatactatataagtaacttaaaagaaaaggaaagtaacttgttatcgcattaaaagtaaatatgttgtggggtaaaaacataagtctatctagaaattagatttaattgatgtgttaccccacaactgatttacttctaatgccgtgagaagttattttctttttcttaagttactgctataatatatataaattgcttttaggccttattaaatttacttttatatatctaagatgtagtttagtaaaatctaaaattaatttgtatttttttattaaaatataatcatgtaagatcttgttgtaaagatttaattgttacggacacaatagtgtattcggatcgtagttcggataagtaaattaagagaaaattttatttgaagcaaaggtggtaggaacatatttgatacttacttgatagacaagtagtatatttggacaacatctgatgatgtcacttgttagcactaaaacgagatgtctctcgatttagattttgctggttttttttcacacgttagttcaactagaaaggtagcccgcgcattcgcgcgggcatataagatacgcttttgtaaggtgtaatatcgaccgggtgacacaccactcttgaaaaaatacaatttcttataaattttcttcatctacattgctcagatatttttttacaagatatctgtaaggtttaaactatataatatttaattcactactataagctgcaattatcagtaattcttcattttctagaaaaaaagcgtcaataaatacataggagatatacatattgtacagctcgcttccctattatatatgtgatctttagtgttttttctaaaaacatacctagtcaacatgagtcctaaacttaaagttaatagtagcatatagataactttttaaccaactatatgttttatatatgtaataattcgttgaaaaactcataatgacatgatataagatagatggatggtcattaacatctaagcacttaaacatggttatggcgatggaacatataatggttgttccaatttgtgaaaagtaataactattttttacaaatttattatattctgcccaattgatttaattcaatccctattggaatttttctatttttctaatttactttatacaactcttattttatgttcaaaatgcataatggatcatgaattgttgtttaattatttaatagagcaacaattagattagaaattagatgtatagcttaaaatatgggtttttcaatattattcatagtttgtctttaaatttgatagctaaaaagtaggaatagggaggagtggagtgcgaagagcctaagctaaaggggaagggggcgtttggtgttgtgtgcatgttatggggacggtgaggaattggagactttattttcctgctttttcctgaataatttaagtaaaaccgatgatcatatgattctccctgcatgtagatttgaattagtgtaatatatttgtcaagcgatatttgacaccaagttgatcctttttatcatgtgaaattatttaaaaaaatttcatgtcatcaattattatatgatggcattaagtgtcatatgtcggcaccatgtatttagcactacaatataacttttatatgtgattaatattttatttaaataaaggaatacaatagattataagttagatatatatttcataaataatttaaaatatgaacatttaaatgtttttcataattttttttataattgtttgaatgtacgcaaaagtgtaagaatataaaccaaaatcaaacatatttatttcaaaagtttgaatattgtgaatatgtgtctttaactttagttataaataatataacaaaaataagtcgatcaaaaattcactatatgctttggatgatactgttctctatttttttaataataaattatgatttctaagtaatgtatcatgagaataggaggaaaagagaggtatggtgtgtttgagggtgtgggcagtggggtggatgaatgagtaagcgcccatgtacggggccgtggtggaggttggtatatgggttctattttttaaaagaaaacgatggatctaatggtcataaatatgtcttgagaaactaatagttagtccataggtagggttttattttgtccacgttacatgtcaactcagctattatcattcttacttgtttttattatccttaaagcgggatgcattttaaataaatggatctgcatctataccactaaaataagcccaatatattattaatacataaaacatttatatctactacaaacataaatgtttatgtcaacccttgtttctaaatctatgaataaatattctataattattgttcctaatggttaataagataacactgttaaaatcaaatatgaatgccccctttaacaggtaataaagccgaccgtagtcgccgaggctttatttctccactgcgatatatttatcgagggatatttgacaccaagttgatccattttatcatgtgaaattatttaaaaaattatcatgacattatgacattaattattatatgttggctaaattatttaaaaataattatgacattaagtattatatgacggcaccatgtatttagcactacaatataactattatatgtgatcaatattttatttaattgaaggaatataatagattataagttacatatatatatttcataaataatttaaaagatgaacatttaaagacagttgatttgatactttatattaatcttgtttaaactgtgcatatacatggatatatgcggagtaataaattttattttataatatagaaaattctactttaaaaccgccgttctatcagcatacagcatagtatgttttttttctggctttatagctgtagatacgtatgtttgtttggttttttgaagtgaacaatacatatgggtaatatccaattatagtgtacgttaacttttctcgtgaaaatttctcttctatatatcggacattaagaagcagctgtgattagataatgggcctacccggacattaagatgaaccagggattttaaaatagatccaatctaacggtctaaaataatgggcctaccagtttaagtgaaaatcgacggttagattagaaagtgctacgtggcgatttaggagcgtttgtaggaacgccacgtggcagcttaggagcgtttctagggagtttaatggacttttagtatataatagatagaagatagatagatagatagatagatataagcttattttgatataatatttttttcacgttattcaactccagtgtaactgtctttcactgtagctagccataatatatttgttctaacttgtacaaactctaatacagtaattacttaaaatataagcttattttgatataatattttttagagagaaggctcttggctctgcttttataaaaagtagatagattttttttagagaaatgtattttttacccagcatctatgtccaaccagatatttgtaacattttaaatcagaacttgaaccgacaaacaacctcatttaaattgggaacgtagcctcgcaaataactcaataagaaattcgctcgtataaaaatttaaactcatgattatcatagaatgctactcaagtcactgcgacgctgactcctcccagacagctctctctagggaaccaaaattagctcgtctgaacgttaggtagctcaggccatttttcaatttccctgcaaccatgactttctgttggttacagatctcataccaaccgaattaaatttaaaaatatactgttcatataaatacttcctctattttatttcgtattataagactttctagcattgcccacattcatataggtgttaatgaatctagacatgaaacagagggagtatttagcatgcatgtcacaaatataccatcaatctcactagactattgagcgaaaaagatgacgcaagccatatcgcgctgggacaggcaagaccgcacggtctcgcaaaataggacaacaagactgatcggtctcgcatatagaatcagcgacagcgaacgtccatgtaattagggattaattaccctgattagcaactaattaatcaaataattaattagcagcctctccgcacgacactgcacggtctcacgccgtgatcgtgcgagacattatatttctatcaaataaattacattctgaatattcttaagaaaagaacaaacgaccaata

SEQ ID NO: 31480 - DNA, 1108 bp, Oryza sativa
tccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggccaaatacgcggcctg

SEQ ID NO: 31481 - DNA, 16015 bp, Oryza sativa
  unsure (1)..(16015): unsure at all n locations
ggtgggagaaagatactatcttagggtgcatttgaatcatgttagaggtccacccttgcatgagaatctaagaatagtatgtggaatcacttacttcacttgtagaaaagcatgcgagaagagtgggcttgttgagacagacaggtcacatgacgactgcttgatcgaagcggcatctttccaaatgccatttgcactccgtcgcttgtttgcgattatacttgccttttgtgaggttactgataaatgtgctttgtgcgacaaacataaggagtcaatgtctgaagattatgcccgagataatcgcaacccgatgttagtagagcagatggtgcttagagacatacgggatatacttcatttcatgggaaaggatatctcagactatggtcttcctaagttgactgatataggtaatattttagaggagtgtgttctataatgttgaccttaattgtctttatttttatcatcaatgaattcgtgacgcatgttatgctttcgtcaaccagatgttttttccaatgacacaccgattgaagtcaaagaggagcagtctgtgccaatagacccagagcatctagatatatacaaatatctgaatgatgagcaacgtgcagggtttgatgacatcacacaacatgtattaagaagaagagctaggttttcttcgttcatggtccaggtggcactgggaaaacattcctttacaaggcacttcttgctagggtgcgatctgatgggttaatagccattgcaactacgacatctagtatcgcagcgtcaatattgcccggatgatgtactgctcactcgaggtttaaaatcccaatcaagcttgctcataatagcatgtgtaacttcacaaagcagagtggcaccgcagacctacttcgcagggcatctttgattatttgggatgaagctgaaatgacaaagcgtcaggcagttgagacccttattatggacatttattgccatttggaggaaaggtcattgatttggtggtgatttcagataagttcttcccgtggtgacatgtgggacaagggcacaaataattgatgctgaattgtagagatcttatttatggaagaatataaggaagatatgcctttcgcgtaatatgagggcacaatctgacccttggttttcggattatctacttaggattggaaacgggactgaaaacacgatcgcagatgatgacgtccgtctgcctgatgaaattgtcattggttattcggacaatgaatattcagtgaacacattgattgaatatgtgtcccctcgcttgatgacgagagaaatacgacctccgaggaatatatgagcacacgggccatcctctcaacaaaaaatgatttcgtggataagctgaacacgaagatgattgataggtttcctggaaaggaaaagatttacctcagctttgattcagtcgatgatgatccccaaaatagctactctttggactttctgaacacgatcactccaaatggcctccctccacatgagcttaaagtgaaggtcaattgcccttggtcctaacaatggactatgcaacagaacaagactaatggtcaaggcaattcaagacaatgcaattgatgctgagattgttggtggacagcacgccaacaaaagggtattcatcccatgatcccactgtctccctctgatgacatatctcttcctttcaaatttaagaggaagcaattttcaatacgtctcagttttgcaataaccataaataaatcacaaggacaaaccatcccaaatgttgggatctatcttctagaacccgtattttcacaaggtcaattatacgtcgcattgtcaaggggtgtgtgttgatgcgaaaaacacacactcgcctggaagatctgcttaacttcagtgcaggtccaaaaatcttgcctttaggttcgtgagcgtgccagttgatttgatcctgcaaccaacaagaaataaagataggaaaatagcggttaaatccataaatgatagccgatcagccagtcgccgatgacgtatcatttatctttgagccgatgtcatatttgaatcgatcggcagttataaataggcaagaaagaactgcagatatcaatggtatataatactttcgtcgatatatacttaaatcaagtggttaggatagatcggtcgccatgccgagacagtataaatcacttagatcgaaatatatattaacaaggagattataagcaatcacagcatagccaatcagatagatctagcatgtatcgggtaatactccgataccactctatattaagatattaaagcaagcaaaatatatcaaacagaaagcttaatatacctaaatgcaacaagatcttaacataaagggcagatttaacatatcaatcaagcatgtaagatataaggtagttaaatcaggtaagaacggctgaaaccccgataaaaccctaatcggcaaccaaaaagcaggctagagattgagattctaatcatgacttataaggtcaaattcaactgatgcagctataagtatgaaaagaaggaaaatatctagacaatcaagccgttggatgtttcataggatggtggatatcctatataatctaagtcaatattggtatttaacctaatcggctaccttcaacgatagatgttagccgattgaaggttaaataacaatattgtcagagattatatacgatatatgataactcgacgaattacataaacaagattagagtgtcgtaaagatggaagcactaatcccgagaacgcatgccgccataacaagctttacctctagttgaagatcgaaaccgatgcagctcaacccgaaagcaagaactcgtcgaaaataaacaaaagtaaaagggtggcgatacgctgagattgtattgaatgtctgtttttttattacatgggttcgggctctatttatacccgtgatacaagatatgtccgtgccggacacgacatctatctctaacaaactctaaaataccgtaagtctttgcggcagacttttgtccaaacatatctccaaggaaattacatgaaatatcctaattaatagatacaattacctatccgagaactttatctccatcgcggcaatcctcgtgaagcaccttgatcgattctagaagcatcttcgaaatcatcatcatcggaatcggctgcaccacctctaccggctgtatcagctgtcctctgtccgatccatctcagctgacgcagactccagccgatgccttcgcagccgatgcatactctgttcttcgaatcaatctcgttatcgaatccgcttcgatcccaatgtcgaacctggtttataatttaccaaatttggttgtcaacagtgtgtcgtgacaaacaacaaggattttggctaagcctgagaaagaagttgaccctgcagggaagagcaccaagaatatcatctataaagacgttcttgactggtgagcaaaggtaggttcgcaagatcaaaattaatttgaaaacataatccagaagatagtaaattagtaatcagaatgttactcaccattgtcttcttgttttgtacagtacgccatcatctgccaaatgtgttcccaactcttccagcaaaggaacacgatctcaatatactgggaaaatatttgaagccgagtagatatgaagaaaaaatatagacaaattttttgtatacattaatagatgcatgcttattaattttttgttctatatcttctgtatggttcatccatacaacttaaatgaatatatatttattttattcacggtataatataaatataggatgtatagaccgtataaaatatcaacaacgtgcaggcattataatgtcgcccatagatataaccatgcgcatgccactcacaaaaaaaggacgtgcatgagatgaataaatattttatatcaaaaccgttgagaaatgaaatgtgtcacaatgaaataaaaaactcacagttcattccattaaaaaatataggtgcatgataatttatataactacgtgtatctaaatgcattacactaatacgtataaaaaatatatctacaagtagtgatctgaaaatatagagaaaaaatattataaacgaaagtagaattattttctttttcttctgtctctcccacatgcttctaatgggaacatactctggctgggcggttgggctgaattcggtccggttggaaaaggttggaaaatgttgatgggctgaatcggcgttgttgaggctcgtgttgctggcgatggggtcaacgccagttaagggcgagcccgtcctctgtcgccttcccgtcgctcgcggaagcaacattaggatttttttagataatggatgtacacagcctcaacaaacttacaagactacatagactcacacccttacataagatttaacaccatctcaagcaactagacccgagcacttaggctctagcacttaggctctagcaacagcaattcttagaaagttaatacaaagtttcaaccataccatacaagaaaacaagagagtattagtctcccaatatttttcttaagttccaccccttcattgcgaaaaagccataaactcttttctctagaatcaagcaaccttctctcactttttggccatcttcctccttaagtagcaaagactattgtgcattaagataactagcgtgtatcgcaaatgagtgcgaaagcaacattagctacatgggtatacaatgagtgcgaaagcaacattagcacggaagcaacattagcaacattagtatacaatgagtgcgaaatcaacattcctagcggcgtacaagattttcttcagtgtatcgcaaatgcaaaacattaggatagttatttatctatggggtgtattctatatatgtaacaaatgctttattttgtgcccgcaacaaataatggaaaaactctatacttctttaacatattttatgcgtatattgcccttttatattgtatacttaagtgattatatataattaagtcttctagagttttactatgcccacgtaatatcatagtactgtactttacatgaaatatatttaacgtacgatatgaatttaattaaagttcaaatacacagatcatataaaaatattttttggaaacatgaaattttttttaaaaatgcagacaaatagaattgcaccgtagtgtttagcacgggtatattactagtacctccctaaatctgattttcaaagggcatgtacctaccgaattaaatttaaaaatatactattcatttatctttttcacataaatattgagaaagcaatttgtttggcaaaaatataccatcaatctcactagactattgagcgaaaatgatgacacaagtgatatagcgctgggacaggcgagaccgcgtggtctcgcagaacaggacaacaagactgatcggtctcgcatatcgaatcagcgacagcgaacgtccatttaattagggattaattaccctgattagtgaataatgaattgaatggaaacggccgtatgacatggactgtctagcagcctctccgtgcgacactgcacggtctcacgctgtgatagtgcgagaccgtccatgtggtcattttcacgtcacggttacgcgggatcaatagtatatttctattgaacaaattacattccgcatattcttgagaaaagatgaacaatatattttcaaatttaattcccgagtaaatcacattggatggacataaactcgttaggtgggtgcaatttaatatataaacttgtaaaacgcttgttttgttgcatggtcttatctaattcgtgcaaactaggaccaaaatgtcttagcaagattaattttaccaagttgatgttgattagtatgtgacgttcaaatatgcagtgagtgcataacacatgctatatttataaacttggtctctactttccttcatcattgaaataatgaatttcatatcttcctatccttgtatcatagctcgattttcatatgttcatcgacaatcactgcctcattctatcttttaattgaactaaatgtatgtttaaattgcaacctttctcagatttatatttacgtctagtatcctaatcagcacctaaattatcaagattaacaatgtaatgtcattttagccctagttcgcacacacttgataagttcgtgcaccaaaataagcgttctacaagttcatgcactagattacactcacctcacaagtttatatacccccaatgcaatttactcttaattccctacctaaccaaatatcttccccgaaggaaatgtgcttacctgatcctaatttccattcagcccctaggacaaatcattttctgatacttaaaatccatcgccaaaagtgtgaagcaccagcttcatttgcctggaacaccccactatctccaacatacctacttgtttctcaagatatctaagcataaactcttttccctagatatctaagcataagtttgttataatttagatgttaaaaaatgaagttgtttttgggcgaagagagtaagtatttagtggggataggaattaagttagcaatggattctcatcactaaggggacactactacacaaataattttcatgtataagcacctcaataagttgcagacagatcacaagtatccgcgtcaggaaaagtcgttctcctattttagctacgacttcttaagagacccacccgcgaaaatctttttcatagactgccctcttagggagcagtataaaaaatagagctatttttctagacgggcctcataagcggccgcacgaaaaaatatattttcacaagcgggccttttaatggcccgtccagaagcctgagttacctcctccgttcctctttaacatacacttcaatttttttcaacttatcccttctatctctccttatctcctctcctctgctcgtactcctaactctctcaaactctcctggtcgggaaagtggcggtggccggcatgagcgcggtaagcacatgggcgtcgatgttggcagtgcgacgccgtcccttttnnccccccccaaaaaccaattagatccaaaagcgggcggttggggctgtccccctcctggatccggtggcagtggcgggagatgaacggttgcggctacggcgtgaggagcccggcggcgggaggagcacaacggctgctgtggcgggaagagcccagtggcagaaggagcaaggcagcggcagcacccggcggcagtgtgtatcagccctccctccagaaccgcgcagcccagccctaccaacgggtgggcccacttacacatgccactccacttatatttttgtccttgcttcatgtaagaggttaacccgggagtgatatggttggagggaataggccttataagttggtttcacccttgctaaactaaaaatttggtacttaacatacgtacactgctctcatggaccatacaggccttatcctaaattggccgggatgtcacacacacacctcctcaaaggacccaacgtcctcgtcggtccaactcacccatatagccaaaaaggcataaaggcaaatgtctaggtacacaccccatcttagcgcatgtctatacatccagtgctggtgccatatgatatgccatttacctcacacaaagcccacatgcgccatgcgccatatgcccgcacaatgactcgtacgagggttggctgtgataccatttgtaatagccctccctccaggatcgtgtagcccagcccactcgacaggcagacctacttacactttcgtcctcgattcgtgtaaaagagttgacctgagagtgatatagatagagggaagaagccttataaattggtttcagctttgggccggaatgtcacacgcggcggcgtgaggagcccagtggcagcagcggcggacggcagcagcaggtggcagcagcgggaggcggattgcggcggcagttgcgggaggaccccggcggcggacgacagcggtagacacgctcgatttttgtggtttttttcggatttttgttttcgcgtgcggtcgaaatatgcaccgcacatttttcgcgagtggatacgccacccgcatggaaaaattggattttcgcagacccttccgagcagacaggccaaaggtccgtacacgaaaaccttttttggcccgtctagaaaaaatatgtttctactgatcggatgtccccttgtatatatttttcttccaaattcaaaccaaatactttaaaagataccatttgaaaaaaaaatgtcgtcgatatataatgggagaggggttacacgcatggtccatccgtcgatggagacgtacgtacgtaggaggacaggaagctagggcatcaccatcgctggccagctgccagctgcggcacatcatgcatgatcaacatgcttggccttatatatttcatttgcattttcctcatggacacagtacactagtagtcattaagccgtgaaacaatacttatgcacgggataaatgctactccattatttgacgtacaggtacaaaagcaagacttcaagggcatgcccgatgattcccctaggatccctttttaaatcaactgagctgtgacatacatatgatttgtgataatgtaaagtatgacggcgatgacacggtttcaattttgaaaaatttcaatggcatccagccaatatcgtgaatagtaatgatatttatcgattatatattattaaaacagctttgaatggaggtatcatgttctctgtggggctagaaatttccacattaatcgaagaaaaataaaagaaaaatccaagtaggaatacaattcaaaaataattgaaatttggaattaaaagtaagcaatattgaaagaagagttcatataagaacccaatacgagattaattaaaattcaaaataaaaataaaataaaatacaaaattagaaaaaagaaaaaagttaaagtagaaataaaatttaaaaataacttagattcggaatttaaaacaagagtccacataataacccaatacgagattatttaaaattcagaataaaaataaaataatataaaatacgaaattagaaaaaaaataaagaagagttcaagtacgaatacaatttaaaaataactgtaatttggaataaaaaatagaataaaatctgaaattagaaatataaaaaatagagttcaagtaggaataccattttgaaacaacagaaaccggagaagaaaataagaaatataaaaagaatagtccatatagaacacagtacgagatcaattaaaatctgaaataaaaaaaattctgaaattagaatatgaaaaataagattttaaataggaatacaatttatagataaataaattgctaatagaaaattaaagactattgaaagaagagaccatctagaacccatgacgagattagttaaaattctgaataaaaataaaataaattccaaaaatagaaaaacaatgataagagttcaactaggaatataatttataaaaaaaatatatcagaataaaaaatatggaattttggaaaaaaaatattcatttggaacacatatggaagtagcaacatacctctaaaggagtagagtggtgatggatgacgagatatcaaaaaactattaacaaaataactaatagaattccaataacgattaattggagggacgacggacagactgttaagcaatacgatctcatcggttggcaggacttccaaaaggtaaaaaattatccccgatgatagtcgcattcaattttaaaatctcaataacaataaataggggaggcagcggacgagccatggagaagtacaattgcaaagccgatgatggtttggcggaacttctagaaagtaaaagatgaatccaaatgataattatgtttgatttttaaattcctgatgacaataaagagatgaggcagtggatgggttgtagaggattatagtggtagcatttcacgggacttccaagcaacatgcctgaaaaagagtagagtggtaataattgatggcacatctaaaaactattaacaaaaccctaaataaaattgtaatgatagttaaaaggagggatgacggatagaccattaagcagcatggtctcggcggctggcgagacttctaaaaagtaaaaaataaaccccaacgatagtcatgttcaattttacaatctcagtgacaataaagagaggaggtagcgggcgagccgtagagaagtatagtggcaaagcagctgacggtttagcgagacatctagaaagtaaaaattgaacccaaacgataattctgttcgatttttaaaatcccgatgacaataaagggaagaggtagcgggtgggctttagagtagtatagtgacagtgtttgatgagacttctatgcattataaaaatgaaacccaatgagacaataaaccctaaaaacaataaggtccaacttttaaaggttccaaggagaatgaatagaagcagtggtaggtcgaacacgggaatgtaaaggtttggtctttcaaagtattaagacaacgagataaccatcccaaaagtgaaaacccggtaattgattttgaagccagccatctcttcaaagcagtacaagatgaattttgttgccacaattttggttgtcatcattggcaatgaagaggactgtatcatcaacatattgaactccttcactcctggaagtgccaatgcagaaggcatcactaacaaggttacaaatgagaggggagagacccaagtcctaaataagtcagttctttcccccattaatatttatgcaaactttccctcccatcacacatgttttaatccagctaatccacttgtttggaaaacccattctcaccattacctgtatcagaaagtcccagttcaccttgtcataagctttctcaaagtctattttcattataatccctttcagctttttggttctcttttcgtggagcacctcatgtattatcacacacccctccatgatgaacctcctagggataaaggcagtttatgtagattttttaattagttaacataagataagataagataagataagatagatagatagatagatagaatagatagataaagataaacataaagatagattttatcatcaaacttatggcaaacatagaatcccttttatttagcagggtggagggactggatatgtccgtcccaacataggacatactatcatacatccatagcgctggtgacaacattttaagcttgcatcttgcagtactacaatacgaaaccattctagtgctattattcgtaaatcatcgcaactatgcactagggagttatatatatccttgaaatggagcctatagcttccaggaattaatgcagaagacgcaatgacctcgatcaaactagacaccaacagacgtacatccatgcatgcaacgcatggcgcgtcattaaggctcggcatagagatggtctggcagcctgggcttgacgacggcgaggagagggatcttccgtggcatggtgagcccgaagatctcctccatgctcagctcgccggcggtgacgccgtcggggaggcaccaggagaaggcgtgcagcaggttggcgagggtgagctggatgaccttgagaccgaggttgtacccggggcacatcctccggcctgagctgaacggcaacagctcgaagtcgcgccccttgacgtcgataccgctccccacgaaccgctccggccggaactgctcaggcgagtcccacaccgacgggtcgcggccgatggtccacgtgttgacgagcacgcgcgtgccagcggggacgtcgtagccggcgacggaggcatcctcacgggacatccggggtaccagcagcggcaccaccgggtgcatacgcatcgtctccttcatgatggcgtggatgtaggggaggtgtggtatgtcaccctccgtcaccaagcggccgacgccgacgatggtgtctagctcctcggtggccttggcgaggatcgccggattcttcaggacctccgacatggcccattccacggtcaccgtactggtgtccgcaccaccagtgacaaggtcctgcgcaaggcatatgccaaatggtgcactgtatgaaaatgtcgtcctaatacttatatgaaaaaatagaataaaaattagacaatctaaatttactatatttatcagaaagaaaagtcaaattcgacatgcacatgaacaaaaaaaatatacctgtgaacacgactatgtttttttttcgtttcaattgtttttctacgcattagttgaatctatagaatccttatccagattagtagtgctgagatatatcgaaaaaattcaaatcgggcgcccgattgattcttaaaaaatttgacagccaagcgtttcagactttcagtttaccatggaaacatggagttataatggtgaaaaaatttcagccactaaaacatttaacttttttgtgaaaaacaatgcagacacgttgaaatatgatgctatcgcgtatgaaacattccatgttaacatattgaaacatatttttctattagaatataaacatgcgatatcttgttgtaaaaatttaattgcaaggaataaaatgttgggatcggatcgtagattagataactagtttagtagaaaaatcgttttgaatgtcactaaatgcatgcaagcgcttgcatggatggagcggagagagtacatacagttagctgcgtgaattttatttaacacagtgaacacacgttgagccatgtctctatcacgtatggaacattaagttctaatggtttcaaagacaagtttttcttttatcagaatataatttatgatatcttaaagatttaattacaacgaatacaacagagcgattggattatagatcggataagtaatttagaagaaaaaagtacttaaaagagagaagaaaggaaggagataaattagctagctgttgtctgttctgccagagagcgtccgattcttatcccgtgaatcgagtggccaattataagtattctcgagatatatcgtatcatgtattagattaacttattacaaaatagaagttacaaaatagaagggatggcccaaaatttactttccaagacataaaaagggggaaaaaccctcgatttatatcaaatggaataccctgggtaatcccctgaataccattcctgggtaagctgaccgtcaaggttagggtcatcggcgagctgcaagagaatgtccaccatgtccctggccacaaagccatccccctgtagccgccgtcgctcgtcgtgctcgtcgaggacacggtccaggaaccggtgtatcaacctgttcacattcttcatcctcctgatgtacccctgcaggtccagccaatccagccatgggatgaagtcgccgatgttgagcacgccgttcatcaggaacagctcctccagcatccacttgaactcctccggcgtcgtcatcgccgctccgcctcctgccggctgcttctcgacgtacttctttccgagcaccatgcgcgagatcacgccgagcgccgccattgacaggtggtctctgagctgcacggcgttccccgccgcgccggagccgtgcagctcgcgcagcagcgcgcgcacctcctcgtggcggatgtgctcgagcgactcgagccgcctggcgctgaagagctcggcggcgcacatcttgcgcgcctggcgccagtaggcgccgtagggcgaccaggtgatgtcggtgcagtcgtaggcggtgtacttgccggcggcggtcctggggcggtcggcgaacaccgcgtcgttggtctggaggaagagcttggccatctcgacggaggagccgacgacgacggggcaggagccgaaccagagctgcacgatggggccatggcgcttggatatctcgtggatggagcggtgcggcagcgagctgatgaggttcaggttgccgatgatcggccatggctttggtcctggtggcagcttgtaagctcggcggcggcggagcagaacggcccggaggaggaagacgacggtggcaagcacgacggcaaagaaagtagcccatgatgattgtagttccattacttattggtgattgctgttaatgggtatatagatcgatgttaggcagcgcaatgaaaatataaaagggttagaagaaaacatatcacacaaacttcacgtgcacacttcgtgcacagttgcacaataactagcaaatgccacgaaaaattctataaaaaattgaatatttactcataatagtattacacatatatgcaaagtctcatattcaataattatgttttaaccgtaacaaaaaaattgaaaactttgacaggtaatagtaaaattctatcaggattatatcctttttaaggcaaaaatataatggattcgaaaataagatttcacatgtaggtgtaatattatttgaagtatgtttataatattatctaaattttttacgacatttgctagttggtgtgcacagagtttgcacggaaaacttgtgtgcatataatatattccttggttagaaagggttgtagtacctccgtcttaaaataacttcatttttcattgatttcacacactctaataaaaaacatatgccttttcacttaatcaaactccaatgtaaatgtccactttatctagccataatatatttgttcttaacctttatgaaatccaatacgtacaatagttgcttaaaatataagcttattttgatataatttactccctctgtcccgttttaagtgcagccatgatttttcgtgcccaactttgatcgtccgtcttatttaaaaaaattttgaaaaaaattaaaaacatatgtcatgcataaagtattatttataatttatcatctcataacaataaaaatactaattataaaaaaaatgtaaataagataagcatttaaagttggacacggaaactcctggtttcatttaaaatgagacggatggggtagatgctaaaaatggagttgttttgtgatggagagagtaagtatttagggggataggaattaagttggggatggattttaatccctaaggggatgtcccctcgtatatatttttcttccaaattccaaccaaatactttaaagaaaaccatttgaaaaaaaaaatgacgtcgatgtataatgggaaagggggtacacgcttggtccatccgtccatggagacgtacgtagggggacacgaagctagggcatcaccatcactggccagctgccagctgccagctgcatgcggcacatcctgaccaacatggcttggccttatatatttcccttgtgttttcctcatgtacacagtacattactagtcattaagccgtgaaacagtactttccattatttggcgtactggtagaaaaacaaggcttccatggcatgcccgatgattcccctatacgatccttttttaaatcaaggaaaaattgcatctattcccccactttaaaaaccaattgctgttttaccctcattttttagggattgtagttttaccctcacttttaaatctgaaccaaccgtctaccctcacttgtgataaccgtttggtaggtcccacgttttgtgttaaagaattgcaaaggaaataaaaaaaggttttagaaaataagaaattacctttgtaccctgagggaatggataaggcatgggtgagtctatcctcccaccccctacgtgcgcgcgaggcggcgagggcgaggcgatggccgcgggcgcgcgcgggcgggcgaggcggcggcggcagctgcggtcgcgcgcggaggcagcagccgcatcgcgtgcgggcaggtgaggcggcaagggcgcgcgggcgggcgaggcggcaagggccccgggtgggcgaggcggctgcgggcgcgcacggaggaggagtccgcgggagggcgaggcggcggctacggatgcgcggggtgggccaggcgctgcgggtgcgtgcggaggcggcggtgg

SEQ ID NO: 31482 - DNA, 738 bp, Oryza sativa
taataatacaaaagatgtaaataggataagcatttaaagttgaacacgaaaactcttggtttcatttacataagacgaatggggtagatgctaaaaaggaagtcgtcttgtaaggacagagtaagtatttagggggatagcaattaagtcggggaggcattttaatccttaaggggatgtcccctagtatatatttttcttccaaattccaaccaaatacttaaaagaaaaccatttaaaaaaaacaatgacgtggatgtataatgggaaagggggtacacgttgggtccatccgtccatggagacgtacgtagggggacgcgaagctagggcatcaccatcactggccagctgccagctgccagtgcatgggcacattctgacccaaaaggcttggccagataaattttccttgggttttccttatgtacccagtgcaatcatagtcatttaaccgtgcaacaggaccttccattaattgggggtctggtaaaaaaacaagggttccaaggcatgcccgattatttccctaaaggtccttttttaaatcaaaaaaaaatgatttattccccccactttaaatccaaatgatgttttaccctcaatttttaaggactggaagtttaccctcaattttgaattttaaccaaccgttcacgcccactgttaataccggttgggtaggtcccacgttttgtgttaaagaattgcaaaggaaataaatgatgaactactgta

SEQ ID NO: 31483 - DNA, 591 bp, Oryza sativa
ggataagagagattggtcccaactgcccttgggcaagaaaaacggaagaactttttattgggttctccaaccgaataagttcagaaggatagccgaacgactggaccataagtcggaatggttcggtaaccagtaagctccgattctcccctttttgggggaaaagctgggggccctttgggggtgtaaattctttggacgggccgccctttttggtcggtagatccggtcaagttggttttggttaacaagggcgaagttggtttaagttctaatgacgaagtcttttgggccctggtgacaaaatttttttaaggaataaaaaaggcctttttaaccggttaaaaatgggaagtggtccataacgggtaattctgggttgggttcgattacgcaaattcgggaagaatcggtagttgggccctggatccctttggacctggaaaacgtgtgaccatgggtcggggtttggtgaaccaacaggtcggtcctttaggtgaaggatcgggccccttttttgttgcctaggttacgctttggaataccccaaacggggaatgaggtttattcccccccattttcactttacgc

SEQ ID NO: 31484 - DNA, 662 bp, Oryza sativa
acagtagctcatcatgtccacatatagtacttgtttcgtgaaaaaccaatgggccttcttcaccaaaaacaatttaaagccacttcccttttcttactgcccttgcttaacctgctgtccaagtaagtactaatttcaaatgcaaggttgtgtaccaaagctacaacccgaaagtcaaaaatgacctgatttaactagctggtaccactcgccctacttgtttattcgttccaactattctatttgttggctggctgaaccaaggaaatataggcctgctgacttgtccaattaaaagtagctttcctactagtggttccaacttaaccaacaaccaccggattgagcgcactagcgcaaaagcgtaacacgcgcatccgttttcttgctccactcataagaacaaatctggtaatcaagaaatgaaaaggtattggtatatcaatgaacacactccatagagtttctgctcaaatcagagtgttgaaaaattaagaaacagtttcatcccgcctttccactaatcccccgattttcgctcaaagctggtctttcatttcttcccctttagaaggtctttactgcaactgagtttgaaagcttttactcatcaaatatttttggccagcaaagtaggtatcaatctggttgaaagctgcaga

SEQ ID NO: 31485 - DNA, 4577 bp, Oryza sativa
  unsure (1)..(4577): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccggcctaaaaaaaaactgattcgtgtcgttcattgcatcaaatccatgaaaatctacattaatttgagaattgagtctttccgaatcgcaaccgatcgttcggtggccataacaaaaaatttgaatttgaattcgaatttcttgcgctgtgatgtgatgtgatgcagcgggtacacgctgctgagagacccgcggcacaacaagggtttggccttctcggaggcggagcgcgacgcgcactacctccgcggcctcctcccgccatccatcgtctcgcaggagctccaggagaagaagctcatgcacaacctccgcaactacaccgtccccctccagcgctacatcgccatgatggacctccaggtacaatcacaaacaccaccaccaccaccaccaaaagtttgatcacccactcaaatcaaatgcattgataatgttcatgcagcaagaactgtggattacttctttttttttttttgagaagggtatttttactcgagctctacattcaatcggatacatgcagcctttttaaattagaaacttagcttaccaaacagagaacttagcccttagataacccaacatgaaatttgttcctatggagatttgaactcaacacctacatgccctttcactagaactgtggattactgaacactgtcatgtttcttggtttttttgtgcttttctttttcaggagaggaatgagaggctgttctacaagctcctgatcgacaacgtggaggagctgctgccggtggtgtacacgccgacggtcggggaggcctgccagaagtacggcagcatctacaggcggccacagggcctgtacatcagcctcaaggacaagtgcggtttttgttgctaggattctgctttccttctgatgatggtgaggttgattaggaatttgcagcctgacaggaatctgtgtttgtttgtttggtggattcagggggaagatccttgaggtgctcaagaactggccggagaggagcatccaggtgatcgtcgtcaccgacggcgagcgcattcttggccttggagatcttggttgtcaggtagtgcatttttcccccatttcctgccctgattttgctgtcatgaatgtgtcgaaagaatttagatgtgatgatgtatgtttacctggaagcatttgctgatatgtgctgctgttactatgtcagggaatgggtattcctgtcggcaaactgtctctgtacactgcccttggaggagttcgcccatcagctgtgagtgttcttgtcttcatgaaatgatcaaagtatttttagtctgttgatggatttgctttgctgactataaatgtgaatatatgtatgatgcagtgccttccaatcacaattgatgttggtaccaacaatgagtcactgctcaacgacgaattctacattggactcaagcaacgccgtgctaccggagaggtaagccacagtttctgcacacgtagttcacctgcaattaattggtgaaacagaaaactctttttaccatagaatttcttttttatcttatctctgttatcatggttatcaggaataccacgagcttcttgaggagtttatgaccgcagttaagcaaaactacggcgagaaagtgctcgttcaggtcagtctgcatagaagaattaattaagttacatgtgcacactctgtttttacctttatcaggattcaggagatgactgaataacatcaaatttcctttccacagtttgaagactttgccaaccacaatgcttttgacttgcttgcaaagtacagcaagagccaccttgtcttcaacgacgacattcaggtacaagaaagcgaaacttttgtgaacctcttctggtttcacgcccatataatttgtctgaatcagtagccacaaaaatactaatgtgatgaatttggtctacaacgatggatggcagggaacagcatcagtggtcctcgcaggtctgattgcggcgctcaaggtggtcggtggaactcttgcagatcacacttacctgttccttggcgccggtgaggctggaactggcatcgcagagctcattgccctcgagatgtcaaagcaggtaactgaatgaaaacacactgcaaactctgaatattgcctcactcactttcactgaatatgataaacaacaatatggagtgtgatttgattgtgtgttattcgtgtagacggagattccgatcaatgattgccggaagaaggtgtggctggtggactcgagggggctgatcgtggagtcgaggaaggagtcgctgcagcacttcaagcagccattcgcgcacgagcacgagccggtgaagacgctgctggaggccgtgcagtccatcaagccgaccgtgctcatcggcacttccggcgtcggcaagacattcacccaggaggtcgtcgaggccatggccgccttcaacgaggtaaccaatgcacacatcatggtggctgcatatgtgcgctcctcttcttgatgatgatgatcaagtgcactaacatgaaatcaaatgcagaaacctgtcatcttcgcgctctccaacccgacgtcgcactcggaatgcaccgcggaggaggcatacacctggaccaaggtgagagatcaatagagctgaatcgaaatcgtcaatggcgatctgaatcgaaatgtttgtgcagggaagtgcggtgttcgcgagcgggagcccgttcgacgcggtggagtacgaggggaagacgtacgtgccggggcaatcgaacaacgcctacatcttcccggggttcgggctgggcgtggtgatctcgggcgccatccgcgtccacgacgacatgctgctggcggcgtcggaggcgctggcggagcaggtgagcgaggacaacttcgccagggggctcatcttcccgcccttcaccaacatccgcaagatctccgcacacatcgccgccaaggtcgccgccaaggcgtacgagctcggcctcgccagccgcctcccgcgccccgacgacctcgtcaagtacgccgagagctgcatgtacaccccggcctaccgctgctaccgctgatcgagcacgagcccaccgaggaggaagacgatcgatcgaattaagcaataaaatttttattcaaatcttggcgcgagcgttagctgccattagaggggttttcatttttaattttttttgtgtacccatacatatacgtatacgtgtactgcatacatactagagcacctgatggtgcttgtcgtcgtcgattcttttgaccgatttgaagtttggtagggtgtaatagcacttacttttgagttttccacattgagttgattcggtgtaataggagtcaaatttgagtttcttatgatggttgttcatgatcagtttctgatgcaatgcgtcgtgtcatttttacccaataaaagcagagatgcttacttagtggaataagttcactttgtgactctcaaaagtgatcgaaatctaatccgtgaaccccctaactcttaaaaccggtgtaatttgtctccctcggcggttttgctgacgtggcacctacgtggtggtgttgacagggtcttccttacacatggtgcttgcgtgatattagaattaaaaaatatatagggcccatttatcattcacataaaggatgacatgtggggtccacatgtcatcctttcacctccccttccttatccccctccctctctcccttctctctttctctccccaaactctcttcaccaccggagcggcagtggggacagcggcggttgggcggtgaggagcggcggctgtggcggtgggagtcggcagcggccatgggtgggggaagagagaggctggccgtgggagcagcgtgccccgagggggagcgtgtgggcagcgggcgcgggcctggagaggaggcggagtgggcacgccgcccccattccgccgtctctcctcctgcagtcctcctgccgctcgtcctcttgcagtcctactggccaccgaggacgagacccacgccctcatgccgccatggacgctgatgacaatggcttcgacgagcttgcctcctcccgtgcggccccaggagctacacccaccaccactaccactgcgccgcctcacccctattgtctacgtcgtcatcgcagcagcagtcgccgccgcagttgcgctccttcgctcgctcgttcttcgcccggctgccgaggacgagatccacaccttcatgccgccatggacacggacggcaacggcttcgatgagctcacttcctcccgccacggccccgcgcgctacgcccaccactacaaccgtcgtcatccagattcatcggtcatggtggcgggcgacaacaactgagccggacgccaccgccactcccgaccgccagttcccctctacgccgttgccgtccccactgccgctctggtgaagagagtttgggggagagaaaaagagaagggagagagggagggggacgaggaagaa

SEQ ID NO: 31486 - DNA, 15656 bp, Oryza sativa
cgtccattccgtgccgttaaatacactgttcatcctatagaacttaacggcgcggaatggacggaaccctaacgacgatggtatttttgggacaaaatcatttgtacgatggcatttcttggaaatcacacttgtcgatgatatttctgggacttagacgcttgtcaatggcattttatggattatctattatatttatggatgaaaagagtagtgtgatgaagaaggatgagagtgaatccgaatcttccgccattcatcaaaccatgtggtcaaactggtggccaacgccttccttcccatacgctgaactgctacatatggcactactctgctcgtgttgccgcatgcacatgtagcgtcgctgcctgtatgtgcttgtcgatcgctcacctagtccagataaccaacaggagatagatggcgagagatgtggctacttaaaaggccttgtttggttaatgagccacagaaattattttccacatattcaaagacacctttaaaattctaaccattcgctctctctcttctatttaatattaatccttgatttttcttttcaggaatacgcaaaaggattgtgcacctttgtgttaagactttaagagaaataaaatttacgcaaacggcaaaacaaagaaatgaagagggatttgggaagaaaaggaggaaaaggaggaaaaagaggacttaagcctattctcgcgattacaatgggacgaccaaacgacctagcacgctaagaaggtagcgttggcgacaggggatgggcgagatgccaaagggcagcctcttgcgccatgcctactaccacctcggaccagggccaagaacagttgttgaacacgcggttgttccgttccttccaaatggaccacgccccaagggtcacgaccgtgtcgaatccacaacgatgctccctcggaactttgagtcggcgggagcagtgccactcgtggaaggaaacatcgctagagaggaagcaatgtgggagcccgaggctcgagaggacggtccaccacagctgtagggacttggggcacctaattagaatgtgatcaattggctcatcctgttggtcacagaagacacaacaggtaggatgcggcaagccacgtttctccaagcggtcagccatccagcagtggcgatgagcaaccaaccatagaaagtagcgatatcgaggaggggcgaaagaacgccagataggtagatgccgggatggaatccttcctcagaagaggacaagataggccgagtgggtggaatacgaccccaagtctcatctcattcatttttcaattccaatcctatctctcatttttctattatctaaacatactgtaggggtgatttgtacttcctccgtttaatattataagactttctaacattaccaacatttatatatatgttaatgaatctagacatatatgtgtgactagattcattaacatctatattaatatgagaaatgctagaaagtcttataacctgaaacggggtagtagatattatagatacttcaatttgttttttaatggatatagctaaaggaagaggtgtgggcattaccaatgttcggtaacaacctactagtaaatacatctatatatttattaattttacaaaaaaaattatggttaaaatgatcctacgtcttacgtttttttaaaccaaacggttaaaatcttgtttgcaagaattttcgaagaaaatttagtaaagcacccctgctcttttagaaactaagctcagcgcaaaattgctcagaaatataaattcctctctttctctcttcaaattcctctctttctctcttccacaagctgtgcgacggcgtggtggcgagaatgcgaggcgccgcccacctcgcgcgttccgccgacgagcgcgtggacggcctccccgcgccctagccttctcccctgtgcggccgcggcggcctggccttaccctcctcgcgcgaacggcggcaggtgagcaggttctggagggtgccacgcggccggacgacctccttcctttcccttcccttttgcccgcctgaatccctcacgtttcgaatcgaatagaaatatagaatagcagctcgtgttctttctccccgcaaaataaaataaaatagaataaattattttgtggggttcggccgctgaatgatccccattccccgtgttaggtcctttactgttgattggatggatgccttcttgccatgataaatcgcgtctcgtttatgtcatatatgtggcctgttttcattttgttgttaatgaaatttggaatgccgcttcaggaaaattagtaagattagtgttaatgctattgtgttatccctgtcagccagtaagcaaaatctagaatggtatgatgttcttgaaggtagtaacttttttttttcttttcaaagaatgttcttgaaggttacttgatcttactatgcagagaaatatagtagtaccgtgttcttgattacagatggtgtgtctttgcttcaaatttgtaaatattctagttttgtttggacctgagactgtagttgagctgattctgcctatgcccatttctgaaagaagctatctggagtaatctgttcgttagtataaaagcagcatgggttgcatttttctgtgtgaagctgtctatggttagtgcaatagcataactggttgccttttttgttttcgtgaaggatgagttgattcttcttatgtcatttttgtgtcaagtttgtatggttactataaaagcacaattggtttccatttttgttttcgtggagaaggatgagttgattcttcttatgtcatttgtgcgtgatgctgtccatggttagtacaagggcatcattggctgaatggctgtcatttttcttcccaggtgaaaggatttgcgtccacctgcaaaggcagcaactggagataccgagaaatgggaggggcacttaacaagttcacaagcactctggaaactgctgcgttatcactactctgggaaccgtatgatattcatgattaacctctgcggcaaatggatttgaagcattttccacgcaggtcagcaaactgaatttcgaccatcgcactattcattttattgaagaattgaaagttgttgggcacttagactaactaagtgaagtgcttaattgctgattatcgggtgtgtgaatctgcagcaacgagttgaattgattaaattcataaaagataaaggctgcaattgatcattgtaattaagatcttgtgtgcatcttgtctcctttaataattcactaggtgaggtctctaccttttcagagataacataagatatgacatattgcacatgttctaccattggcccatagataaccatatcgtatggcatactacaacttcaaaaccctttttcacaacactaaagtagggaatagggtagagaagaaatatgttatagctacacatttgatttcctgaatggaggaccatggtgaaacaacacaacaacagaaatggataaacattgcaaaaaggagacctgtttgtgctcataaactagtatctcatgctatacgcacatgaaaacaggagtgaagaacacagcacccaccctgacgtggaaacatgcttttttgacttaggatggaagacatttagtacatcaataaaaggcactttgctatagcaatattagactgtctggattgattctatttatctacaaggatgatcttaccaatgtcacgtaccaattgttactgctaattttctatgctgttggaaaggaaaacaaggttcatgtaggcatcgtatagtgactatatttaagtctctgttaaactgtaagcaattcaacatagtactatttgcttatcaaattagtggactgtgctagtttttctaatgtcacccaagcacagtagcaacgattttggtctactttgtagatttatatcaccaaaggaattgaaaattcagaatttggggatccaaaacccagactcttgaaatgtgaacaggtgcatatgtcatgactttatggagccaaggacccatatgcatttcttgtggttatccatgctcagaagaatatatcagtcagagaaacattaagacaaagtaagacagaagagtcagttaattttgtttaacgtggcttcaaagttcaaaaatattgtggtattcctacttcaactgctctgcattagtggtgttctgcagcttgtttctatagcatgtaaggtggatacctgctgctagttatcaagaagcagcctatgtttgaacagttctcctagtgcatgcacaacttcaaatcaacccctaagattacttatttgagaataccaggatctaacttcactaaagaggcatcaactttacatatagtgcagcatgaggaatccgatttcaggaagccttagtaacatatgttcgacattagggataaatacacatatattcttcaagagcaccactgctcgacagtgctaacattctatccttcaaatgctgtaaacaggaaggaaacagcctcagccttgtagcttaaatcccaatgatttgatggcagcggtcttcacagtaggtatcttggtgaaacagtgctctctggtctccaatagtctattcataaaacagtgctggcttgaaattgacacatctgctctctctctctctctctctctctctctctctctccactttcttcaggttattggtaaaacaattagcatgttgtatgaaccaaccttgcaatgatgaggtttgtcttgaggaatagcagcagtactgcaagtaattcaatatagacaagcatgcaatagccatatttccagctcaaactttatggatgtatataattatatagattggtgtgctccagcattttgtcatcagcttctgggcatcctcttgctctaaacactaaagatgatcatgtgccttgtttatgttctttgtccaaaaaggcatgtacgcgaactgtcaactacaatatattttattattttacctgtcaacagtctaggaatatgcgtttctgtagaatatgcattggaccttgatcttcctatattatttcatatctcctatgtagcaaaataaatgattttagactatggcaaataaattccaaaattacctttgatatttggaaattatgtgttgttatcctatcttttgctaactacaaaggtacaagtaaaatgagctcacaaagtgccaattttagtgttgctgtgctctggaatataattatctaagagaatctttaccagttctagtagtattttttttggtggctccagataagtggttattaattatttaacatttttataactagtaaaattgcagattaaatactatcgcaatgccaaattaaacctaattttactgtgtaaaaacacttgcagatgtatagttcttcatttcctcaaaacatcaaatgatgcatagaaggatatggacataattggttggtctattaggtgatataagcgattttgatctagggcaaatttttttcccatagataatttcctaaggtgttgatatgattatatgaatatggctaaaactagggcacgatgcatgacatacagtttcccttctattttcctaacaaatatgaacaataatatgactataaccgagatcattacaaagtgttacaatgagcatagtgcataattgatattagcgtgaagtgatttgatattatctctttcctgtgtttcaaatacagtaattacaatataattacaaactagcaagagttcatgttgcatgtttacttgctgtaaaatcttagtaatgtgaagcacacatgtacttcactacgtaacgatggaaaatagtggtaagaaatcccaatgtgtagtatatttgtattctgatcagtgtgtaagttggttgccctgttgaatgtatatggagtaagtactactttcctgttgaaattccttcatccaaattcattctaataatggtctagtggctctaaatcactgagtaatggatttgcgagatccaaaatctccaaaattttcaaggaagaatctgtctctcttagcttgctccactgccataagcagatgtgctgcaaaaaatcccatctttataaatgctctttggtcacttttttttatgttgttcttcttaactgaattgtatggtgcaggatccagtcctgtaaatataaacatgaaatatcatcccacacaaattcttactttccatggaaacactttgcttagtctgtagtttctgatagctgttgtttctccttatttgtttcattatttatgttactagcaatatgcatttaggaatatgcataagaaggaacatgcaaaaaagctgaaacagtgcaaccattcttgcaactatgagaatagtgaggtgatgattttgccacctcactttgttatcagatttgtgctctgtggctattatttgttttgcatcttgttgtcatgattcgccaagataagaactttactgacactaaccatttaaacaagtatctatcatttttttttgagaaagtacaattggatgcacacacccacacacgccacactaacaccaccagacgtgtgcatttcctctgcacacgcttcacacgccacctagagcgcaggcccacgcatgctcactaaaagcacaagtgcgtgtgtacttctgacattagtgggtaccaacgtcaaatttaggatttgaaccttggtggcctaggtgcacagcttcaccacctagccatttagccatatgcaagcttccagtatgtcattttaatatactgttccaggttaggattctcttatcactatccagctgagataccaataagtcattatctttgctccaattatacattttattcctcttttcagcatctactgaaagtagtggatgggaccagctaataaaatatacaactataactgaaaaaccacgggaagtagctactagaaagatttatccatccttttctgcatgaagtggaataaaggtagaatttcctgcccaccatgcatcttcctttttatcatccagttttcatttggtttcagtgtgaaagcatagggatgccactgtttctcttctttctttttagtaggatgcctccttcggccatttgatggttatgtcttatttccaatctttgctgttagctttttttctgacaatctttcaggatatgtgagatgtggcgaaaaggagcagatagtagagctcctttggttcatcagatgatagatctgcctgagcggtccaggccttgtggtcttgcatgttagatacccctagatgtttttatccatctgattgtctttgagaaatttattggtctgatttagctagaggaagggcacagctctaactgattgaacagtggtgttgctaataatagatattacacatatgaatttgattattgaaaatacatacattgttgttggtagatgtacttttatttaatttacttaccattgttctgagttcgtaacttcctgttgttcctatatttttgtgaagtggctttttaacagttggcttattggctagtgactttgtaagtcactttcattacctctctcttttctttgaacgaaccagcagagtgctaattcatacattcaaaaaaaaaggagaatgaaagtgacttacgaaatcactagccaactcactttcattctcaaatacatagaaaataaatgattctccagtcgttatctgattctgttatgtgttttgtgcacaaggttgtggccaagggctgctacacccttgtttttgttttgtcaagtatccgtttctgttcaaccagtgcaagtccaagcataacaccggaatgacatagctgtaaactcgttgaaaatggaaaattattatactgcaaggaagttcaactatgttagttgtgatagttggtgaccctgagtggacaagtactggctgattgtataattttttgttcccctgagaaatggaattccggggtacccattgtaaggaagaaaaaaaaggttcatttgtatttgggattactctgtcctggcgcagtgttatcctatgaaaaacaaatatcattgttgggcgaacaatttttgggtgcttgttcatatttcatgtccatggtaattttcattatttattttacaggatgttagtcctatcatctttgattttttttcatggttgattgtataaatcctaattgaaatatgccaattttgtcatctgcatagcatgcaacctcaattttgttcaatgaaatcaactgagttgtacggaggcagagtttggtggaaggttgccaatggtttgtactctgattatctatataattcaggaaataggataattactttctgttaaatactcaatgcagaatttcaacggttgatgtcattctagggaggcatgaaaatctctcccgaaactcatgtttagtataagatatcttgtaaagtttaaatttgctagatttagtgaatctgtcctccttaaaacattaagtggtcatcagtcactaacgaactttgtcggcttgcgttgtgtgacattcagataggctgtttcccaactctgttacagttacttgcacacactctggagtatttgaattgtagaaataacttctttgtctataaataatgtaatttcataaaatatatattagcaatataatactgttaaaatatttatttattacatctatacagttgcttcttcgggaacaaaccttgttctaggtgctactgttctacaaacctctgctgtgcagtgtcacaaatattcttaaatatctcttgctgtctaggatataaaccacagaaaccaaatgaaatacagagctcagcaacttgtagcattggtactcgagttattgttcaacagtttcatgaaagaaaagtactctgtccttttgttatgctttattcacaggagggcattatcaatgtagaataaaggttttgcatgttataagaaaaatccttttttcctctatatatacaccccccctcttgtgcatggctcattgtgtctcagctctctccacctgcttgaactgatctctaaagcttagccatatatggagtattcaaatttgcgtcgccaaatcatctttatgaagaaaaatcttttcgatcaggtttcatgccttcacttttgttcctttgagaaatgagatcgtaattaattagtgtattgcactagacactagttgatgttttattgcttctcagttcctgagctgcaatattagatgagatagttaactaggagagagagttagtttcttcagtttttgtcttacatgtaagtatataacaaagtttgattgcacccttggacatcccctgagggcacactgaacccctggagaaaagcattatcaatcaatggtcagatatgtggtcatgtggagcttatatcattcatgcactctgtttcaattgtgaatttcatttgcaacagcataactcagttttgtagtgtagtctactagtctgggatgatgcaataatgctcacttagcagttggcacccatcttatcttatctaaaagttatacaactttcttttacatcacatatgcatgcattatgataatgagtttaagcagatcgtcaaggatgtaatatgccatagacaatagcaaaccactttcttaatttcctttgtactattccattgagaatatacaaaaagtcaggtctttcaacctttagagagtaatcatagagtagcatcaatttgatgatacattagtatctcctaggcaaatactagatttcctttatacttaactagggtgaagcctactccctccatcccataaaaaaccaacctagtaccggatgcgacacatcctagtactacgaatctagacatatatacgtccagattcatagtactagaaaatatcacatccggttctagattcgttttttatgggacgaagggagtaagtcacttgctggaacctgactttttttttaatctttgactaattatatagatttacccttgtaaattagtacacttatttgtattatatggactgcacaaaagttttttttttggttgtgtatttcatgcttctttcttttgcctataatctacctcgtggttttcctgcagggttaccttgatgaacagtttaatcagctggaagaactgcaggatgaatcaagccccaattttgttgaggaagttgcggctctgttcttcaaagattcatcaagactgttgacaaatatagaacaagcaatgtaagtaatatgtctgcatccacgatatgaatagataattgattttttgtacaatgattacccatgatttgaaagacatgacaattacatttacttccatttcttttgatgcagtgataaataccctcaggatttctacagattagattctcttgtgcaacaactcaaaggcagcggatccaggtataaaactggggcatatgcccagaacacagagtgaacaatattcttttacaggtctcatcagtgtaaaatcatgtcttaggtcttaaataaccaatataaaaacattcaaacttaagaatgcttattgatgtgaaatgaacaaatattatttgttaatatgaatgttctcaccgaaagcttgtcatctttgcctgctttatgtgttcaaaattcgctaaagttggcctgtgtttggcgcagcattggtgcactgaggatgaagaatgagtgctctgtgttcaaagtaaactgcaatgacaggaatctggaagggtatgcatttcattgactcgtccaacttgttcttcacatactatccaatcatcatgcaatttcctcacatgatgtgatgaggccatgttctctttcagatgccgcaggtctcttcagaagatgaagagggagcatgccactctgaagcagaagctggaatcatattttcaggtatgttgtactacatccttgtctctctctctttctgtttaccttattttcagcattgctacatggctaaacaacttggttatctcctgttccttctgctgatgcagttactgaggcaagttggtccccgtgattatgcagtgagctcaaggaagtaagaagaacagtatgagttccaaggaaaataaagaacatatacatagcagctatcagtctcttgaaaattctgtcgctgaaaagtttttgtgccaatcagatactcataatgcttaatggtgcctttttgttgtgtttggattgcatctgtagctccataatccatatatactgtatgaagttatgtaaagccctgcttatgcacactctccttgcctgtctacaaagtgccatgaacttgtgttattagtcagtaattgtagcagaaagtgtcatggtactaatatgagcttttaatgtttgaaactagtaatatgtaaactagttttttgggttaattaattgcccaggtgccatcatggaaaactatttgtttgtactttgtatactcaacaaacgctatagtcacattcccagaaccaaagacacttaaaaacactggtttttcatctcttccactaatattcataacagtgtttgagctttaaccatcaatatcattttgaacgtttcgatttctaaaatcttaaaaacgttatggctagatttgtcttcagaagtcctaaaaatatcataactttgctatattcttcataagttttatactagtagtaataatttaatcataaaaaaatgattatctatagaaaaagaaatgagaggacaaaaaaaaaagaaagagaaacatcagaattgcagagggccaagccaatcatgggcttggtccataggcccaagagacaaagcccaatccatgggcctgggcttccctttccctccgttttatctactccgatgcacgcacagcttatccgattccatccattcctcaagctctcactcctctctcgcttccatggcgctcctcgccgtccacgccatggccgcgtccccggccaccttcccctcctcccaccaccacgccgccgtctcctcctactgcgcgctccccgccgccgccgcattctcccgctcccgctctcgcgtcgccgccgccgccgccgccaccctctcggccccgctcactccagttcttgaaggtaactgacatgcctacctaacctccctgtctctgttttgttcgtcaattcggattagtctggtgtgaaattggctcgatgatcttatatgaaactgcttttcaaatcgtattgcacgaattcaattgatacagcaccaaaacatagattgaaacaaaaacctcgcagtttgaaccaattacgattccaactcaaattactccatttggtgtgaccagtttactgcgggagaggggacaagaagaccaagaggggaaaaaggttcaaccactcgtacggaaatgtgagtctctagcacaaaaataaaattaataaaaaaatcatatgcttattgcttcctgtgctgctgtttgctgcaattcttcagacttgccatctgctgactgctgtttgctcatctcaggcgaggccgcgcaacaagaagaagggaactggccctgcacggctgttcgcgccgcctgcgcctccgaggaaggaccagttcgacgacggcgaggtcaccccgatcgacatcgacgatgacatcctggaataggttgtctgaatttccccccttgaattatggtttaccttgagcttaccttttgtctagtctgtaccaaacactgtttcttgaaattaattacagtacattacatggtctcattctacataatgtagatgcctatgatttctttccttgtaatatatatgaatggtgctgcttagagtcattttttatgcattaccagctgaagcagaacataagtacagatacaatcaccaaactttcatgttcttgctagaaaccagggaagatgcagtatctcttttttttttcttttctagctgtgtccctgaattcaagcaccttttgacatgcttcgaatttgttgtgatgatctgggaagcagttcttaagaatcaactaataaaccagtccatcagatcgggtcagaaatctgccccttttttgttgttttgtctgttgactctgttatgcgcttgagttttgacacaagaaattgttttgatgatctgcaaaacatattcctttaaagctggacaacaaaccagttcaactggtcagcttggtggtaattgtatgttaaaattctgtcattttttgttgtttcgtctgcaagtttgttgtgagctgctccccccgcccacaagggtaagcaactatctcgcccgaaatatactacaattttggcccaaactggaagtgtaaaccctgctacgcaatggctttaagaaccctaaaccctgaagcatgttttgtttgctaccatttcaagccatcacaaattttggtaagataacgaaccaaatatgttcgagtatccctaccttaccaaaatttggtaacgtacgaaacaaacccgccatctgttcaaaaatttggtgaagtaacaaaccaaacattttcccacagtcctaacatttgataagttcacacctctacagcatataaaaaatagagggggataaatagagcagttgtcagttgtcacttttactcaacttctgttactgttatctctccgaacctagaggcaacatcacttgtcttccactggactgaaaccagggtccagtgtgatgccaacctgctgcaaggctgcaacctattacaacaactgaacctcatgaaacaagacattttgcttttcattttgatgcattttgatttgaagaataaggttttaccctgattctgttaatgaaaccatcatttggattacagagtttgcaaccaatgcactagatttttatattaagaaatactagggttcattctcatttttttcaatcaacaggacaacatccatagtggtaacttgacaagatgagacaaacaatgcacaaaacatatattcttgaaaaaggaaaaatagtaacaatacatactcgatgttgccgtgcaagtttctagtactacttatatgtaccttaagcaaacattgcatattaatggaaaacatgtctcagctattttcgcaatgcagaggtggttctgaataattctgatcctccatatacattttggcaatgcggtatcttttttgagacagcagttaaaatttcatcaatctagccaccaaaaaatgtctcctcaaatcaatactcagagaacttaaggaaaaagaacatgaagttttttggataagccagatgcacatctgcactacacaaaagttgagccctaaaaatctcatatttagaccacctcatgagcccaaagctccaaaagcttggggttccgagttgcaattcctactatgagttccgctcaaagcataagttataaaacccaaccaagaaattgtattatggtcagttgctgaattgttcagattgcgtacagcgtacattttggtgtaaaaaggtgctctgctacactgccttttgctaagttgctggagcatccaacagtatagattcacttaactgctctttgttgtgctcattccaacaaaatcatgaaaccatgggttatcgcaagtgcagcaaggcatcgtgtagtggagaaaaggaattcagtgtgatttggttttcacattgctatctatttgctagagttagtggaataattttaattgatgagcatgataccgaggaggatttattaatgctatatttttcagttacaaattggggatttttggcccacggcaatacttgagatctcaatatataatgggtgcaatacatgcatgatattaggactgatggatgataaggttagtcaatggtgttttctcatggacaaaagatgctcaggtttttttaggaattcaatcattgatggatgggatttagatagaacttcatcaattgccatgtaaatctgagcttatgctttggtggaatcaacttgagcagacatatgagttgatggatgggatttagatagaacttcatcaattgccatgtaaatctgagcttatgctttggtggaatcaacttgagcagacatatgagttattattgttaaggagggagaaactattaaaccttgatgtggtcaatttcggtttgaactatctttcagatcatctaattgagctaaggaaggtggtcaacaacagttatcagatggcagctgccctagacttaagtggtgccgaccctgcacggttgaatcaaggactaataagccgtatggtgtattagcaaaacaatgataatttgtgggtagcgattttaaagccaactagaaaggtagcccgcggattcgcgtgggcatgtatcgtgggctgcgttgagaacggatcatattaatcagatagcctctgccatctttcggaagtacgtttcctcgacaaatattcttcatcaacatcactttgataatttctctaagttatatactatataatatttaattcatcagtataaccaaatatctataatctttatcattatataaaaaatagtagacttagtttgtttagaacatgtttaacaaattaagtgcatattaaaatcaaggtggtttttatttccattatttttggggggttggtgaa

SEQ ID NO: 31487 - DNA, 7715 bp, Oryza sativa
aaaatgtaagacctagctaaactcattgttccttttcccctaccatacggttttctcacagctcctagtcattgtgtcctacaactgagatgtggtcgttgcacctatgaaggtttccttgtgattcatcgtgattcatcgtagtggtgatctcatttttgtcaagcttagttagtccactttccatgtttttggtatagcctaaaatctaaatggactccaaagttaatgcttcaagtgtatattcatagacgattaatgctcatatagttgattcaccttttgactggtctatgcacaaagaaaataaatagagttaccgggaaggtgtagaaagccacaaccacacgcttgaatatatatatatatatatatatacatatacatatatatatatatatatatatacatatacatatatatatatatatacatatacatacatacatacatacatatatatacatatatacatacatacatgtacatatacatacatatatgcatacatacatgtacatatgtacatacatatatgcatacatacatgtacatatgtacatacatatatgcatacatacatgtacatatacatatatacatatatgtatacatatatgtatatatatatatatatatatgtatatatatgtatatatatatatgtatatatgtgtatatatatatatgtatatatatatatatgtatatatgtgtatatgtatatatgtatatatgtatatgtatatatgtatatatgtatatatgtatatgtatatatgtatatatgtatatgtatatgtgtatatgtatatatgtatatatgtatatgtatatatatatgtatatatgtatatatgtatatgtatatatatatgtatatatgtatatgtatatgtatatatatatatatgtatatatgtatatatatatatatgtatatatgtatatatatatatatgtatatatatgtatatatatatatatatgtatatatatctatgatatactaaatttgcattaagaaccatctaatgttaatttgatggtaacatagtttagagcaaatacacgaaagatcatttagcttgctcgcattatttcagcacatttaaaaaattcacgaaataattggagtttgttttctctaactatgggcattggatttgctatgcattggtagcttggactattcatattttagttagttctatttacttatatagtgtctatctaatttagctatgcaagtttgcaaaaacaacatatgatgatgcaacatgtggtgttggattatttcataattcttttacggcaattccaatgacatgtaaaagggcaggggtgttcaccctaaaaaaatagttttatagttatactattgatttaatttagcttgtttgcagactggtgtataatgacgtaatatatgcaaccaatttgtttaaggtatttcaattttatttgtatgatgtacaaggcatgtgggttgaatatgggcgaatggcatactttgtatataagaaaatataagcatatggatcttaaattcttggtttaattataaatagagaaaaaatcagacgtgcatcttaaatattatggtttttctattatataaattattgattatatatttattgtttaatagctaaaaatagggaggggacaggtagtggtatgtgcatatgagtaggagaggaggtgcatgcgatttatttttctaacttttataaataatggaacttaaaactgatgatgatagctttcattttgttcagaatttataagattatttctgatttttaggacatgacacatggcgagtttagagcgtttgtagaatgtcacgtggtggcttgagaatgtttgtagtatgtttaatgggcttttagtatataatagatagattggttcaatttgtattttatggagatttttctattttctattttattttgtacaaatgtaacactataaaaacttatatagacatgtgataaatagtgatagtgttacaccttatgtgtcattttttagaaataaatccaataatcttttatcttcaagcagtaagattgatatagactatcattgtttattaacagataaattatatgggatataaggctacggatagattgagataggtccaattaatggatttaccgttttgagttatctatatttaaacataaatataatcttcgtgaaccaaaatgatatatttcttctactacttattatttaaatcttattaattaattctctgtgtttcatgttgttctaatataagctacgtgctattaatcaagtgttttaaactctatatgatttccctaaaaaatgtgtctcgagtgtccaatagctagtccaaagtaacatatttctttgacttgttaaatatagttaatttgggtcttgaattatgcaacaaacgtacgtgcagtgcataaaaaatatatgattttagatcgtatagtcatataatatgttttcactctaccacatcatcaaaataggagagataggaacagaagggtcatcaaaaataagagagagagaggaacagaaaggaaggaggggccaatacatctacgtacgtacgtacggtagcatggcgtgcgtactacacgtacaggtcggaaggagaggaacgtgggcctttcaatttttttattttttatggtaaaaaataataggtccaccatatttaaagaaaaaaaaatctaatttattagagtgccatatggcagcttaggagtgtttgtaggaatttttttgtgacggcttgaaaagctttgtaggatgtttaatggacttttagtatataatagatgttgaaaataaacttagatgattttttttcaaaattaaactttaaaatccaaattttaggcaaaccacgagggcctccattgctagctcctctcccttcccctggaaagctatccctgtccaggggaagagcaggacatactagtaaggtggatactcaaatataccaatggtcttaactaattctaggctataaagattgtaaaatacataactttgcacacataaataacttgtcaaagagctgtatgtttgtagctggagtgaagtatgcatagagcaatacatgaacaatacactgaataagtacaagccaaccccaaatgaatagtttgagggctgggattaaaggttagtacactacactactatatactgtattgtacattttacacagaataaagcatgtgtgctttattccagtagcatcttctataagtaatctcccatcaagaactggagaaatatatacatccaggaagatgggcctactgcactctgcagcagattgttcctatgctatttgtttatcagtggtccttccttgatgacctagaacctggtctagatgtcttcagtgcctctgcaaatttgtgaatcttcttggcatcttcaggaaccgtggcttcaccattgccaaggtgagaactatgcccaaaattactcactctcccctccccaaaagacacactcttgaccccaagatggaggtttcttgcatctgcgatttccttgctgagatgtcgagcactttggctgtccatagaatgccaacgggagccgtgattatcatgctgttgattgccagaattaccaggttctgtcatgaatgaagaatagctatcaattgactctcttccattgaactcgtcaaatgaacagctcgaaatcgatatcctcctctccagagtaggaatggttttgttctccttttcttttcccagtaccaatttccgaagcttcgaaaagaactttttcttcttagggttcttgtgcttgttcatcagtgagacatcgatcgacgcgtcgtcgggttcgcctaatgatgatgctcttgaggaagagtactctgaacagaactctatatgatcaaagtttttctcatccggaccagcatttgcgtactccattatcagttgcttggccttctcttcagattgggggcttagtgtcttgctaagatcccttgcaacatttttccctgatggagcatcctggttcctgagctcgtaacgcaggcaagcgttgatccatttcagatataccaattcctcaacatctgaaaacctgtcagtcttgagctgttcaacctcttttgccagcttgtcattttcttgcctcaaatgatcagcttcctgcaatgcttttacctgcaaccaattttacttgttcagttcctgacagagcaacacaagctgaagtaaacactgaaaaatgagtttgaaaaatcagtagcgcttatgagaaacaattgattgctctttcaaaccaaatatcaagaacagcgtttccttctgacgagtaacaacctctatctgaagattaagattgattagtaagtgccagctacaatacagttcaagaacagtaaatattcacctccatgttattgatgggcttgggtacagggggcaggcgtgtgagctccaatcgcctggcaagatgtgcattctcctgctgcagccttgaattgacaaccctaagctctcttgcctcattttccaactcctctagcttactcaatttttcctcaacctcagcactgaatttcccctcagtaataatctccttacactgccaagaatcggccatttcctgaagtgaggcaattctctcctttgcttgttctgcatcctgtctcagcttcttcttcaacagcttgcatttcattctagctgcctcaagctctgaagccagctttgagctttcagttaactgagcctgcagcctctcattttcagactgcaaggattcgatcttcagcgtgtatagcttcgattcgacggtgttgatcttcagctgattctcgagctcccgcaccgcgacatcttgctcctgcaaaccatagctctctagaagctgtagctccagggtcttctccctttcttgaagtgatctgaccatttctctaagctcaaaaatttccggggtcttcgttgcatcttcttcgcttacccttggtgcaggtgaggttgcaatgttgcccatgtctcggccgaattctttgagaactatttcgttgaattctgggaggaggaattcttcatcatcatcaagagttctacattttgggggcagtggtactaacgcggtggtggtcatcgttgtagtggtagtggtagtgtggacagagtttccattgatgattttggccttggtatcctccttcacaatcaaaacaaaagagggtcaacataaggagaagaaaaatggaatacaatggtaacatttgaggacaagttgtattttgtcaaactgctggaatagaaacaagcagtatgagactaaaaaaatagagaagaaaaaaggttgaaattaaaaaacaaaagcaaagtccacaccccaaatgcatgtgatatggacagacttagagaatttataatataatgaggaaaatatagctggattatgaacagttcaagaccatacatccaaaactgaaccattctaaatataaatggaagtatgaaaagtacattaatatatacaatttataataattatgtgcaaacaagattcttacattcttgaggatcctcagctcatccttgagccctccaccacccttcattccatccgaatctgcaaaaaaacatcaagaaacgattcatcaccaaaattttctaactaggagtagcaatcagcaacaaacaacgggttcacaattccggaacgaaattcccaaaaattcagattgaccggtgggtccgaatgttcctccggcccaaaacgaatcaaatttatttgaaattgagccaaaatattgttcatattccaatttttcgttgaaatttcattttgttttccatctgaaaatctggaatttcttcccgaaatgaaaaaaaaacgttgaacaagacgcctctgctgttgatacctgagcgaggaggaggaggaggtaaccggagttgctgccgtggccgccgccgcgagaggagcagcccggcgacggagagcgcgacggcggcgccgaccctgaggaaaacaacgcgcaagtcctcgctcctccggccaccgccgccgccatctccggccaccttgggcatctccctcttcacctcacctcaccaccaccttcttcccaagaatccaccacatgcagactgcagcaaccaaccagcaatggaaggaacacaaataatctctcctaccttgatcaccaaaaaaaaaagataataaaaaaaatccaaacatttgagcaagaaattgagactttctttttgactgcaagaagattatggccaagaacctgaacctgttcttggaggggctgaaacttgcatcaagaaatacgagctcgctccagccccatgaagcttgcaggctatatctccatggcttcgaatcgaccagaccggggaggagattaacccagcctagccaacaaagtctctgaatttggttttgggatttgtactgcctgagacaaaatccccaaattaggctgcctaagcagcagctaaaattgggggtgtcaggcaaggctccggattcagctcacggccatcgaaaacgccaagaaaagcaaaaaagcaagaaagaaagcaccccaaagctagcaagaaccctccaatctctctcaatctctctctcctatttctgtttgagcttgtttcctttctgtcttggcctgttcttgttcagaaggcaggacaactccaaggaatctggctttgttctctagccaagatagtgctctctactcgtgcagcttgtgctgctgcttttcttaactggatggacaattggagtgttggacatggactcctctctctctctctctctctctctctcttccatccctttcttgctgcttcgacaattgattataggttattaactctgaccagtgttgttgtttacttggccatgtccatttcagctcagttttttgaggaattgctgccgttgggaggagggtggaattgatgggtggatgagacgtggattgttgctgtgggcgtttgacgtatctttcatgtgatttcgtcagaccgtgcgagaatttgccagcatgctcgagctggctacggcctacgaattgatgaaggcgtgttttgttattagtggctggttgtgttaatcacgtggttcatcctctttcagagaataattgcgcattttgcgtgtaagtcgtgcctccagcagagtcttttacccctatgccattaagaaagttgaaggttacgtgtatgccataaaaaagttttgagtctcctgtatgccatgacataaactttcgtttacccgtgcgtcactttggatggaatcagcactaacggagactaacggaggtttgaaagatctattttgcccttgctctatttcagccactttggatggaacatttagaagagaaatcggcggcggcggcggcgacgcccggcggcggcggatagacgaggcgaggcggcggcggcggcggctagagaggtggcggcggatagacgaggcgcgtcgccggataggcgaggcgaggcggcggcggctaggctagggtccgaggcacactggagaaattgcacgggagaggattagtagagatgaaaatgcttcaggggcaatttagtcattttcatacgtgggttccacatgtcagagctcattcgctaacagaaggtagatggaatggcacacgggtaaacgaaagtttgtgt

SEQ ID NO: 31488 - DNA, 17767 bp, Oryza sativa
ccaactttcttaatggcataggggtaaaagactccctccagcagggttcacaatcgcgaccctgaatcgaaatccgctcatgagcagtatcatcagatactgtgaaatccatcgaaaattgatgatactgtgaaatccatcgaaaagctgaaaaactgatgtaatccgaataaattgtgtcaaaatttaaaattcagtttgaatactttttgtttgaccgaaaaaccaagtgaattgtgtttttttggatcgaactacaagaactaagccaaccagagaggggtgaatggttggtatgctcaaaaaccgaaacttttaacggaaataaaagttaccctcaaattcgacggagatcagtctgaccgaagttgtcctgctggtctgaccgcgcctgtgccgtcggtctgaccggtgtagatcgatcggtccgaccaccctgagatcgcctgccatgcctgtcgacgtcgccggtctgaccgccttgcgcccgcaggtctgaccggtgcttgccgccggtctaaccgccggtatgccgccgaaacccgatgaaacacagatcgaagaactcttaaagtggatgacgactttattgattctctctgtgtttacaaagtgcaccaacagcactccttacaaaaatctcgactaaacacgaaacccttattcaactatcaactcaattgctttcaaaagcgatactgggaagccttacgctccccctctatttatacccgaggcaagcaacctaaagccacgaaccaaaatcatactagaaatcctaatcaccctaggaaaccctctagtagaagaaataaactttacataaccaatcataccaaatttggactccttccaaattcgactccgcatcccatacgcacacaatacctccatcgtataccatatggaatcttcaccaaccacgtgtattgaactctagtcttagtatcccgcatgatctctgaccaccacggacgtcgtcttatccccaagctgactcccggtccatcaccgcaaatactctcccggcatcccgagtcacctacacatagaacaaacaaagaaaccatattccgagaccaaactatccccaacttgactcattagtagctaacgacagtattacatacgcatagtatccatctagaagccataatcatgaaacaatcacggatatccaaacaaataacccgaaaccgaaaccgacatagagtcggccggtcagaccgcgggctgcaccggtctgaccggcagcacatgcccggtctgaccggtccaacaaacagcagtactcacatgtgaaatccaatcatctccaaaaccacttcgcaaataaattccaaataacaaaaccaataatctccaatgccaattgttcatcacagaataacaattaaaaatacctttgattttacatttttgactgatctagaaagtccggatagttgagttgtgatttaaattcatttgcacataataaaggctagcttatgccaaaatgaagcggaggcttgggccggatcattatccttttagggtttcaccttcatatatatctcttgtaagacgccgttcgacgttctaacctcacctcgatatagtgaagatattttgctggctggcgccgtagttttttcttctgttttaggagagttttccaaaatccagtgtcttctgtgattgatctattattttttatcgtttattttcctatcgtttccaaacacggatttcgtgaaactggaattgtgaacactgaccttgagagatcatctaagtttgactgttaggtggtacagatcaccgatcgagtgatgggaacttctggtgccagtaaagtaaactggattttgtttgtggtacaaaactaaaatcgcaaaattacgatgctgtagaatcagtttgcctttactatattatattattgtatgttgcggatggcttagcaatattgatttggaggaaaattttttaaaaaccatccataagtcacttaaagttgatattccatcccataagttattttgttgtaattgcccacctctactcagttccgttgtaaaatccaccttagtgcgtatgtgtttaactgaatcaacatgttttcataaattataagccatcaatgtggtgtttaccaaattaaatacttttaaagtataatctggatactttttcggagattccacaaatagaaatggtgatgagagcttaaatgttatcgcgttgagattcgctattcagctataagggatcgattcaattaagcatgagtgcattaaagtgtttttttacaacaaaactgatagggaggttgatatttgcaacaaaatgatttatgcggtgaaatgttaaatttcaagtgacttctgatgtgtgttttttttgttgtccttttgttttctgcaattttcccttgattttgtggcagctccatcctttgctttttagccacgaccaaagcttaaattttaaaacttattttagagttaattttgattgttatttcgtcataaatagtttttcaacaccagtttttaagctctatagcacacgtataaaatttttactcataaataacaaattattttgagttggcattacgacttatcagttgtagtcaaagcgattggacttacatataatgttctcatattctttaaccgaccaaaatcgcgctttacataagaactgttggaagttctttgtagtttgcttcacatcaacccactaacttaggccctgtttgtttcagctcagcttaagattattgtaatctaaaataaaatattgagttagattactataaactggattataataagccggcatagaataagctataagctgcttgtttctcagtattattagatgtttgttagttgttagccacccaataatctaaaaagcacctttaaagtggattactagattatagaaatctggcttgtagattgtaataatatatcataataagctattatttgtttcagcttactcctaataatcttaagcggaatcaaacagggtctagagcacttgcaacgcgtttggttgggggaattgttatggggaacgagagttattaaatctattgtttggttggagggcatggaagttctaggatagattgggaagaggggtttaagagcaaacgcttaccttttgagataaatcttagtcctatatcatgacttaaaattcaattcccacccattctttacatgatactcatctttattaccgaacaaaagataaaaatgaaactcccataaccaattccttcaccaactctctcttttaggtcctctataaaaaggaacgggaaaaacgtagaaattaaagtagattatagaaattgaaaatatggtaaacagagagaaaaactctttgattacaccacaagagacactcaacaaagaaaagtttcacaagaggtctaaccgcttgcttattttcctatgaaattgacggtagaaatgcaatcctatgaaaaattttctatcctcttcttatgaatcaaagggctttatagaaaataaattctctaaaattcatttgctaatcctcaatttcaaaggggctaaaaaaagccgttgtggattgtgaaattggtttgcatcttggagcatcatcactcacgccgccgcctactccttccgtcccaaagaaaaacaaaccatgggtttccgtgtacaactttgactgtccgtcttatataaaatttttttataatttatattttcattgttgttagatgataaaacatgattaacattttatgtgtgacttttctttttatttttttaaataaaatggacggtcaaacattagaccagagtttgtcttttttttttttcggagggagtacgtaggtactacagtcccagaagaaagtggatcctctcaagaaagaagaaaaaaaaataaataaaagaagacgaaaaaggaaatcgtcgtgcggcgtccgctcgtcgtcgactcgcgagttcggccgccgccaccgccgccgccgccgccgccgatccccatccatcccgcgagcaagcaagggcgcaggcatcctggtgagcgcccagcccatcctctttctcatctctagaaccacgcactttacttcttattcttctcgaatttgcgtaaaccctagcttctgttctagaaatttgccgcaaacaacagtttgtttgttaaaaaatatagtaaaagtttgcggattccccccattttagatccgcccctgggcttggctagcacaacattttttagtgggggaaggaagggaaaggaatcggtgggtggatcgatgcgagcgttcgcgcgaaatctggcggccatcatccctctcgcgcgctgcaatgcgacggcgacgaccgcggcggcgccgtcctccctcgtcctcaaggtcggcgacacgctgcgcgagcggcggcgcttcacggatggggaggtggaagcgtacgccgcggtgagcggcgaccgcaacccggtgcacctcgacgacgccttcgcccgccaggtgggagggttcggccgcggccgcgtcgtgcacggcatgcttgtcgcctcactcttccccgccctcatcgccgcccacttcgtacgccgcccctctcgtctctctctctctcgctcgctctcatgcctgccagatggtgcaccggcatttcgtcgagcactgcatcggcatgacgtgctggcctggcccttctagtatctgatgctgatgctaatgcagcctggagccgtgtatgcgaggcagtcgctcaagtttgcggcaccggtgtatgtcggcgacaaggttcttgtgcaggttcaggcgctgcacatcagggcctccacaaaacacatgtatgctcaattcatcttttcatttcctagtcatcaagactagattgtttggagtgaatcatcttctttctgacagtgtcaaattcggaaccaagtgcttcacgagtgacagtgatgacctcctagctgtcgatggtgaagctatggctgtgctcccctcgctttacctcagacaacaactgaaccaagtgcctcccatcgttgattaaagactggaagcatcgtcaggagtgggacaatatgtgatttatgttcttttgggtctgtagatgctttgacaagataggaaggctatatgttgttttgctgttctcggtagtagctggctcccttgttaagctggaattcccagccttctgtacttcatcaaacctttattccgtttccaatagaacctggggtaaatcccgttataaaaaaaaagggtacatcactgatggtagcactggctagtaactctcagtgcactccattactctaaatagaagtcccatggtttgggtcctttgttgttaaaacatttataatgtctcatgatttagtcagacagcatcttcaaaactgagcttgcagagcaatttgtttggtttgtgttgctcactttagtagaagatgatgtaaaatctgcactcgtgagcgcctgctcaacacacaataaaagttcttgacatattgttcaagtcatatgggttttaactataacatgtcaacctggttattgaacttttgcatcatgcaaagagcaacataataactagaaagagcgagtgtcccagctcctcagcattatgccactcagccgctgccactggccaccatgccttgtgcatcgttcctaggtctttggcattatgcaatgcctaccatgactctgttggtggaaatgttgatatactaggaacaccattttgaagtatcataaattgaaagtgagttagcactcagcactcaggcacatatgggcattggatcaacgccaaccaggaccagaaacaaaagtctagtgcaagtcagctagtaactgaacaggtagtttttcatctttttacaatatttttctttctctgatctctgttttttcttttcctggatgattggtatttgattgaaatgtgaaatatgaaatcaatgagttcaaagatggcctggttttatgatttagattaacttgaatcaatcaaatatgaaggggaacataggcattctgtctgtctttagcaaagtaaatatgtagttgcttgtttgtatgtcagctttgagcccaaccagctttattcttgccatgcttttctcaataagtctcaagtatgagcattatgagacttccaatttcatcttaataacttcactgataacatgtaaattgacgataggttcaagcctgtaaatattattaacttcattgagagaggcaattgcgctgcgatgagctgctctgcctctaaattctgagaacaaaccaatagcaagaacttagcaaaaagggcattgcctgccctcttgtgctaatccattggtaatgttgctactgctactgctaagtactatactgcctcactagaaatagagaaaaaaatactccatgtgacaaagctaaaactagaataatactatcacatggttttctatcattggtattcagttattgcaactgaagaatgcgaaagttggtatcatgttttagtggcatgaaattaactattacgcgtgataaggaggtggtgttaatctcgtatcaggaatatgtcaggatgatgttaagcatttaggggctgtttggtgcgttgccaaaaattatgtcccttatttggtttgtagccacaaatttggcaatgccaattattttggattggttaagtttggtagcaatccaaacaaccaactctaccaaaatttttggcttaccaaatcttgctatagcaaaaaattggcaaggctagcaatggttgagaagaaacaaacacttagatttttagcttatttccatctttcaattgctgatgttctgggtatggatgctgcatctgtggcataaactaaatgaaatcctctttctcgtaggcctcactcgtgtgccactgcccaaactggcagatcttgataggtggctttgcaatctttggccccctgaacctgtccttctccatggctggggccaccaccacctcctctcccctgcggaggatggagtctgtctgccgccacctcctcccagcatcaccgcctatcctttaccaggtacggctaccttaagaggaactactgcaacttatcctctctatagcctgcagtcccatcgagtacctttctaactagtgtttcttgggcttcagttttcttgtgttctaatttttatgttgttttctgcacagaatccgttaggtgccatcaggctggagtcatctccagtgattattggggggatggtgctggacatccatgccaagccatccatgcagccgcatcctggaacgactgtgcctgggatggtaaaccacccatccagctctttattaacttcttagcttgagcaaactgcttatttgctggtatgcaagaaggatggcatatgtgtgtgattgaatggatcagcatgaccaataatactattcaatgtaaactagtgttgaattcattatatgaggaagaaggttctgcaggatgatgtttgggttgtgatatccataagcttggtactgtatgcatcttattcatacagaggtttaggccataaatcttgtgagctttaacttcttccatttcaatcatttatgagaagttgaagtaggatgttttttttaaacctttttaatttttaattgtaaaaataaacccttccaaaacttattttcaagatctgaaccttttggccatgccaaccaggctggcgtggcaaaacaatactgtcacgcctgctacgggtggtgtgttagtgttgttttgtcatgccaggcgggctggcgtggccaaaagcttcagatggaaaaaagttttgggagggtctacttttaaaattaaaaattcaaaaagttaaaaaaattaaaaaatcaagtaataatgcatttgaatttcctaggttaagtacgtcagtgggggagtagcaagaaatattgccgagtgcatttgtaagcttgagactcgaccattcatgattagtgttgttggaaatgatatggcaggtatttcttttatctatttgtgaagatatagtttttttctaaattggtttactcattttgaattactctgtccttttctgctctctgggtagttatttgcttcaatactttccattttttctactgcaggggatttccttttgaaatactggaggtcggctggactatgtacagatggtaagtgtgaagatattcatattgttgtatacatccttgaaattacagtctaatccttgttatgtttgttaggaaaggctgtagtttttcatgtgtagtgagataataggctcattatttattttatttgcattgcgttactggttgaatatctatagatatgggcctacttttgatgcaacaaccaatgctgaaattacaacagcaacatatttaaagggtatttttttgttctctacaaaatatgtactcctttaaaagcctctagtggtggtggcagtgaatctgccaccccactattgcttttgtagttctgtttggtattcaaggggttcagataaaatgaacttatttcttataaatatatactcactttggtcataaatttttatgtttaggttaagattcagtcaaacttttgaaactttgaccatcaataatttctcaaatggcaaaaatggaaaatggtaagcacagcttgtccttgaaaattactatcataatgtcaaaaactttttagaatttataatattttaatataagattgatggtcaaaattttagaagtttggccaaatcttttcctaaatatcaaatattatgaccggagggagtacatagttttccttctgttagctaacactgttgctaataattacataggaatactgcagattgatgacgtaacaaccccaatagtatcaaatgtgtttgatgggagcggtgaattaattgctggcgttgcaagtgttggggcagttgtaagaattttgcagcacattgtgtagtgttcgatctgtatcaacgctaatgttgacaagtaatcactgtacttatctccatttctttttgggcaggaaaaatttctctctcctagctggatatgtcagttccgtcttcatatctccactgcacctctactaatgcttgatgcaaatttatctcctgattcacttgaagccgcctgcaaaagtaggttattccaccttatttctttacttaggcagtgagctcctaagcttatgtgataggctgatatagctgatactagtatgcatttgaaccaggtagaataaataaaggggttacctaatttgcatgcatgcggtgctggatctttgtgtttcctttccaacaagggttgcagccgacaccactttttcaatataatagcatctgtgtggctgcacctaaccttcccttgcctgcaaacaaggatcttttgttgtcttgtgccaaccgatgagaaagtcttctgccagaagaaatgaaaaagtaataatgtatacaagaaacatttttagagatatgctgtttgcaggctttttatttttagctctatgatataatcttacaaaaaaaacaagaaatcacgaccttacgatttgaaatttttcatctcaagaaaatcatgagctttcagcttgattccaaaaccttttagctcaagaaaacatgagctttcgacttcaccttgaaaaactttcaactcgagaaaccagcagctttctatatccatttggaaactttcaactcaatttgagtaatttggaggttttaactcaatatcaggaattctaagcatctttgaaggctagaatgaaaatttgaagtaagaaaatcaggacaatctctgcaacactgtggaaacgtgaaacctaaaaatttcaaactttcaccttaactctgaaacttttacctggaaataaactttcaaactttcaccttaactaatttaattttataactttcgaacctaataatagcagaaatctgtaattctatcaaaaggggaaatgagtgagaagaatgttcttgtcatgcactattggtgttcctaaagagatttgaaaaataggtgcctttatgttgaacctgtcaatggaacaactgccccgcagcgctcgacatcagtgtggctgatcagcagggtacgaatgagtgcctcgcaacaagcttggaatacagcagttttgagtttcttatctgattaggtgtcaatattcttaacatctaccctattatacttcctctagtcaaaactcaaaaatatttgcggttcccagtaccacataaatttaactggacggggtactaatgtatgcaattctaattgtaaacactccctaattttatagaattgtattattattgaactgcattatctctgactctgagtatactggtgcactactcatgtccctcctgaccatcgttttgaggagcttccttgacaaaaatgagaaagacagtcctgtcaattattacaccattatgtttttgtcctaatctctacattgcatcaaaaagttgatgacatgcatgctattttcttcttttttttccccagtagcacatgaatcaggagtgcctgtgttttttgagcctgtctcacttgcgaagggttcaaggattgcaccaattgcaaaatatgtgagtgcaaaggattgaattggtacttattactatgtatcatgttaaggtcttgtcacttaataatttcctggtgattcagattacttacacttccccaaatgagattgagcttgtggcaatggcaaattcattatctcctcctgagaaatatacttttgtcaaaatggagcagtccaagaacaaagccaaagctgtagagtatttgtttgaaatgctcagcccagcaatgtttttcctcctcgaaaagggcataaagtttcttctggtgacgcttggctcaaatggtgtttttgtttgttgcaaagagagcacaagtttgatggaccagcgaaagtctgaaatgatgtctttctcaactccactacttcaaaaattggagcgatgttttccatctaacatgcttgtagatttgcctagagaaggctcttccagaacatgtgtttttcattttcctgcagtatctgcctcagtggttagcctcacaggtgctggtgattgttttgttggtggagtcatttcagctctatgtggaggtttgggtatgatgcaatctgttgcggttgggattgctatagcaaaatcatcagtggaatctgaagctaatatacctgataagttttctgctgcaactatcgcaggtctgctatagtaatttgttttcatcttgtatagtgtacttctgaaatttcagattagatcttagtgctgtcaaatttattttattgcacaggtataactccttgcatttccatttctcatgcagatgatgcaagaagaacattgctatcagctaaaatgatgtggtgcaaataaccattggtgttatctcgtgaaagtcttggtgggcatgtaatttcctaataccgtttgttgattaggctatatatatatatataaggctgagtgtggattcaggtcgtgggctggtgacaacttagcaagtttaatgtagtagattaaggagcacggcaggtttctaaatttgtttgcatgtacctatgcctttatacttcgtcagtttctgtaggctagtgatgatgccacgtttgcatctgtatgataatgtcacatcagcgtcacgtaggatctcgaaaatggtcgtggcaatcttgaaccagaatgatatattttgtggtactaggagttctggtggatatcactatataaaaacaatctctgtgagacaaatcttaaaactaaaaagacaattctcttagggagtagggaaaagatgcattattttcttttctttgcttgtgatgattagttcatcaagttggtaaagtagcttgggaagtcatttgatacgaaaaagctaaatatgaggaaaataaaggattggtgccagaggactcacatgtatgtgtgtgctcatagcaagacacccttagcactttaagcataagcatttcccaaatttgatttaaaatggaacatcatactatatttttaatcttatccttgagctatgttgagatagatgagtttcaaggagttaggagcgggaaggcgaaaatgctaataaacggtcatccgcgtgcccgctcccctgcgtggcacgttggcacgcgcggaggggaggggcggggggacgcgcgcgtgggagtggacatgtgtcccgctggtttctgatatctttttttctttggttttttccttctttttttttggtttttcttttttttatacatataggatacaaagtttgtatacatgtatacaaagtttgtatacgtgatattatttctaggtttttccatatttttttaatacgtacgtatataaagtttgtatacgtatgtatacacactttatgtataaatttttatacataaaaaaaacgtatacacattaaaatatatatttttatatgtatgtatatatacgtataaagagaggagagagaggaaagactagagggaggagggttgtcgtgtagctcgtgcgtcatgcgcggcacatggatgaccgcgtatcagcaccgcctgcgggaaggtggccatcatccacgaagttgtgggtatccctttactctatacgacattttccttagctgaagggtttgatggctttaaattgacttcgccaaaaggcctcatctccaaagcccagctagcgaggtgtccctctcagtgtagagcagagttcatcacctcgctcttgtgagagagaataaggggaagctctagaggagtgttggagttgctgacactctttccactcttgtacctcgatggatgtttctttttataaaagtaagtgttcatgctttcttttggtatttactcttcttgtataagtaaaatatatgcttatcattgcaggttcatcgcttaatatttatgttaagtactctagtactaatactttggataaaaaatgaagttcttggccaaggctagagtagtaattgataatgcaaacgtagtgtttaggttataggttacatttatttgttgtgtgtttcatgggctatagaggtaggcgacaaatggtaacagccttgatcgtcttttgtagtcctccacattccggtacgtcattgggctgtaggctggattcgcttggcagaccaggggaaagtcggtgcctgaagcaagtgatagagttttaccttaacttaattgaagaattttaacccatagaaaccctccctactctccgcctaccattttgttgttgttggatgaacttgatttcttgatgttatacacatgttccttgtgattcgatacccttggaatactctgaggtgaagtgttacagcgttatccgtgcgcttgcggatttatttgtgatcgtaacaaataccaataagcatttctggtgtcgttgcttgggaatagttgttatattatctttgaacctagttctccctggtatcttttctttttatttcttcttttcttttctttcctgccatggagtagctatctattcaaaactcattctcacatttgactggctttataaccatggttcaggggcaaaatccttctcggggtgcgacagtgaaaacccctaccatcatctacgagagttagcaattgtgttcatgcctgacaatctcaggcatgacgcaagaaactttgaagtggaagttgtttccgttctctctcatggagagggcggaacaatgatactctcataccattaggaaaacaaacggtgaatgggaggaactcaaaagtaggttctatcttgcttttgtcttgttaacctatgttgtctccctacggatggaagttctcggttttcaatagtgcaagaaggaatctattgaagtagcttaggctaggatttcattgttaactcaatttgacccagatttgtctatactcgaccatgttacaatatttcggtttgggtctaaacaaggactctgcctcatatcccggaggttcgtttgcacacaaaaccacaacaaatggaaggaaactcttggatcttgtccatggaacatcttgttcgtccacaacgaaacatctcctgctccgggtactccctatgaacctctagaagataattttctcaaggaaattgtgagggaattaactatcatcatgagcgatgaatggttaagagatgtagaggtttcttccgaagtaattcggactagctccctatcgtccctaactatccaatgtctcgtgatggaggttacagtgaatgttctcgataatcccactgccggtgctaacatcatgtccacaacctttgtattaacttgcttaggtgacaagccccaaattcaagttcttgattaatcatttatctacaattgagttgctatctttcgtgttcttgcttgtgttcttcaatacgcacgtagggattagtcttcttggcaagatctatcgggtttcgacatggttgatactagaggagaagtggtgctgcgattgcagagttcggtgttcttcaatacgcacgcagggattagtcttgttagcaaggtctatcgggtttcgacatggttgatactagaggagatgtggtgctacgattgcagagttcagatcaacgaagtcagctcgtgttgccatcacgagccattagtacgaaccgacaaaacctttcggagttcctcaagtcctatcatagaagtttatgggattctacgtggagtgcctatgaggaacgagaatgtcgaagccaccctagacttccacgtgttcaaagtccctgacttcgatcttctgatcgactatcccatagaaaaacttctataatgtgcctaatccagattgtgcctaaggagttatgacggtcgttgaaaatgccaaaaacaaattgatcccacaacgaatcgtcatgggatggaggatgtgcctagattacagaaaacttagcaaggcaactaggaaggatcactccccgtcgccttccatcgacgagatgctagagcggcttacaaataatttcttctgtctccttgatgactattctggctatcaccaaagtcctattcatctcgatgatcaaagcaagaccacatttgcttatcgtcgaatgttgttcgggttgtgcaatacacccatatcattccaaaggtgcatgatgtttatcttctccgaaatgacgaatgaaatcatggacgacttctcagtctatggaaaaatcttcgatcattaactcgagaacttagacaaggccttgcaatggtgtaaagaaaagaacttgatgcttaattggagaaaaaaaatgtcatttcatggtcaagaggggatagtcctaggacagcgaatttctgaaagagggatagaggtggagagagcaaaaatagaagtaatgaagcaactttcatctctcaacaatgtaaagggaatccacagcttcctaggtcacacaaggttctatcgatgcattaaagtttttttctcaaattgctaaacccctaacttatctgctagctagatatgctccctttgaatttaatgatgagtggttaaaatctttcaatttgttaaaagaatctcatcttagcgccaatcattcaacctcctgattggttgttggcttttaaaattatgtgcgagtttagtaattatgttgttggggtcattcgtggttgaactaaaaacaggaagcactatgctattcgatatgctagtcaagcatgatagaaagcaaagtcagcctgctagatgctgaaagagacattagctcaattctactccctcctttaactaagtatataaaaaaatttagcaacatctaaaatattaaattagtttcattaaatctaacattgaatatattttgataatatatttgttttgtgttaaaaatactactatatttttctataaattggtcaaacttaaagaagtttgactagaaaaaaaagtcaaatgacttgtaatatgaaatggagggagtagaaatctgataactcgctcttttccacgtcaacatgaaggcaggagactcggagaagttctgaacaagagacattctttccccaccatctcatctctatgattagctcaggtaagtttataattctatggtgtccagatcctacaaagaatggatcaataaaacctttttatgtacaaggaaaccaaatctgagactgcacaaggttaacaaatggactataagcatgcatctgtaagaagcaatgtactttgtgtacttcgcttcctctgacgggccgaaaaagaatcaactcatcccctagccttcctttttatcaactcccaaaaactcgagttgccaaaacctctgatgatcaattcagtgatacaaatgccatcactgccaaaatatggttgggtcattgctataaactgcacgatcctggatctctaagatagagacatgccaatcgacaagtcttgcttggatgcatttacataacacaagtcctgttgggaacagccaccagctagtatcatccctgccaaaagtaccaatgcttgtgtgaaaagaacagaggcagagtttttgaggtagcaacagttatggtagagcagtagcgaaatgtcatttggttttcagctaaggttacttacccgcccaaattccaaggttgcatgcttggatgccttttggctgaagacttgtaatgcacaagtccacacgcaaaggccacgatctgcaagggatgaaccaagtgtgaatagattaagaagatccataatggaaaggattaaacttgctattaccattagcagaaagaaagatgcattgcagctgttgtaatgtccttaagaaattgaaatatagctactactgcaatgagtaagaacatcaacataattccatgcaactagttcttccaaacatcaggatttgagctcagaaaaaagatatctaaaatgcatgtattttggtacattacaggctcaaacttcgactcaataagacacatggacttcataaatgtatgctcaaaagtatatattaaaagaaccaagcttgatgggacttgagaatgagtcaagggtttgagctcaagatcagctccactgtgctcgagaaccctggataccttgatgagcccaggctttcttgacacatcaagaagtgggaaaatactgcctaactgaatacactatagcaaactgtaccaaataaaccgaaactgtgtgttactgttcttgtgattgtggatgtatgagcaatgataatagccaaccaaattatataatttccccttttttggaacctaaagcatttgaaatgaactggtaatatcaaaatataagtacagtcaaagatgagtactcacaacattaaccaatgatgtaatattccacagcgcatacacacgagcaagacctgctgaccgccgtggtccatgactaaatagagcatttatcccagcaggaaagggtgccagtatcccaagaggaagaacaaacagcactaacaacacatcgatcatagaatatgaatatagctggagaaaagtaagcaatactaagctgaaatctgcaagaagcaatatagagatcaccaaaccaacaagatcctgcaggaaagaaaaagaaccttggtaagttcaagattgtgtagatccatcataaccaaactaggggttgcaatgatgtcaggatagctgtgcaaaatggaagtcacctgatgcccaactggtttggtattgtgcaatataag

SEQ ID NO: 31489 - DNA, 32791 bp, Oryza sativa
agcatggtacggatcagtgggataaattttaatatgataagtgcaaaatgtgcagagctaaagcaaaggactcactgcgcatgataatcaaatttcattctagagccaccttgaaggccactactgaatggtcccacagaatgaataactagaccaaattgatagtaacctagtgctgtagcttggaaccatgcaaggtcaacacgcacgcggtatgtgttcaaagcaggatttgcatgagtttcaagccatttgagtacaggaagaaatgtggcttttagatttccacgacgagccaaacgcaactgggcgttcaatccagcaacaaggcggtgccatattgatgaaggtacaccctgtaaaaatatgttcatgttatatgctaataaaatgaattgttcacttagtgatccagtacagcttgaaatgtttcagaataaacctgactaataagacttgtgaccacactgtcactgtgaagtgaaaatggagccatgtaacttccatcgcctccaaagattaatgacattggcaacctttgatgaagacgaggggggaggtcaggccttttttcatccccaccaagaaagaaatctaaataacccagcattaaatctggtgtagcagcaacctatcaaatggaaaaccagaaagcatacctcaatccatgatgtgatgagactgataattgtataaaaattcataatacaagtgcagttctggttcttgtactggtacagttgcagataatgcacacagaatcaacacagcaatatttgtaactcaattacattcagtgttcccagaaaaaaaacaaaaaactccataaggcaacaagggatgggtgcccaacctcgtaccacgtaagcagatgggtaggctgtatgatcgctacaaggtgggttcaataataccacttaccactttttagaacctttgaacagactttttcttaacagtacagtgacaagatctatctggttattttggacgtctaatgatgctgtacaaggtacatactcttatagcaattgaagattaactaaaaagcttgaatcaaatgaagaacacttaacatacactagatgactgagaaagtaaggctaaacaacataatttcaagaaattccaagataattgatgaaattgattgtcgagctcataaaaaaccactaaagctcataccagggatttggcactgaaaagaacataccttcagcccttcataaagagcacgtgaacggcaagaccgtaaacatgaatgatcatattcagatcgaacaaattcacgtaatctttgtaattttcttcttctgcgccactgttgccaagaccatgccaaggggtatgaaagtatacacaggatactataaattgatccttcccaccactgatatgctgcgagagcatttatctcatcgacaaacttgttaaatgcatcctcatacctaacaaaaatacgataaacataatcttaaatgagacaggtaaaatttgtggcaaaaaaagcaaaaccagtaaagataaggaaaaaagaatgacaaaagagcccaaaggctgaatgcatgttgttcaaaaataatcttgatttacttgtggacagatctacgtacacaatctcagaaatctgctcaggtggggtgtgtggtagatgccaaggttcactgaaggtgttgggacccatgaaatacatcctgtgcacatgacagtgagattcttcggccctattggtttccagtacctaccacatgaggagagatttcaacgaaaaaccagaacaatcacaccacagcttaaagaaacaaattaggaatgcagaatgttctgctacctcattgagtgattcgaggaagggaaaagagtgatcaatttgggagctatgttgagttggtgctggtccaggcaactcatcagtgccaacaaacttcatccgagcgatactcaaaacaagggctaataaaaaaagaaggcctgagagaaacagaccaaacaaccaaggtccaccaaaagtgtatattaactcttcaagagcagtaaaacagtgaggcatgcggtatctatcggacacacatttgtatgggcacggggtttcagtaacacctcctgtcaaaaacaatatctaaggttagaacattaaggtaaactggccgaaacatttcatatatcacatgtaaagctaacaaaagttgaagagtttgaaaatgctaaaacatgagagaacagaacttcatactctcattaaaatagtaaacaacaataattatatacagcaacaattccgtctagccattagtttacacaagacaatcagttaaaagcaaggcacttctagcagctaggccgcatggaactttgtggtatgcatacctcgtgtccacagatttattgcaaataatcccattagatataggaccattgacagcctataattctttagaaaatttaaaaccatagacccaacgacatatgtatttgcagattagacgccataattctgtcactaaatttatttgatctgcacttgagacgcatacaaaaagaaacaatagaaatgacctcggatgcttatgtagacagcacgatgagggagctcatttgtagggcatggagaacacaaggacttcaaagacccagtaatgttcttatatgttcctaaaggacaggcctgcatcgtgccataaaaaccgttgcagcaaagtgagaaaataagtagtatggcaggttggactgaaaaaattgaagtgcaactatgacatgcggctatgttgataagaagacatgttatctgatttaaacaaagaaacaataagctacaaatatatcaataattcgaaaatagcaaacacacttttgctacaagttaccttgcaaaatgtgccataaagaccttttgggcaatcttttcctgtcactgttccattttcacccggaaaaccttggccatcaacggttcctcctctgcacaacaaataataggcagtatttttttggtcaaaaaggaagagtcagcatactgtttaccaatcttactgtacatggctgcccacaccacacagaatcaaggctctggaaaatgggaaggtgaggaatgggggttgctcctagtttgcttaacctgctctactaactattactccttgaaatattccagaactacgattaaggaaatgtaaggacatccaccagcaaaaagcatcataaacttagaactttaaatataagaatgcagatgtagcagcactttagcatcatgaacagatctagctagtaaaacagaaggaaaaaaatagaacaaacagagaaaacatcagaattaagatgcaccttgcaagtattgatccattaactgttgcaaagggaatataatcatctccagtgggaatgtcagaccagtggaagtgaatccggccacctccacctccgccactaccattacttccaaccccaccagcgctagaaagtacagagccctcctccaaggacaatgccctcacaaatagaagaattgtgcccccggaaccaccaccaggtccttcatttgcagcatgagtcaccgcaccagcaaaactgccaccattcgcctctattgaaccagcaagggagagtagtggaagagattgctccaaagaacccattactggaaatgtgcagatgaaaggcagtaaaaaccagtactactaagagtaacagtgactgaatagaggatgataattgacaaagatccatatgctcgatctctgttacctattataccaccaccagctgttgaagatgatgtacttacattaccactaccactgccaagttcacatggtaaatcagcactaccatatgcagttccaccccctgcatgactgccactgtagaaagcatcccctcctttaccaccatgcccacccccaccactaaggccactgcttaacattcttcctcgtccaattccacctcggcagcctgcagcagggagaaatcaaatctaaattctacaatagtttacagaaggctgcattcaaaagaaagatatcaaaagaagctatatgttactattaaatgtgtacatagaaatactgaagcttaatgaaatctccattatgaaaaataggtatactgaagcagtaactattcaaacaaaaataattttcaatgctgatgattcaccaattcacgaacaaacagagaattaagacagcttatctcagatcagacagctataaaataagactggtagatgtaagactaaaaaaatgccatatttttctagtctactcagttggagctgtgcacaagatttattcactgctataaacattatagcgtgtcatgtcatttgaaatctcgagtataacagggcaaatggataatggccatcagtgacataagcataccgatttaagcctaggtaggcttaccatatgacaaatttttgaagtgattattgcaacattgcagcaaggactagagaatagttatcatagccataggaagctatcattaaactaaataaggtttcctttcgaatatttagttaatcaatagtttgtgattgcagatcgaaagcagggctgcactgtgcaatgccacaatctggatacgggtatctttaacaactcctgtaagaagttctatctcacagcttaagaaattatgcttccaataaactgttttatccagagtagaaacaataaagtgcttctcgaaaaccaccacaatgctgaacagaatcttaatagcatttatggcaaagaagaaaaagttacctaatcctgttgcactaatggtcccagatgatctcacagtgacatttcttgctctgttgaaattaataacagttccttgcacaaggccagaaacaacaatgtcttcaacacggcatatctgcgtgtcaaaagctaaccatttgttacatgttaaatgaaaaggcaaaatctaagataaagaatatatatagatacacactgcacggaaagccttgggaaattaaagtgtgcacctgtagggtaaaagacaatgaagtgttcaggttgcaatcctcaggaggatgaaagatttccataggacaactctcatcttcacagttcagctttggggccctagtgtagagacaaaagctcagaaaccgttttaaacttcatggtggaatagcaaaaataaaagcaacacaaaaactgaaggtggtagtatttacacatcatcactacttccatttacaagtgggccttgtagaacagctccaggtccaacctaaaatggaattacttatcaattagagtagtctgaatgatcacgaaggatcagaagcatctaatagaaacaatgaaatgattgaactgtaaaaaatcaaaaacaacaaggttgcaacagggttataccagcgtacgatatgcaaggtaaaagagaaaggaaatgcatcaagggctgcactctatacctaacagttggacaaaatactgatcttgtatataatgaacaacactctatatcttaagggcttcgagaaaatattgatcttgtatatcatgaacagcagcataattcatctcaaagataagtttagaacattaaatttagtgtatcgagttagatgagatatgaataagtaaataacagaatggagaacactacagatagatcacgcaaactactgatgtcacacgatggcctcataacatgtcaaatttaaggcaatatcaaaggcatattcatcattccaactctgaaaacaatccgaatccataaaaatgtgcctaagccacaaaaggtatgcagaaagaaataaagcaattcagactcataactgattgtgaataaacaaaccaaaatgaacttattttaccactatgttgtagaaaagtgataaaataagacgttgcgcctgaatcgtatctccatctccagataaattcaggatgccttgaccatgaattccaagattgccaatagaatgtataactgatgattcctgacaagcatgggaacaaaataaatcatacagaagagaaggcagaggaggagaagggccatatcttgcaattttgaacaaataacataccttcaacactatcaaattgctaccctctagtaaagaagtcgcaactcctgactctctgccaccatcaatcaacattctagagttccacataagaagcatctttacagacattcgtaaagcaccaaacacctgaatgtgatttaagaatcgtgaggtgcagatacaccacataatgggttaaaattgagcaaaaggaatacaacatctgcatgaagtaacagcagataaataccttaattgtagaatcactcataagaagttcctcagccaacaattcaaactctgaatatggatagtgtgtcaagccaaaagttaatgtagcgcgagatagaaggctaatttgtccttgagcctgaaaatcagaaaacattgaaaaaagggtaactgaaatatctatagtgactagaatgaaagaaacatttagttaaagaaaatactagtccaatatcagctgcaagctgcagcaaatgtatccctgttgacctatacctgccagtcccaataaggacagaaaaatagctcaacagcagggaacagcaactcatgttatttaccaaggtgacatgcagtaaaaaagaacattttttcccataatggaagtcaccagaataatagcattcctcctcccaatttaagaaagaaaaagaggctcagatcctttttaaagaaaataatttatgtctttgcaatttcatctccacaaaaacgaaacaaatgaagtgtttatggacaagcaatcagaatagactttaaaactaagtgcctcacacctgaatacgactccaacgcaagggaagagaaactttggcatgattcttgataaaaacatttgtccagagtggatcatatgggggttctagaaaaactgtatcagtttgtgtgctcaagttattgttgctaacagtaatactcttaggcacttcttcataaagagtcccagctgcacctgcattgtccagacaacctgagctcctcccacctgttaaggcaacatagttcaaacacaaataagtagtatgttgaattgttgataagcttgtacaaactatgtactttgcataaaccaagtaccaactacacaggtaatactaatactcataacttgtcctcgtcaaacgaaaaccaaataagaaattctgggctagtccaataaatatctatctaacctagatcagataacgccaaagttcactttacactccgccagcatgaaacaaatggagaatatgtagatcatcttttaattttcgagcaggattcaagaagccaaatcagaaaatgaaaactaacaccctgcagggacattagtgtcccttttaaactgttactggaagaaactggttggttctgtatatttaacaagttcttgatgtttaactctaaactaataacttggtcagaaaagttatggtcactaacttggtcactaaagttatggtctctaaaataataatgtagaaggtttaaagaatagttcatatcttacaatttacaacaaactgaactatatgccagtggtttccctgatcagaagtttgaagaaaaagtatattatgctaaaacaagctcttttgacagttgaccaaatcaatgttgaaagtcagaaaagaaaaattcaaagctggcagggaaaaaaatacggataccatgaagatggcaggttataaacgagaacaacctcatataacctcagcaactagaaaatcaatgtgaagatacaaaattggaagcctatcagagcaaaagtagtccatgatacaaatgaaatcaagtgaattaccatgaacaaaaaattgggagtcatcatgcctactgaaaacatcaacagaaacacgcccaccacctcccccagccaaaccatcccctccgcaagcacttattgtgccacctccttgcctgttacaacaaaatatcagagaggaggcaactgttcgaaataacataaattcgaaatttaaacaaaaaagttatatatatatattcatttaatattttaaaatatcaatgagtatggttttcatagaccagctcacttaaaagtccaaaactccaaatatggctggtcaggccaacctgcattataatctaacatgtacataactgatgcttcttggtaattctttgcttccatggttccttctacgttggagacttggaatgtattgtttgatcttcgctagtcatgctcatactagtcactatgacataattgtggaattttagactagagcaactgatctggagtaagtttaagtagcatttagtccaaaatcctttgtttattagttgcctggcaatatgtctttctgaagaatgtgtttgtaacccaaatacgtagatatcaacatacaatcttcgagggctacaaatcctatcatatgatttagcacttaacataattgtaaattaaaacttatctggtccccatcactgcaactgtcagttttaggcatatataaataaaaaaaggatacacaatctctctcaaatccttattaggtcctaaaataccagtaccagatatagttcctcctgatttatttcaattgggaagtactgtttcaatccaatgcactggaatgtgaaatttgtaccattctcaacacagaagaaattttattggctttacatccattccagtgtaaaatttctaatacatctattggacaagctagtgcatgttgagtgcatcctatacaggaatcatgatctattacagaatatgatattggatatataactttttaaatatggtaaaattaaaaataacaaaaatataagtatatatgaattgtgggcaacaggcagagcaatgatttatccaaacttcaaaaaataaattcgtgttgcctttgtgtgaaagtgtgaaaaagagccaagaggcctgaattttgaactttaacagtcataaccatatgaattgcttatacgatttcgaattagccaacaaagttaatatcatattttcaatataaattacaaatactcacatggttttagccttgagatagatgcttcccccagagccacccccacctttggtgccaccatctcctccattagcaagaattgttccattcatcataatatccttggcgaacaaccacactacacccccaccaccaccaccatagtccttctcgacgctggtagaaccgcctttgctcccgtagctattgggggtcttgagttcagcccaagcgtacatatcgccgccccacgaatcctcctgcgcctgcccctccttgacgtagcagctagcaccacggccgccatggccaccgccatcaccatacgacccagtaggcacgccgctggtcttatcaggcgggtcgccagcgagcgcggtggtgtcgattacagcatcactggagagcgtgatgttggtagctgaaagagaaacccacccggccacgacacgggcctcacggccgaagaagatgccgccggacaaattggcggagacgacgcacccaggcctctcgcaggtgagggcgacgccgtcgacgagcaccagcgtcccattcccgctgatgtagacgccggggccacggagcctcacggaggcagggaccacgcagcgggtgtcgaggtcgcccacgccgcggaggtccccggcgcaggtcgccgacggggcgggcggcggcggcggcagcgaggggggcggcggcggggtgtagtcgtggaaggtcaggatcgagtacgcctccgcctccgcgtccccccgatcgaaacccccgaggctagggttccccgatgcgacggcgaggagggcgagggcgaggtgggggaggcggaggcggaggcggaggcgggcgaggggaatgtgggtggccatggggtgggaagcatcagaggacccagcgcccggagggtaggtggggggtactcgacgaggtttcggattggcggcggcggcggcggagatcgccggagacggcgagggggggttggggtttggtggtggttgctcggtttccgcttccgtcgctaatgggaatcgaagcggggcggtggtgcggtgggagataggccgtccgatttgccttgagattcggggaggggttggtggggactgactactatgctggggtttggtggggccggatgggcagtggcgcttttggttgattcatagaggagggtataccatccatctctctctatcacttgattgcagctaatagtgaatagctttgtatgatcttttaaagtgcaatgtgccaagtgacgacagcttatagtagcagattagcaagaggtcagtttgctggtacttttggaaagatcttacagttatttgaaatgtttgtttctctttcactaaagtatcaaagtactccctccgtttcataatgtaagtcattctagcatttctcacatttatattagattcattaacatcaatataaatgtaggaaatacatttagattcattaatatcaatatgaatatgagaaatgctagaatgacttatattatgaaatggaggaagtatctatttgtctatttctcgttttcacatatcactaagttacttgtaagttgaatcgtttgtaggtatcatccttttttaaaaaacccgggcacctctttgcttccacaaattattctaatctttgaaaaaaaagttaatttgatctttgccattgcaaatatgcctattcagataaatatcatcactatttatctattcgtagtctcaaggcgaagaaagataaggttgtgttacttggtaatggctcaaactcactcattatctgtgctggtccttaccaatctcttcttccttcactgccatcgtgcagcgacgggagtttgacgctcaacggacgctttgtgctccatggcagccccacaaagagcatgaatgtctcttaccagtggggcccaatgcatattttatttgattttcactggttgtaatatcaaggtgccaataagagtcacattagtcaaaatcgtcttacaaaccattgaagagtcattttgcatcggtccgaacggtaggagaactcgttatagctagttttctgtcgaggaacgcgaagcagatccaacataaatttgaggaactcgaattagactttatctgatgagtaacagatcgatgctctctttttgggctggtttagtggtcacattttgaactttgagcccattaaactcccatggacaatcattatttttcggattacatttcataccccagcgtggtcttgtagtgcataagcttactttttacttactagtacagtgtaacaatcttctattgcttacatcccttgggtcaaatacagctgacaaccactcttgtgcagaaattgtttggagtagattaaaaagagagagtaacatcaatggtggaatgaacggggtataagcacgatgcttattgattcattaccaaaatattcctgaaaatttataagtagtgaaaagtacaaatatctgtacaagccactaaacacctacccctccgtctaaaaaacccaatcctaacaacgaatctggacacagattgatctttttttagacggagtagtaaaacttaaccattcaaatatagaaattattaatacttccaaaacttaatatgcaaatacgacacatcaacgcactaagcatttaaaactcaacaacaaaagcatagtaagtacatctataatttattacatgctaaaactcaacaaacgagcacggtaaatcataatatttatcaatatcattttcacaatattttaacccaagtccatccatcttttctacaacattcaacataaatttatccatatattccacggtaaagcacgggacataatctagtatataatataacagcctcatcggatggcctaataagtcaaagaaaaagcctaattttaaattttcaagtttaattttaaaattaattttgacatattttcaacatagtttctttttcaacattagcttttaagtcacaaataacacatttctaaaagttttacccacaaattcatttttatttcctaataagccgttttggcttattaggaaataagccaaccaatggggacctgagtgacggtagaaattatttttttaatgccccacaaataattgagatgaaaaaaaagtgtaagtgggctggtttatttgttgtggcccaagcaaagcaagcaagctagcgtagaatgcagggccttagccggcccatgagagcagcatcaggcaaccagcaaagcaaacagtaagcaactcgtaaagctcctgtagcatcgcaaattagtaaccacgtcggaagtttgcagtgagagggaaaagcttacaagaaggagatcctaatatcctatgttcaaaaaaaaaaaaggaggagatcctggacaataacaacactgaatataaaccttctgcgcaaactggggatggtaatgaaagggcagtttatgagtatatgagctaagctcatttttgtttgttttaatttggtgattttttcgcaggcgaacagcataacttgaccccgcctacgataataacttttgtgccacttgtgaaagtgggtttgccccgtttacaatgatcaatttccgtagtaatgtgactagctagcgagtattttctttgatggccgcaatattatctgtgataattaaggaatttgagctgacatttacaagcactatcactaaaatggtcaccactgtcaattcagcgcgaactggctatgagagtattattgagatgcacttaatagtgcagtggtaagaggtgtatggttttaattaactccaagatcctatgttggggctcataatttttttttaaaaaatatatttggaggaacatctcttcttccaaatctcctttttttaagatggagtatcactgctggttcaccatatagtttcatgcccaaaacgacaagaaccggcagtgttgctctgtcggttcgttcagctgtcggatcacgtattcacgttagccgttattctctcgattcaatggatcggatgcatagatgctcggccctaactaatactattaattaattacattattcatgcatccattttatctctagaaacattccatactgcagcttggatatgtagctagcttttgcaataatgttgatctctatagctatagctacatacattgcttccgggaaagggatataaaagatgataatgacatgatcaaaagattgccaaaggatattagcataattcttcatcactctagaccaagaacaggaagaatatgcatcaaatgcatgcagctaatgcttgagagttgaaacgaaacatgctttacatcgatatggttcgctttggtatgttctccttttgtattgtgcatatcagctactttttgcttgcttaaaatatttttaggtcatttagttatacattgtgggaggagaatatatgttctgtcggctgcactctcttttaattttctgggggatgcaggatgcaggttgcatgagccgttgatagagccaaatacacatatatgcactcatgcatgtatgtacatgacaatgtctggctttgtaattggaatcatatcaaaatttgaacacacgtatttttgtcagatttttttcatcaagaacccagataacgattgcatcctctgtcttaattaattaccgcggctgcagcaacaaatgctactcattatagggatttcaacaaagaacacgcctgttgaccaatctacagttttaatttcttgagagagatcagttaatttgcatgtatatatatcttctggtcaattttaacatgcatgctttcttaattgtgatttgatattttaattaggggtgaaaatggattggctagtttctgaccgattcagaatttccggaaacaaaatgtatcagctcggatagctagtgttggattcggaataaaattcagattcttttttcttcacgtatggaaataaatacagaagttttaatatccaccgggaatgaaaacaatcggaaactatccggataggtgttcagatagttctcagaaacaaagacttagacctgtagcccatattacttttaactttaggctcatatctctagcccaactcattatccaatatttttatcttagaaacatagtatgtggagtagctattcttatatttactagcttcaaaccatatatacgttgtatgggtagtattattgatattgtaaatattaaaaatttaataatgtattttaaataacactatctccttttatatcataagttatttttgacttttttttctagttaacttttttaagtttgattaaatttatagaaaaaatatagcaaacatttctaacacaaaagaaacatattatcaaaatatattaaatgttagctttaatagaactaatttgatgttgtagatgttgttaattttttctataaaatttaaaaaagtttgactaagaaaaaagtcaaaccgacttataatatgaaacggaggtagtattatttttttgaatgtaagaactgattctttttaaataagagtatagatcaattacatcttattaattattaatattagaattaaattaactaatttctaaattgagagtctaacatggatacaacttcatatttatcatttcaagtattttaaattattaaattttaaaaaaacaaaaactaatgtacagaggagtaaaaaacaaagtatgacatattatatttaacaggaatttaatatattctttcgggtgaaataatgagttatatctctttgtttatattgaaagcacagtctaagggatttcatgttccgataaatattcgtgattgtattctttctggttcatatttgctctgtatgtgtagaatttatttttattttcatatctagggtgactatattagttttcattcttagaaaaatatatgaaaccgaatatgatagaactagctggtttccgtccgtattcgagctagctgttttcattcctactattaatgatggtacgataaaagaagaagagaaaacacatgttatccctacttggtgaaaacatataatagataatatttgatagacgttaaatataaaatacaggagccataaactgactggaccaaattaaatcatattacaactaatttgagaaaacaacatgtgtaatatgatgaaatagaaggagcatgcacacataagtttctttaaacaattaaatcaaaggaaaaaaacacatttttttcactaaatttactaaacagatgaaataatatgggacagattaaaatggtgttttgcacaaactacctttttgcattttgtacaccataaaattaggaaccaattttttggtaatcaattttggaagcacttctagtaatttaattttcaaaatggtttaataatttaaaaacaagaaaaaaaaatccatggacaaactgatgcatgggagtaatttttttttttgttttctttgccaaactaacttgacatgccctcatttgattttttgatgatataggagtatcatttatgctgttgaactatatcacttacacgtggaccagtggtggagcccgtatcttcacaatggaggttcagacttacttggctccattctaaaatgtagctatttctagcacagtaacttgttccaaaatgaagctatttcttcacctatcttctcttctccaccaatcacaactctcatccaatcatctctacctactttcttaatatctgtgactacctataaaaatgcttacattatggcaggggtggacccaaggggggtgccgggtatgcactagcatacccaataattccgaaaataagttaacatgtagtaggtattaaacatctctgtattagtatgtctaaatgtttgatgaaagctttctcgtgtggcaatacaccaaggctcaataggcccagctggtggtaggttttcaatttctggcgttatctccatctcgctagcctcgaccgtgccttgtggcggcacagagtgcagacgaaagcgacgagcgaccatcagctaataaccatgtactccctccgtttcataatgtaagactttctagcattacccacatacatataaatgttcatgaatctaaacacatacatatgtctagattcatcaacatctaaatgaatgtggacaatgctagaaagtcttacattgtgaaacggaggaaatagtatttcacttttttacttcctctgaatcattgatatatcctctttctctagatgactacatttgaaattgaaaattgaaatacgaaatcattgaaggcgtgtttcatgatttgtaggattaggtaaattgaatcagtcaattctgattaggaacatgggcatttctttattcagcaagtcaccgaaaacttctgattctaccagttctacattacccatgtcttcactcctgtcacggtgatgaggaaattccgaacagggaggaataataagtaaagaaaataggaattaattggaatttgtgctgtccattcttcttcaattccatctcagggtgcattatcgatccaatgctaataatactatttgtactaatacttttgataacctgatgcctaattgtattagcgtgtagggaggctttaatttggcttgtcacatgggcacaccgacgacaaaaaacctgggtctgccactgcattatgggacggaggaagtagatgacaattgacaaaccaacaaagccagtcgcacattcaaacaaatcaacaagataattcaaatgacatatatattacaaaagttcaactggtttttattgcatgcacttgtgtataaatatgggtattatgtcaaaaagtttgggggtatagatgtacccccatgaatcaccctagttcgccactgatgtgaaccatcccgaaacctaccaaatggtcaaaatgtgagatgaagaaacaagttagtggaaaaacatatatgtccatatttatatatttctcgatgaaaaatgtattgcagcatatattgatccaagcacacatatctataagttctaaaaaaagacgcacgcgcgtgcgcacacacatgtgtgtgtgtcaaagataccagattcaacattcagacaccagctagctggctagctagctagctaacttgtgctagaaagaaaaaagaattgttacggcataattatatattccaagttctaatttaatctgaatagcaagaaaagcaacagtagcgtaatgtctaactaatgaaagaaatgtctataaacacacacacacatatatatatatatatatatatatatttgcgttgtatgcacccatgcgtatatattagggagagagggagggagataatttgctgacagaaagagaagtgagcacatatagcttcaagcacatgaactctctctctctatatatatgtatctcttcagtcaacacacatatgaccacatatgcaaggaaagaactatatatgctcactctcttctgtcggctccctagctcttttgttccttccctgtatacaaatcagcaagacatgtcatcatgcttgaaagttattgattagcaaaaaggaaaaaaaacacatgcccaaaacaaaaggtgtggcctctcattctcttgattgctttccaagaccttaacttgtgactttagtttcatagactactgttttatttgaatgtgtggcttatgggttctgaaggggatggcatggtatttataggaggagattgcgaggggatgcatgtacacaacctactcccttcaatttcctagtttgaacagaataaatgcctcatccattaattaatttgctgatgccacaaagaggtgaacttgtgttttcttgtactccctccatactcgtaaaggaagtcgtttaggacagcgacatggtctccaaaatacaactttgacatcttgtttctataaaaatatttattgaaaagtgatatatgtatacttttatgaaaatatttttcaatataaatctatacatataatttttatattttcaaactcaacaacttaagagttattcatgatttatatttccaaggtttgacttaaatattattctaaacgacttcctttatgggtatggagggagtatacctctaggttcttgctagtttgatcatcttatcctatatatccatgcatgcatggctgagcaacaagcatagaggtaacagaattatagggccttgtttgattaagattactgtggagagtattcggattactctacataatatagaaataaattaaatattttaggaaataaacttaacagatagcttagaataactggtcgaaacaatgcagtgtagaagaatttttgttttgagaaaacatatttttcaaagcataactcaaataattaattttaaataatccagtgaataatctgaaaacaacgaggcctgaggtcagctaatctgtcctaattgcatcggtcgaatttaaaactcctgtaaagagtatctcgagccatttatagttcaaaagtgaagttagttcgtttacaaggtgttcgagctccctttttttttttgagagagaagatagattttgttgctagctcgttggtctacatgcatggaagatatcccatctttcaaaatgttctggttggtcttaactacaatctcacacacgagaacatgattatgcattttaactattgacccccattaatttttgtcaactcttatatatgggttaggagtactgcttcttgttataaaggaaatgaaaaggtccgaattaccccattaaactatcacggtcgtttgagttagcctctaaaaatactagatattttacaccctcaattattcaaactggacaaataaccctctcattcaatccggagtggttttgttcatggcaaaatttgctatagggcataaaaaaagcgtaattagctggtggacaccgcaagaacgcatatatattgtaggacactataaaaaactgataattagctgctggacacttacgatattatttattatttctgatagaattggagagagaaatagtaattaaagacaagtttgcccctgaccgaacttatttcaatccgactggttcctgttcaaaccagccacgaggcttttcgcagtaaatcgatgcctgtcgcaaacccgacgagtactggcggcaagtgcgtggcgcggcggaactcagttgccaaatggagggtacacgttctctgcaccgtcggttaatcaactaatcaagttgtcttttggtgacaaatatttcctagtgccatagaccaactagcatcagagtggattataacagcaggtgcatgtatcgtcgcagtggcagtgcaggatcgaggaggaagaagcagccaaagggcagtaatggcgcaggtggagaagacgggcgcgcgagagattttctcctctgcatgtggaatctcctgctcgctttatcccgtgcgccaggcacagccctattcgcgtccgtgcgtggcgcgcacacgccgtggcatgccaattaccatgctgctcgcgtcgtatatggtgagagaccgtacgtcgtgtgggatgagacgggtattgtcgttaatggtggcactggcatgcgcggcgacgatgcctctggctgcttgggccgcggcgtgcgcgagcacatgtgcgcagcgacgacgacaccgacgacgcggcatgtgtcatttacgtgctcggccactctcctttaatttgtcgggtgatcagccggtgccgcgatcgtgtcactgactcaccggcaccgtccactggggacacaagggatcgtgtcatgaagagcagggttagaatcgtgctctcacacattagtttctctctccaattttcccgaaaataataaaataatatcatgagtgtccaacagttaattatcagttttttacggcctacagcagatacgtcttgcggtgtccatcagctaattacacgtttttcggatgccttgtagcaaattttgccgttgttcatacgtggtatacatgtggcaatccaattagcacttttttattaaacaattcggtggggcccacttgtcataggcaagctcgaccttatctctttcccctctggcctcaatcatgagcttcgtcgacgacatgagggcgaaccaagcgtcagccaccgtccctcttcctcttttccccagcgaggcaaggcatggctaacatcttggaggagagagctatgcccgcggaggcgaggtgctcgccagctgtggctgcccctggtggacgatggacgacggagcttggagagcgggaaagcatccacctcgcatactccggctctgcatagctcacgcggagatgaagctcgagcggaggcaacggtgaggaggctgcagcagcgatgatgaacgactacaaggcagtgaccggtgaaccaagacgcacttgtgactcgacctcctctggtcgacgacttctacttgccgattgacatgcttgtggaggagagaaccacgccacgcgaagaagggattggtgtggagaccaagctgcggcatcggtggggagacgctacagcgaggtagcaggccgacaggctggtcaccggctgcatgccatgcacaacgtgggcacttgtggcccaccagccgcatcttacaatagcggacgtgggcacgcggccccggtgctaacctgcacaacatctccaccaccacctccccaggacaccgccaacgccgttccagttcctccatccgtagcacgagcagggataagcagatgtggccctgggcttctctgtcctaccacgctccgttgtcggcgccgtgggggaccagtatctgccgctgccatggacttcttcgactgcctccaccattgacgcctccttggccccgtcgctctcgcctttcctctggatttgaggccgccgccgctgtcatcctgggattctttggccgaccgtgcaccgccgcttccctgggcttctccggctgatcacgctccaccactagcgccccgggggtctagtctctgtcgttgtcacaccaccgccgctgcctccacctcctctgtgctcggttcaaggtagagagagagagagagattgagggggggggaggaggcagaagagaaggggagaggagtgctggagcactgacaagttggccatgtattttttaaatatttttttagccactttagaaatgtcatttcagccagcctagcccaaaatagtgctcgggtgtaatttgtccggattaaagagttgagggtttaaattgtctgttttttgaatttttttgtgggttgggtaattcgattgacaactatagtgttttttttaggaggggtggggattcggactttttcctagaggaaactatttgtctaaattagttatgccatcgtcatcagttgcatcttgtgtgataaacacatatatactagtccccactctattgtgtcgtgggaaaacagagagctttaacaaccattagctactcctcctaatgaattagcgaataatggtaaattttggaatagttattatgacattattgaagttgtcaactattatgtatgtgttaggaaaatgtccattctatacaacactaaacttttatataaatgtgtgcaaaacaacagtgaacttctaaaccattgtctagataaagagtgttttcagtgaaatgacgaccaagtggcaatgtagggagaagtacagcacatcgagtatttgaattgatgtaagccagcgctaaaacatttcttgaattttttaaattacttcaaatattcttaaaatattatcactatcttttggactatctataacctaaataaatttggcaactgtgaaacaatatgtagcagtttaggactttggtaaaagttgaaggttgtaacgtcaacagtttctcctctatatgataaattttattgttcattattactgctttttaacacccatggttcacaacacacttcacaccgaattcatttttccttagtagttggttgtcaacacattcttgagggaaacgatatatcctcaaaaatttatatgctactagcaacttgagaaaaaaaacaaggtccattttacaactttggattgtcacgcaagtttggttttcaatccaaaactattgaaatcattcagttttttatggtggtgcaaaattcgaatggttttggtacctaaacacttgaagagttttgaatatgtaaattctggaaagattctcacttaattgagagtatttactagtaaataattttggtatttataattgatgcagggtgtttataagtactaaaaccattttgagtcccccaataaactttactttctaaggaattaatcgatttagctatgttctcttgaaaagaattaataattatgagtgtacatgctgtcatggggatcaaaagtgttttccacatcttaaggggatgaccccttgttttctcaaaatactttcgaaaattaataaaaaaaacttataaaaagatgacattgttactatgtaacatatgataatcaaggaaattcaaagtctaaattaatcatctctcgtattgagaaaaaaagacgaatctaaactgtgaacaatacttaattacattattcaccactatatttctccttttctttttcttggtttgtaggtcgagttttgacatgagattttttgtgcgtgatagtttggtagatgtcaatatattatacattatcaaaagtttttaggttcatccataactatcagtattatcattatctcaaaaaggttaattggatacatgccattccaaatttgcatatttttaaaaaataccattactattcacccatttcaaatcatgccattacaactttacagaaatttgagatatgccactacttaccccttcgatgcattcattaaaatttttagaccaatttaccctttcttctttcttttcctttttttccttccttctctctcctctcttcccactggtgactagtgctactcactctggcagctcctccatctgcaactcactccgtcgatggtgcactgggaggttggggcccacggttcccctctcttcctctcccccagctactcaaaccgacggcagcgcatggcgaggtcagggccgatggttcctctctcttcctctcctctgctttatttattgctcctcatctcctctcactttagatagagcaaagtcggcgactttgccaccgtcgttgacctcatacatcttcgtctccgacctctccaccatcggatatgcttctatctccaacgggtgcactagccatggccatgttgaggggaaagggagagatggctggtggcggagtggaggtggagggggatggccatggtggccaggctaattggaaatgagatagaggagataggggaaggaggaggaacaagtctaaaatttttaataaatgcatcgaagggttaagccatgacatatctcagataactgtaaattgtaatgtcttgggtccaaataagtgaatagtaatagttttttttttaaaaatgtaaatttgtaatggcatagatccgattaacctaaaaaaatatcagtattgtatttgagaagcaaatttacacgagagacatcccagctatgtcgcattgtaacatgtgcccattgcttttgactattccattgctttgtttatgcagggaaagttaaagatagctagctagctataaatagaaaagctaagttagctaggtataagttaggccctgttcgtttgttctacgagtagagaataaaattttggataaaagtgacatgctttttaaactgctaaacagtgtgtttcgtgtgaaaactttctatataaaagttgttttaaaatatcagattaatctaatttttaagtttgtaataattaaaactcaattaattatacactattaccacctctttctttctgtgtgaaacacttaatcttaatctttatttttatattcgggagattcaaacaccacccaaggtctctctctaaagatgaagaacgagaatttttgctctaagggaatacactagagataggtctcacagatgtctgatatgacgtgaggatgcatttaatcctttctgcttgattcccatgcatgatggaaatattttgcatgtaagaacatctgtgtattacatattatatatgacatgcatatatgaaaaaaaataatgagagaacattctccaccaaggaccatacttaatctttagtgtacaaaatataggatactccacgtacacggacatatctgaacaggaatatcacatctaaggcctgtttagatcccacataaaaattttacaccctttcacatcgaacgtttgaacacctgcatgaagtattaaatataagctaaaaaataactaattgtaaagattgcgactaatttacgagacgaatcttttgagcctaattgctccatgatttgataatgtggtgctacagtaaacatttactaattaatgatggattaattaggcttaataaatttgtctcacggtttactaacggattttataattagtttttcattagtacccgaacactccatgtgatatcctatataatatccgatgtgacacgtcaaaattttacattcctgataactcttgagcaaatgaggagagtgatcccggaagaaaaacgactgcctacagattgggattgcttagattgtatctcaacttatctctcgagttctaccctaacaagggagaacacagggacataaagacaaggcttcccatgagacgagggtatcacgatctccatacaccaatgcaagccacgtcaaatccacattccgaggattcccaagtgttagccgtcaatcatgtcgccacgaccttaattatctcgccaacacaagtgttggttccattaggattttcatcatataatttgtttttattgtgtctaaaaaataatacatataaacatgacatcaggatttacgatttcgacggacggatttcgtaaaatttcgatgttccgacgaggctcggaagtataaaccgtctaagatttcagggagtttcatccaaattcaaatttaaattgataaaaaaatcaaataaaatcttataaatactatgatattaatagaacctattgggatataaattttcgaaaaaaatgatgtagtgtgtatttactgtaacttacattagaaaaaaaagaataaagaattaaaaaaagaaaaacacttacattggcccgggttgcatgtattaggcccagttaatagttggtccaaaatactggagcaaacaggggagtggcggcgagctgaaacgactgagtcaatatgcttttttttctttatcattttttctaatgggctggtcgagatggccaaacacacaggagctggtcacacaatctcttcgaccgtgttagctttccatcgatggaatgttacaaacaaaaaagcttccaatggattaatcgaacggctaattagttcacctggttgctgtgccaagagcgccatgtgacgaataataaaaattacctggtgtccaatactacatagtaattatttaattatttatttaattattagctagtatatgttatatttaatttaggatcggccacccacttttgcctaaaactgtcacatcgcccaaagcttctgggagaggattgatatcagcccagcaatctcagatgctcaaagcattcacgcgctcaaacgacaaacagcatccaagtctacctgctctggttttgggctctttggaataatcgtcagtcatcgattgacaagatcatcagagttgctgaaggaagaggataggcatgtagcatttcattgacaaggttgaggtcaaacttttataatttagactatcaatgactttaaaaatatttagtttaaaggaactagaacaacatatatagatttgtcttttaaagtactataataaaagtaaacatgcatttatttattatatatcttataatagaaaaacaaggtcaaagatgtatcttgtagaccgtgttattgtccaaaacgttaattaaaatgaaaccggagggattatgtttttcgtcctcgctgtaactctatactctactgtactcctctgtataccttgcaaacaatttgagcaatgaaaaattattcaggtgggaaatctctcccctccggtgattcgttaaaaaaaaaaaaacttatgactgcatacgtcactactacagaaagcgtttttgcatacgggcggaatcgatcttcacatgcggttggccggcccgcatgcgcgaaatggtctgcaaagatcaccatttgcgcatgcggccgtcgcagccgcatgcgaagattgatcttcgcatgcggtcacttaagacggccgcatgcgaaaatagatcttcgcatgcggtccatataagaagccgcatgcgaagatatattttcccatgcggtcgacctaagaagaccgcatgcgaagatctattttcgcatgcgggcgtcttaagtagaccgcatgcgaaattcaatttccgaatagctaaaataatatttattctagcattttggtgattcgtaattaatatgaaattattgagagatttattatcgtatttcggagtagtaagcatataagataagacaagtgccgcagtaacaaacatgtaatacataaccattaattcaatcgtaatttacatacaaatatataatacaagtggcacagttttttcatcatatgtataagtagtgtacatgttattgcatatgttctttctcccactctctgagaggtttaaatttgtcgtccattgcgagttcactctggttgtcgtagaagagacctcttgcgttgcagacatcgcgacggatgaatcggcagaggtcagcggccacgttcaagatagtagtgtggttgaatcgttgtgcaaaatatgggatttcggggatctgcacacagaaaggaaaataaaacggtactcagtgagaagtgtgtgcgagatgggtttctttgtagagaagagttcgatgacctactcggttactggttgttttgtacctcccatttactctgagcatctcgcacacgtaataaccacacaagttggttcctggtggttgtttgtagcactgcgatataattatggggaccgatctcagtagatatatttagtatatatgtactattcgataattagttgtattggtataaatttgatagtaccggccagccagtcctgacggataacttcttctgggatggaatatgtactggtccacctcttttgcggtagtacttgtgtgctctgtttgaaggaaacaattgttttattagtagttagaagactggtgatcgacctaaacaatttatagtaatgaaatgtttatcacttacaaattcaaaatagtgaggaattccataaatgtctccttgtcatagtgtgcggggtccaatgatatgatcaattggtctttcggatatacaaggaataatatgtagtggtctctacatataagataggcttattggagacagaaaattccgaagaagataaattaattaaacaaaaagaagagagagcttacgtgaactggtaggggaccattaagacatctttgtcggcgtgcgccaacattgctattgccaagtatgttgctacttctagcttcttcctcttgtgcaatgtcttcacatattcttccttttcttccggggtcttgccaaccaattgctcgcagtcctgtctcagctctacggtgtgttgtgttttgcatattcttgttggatcgacgtatccaacctttgctccagttctatcagcttcgtggaattgcatactgtacaatgaataaagaagaaatgagatttggtttatttgtttcgaatgaaacgtgcaacatgtaataaagagtttagacttacagacagaaagccgcaacgagattaacgtccattttatctagcttgtagagggcgtaaaggtcttggaaagagataaaaaatatcccattaggaccactcatgaaagcgccttccgggacggcgacgcttatgaaaccgagacctttcctagatgccttcatataccattcgtgcattaccctcatttcccatggtagcttgttcataagataagttggcaagaatggcttgccatactcataagtttcaggcacatcggcagataaccaggattgcacttcatcttgggccgctagtactgacttctgggagtctgacaagacgtgagcaagttcttttctcttctcagaattcctgaaagctgaaaacatgaacttctccttatccttgtcaatctcctttgggtcgtatgtcgatatcaactttggaattatacgacgaggttccaaagtattagactttggttcggatgtagtaccatctggtatgtgcacttcttctaccagagcagattggggtgtaggtggagaggtttgaactgagggcggagccgggggagcatgctgtttagttggggaggtgggagaggcttgaactggttgcggggtcgggagaggcggttgttgagaaggggagggtggtggtgtaggttggcgaggcggtgacctaagcggtggtggtgacggcggatgtcgaggtgacggtggttcaggaggcgacggtggtgcaggagcggcagcagtcattgcctgcgatgaggatggggttgaagatcctgctgcaagaacggccgcgctcaggattatgtctctgcggtgccacaagataaactgattcactgcatcaccgagaagttcaatcccctcaggtgcaggtatgtctagttccaaggaaacgtggtcgctatggaccttggcgacctgtacccttgcgtaatcctcagggattgccgtgttgtggaattgacgtccgggtatcgctaaacccgttgcaacctccttagtctttccagcgcggccgattggtacgacgagactgcacggagttggtccagttatactatccacagggaaggtacttgtctgcactgagcctacactgctgggtacattagttgtttgctgtgcggattgtgtgggttgctggctatcagggaataaccttggaaatgctgtcgggttttcagctgccaacgagtagaagtgttccttcacttgcgcatagatcttgtccgatagttgttctttgtatttgtctctcttcttataacttggtgcgtcttgtggaaacccgaccttccaacttgtctttgaggacaaaccccttacacgtccagagtgttcagccgtccccaacgccgcagtaagctgatctctctccctccgtgggacgaactgtcctgatctttctttctcgactatctgctgcaaattagtagtcacttcttctatgtctggagtctcgaatagtatgtctccctcatccgagacttgacctgtgctgcgcgcccaaacccagttcttgctacgttcaaccatggggtctaccagcaggggcttaccggccgcggcaaatctttgctcgatctcccgccattgatcgacgtgaccagcgtatccgctcgaccccaatctatggggatatctgttcttcttcgcgagctcggacatttttttcctcaaagccaatgcttccgctgttgtacgatccgcaacaaacgtgtcccagtcagcctgcgatatatgtccataatccgtaaacggtgggagattcttctgaacataatcccgatttagatcggacttccactgtcgccatcgatctcccatctttttaagtgcgtaatctctccccctgacctctgatccaggagggaacacaaaatacttctgcaactcattccagagaagtgtcttgatgttgtcgtccactgtttcccacaacttgacattaatgggacaacgcgtcctgactagagtgccacaggcgttgctgaacttggaccgcactatcggtggctcgatgggcttcccatcctgatcgagagcaatcacgttgtaagtttccttgggtaatttattcttgcttctctcaccacgtctttttttcccactcccgcctgcacttgtagatgtctccgtacgttcaggtgcagacgtagcggtgtccatctcaacttcttgctctgtcctgttcctcccggctttacgtttcgagcggcgtcggactaccatctgcacagaataggtaactctatacaccattaggttcatgtcacatcatagttagggaataatacatggctaacgattttcagcacttacggcctgttcgataggtatgtagtccggatcatcatcgcggggggcgacttgtgttatttccattggaaacgggtcacttggtgtgcgccacgtttcttcactagaagcgcctggctgcttattgctaccggaattttgaggagcgttaccttcttgaggcgctattggtgcgttcgatggaaccttttcgttcgacatcttccaacttgacgtaaaaaaatttgacataagtcccaattttacgtaagtcccaatttaacgcaatttcacataagtctcaatttgacataagtcccaatttaacataagtcccaattatacataaatctcaatttaacataagtcacaattatacataaatctcaaattaacacaggtcacaatttaacttattttcacataagtcccaataacttaatttcacataactcccaatttaacataagtcccaatttcacataagtcccaatttaacataggtcccaatttagcataagtcacaattaaacagaaatctccaattgacataggtgccaatttaacataagttccaattatacataaatctcagtttaacaaaaatcacaattatacataaatcacaatttaacataggtgccaatttaacaaaagtcccaattatacataaatcccaatttaacataagtcccaatttaaacataagtcccaatttaaacataaatctccatttaacaatccacaattaaaccttctcaaaattaaacaatccacaattgcacatatcacaatccacgatgcacaattaaacaatccacaatccacaattgcacatttcacatttctaaaaagtaaatgttaccgagcgacggcggggacgacctggcggcggcgacgacctggcggcggcgatggcaacggcgaggggggagaggtccgtgcggcggcgacggcgacctggcggcggcgacggcgacggcgacggcgagggcaacggtcctggcagtggcgtcggcgacggcgaggggcggggcgacttcggggaggagccggcggtagcggggacgacttggcggcggggacgacctggcggcggcgatggcaacggcgaggggggagagttccgtgcggtggcgacggcgacctggcggcggcgacggcgacggcgaggggggagaggtcctggcggcggcgacggcaaaggcgaggggggagaggtcctgacggcggcggcggcgacggcgtggggcggggcgactttggggaggagccggcggtggcggggacgacggcgacggcgacttgggaaattttggcagcctggcggctagggtttcgcgggagctgggacttagaaaattttggctccccgcgctccctatatataggcgcagatcatcgcatgcgggcggcttaagggaccgcatggaaaaatatctttccatgcggtcgacataagccggccgcatgcgaaaaagatctttccatgcgggctgttaagccggccgcatgcgaaaaagatctttccatgcggtcgacataagccggccgcatgcgaaaaagttctttccatgcggtcgacataagccggccgcatgcgaaaaagatctttccatgcggtcgacataagccggccgcatgcgaaaaagatctttccatgcgggctgttaagccagccgcatagaaagatctttttaccaaaaaaactcatattttttttcctctataagtaaactgtccatatatatttttttcccaatatttcgccacaattatacattccaaatgtttttggcactaagaaaactcatgaaaattactcaaaactcgtaatcaaatgttacatgctaatgattacaacataagggggacctaaattcatgcacgtacatttgctaatgattacaacataagggggacctaaattcatgcacgtacatttggaatacaatgagaactaaaggttacgaaataactatgacttaataaccttggcaacaccatctgctcgaacgtacgacatatttgcttcatcgattgttctctcaaccttcttaattcgcataggaagatcagtaaacaatggtacatcgtcgaactggttgtaatcattggggtcttcgatgttgtcgatgccgacgatctgttgctttccggatatgacaatagtttttctttcatctgaagggtccttcacataaaacacctgagccacacgctctgctaaaacccatggatcatccttgtggcctgttttactgtgatcgactatcgttagcccgtagtcatcaacggaaacccctattgtgtctttaacccattcacaacggagcacagggatctggatgtttaggccatagtccagttcccatatttcttgaatggtcccataatacgacctcttttctccactcgtgtcaatcgcttcgacacggatcccactgttttgtgaggtgcttttcatgtccttcgtagtcgtactcaaggtaaatccattgatgtcgtaaccttgccatgaatt

SEQ ID NO: 31490 - DNA, 11196 bp, Oryza sativa
atgaatggctcaacgatagcgagctgttgaagaacgctgttgtgtgccgcggacacctttttgtaatcattatcgaagaactgcttcctaccaacagtaccccttccagacaatctaccttcatgtcgatgaacaggaatgccaatggcattagcatcctttatgtagtccatacaacactcgactgcctcttcagttgtgtatccctctatcattgatccttccgggtgagcgcgattgcgtacatagcctttgaggatcgacatgtaacgctcataggcccacatctgatgtaagtataatggaccaagttcaataatctgagggacgatgtgaacgatcaaatgctccatcatatctaaaaatgatggtgggaaatacatctcaagctggcatacagtctcgacggcaaatgtctgaagcggacctaattccaaaggatcaaatactttttgcgaaattcgattgaaaaagtagcacaactttgttataaccacctttgtatggactggtttgactgcccttatagcaattggtaggaacactgttagcaacctatgacagtcatgcgcattgtatcccgaaatggacaaatcctttattgatactagcttcctgatgttcgatgcgaaaccagtaggcactctaaccccttgtaaacatttacagaaggcttttttctcatcaagtgtcaacgagtaacaagcaggaggaatctcggtcttcccatttggcagcagtactgggtgaaggtcatgccgtatggacaaatctacaaggtcgttacgtgacttcaatccatccttcgttttactcgggatgtccagcaatgtgccaacggtgctatcaaacacgttcttctcgaggtgcataacatcaattgcatgtcgaatctctaggtccttccagtaatctaagtatttaaagaaaattgagtgcttcttgaaaggcgacgcagtaccgttgtcaccatcagctttcttcctctttactgtcttcttctttccctttccatatacaaccttaatcttctttgttatctcatacacgtatgtaccacctcttgctactggggcagtgtcattctccactgtattatcgaacaatctagccatcttacggtacctatgtctttgtggtaggaaccgtcgatgtcgcatgtacactgtcttcaaagacgacgtcaggtatttgtatgaagttttctccagacatatcagacatccagtcttccctttaatctgcccagataatgaaaagtttgcaggtaggtcattgatggtaacgaatatgattgcacgtagattgaagtgctcccgcttaaactcatcccatagtcgtaacccctctttccaaagctcctccatgtcctccatcaaaggctcaaggaaaacatctatgtcgattccaggttggtttggaccttgtatgaggatagtgagtagaatgtactttcgtttctgacatatccatgttggaagattatacattgtgagaaggactggccatgtgctgtgcgagctgcttaagtcaccaaacgggttcattccatcagtgctcaacgcaaaccttacattcctaggatccttagcaaattctgggtgttttgcatcaaatgtcttccactggcgagcgtcggcgggatgtcgaatcataccatctattttccggctctcttgatgccatctcatcaactcagcatcagtcgggtttgagtacagacgcttcaggcggtccttaattggtaggtaccacatcaccattgaaggaatcttcccgcgcttacccttatcagaatctggatcggtacactctgaatctacgggcccattccccgttttataccgacttgtgccacacgttgggcaacattccaattccgcatattctttacggtataatatgcagtgattcttacaagcatgaatcttttctacaccaagagataaaggacatatgagtttcttcgcttgatacgtgttcgatggtacaaagttaggcttaggaagcaacacacgcaacaaactcatcagatcattaaaacttgtgtccgaccatccatgtttagccttcaatctcagaagttcaagcactgaacgcaagactgtgaaatccttatcacatcccttcgtttcatcgtaaagaagatccttcgatgccttctctaatgcttgccaattctccaatcctcgtgacctgcccgctagcacctctggttcaacatggcgtagcatatcctctaaatcaaaaccaccatcgaaatcatcactatcggtggaaacatcgacaatcattctttcacgcgacatgtcttcgattataaaattctctgcctcattcatctcgaaacttaactcttcatcgtcatcttccggattggcgaattccccgtgataggtccaaaccttgtagttggcggtgaatccgtactccattatgtgacccaatatttcaccaggatctaccaacaatttctgattcttgcaatgacggcacggacaaaagatctttgtcatattctccctcaaagcatgctccttagcctgatcaataaatttagatgcttccttaataaatatcggctgcgttctccgcatctcatacatccatgacgaccgatccatctaattatataaaggcaaaaaagttacagataaaaaaatagaccgcaggtatttcatacaaaagtttaaatgcatttgtctcccaaaaaaaatacaacaatacatgtaactagtatgtacaattgattacatgcaaaatttgcccatcaaaacatatattttgaagctagattttgcaaaaaatagttggaacaaaccttgtcaaaatattaaaaaaactccactttccaccaacgaaatataacaaaaatggagccaaatgaagcaagatagagagttcttcacctttcgtatagagttcaagtaaaaatttcgagttgaaaacctccccccctaattggtgcttgctttaggagagagaaagcttcgttttcaaatggtcaagctcgggcctggaggagcatatatggccgatcatcgcatgcggctaatcaacccgccccgggggggcggtttttgcaggcgccaccacaagcggcccgcatggaacctaccgaccccctcgtacagaaaaacgatttttgtagtagtgcgtgtacgtcttccaaaagagtaaattgcaatacttattataaagcttgttattgatacaagctagatgcatacatacatgcgtgaactgatcatacaccctcttaaccaacacaagctgatcgaagagaccgatatcaacgacgaatcactaatatagtgtatgtgtaatatttgtgacatcaaaatttaaacattagtggatgcatccacgagaccgtaccacgattcatcacttcatttgtacacttcctagaaagagcatctccgataacatcctttccaaatctcactttccaaatgttcatttgaccgatttgccaaaaaataaaaagatagtcaaatttacctttcatttcaatagcctctctattacaattctctaatctgatagtgggtctcacatgtcagcctccctacttctttccccttcttctttctctccttcaccctctcctctatctcttctcttcctctctcttcttctttgccggccgccagtcgaatccgtgtggggaaagaggcgttggaggccgtgcaaggacagagacggtggagaccgcgacgagcaacaacagtgcagttgtggtggatggcgagactccaaatgatgagtcatgagagagactgtgatgaagccgaaagcgcagccagaacgtattcatcaccagtgaccggtctgacctcgtcgacaccgccgctaaaggtcagcaggccctccgatccatccctgccctatcatcgtcgttgcttgctccgccaccactgctacaactccttgctccaccatcagtgccgtcaccaccaattgatccgccaccgtcggtgtcatcactgcttgcgggtgggggccagtacatggcgagagagagagagagcaagagagaggggggggggcggggagccggaagaagggatgggagagatggtgggacccacctttggccaatggaagaggctggctacgtttagccattcggatggagagtctattggaactcgttttttctctatgttggagatgatctaaagctcatcaattttttttaatacaaactaagtaacacatatataattagataatcaaattaagagtatcttttattttgtcagatgaatttgttttacagattaaatagtatataatataggccgtacctgatctttgtcaaggttatggataccacgtacctaatagtagttgactaaatctcggcaggacccaccacataccatgtcctatacggaaacaacctgcggatataggaggagttctggataaggaaagacaaccagagttctacatagaaatgacaagaactactcggattgtatccatattggtttccttagttctacttggacaaggggacacctatgtgtataaatacaaggctccctaggaggagaggggacacaaccaacgcccaccatagacggaacaacagaagccacaacatacaagccaacatacgacaggacaagacgccggatatcgacttcagggataggcacggctagtcccctacggtgtctccagatactgtcaggagagacgaaagcgctatctctgatctcgccgggcacgaactcgaggaggaagactaccctgttatcgactacgagtcagaccttcagaccgccatgtcgacaacagttagataggctaccccacatattgtacttgtgtgatctagatgaataaagagcaacaacggcttcggccaacatgatgtagggttattacctgataattcaggggcccgaacctgtataaaaaggcatgtataaaaatctccgtctccatctcttttacctcagtctcgcgtataccctagtaccaacgatccccataccatgtaaataccagaatcgcgacatcaaatgtcgacagtggcgtaccaggtaggaggattttggtgcttcaggatttcaatgagatgggtttaagagatagattctccaacaataagctactcgacgactttggctatggggagatctaacctgaccggaatatgtctttcgacaagagcggaaccatagtcaccaattatttgatctctcgagatcaaccaagcttcgacgtgttgccatggtgtcggcatggtgtcggcatgatccaacattaaattctcgacgtgtgcgacatcaactggtgcaaggtatcggccggctgagtccaagtcgaacccgacaccgatccctaccaaccaaccaagcacgtcgaggagccaaaaatctaccgctggattagtactaccgtgttctaactaggacacgatttctagccacgatctactggtcgacagcctgacgtcaccctgcatgtccctttaccgagccaacacccatgtgcgcacgtgcatgtatattggccgaacagagctcctatatgtattttgatgacacatactccatgtctcccaaggtaattagtaagattaatttttaaattggtctactaattccgtagatacatccggcatatatctgcaaaggtacgcaatattttatacacaatttaccatacctacttttccgatctatacgatattatcagatctataatttattatgtttacctagagcatatttttttatacaatatctgttgcgcgggtgtccccgatgttaaatcgactacgatctaacgctggggctcgctctatcttcttctgtataaatcatgcttgtttacagtttacataatgccctgatatttaatctgctcgttatatcctgataatgctagaagatccatgcagtttttttgagtacatattcgatattatctgctatatatcttgtcttctagaaaatatttttcaggaacaattgagcactcgagtaggttgtggtcaagtacaccgcattatcgagaatgatctcgacaaatgcagagttgtttcccccaatctaccaacgaagaccgacgacctatctaatagcaccggccgtggctagactatttgagaaaaggttgttaacggataattcctcgtgaacgttgtcggcttaatcacacgacatgattgcaaacggacatctggatatgctacaagttgggtgtgtgagtcatgctggccacatgagatacacatgtaataaaccaactctagcgctttcattgttgttcgagagatgattctactcgctcgctggttctcgaaccagtacgtagcaatctcccacaccgcaacttccattggtgttcgagagatgattctactcgctcgctggttctcgaacaagtacgtagcaatctcccgcaccacaaacctccattggtgttcgagagatgattctactcgctcgttggttctcgaaccaatacgtagcaatctcccgcaccgcaacctccattggtgttcgagagatgattctactcgctagctggttgtcgaaccagtacgtagcaatctcccgcactgcaactttcattggtgttcgagaaatgattctactcgctggctggttctcgaaccagtacgtagcaatctcccgcatcgcaaacctccattggtattcgagagatgattctactcgctcgctggttctcgaaccagtacgtagcaatctcccgcaccgcaacctccattggtgttcgagagatgattctcgctcgctggttgtcgaaccagtacgtagcaatctcccgcaccgcaacttccattggtgttcgagagatgattctactcgctcgctggttctcgaaccagtatgtagcaatctcccacaccgcaaacctccattggtgttcgagagatgattatactccacaggtggagaaagcgtttgtagtaccggtttgtaacccccctttagtcccggttgtctaaccgggactacgaatctgggactaaagatagctatctttagttccgggtgaaataatcgggactaaaggtcgatttttagtcccagttcgtgttaccaaccgggactaaagatctgtcagccacgtggccggccgaaccatctttagtcccggtttgtgttaccaaccgggactaaagatcggtgtaccattttttttattttgcatggcgctgtttgctgcaaggttgattatatatatatatatatatatatatgtgtgtgtgtgtgtgtgtgtgtgtgggcgcgcgcgcgcgcgtgcgcatatgtgtatatgtataaatacatatattacacacatatgtataatttaaagcacttaacattttatatgcatatatattaccaaaatatatattaacactaaagtaaatgtgtacatatataaatatatatatacacgcatatatagtacaattcatttgctcgatagctatagatacgacttcgacgccggcgttatgtcagaagaggaaggaccgacgttatgaattgtcgatccatcgtagtagaattcaccatcgggattaaggacttcttcgttgatgaatcccattagttattcttgaacagccgtgataaaatccttgtgtgggagattatccctcatgtgaatacgctatcattcgaaaaataatgacatatcaatatatgaaattaataaacaacttaacaaatcgatacgcaatgaaattttgaatggtttatgtatacgtacatcgagctctcgtgtggtgtatatttggtttgataggcagtgggcatactcgcatatgtagtagccgtataagttagttccttggtcctgctttgcacacttcatgagaaacgatgagagatttaatataatctttatatttaactgtaattagagatttaattaaatacaattttggatcatgcatatactcaccggaaaatgaaacctccatccaagtttttctttccaagtcccgcggaccaatttacggaaccgatcccaagccctacatgtgcagttgcaagctatgattaattaattattacccgagatcaacataatagcaatagaatccccgcgactttggaatagatggtattatattacctgtctatcagttggaagaccttttcaaaaatcttcttcctctttattcattgagtcatacacagtgactctgcatgcgtccaagtcgaagaataacaggacccagtggaatctggaatatgcgtgagatgagatatatatgaaaatatacatgctatatgtatgggaacgaaatttgttcgaacgacaataaaaactcactctgtgttgtacggcagtagtataaacgtcttgaaatgctgctgcgttagaagatgcacgagattgtcctctgtgtctttctcgtacttgtcgatcatttcggtgttgattttccgagggtcgatgaacccagtatcgtaaaccccccgccgtcgggccctttgaatctccattctacaacaataaaatgaaattgttattgtttacatatatgacaggagctagttattgaacgaaacaaatcgaactcaaagatacttacaaaatccatgcgctcaaaagagagacgtcgagggcgtccaaatggtacagatcgaagacatccttgaaatggagccagagaacatcttctccttgcaagaagtcggggtttctgatcctcgctccgaacatctctctacccttggcgctcatttccatgtaccgttcatggaatttgtacatctgtgtcggtagggactgcagctgctcaggcgtgacaagcggtttaccgagttcaaacttgtatgccacttccgcctttaggattggtgtggctccaatcagctgatccacagttagaccggtatctgaaatgaaatccgttattccaaaattttcgccggtcaccaacggctcgacctcttggtttggttgttctccaagctgagggactggtttggacttcttgtgataggctttctgaagtgttcggtcatagtccgatatctttaaggcctccttgtttgctatggacattcccttaaagaagttcttcacgcttgggtcaataggtatcttcttttcattactccgaggcttgagttgcttcttcacttctcctgccacataagcatcaagctcctcttgactgcaatcgtacggcggctccttgtttgtggtggtgtcaactttcgccttcttcgttgcccttgtgtaggcaggcggtggagcttggtgagaccttgtcttgggaggtgcaggcagacacggtggaggtggaggaggcggaggagccggaggagatggtgcagggggacgtggcggaggaaccgaaggatatggtgcaggaggagatggtggagccggaggagatggtgcacgagacgccgcttgtcgcccagggaggatgatgtaccgcttgcaccatagtataatggcgtggcttgtgcctcgtagatgcgtctcaccgtttcctcctgggtagtccaactcgaggtcctcatacgcagcttccactagctcaacttcgaccctcgagtatcctgctggaatcggcctgcagtggtaagtccctgaaatgtccgttgggatggccattcccgacaccaccttcacgtgatgagaggttatctattagtaatcgacctaagcagaaacttgcggaatgtacaagtcaaaaaatcataaaactatgagcataccttgattgataagttcttgaagggaatatgcagctcacatggtgtccgttgcgtgatctcatcaacggggcaggtggtttcatcctgggtttgcatggcgtccatgctctatgatcctacctgccccgttaaggcacagctgttacgattgcctgatgggctaaccattgcaggaggaatgtacggctggggatcctgggaccgatgtgcggccatgcgttcatccaccttccttgccacctcctcttgcatgctgagctcggctcgataccctgtactcaagatctgcaatctttgcctcatccgactcctgtacgtgtggatgtcctccttgaatccaatcttccagggaatcacgcctttccctggtgttcgtcctggatgctcgggagtctgtagggcgagtgacagctcgtccttctctctgtcgggtcagaatgtgccctgagaagaggctttcactgcgtccgttagtcgactggcagcctcgcgtatctgatcgctgaagacaagggagccatcaactgggttaagcgttccaccgtgagcatagtaccagaacttcgatcgatccggccatttagcggtggccggttcgatacccctctcaatcaatcttgcctccatctcctcccacttcggcattgcgacgctatatccgcctgaccctaagtggtgatggtacttctttttggcggcattttctttgtttctggccatcatcgcttgcccttgttgccctgtcttgtaagcaacgaacttgtcccaatgatctcttagctttgggaatacgtcgaagttcggtgttagtcccttcaggatgtatttcttgtagagatctcccttgaagctctggaactgttctgccattttctgtagagtccactgtttcactatgttctccgtacccgcgggtagcgtgagcatctcgagcattgtggtccacaacatctctttctctgattccgggacaaagctgtcattatccccgtgtgcccttgttctgcgccagtacaccgtgctgacaggcacgttgtccctcacaacccaaccgctgtggcgtacaaaattcttggctgcttctgccggggcactaggtcggccgtcttcgtccacctcagttatgatgtgccgaccctctatcttcttcacagaacctcgttgtccacgtgccctcttctgtccagcggagggatgacttccactagcctcctcctcctcgttcccctccgcatccctctccatgttcccctcctcgttcaagtactggtttggatcctcgtttccctcttcttcgttccagtactggctacttccctctgcgattgtatcgtacagtatctgttcctcatcgcgatcagccatctgtgcatacaaaaaatatttgttaggtctataggtcatatttgctaagcgtaatattaaaactctaataatcttatattaaaattgtaataatcatatatgctaa

SEQ ID NO: 31491 - DNA, 32240 bp, Oryza sativa
tcaccaatcgggactaaagatcttttcccgctatttccaaattctttttaaacccggttagggttaagaaccgggactaaagataatagcactgaattttgaatttcattacatttgtgtttctaaaatagtaaataatgcattacaattatttaaagtcgaaaaattaatgacaaaaccttcgaaaaattattgttgtctgtagtaaactaagtggataatatataattagcgcatgaatgatttaaaattgttaaaatttttaataatcatatataattagcatatgcatgatattaaattgttaaaaattctaattaatatatgtaaataccacatgcatgatttaaaattaataaaaattctaataatcatatataattagcatatgatgatatgaaattgttgaaaattctaattaacatatgtaaataccacgtgcatgatttaaaattaataaaaattctaataatcatatataattagcacatcatgataataaattgttgaaaattctaattaacatatgtaaataccacgtgcatgatttaaaacttttaaaaattctaataatcatatataactagcatatggttgatttcaatttgataaaaattctaataatcatacataattaacatatgccatacaacaattgattttatggatattcaatacatcaaaaatagtttacatcgtgtacacaacaattacggtaatacatcagcggtgacggttgaccgcacgtactttctcctgactattgttccttccttgtgatcgctacgtgagtaaggggtgtcttcatttgttaggaggatactagggtcaatcgtcactgtgaaagggggttgcccatcaaactgatcgtaatcttcgtcagtcttgttctctactccgacgatttttctttttcctgggagaaccacgtggcgcttcggctcgtcaggccctttgccctttttttcctttgctaaacatgtccttgacgtaaaaaacttgcgttacatcattggcaaggacaaaaggttcgtccgagtatccaaccttgttaaggtcaaccgttgtcatcccactgtcatcaatcggtacgcctccaccagtcaacctagcccataggcaccggaacagagggaccttgagaggtccatagtcaagttcccatatgtcctcgatggcaccgtaatacgtgccagttgtaccatcgtgtcccatggcatcgatacgaacaacactgttctggttcgtgctcttcatgtcttgggctctcgtgtagaatgtgtacccattgatttcatatccctggaatgtcgtgatcaagccagatggttccctcgccagaaaggccagttgttggttaatcgtcttgttacccatggaatgttgtcgcacccacgtggagaaagtatcaatgtgatgccttgtaatccatgcatcggacttactaatgtttctggcgcgaattaaagccaagtgttcctcgatgtagggagccaccaataaagattgttccagaaccgtgaaatgggctttacggaataaattgttgtctaccgtcattattgctttccttccgagagtcccctttccccgtagtctcccttgagtcccctttccccgtagtctcccttcatggcgtgattcaggtaccctgattgggcgaaggtcttcgataaattctacgtagaattcaataacctcctctgttccataccccttggcgatgcttgcctctggacgagcacggttacgaacatactttttcagaacgcccatatacctcttgaaaggaaacatgttgtgtaggtacacaggaccgagaataccgatctctttgacaaggtgacaaagcagatgcatcattatattgaaaaatgaaggtggaaatatcaactcaaaactgacaagacattgcaccgcatcattctgcagggcttctaatctatcaggatcgatgaccttctgcgaaattgcgttcatgaaagcacatagctttgttattgttgcccagacattgtctgggaggataccccttattacaactggtagcagctgtgtcatcagcacgtgacagtcatgagactttagatttgtgaacttcttctccttcgtgcttattattcgctttatattcgtggagtatccagacggtaccttgatactctccaagcattcaaacatactttccttctctgccttgctaagagtgtagctggctggactcaagtaatggcttcatttctcctttggttccgggtgaaggtcaccgcgttgttccatatgcttcagatcattacgtgcttccagtgtatctttcgactttccatatatacctaggaagagaagaaggtttacgcaaagattcttagtgaggtgcatcacgtcgattgcgtggcggacgtccaagaattcccaatagggtaactcccaaaatatagagttttttttccacatcgccgcgtgaccatcttcgctctctatgggctggctaccaggcccctttccaaacactactttaagatctttaaccatagcaaacattgttttcccgccgcgatgtttaggcttcgtacggtggtccgccttatgttcaaagtgcttgcctttcttccgaaccaggtggtttgttgcaaggaatcgacgatgacccatgtacacaacctttctacagtgcttaagatacgtactttctgtttcatccatacagtgagtgcaagccttgtaccccttgttggactgcccggataggttgctaagtgcaggccaatcgttgatggttacgaacaacagcgctcgtaggttaaactcctcctgtttgtcctcatcccacacggggacaccttccttcttccacaacagtttaagatcttcgaccagtggtcttaggtacacatcgatgtcattaccaggttgcttggggccttgaattataatcggcatcattatgtacttcctcttcatgcatagccacgggggaggttgtagatacatatcgtaatgggtcaagtgctatggccgctgctcatctctccaaaaggattcatgccatccgtacttaaaccaaaccgtatgtttcgtgcgtcctttccaaagtctttaaattttctgtcgatgtttcgccactgcgaaccatcggcggggtgtctcaacatcccgtcctgttgacgctctttagcgtgccatcgcatcattctagcattccccttgttcctaaacaaacgccttagccgtggtattatagggaaataccacatcaccttagcaggaattcttttcttcgttagctgctcatcaacttatcctggatcatctcatctaatcttgtatcgtagtgctttacaaacagggcatgcttctaggttctcgtactcctcaccgcgatataggatacaatcattcgaacatgcgtgaatcttctgaacttccagtcctagatggcagactatcttcttagcctcgtacgttgtctcggacaattggtttccctccggaagaatgttcttgacgagtttcaataaatcgccaaatgccttatcactaacaccattttttgccttccattgcaagaactccagagtggtatccaactttttgtgcccctgctcgcaacctgggtacaacgacgttctgtggtcctctaacatcctgtccaatttatgggcccccttttcactttcgcagtcctccttggcgtcctgcaacatctgaccaagatcatccgcaacgtcgtaaccatcagcatccatttcctcctcgcccgtttgatttccttcaaatccagagtactgagcaaagtccgaaatattgtcgtcttccacttcatcttcttccatttcaaccccttgctctccatgggatgtccaacagttatagcttgggatgaaccccgactcaaacaagtggaaatgaatagtcctggatgcagaatactccttctgattcttacacttattgcatggacaacaaataaaacccttttgcctgttagcttcggccactctcaaaaaataatgcacgccgtcaataaactctttggaccgccagtcagcgtacatccattgccgatccatctacatgacatgaaaaaaaatcgtacacacataattattcgtacaataatgacagtcatacaataattataaaataattacaaactctttcaacagtaacacaataatgacatatcattattcatacaaaattatgaaatattacaccgaataattatatatttactatttataaagttttaaactaatattaatgtgttgtacttattttaatttttcattttactttgttttctattattcaagattaactttcactatattttccttctcaactattttataaaaccttctttaacaaataaactaaatttctatatattctttcttctccacacaaattttctctctcatcaactaacaataaaattttgaagacaaaaaagtgtgcaaaacatgatccaaatgtaatatgaaaaaaataaaacattggaggatgaagttgctaaccttttaggcacctccgatttatatataatcaccaaaataaattcaatagaaattttggcatgacctcccctcttttttgaagaaattttgaagcttactcgggctggaggaggacgaagacatatatatatatataggggtgggattttagtcccggttggtgttatgaaccggggctaaagatcgctgggatctttagtccgactaatgttacgataccaaccgggactaaatatcccgggagggcctgacaggccctgacagcatttaaaccaggactaaagatctttagtcccggttggtgatgcccgttaccctttttaaccggggatctttagtcccggtgtttgttgcaaccgagactattgtggaattagtccgaccgacgaaagatggtttctccaccagtgtccgcatcgtcgtgccgagggagcacgccggcgagtactacgaccaccgccttaccgaccggaacaacaaggccacctactccgtcgccatgcaggccgtcgtggacgacgagggcgccttcaccgacgtctgcatcggccaccccggctcgctctccgacgccgccgtcctcgcgaagtcggcgctgtacgcccggtgcgaggctgggcttctgctcggccacgacaagctcgggtggcaacagccgctgtggctcgtcggcggcgcgagctacccgctgacgagctggatgctggtgccgtacacgcagcccaaccagacgtgggcgcaggacaggctcaatgcgcacgtggccgacgcgcgcgcggcggcggtgggcgcgttccggcggctcagggcgcggtggcagtgcctgcggcgtgccgaggtgaagctgccggagctagccaacatgctggccgtctgctgcgtgctgcacaacctctgcgagcgcattggcgaggagctcgacgccaacctcctacacgacgagctcgaagtcgtagacgacggagtggtcgccggcggcggcaatacagtgcgctccgccgccgccgaagaggtgagagatcaccggatcgcgcacgtacggtcttcatcacgtcggcaatgcttctttgagtagctgctactactagctaccattactggcggttataagctgataacgaccaagctaggttcagatttttctgtttggagctttctatatctggagactctgcttgaaccgaaatttcactaattgtggaaatttcagaataatttgaattttgaacaagttttgttaaatttgaaaaactactttggctaaattcacaaaaaaaaaacattcctgaaaatttcggcgaaatagtttcatatagggcgggcctaaattcatgactttttgaaagtattattccggaattttgaacctggtaacaacttcagagtttgtgatagtactcatttaaagttaacttagaaaaaatacacgagtgttgcaacgggtaaaagcatttcttcaatggtacaactattaggagtttagcaacaaattaaaacattaaaattgctatacactataattgaaaaagttaattataactattccttggttttgggccaaaagcccattccttccatacttttcaaccctagcccaattgatggatttgatcaatgtgtcatgattttttagactaaaattatttattacatgatcgatattttaacttcatcaactcacaattgttcttctgcccaatgttgaaattatgagttttgtattcatccacgtgtttcttcatcctgcatgtacatataggattaatcatttggctacactgcaattttcaccatcgcatgtatatataggattaatcgatcattcagcggcacctacaaccagtttccaacaggcacataagggcatttatgtactagtgtactacagaatagccatcataaccacccctatttgtgtcgattagactaaaccaagcaccgataagggtttcgagcccacccccaactcacgcgtgtcctaaaaaaacctagaatatcagtgctggtttatttaaaaacccaacaataatggactgactcatcactactggtacaaaagaaaatataagtttgttctacccttgctaaattagcaatatggtactaaatatgcacacacaactcttatgggtcacaaaagcctcacaaaaactcttatggtactaaatatgcccttataacttggtttcacccttactaaactagcaaatgtggtaccaaacatgcacacacaactttcatgggccacacatgcctcatcctaattggaccaggatgcatatcacatccgggcaacacccgctcctcctcatcggatccagccattcggaggttagaggccaccagatctagccacctccgacctcaccgccatcgatatctctgccatcgatgttgtccttgaaatggccttgaggatgggatacatcgcctagagctagaggaagagtgaataggcattcctggaaattcaaaaatttgcagtggaataaagcttaaccggatagtctgacattaggttggacagtctaactataggagcagtcggagagtttggcaatgtggtggattgtccggtcagagtgaaaaacggaaagttgtaaaggggctcatattgtccgactgctctaggacaatctagtcaacatatagcaaaagactcgagcaattaagcaagataaaaactagacaagagactcaatcacacttgatatacaagcaaagcaagttgagaatagtgaaagtgcatctagccccctaaatgagttttggtgattaatgatagaacggttaaggaacatgtttattgagatgagtgcagataattagtttcagagtacttaggtgtgcatgaagaaccccccacaaggccacaacaaatgcaaagcagcgagaagactcggtgaattatttaaatttctttttgtattttctatcttgggatccaaatggttgcatagatgatccaagtgcttattgtccacatctgtagaagagagacatttttggtgcaacactagcacgggctcaggttccaccagagaaagtggcccataagttcctagcagtactttggcccatagcctccgggttcctgtttttccagccaaaatccctttgttattattatagcaaaatgcccgtgcttcgctacgggtatattgacagattaaatgatataaatacccagttgacatgtatataataatgttctaagatagataaattgttcactggattaatgataattaggattgataagaaacgctattgcatattgatatactcatattatcgtaacacgctctctctcaactcttgcatggcaagagcatgatataatttctaaaatcgaacatgggcttgcgtggagatgactcgttttcatggctcatgcgtggacgatagatggtgcggactgtaatatagtgttatttgcagatgacgaaaggaaaaaaaataattatgtttatttttcaaattaaaaactggttcattataagatttcagaatcactaaatatctattgaagaaagaggtgcaaaacttttgatttttcagccatcggatgcatggtaagagcctgatataatttctaaaatcgaacatggacttgcgtggagacgaatcgttttcacggctcatgcgtggacgatagatggtgcggactctaatatgtcgtattttgcagatgacaaaaggaaaaaaataattatgcttaattttcaaattaaaaactggttcattataagatttcagaattactaacgtgctagtggcagagagaaaaaaattgcacaacaatctagccagagccaaagtaataataggatttgagatgtgggaggcaaagtaggcggataaaaaaaattgcggagcaatttagcctaggagaggcaaagtaataataggatttgagatgtgggaggcaaagtagacttattctgaggcaaagtagcaataggatttgagatttctgagcaatctagcctgatagaggcaaagtaataataggtctaaaatggagagatagaggcaaagtaataataggtctaaaacggagagatagaggcaaagtaataggtctaaaagggagagctggtgggaatcgaaccgtggtcggcgggttgaagattttctccactgaccaagtaggcaagctgctagttgtggttggtgtctacatgagcggtaaatattgtatatcaaccgaggttttggagtagattagaaaaggtccgatccgactattaagcggagtaaaacggattttagcaacgtgggatgacggacgaaaaaaaccaccggaagccttacgtatttttttattaggtatagataaagtaagggtttaattttttttttcatgttgagttggttgtttcttctcgttagcagattaaaccacatcatcggaataacaagaaccgtcagatgcaattaagaatgaagagttttcaccggaggtcttgccaatatgcagcgtccacgcatcggaagacggaagaagagaatgaaaactaagtgaacgagaaaaaaaaataaaaggaaatcaaaacaaatacatacttccgatatagaacgacattattgcagaaatcaaaacatcttggaacagatatagaacgaccgaaagtataatttttttaggaaaagaaaatcaaatattaagcaaataattgtgctaagtatctttatttctatctctctttactattataaacattgaagatgtttttatcggtattttagtacctcattcgtatttaagtcggtttttaagttcgttcgtttttagaaatacagatccgtgtttgagtcagtttttaagttatttcgcttttagaaataccataaaagtcatataagaaatttcttttaaagaaaaacttatatactaacttaagacgatcggacttttaattgcagctcctgattttgtaaaaaaaaatatctaagagaattcccacagtaaatttcaccttaactaaaccgtataataataataagattaaaataaccttcactcgttgtaacgcacaaatttttttttaagtatatatatatatatatatatatatatatatggaaaagcaaatgtgaacctaggttcatatgcaccaacaatttacaccattgatggctgctaagatttgtgctattactatataggggagagatgagggaaggtacacaatgccactgcccactttgagtttgtcccaaattgcccttttatactagtatgttacaatacgagacgttcattggttcattgattcaaagcaaatttctatcttgtactcgtacatataaatattagtattttttatttctcttaactttgtagtagagtaatatatattaagatttattgaacatgttcatactgatatatcatatatcttcgtttgtatgaaatataaaatttgcagatgatctgttattgacatttctctaaatagcatttagaaaatgattttatatctctaaataaaatgtgcaaatggtctcctaatgttcatactaatgacatttctctaaaaatgaaacttgcaaatgacacatctctaaatagcatttacaaaataatttatatctaaacctataacttgcattgactaaaaaaccatgagaaaaaaaattcttgcaaatgcaaaccaaagagaacacaaaatccacccataaaaagataatacaaccgttgaggggggaaatagaaatacattattcttgaataaaatatcaattacatatctaaagttataaaaaaattacaaaattatctcacaatatgttgtagtgaatctacattatatgtttttcagaaatataatgtcatattttttatcaacatattaaataaacataggacattactttgaaaaaaaaaggaaaaccacaaaaacaattcattcgaactattatagtactacttaagggacattttggaccacaaaaatcataacatgtaccatcccttacagccaccatgaagggaaccaatcaggtagatacatgtgtcaaactatgcatataggtgcatatgcaccttggttcatattatgcaactcatatatatatatatatatatatatatatatatatatatatatatatatatatatatatatatatatatatgcgtgcagaggggttttcaatgtttcatactggtctcaagttttcaagaccgggtgcgtatgctagggtgaccgggcgggctgccgtcatccacacagaattcggcgcgaccgcgtgcatttgcaaattcgctaccaactccgccggccgctctccacacagaatcctgtcagcgagagctggagaaaggacgacgacgacgccgaagacgatcgatgacgacatatccaatggccggcggacggaccaccactacaattatttcttctgcatgaaggcaacgcctgcaggccccagccccaacacacgcacacaccggagagttaattaattaggtcatgcatcgatctatctctggacttggactagctagcttgtattttaaagtagaatgccgttaactttttatcaaacgtttaaccattcgtcttatttaaaaaaattatgtaattattatttattttattgtaatttgattcatcatcaaatgttctttaagcatgacataaatattttcatatttacaaaaaaaagaataaaaaaatagtcaaacattggtcaaaaagtcaacggcatcatacattaaaatatggagggagtatattttaaagtgtatatatattttcttttgtttggttaaaattttaacaaacaattattcgatattagaacctatagtagtgatggcagtgaccacccaactaccatgcggaacccgtaaattgagttgcttatttcttagcctccacgtgccataatggccggagccaggatttcaagtcgattgtgtcaccattgtctctcaacatgtggtatgacttatataattaattaattatatatgtgataagtgtaaaaaaagagattaaccaagaacacagcctatcaattcaaacatccagtcatttaagcaatggtgagataattggtaaaaattaaattataaattactagactaaaactacaagatacaacatgtactagctagaagattaaaagaagatcggatatcctatatcccaacatcccgtgttctctgcatggttcatcaaagaagaccaaccctcaatccgtgcaaggatcagaatctgtacaaaccaaaagtcctgaatctaaataatcatgtgagattaaagaaattaattgagtgcggccttctcaacaataggtagctgctggagaaagggtttttaactctggtttgtaaccccctgactgttatgaaaccgatctcccaaaggagtcggatttgtaggaccgtgatcgtgaggatcacggtacctcctccttctattcttctgtttccttattaaggaagtgggcttataccaaatatatatgtatgtatccatataggacatcctattgtgggtataaatacaatagtgaggttgagggcaaagtaatacttgtaacagagagagaaacatcaataaagttgattgccttccactttcatgtccgtgtgttattgtgtgcttgttcgattgttgacaacatgaattctaacacgttatcagcacgaggtgctcttcagccaaggtatattgtcaacatcgatctgttctaatctcgttctatagggataacgataaacttgctagatcgttttctgttatttttatttctccgctaatcgttcgattgatgggttgtactacgtggatttgtcccttatggcgcacgtagcaggagagtttgcagctctccaccctatgcgcgacaggcgtatggggttatcccttgtacaaccgatctatcgaacgagaagcggttatcgctatagtccgattagatctgttcccagcctttgcgctgggtttcttttcttgcaaacaaagacacggataccgtacgccctagacgcgcgaacggatcagacaagccacagcaagaacgacggtttagaactagtgatgcctcgaagggcgacgctacgttcagggtgtaatcgcgatgcacatgagaagaatcgcgtacctggctaacgtaattgccgattacgaacgaattggcccaaatcctcatgccagcgccgccgtcctcctgatgttgacgatgacgaaaccgagtcgatgacgccagcatgcgccgtcgtgcccttgctgccgccagcacgcgtcgccagccacccccttcaccgatggccgcagaatcgtgccatcggctttccgtcgtcggttcgcccttgaaaagccagccgacgggtcttcaatcgaccatccgcactcgccgtcgacgaccgccgcccgcagagacgctgaggagaccgcgcccgcatcccccccgccgacggcacgcacagcacgcctccagcgctaccgcacacgactgggtcgggggccgaagccgccgcggcctcccgccgctgatagccgtccgccttgccggcccacatgccgagccaaattccgccggcgcacagcaaggagctgcgcttgccggacgctggatacggcccgtagccaaccacgccagcgtcagtgctgcttgtagcctcaccgccgctccgcctctgtcatcgaccccgccgcgccgacgagctctgtcgaccccgccatgacgacgagccccgtcaacctcgccgcctcactcgcatgagccgccgggatactcgccgccaccatcgaatcggtggaattgggggctagggtttcaaccctagccacccgattggataaggtgcagcgctcttgttgggccgcttatgggccaaggccattagcaggccgacggtcccgacgggccggttaaaatttgagtagccggtacatagaggtgggccgagtataaattaggcctataaaaggagtcgggctcaaatcgaaatttggcccgaaaatggcaaacttctaaatatgtcctagaattttcaggatacacgcggatttggaattttagcggaatagtccctcgggattatagaaattactgagaatgtcagattatttttgttattccgtattttcaattttctgtatattaactatttattagttaatttttgaatcaaccataaaatcctagagacatggtttttaggcaatgagctctcatcatttgaacctgagcatcgtgtttatggtttatttttcctagctgttttcagaatactatttaatgggttagtaattcagtaattactttggtacctaaataattagtgaaacaattctgaaaattattgggagaattatgggaatatattgacacagtactaaatttagataaccagaatttactatttgcacacttgtcatgctcctacttgcagtacttattgaattttgcatgactaatgtaggaaaatgactgatattgctaagagagattttgctgaactagcagtcagcggcaagaattacctgacatgggcactggatgccaaaatcatgcttggtgctaagaaactcctgaactgcattcaggacccaactattgcaacatcagctggaggagttaataatttaccaacttcagctgagaaaaatcaggcactgcatttcctgaggcaccatttgaatactactctcaagaatgagtatatgactgaggaagatccgaaggtcctttgggactcactgaaggatcgctatggccatcaagtaaaggccttgctcctaaaaacaaaacgtgagtggcttcacttacgtttccaagattacaaatctgtggagcaatataactcagttcttcaccgcaatgtcacttgtcttaagctatgtggagagaaaatcactgatgctgacatgatagacaaaactttgtccaccttccatgccaatcatgtgaatattcagaggcaataccgccaggctaaatacgagaagtattctgaactggtctccatgctcatcgaagcacaaggagaagatgagacacttgttgaaaatcatacgtctcgccccactggaagttcagcagcacctgaagcaaatgctagctcctttaagaaggggaaaaaccagaataaccagaacaaagggaagaatttctggaaaaatggtggcaaagttaacaagacgtctttcaagaagaaaggaaatcagaacagtaagtctaagaagggctctactagtggtgaatatggaaagcaagatcaggtatgcttcaagtgtggcactaggggacactggtctcgcatttgccgcacccctaagcatctcattgagctttatcaagagaagcacaggaagaagaagtcagagcatgagtcacacttcactgttgagatccagcactcagaagagaagatggctgccatgcatatcgacaagcaggtcgacgagaaggcagtggttgcaatgcacatcgatgataagatggaaaagaatgcagcagacgcagagctgaagctctcagatgatctcatggactctgatcagttatatggggacatttaagtcttccaatttgtatcttagcttcctgcattataagttactttaaattttagactatgtaatagactaaagttaggtgatttttcaagtgtgcatttagtttgtgttcctagcagaactatagtttctgtaagctccttcagagcgtggttatcttaataattgagtgaactcttttagtttaatatattctccagatttttatttttctatcttaaagtgttatttttgctatatggtcatgaattgactatatttaaattctttatgatagaacagtgttacgtactatggcaatggaagaggagatgtgtctggtagactgttgtaccaccaatactatcttttgagataccacgtatttccagactttaaagaaaaagactggtcaaatcgctactattgccggaagcaatgcacccatcgtcggagtgggacgagcaacagtagttctcccacatggtaccaagatcattataaatgatgctctattatatctaaagtccagtcgtactctactaatctttaaagatatccgtgcttatggttatcacgtagaaaccaaagatgagaataaactcgaatttcttctcataacgaaattagacggaaatcataagactgttgttgaaaaactcccttccttgaaatctggactgtactacactcatataaaacccgaaaatgttgcactgaaaacaatatttaaaaatcctgagtcatacagaatacggtctagggatgatgagaagaatcatcttaacttcaaatggccataatttactaactaacgatttcccaaaccaagaagattttgtttgcactgattgtgcaacacttcaaatggccataatttacgaactaacgatttcccaaaccaagaagattttgtttgcactaattgtgcaacagggaaattaatcgttagaccctctaatttaaaggtggacgcagaatcaccagtattcttgcaacgaatacagggcgacatatgtggaccaattaatccaatgtccggatcattccggtattttatggtattaattgatgcatcaacttgctggagcactgtttgcttactttctactagaaagcacgcttttgcgcggcttatttcccaaataatctagttgagagccaatttcctggataaccggatacaatccattagaatggacaatgccggggagtttacctctaaggtatttaatgcatattgcatggctttgggaattaaagtggaacattctgtaccacacgtccacactcacaatggtctcgccgaatcattaattaagaggattaagcttatcgctaggccattgctactgcatagcaacctaccaactacatgttggggacacgctgttttgcatgcagcggcgttacttcaaatcagacccactgcatacaatgttgtatcccctatgcagcttacacgtggatatgcaccaaatatttcccatctgcacaattttggatgtgttgtatacgtccctataccgccacctaagcgtacgtcaatgggtcctcatagaaaattagtaatctatgtaggatttgaatctccgtctatcattaaatttttagaaccattgacaggagacgtacatacgggtcgatacgctgattgtatatttaatgaagatcatttcccagcattagggggaggaaagtacctacagaaggtcgaatgccgcgaaattgagtgggaaactaaaaatctcctacatttagatccacgtactaaggaatctgaccatgaagttcagagcataattgatttgcaaagaattgcaaataatctgctagaagccttcactaacccaaaggggatcatgaaatctcatatacctgctgtgaatgcaccggaaagaatagaaatacctcatgacgcagaggaaccggttttcaaattaatttctacatctaccctaacttctaggaagagggggagaccaccggttgcacacaaccaaactaaagtttctaggagacgtcctacgaaacaacagattggacagaataccacagcaccagagaatagtgaaggagctcaccaggaagatgagccacctgcagtgatatgcccagatggcaatgaacctagtgagaatgcgcgcgcaattactactagcactgggagaccggaaattcctgacttaaacattgcaggaaacaatgaagatcaggaatgtgaaagaatagaggaaatatccaccaattatgtggatacaggtgaaacatacaataaagagactactattgtcgacatatactttgccgaaaagatcgctaagatcattgatctggacccagaaccaaagtccatggcagaatgcaaaaagcgttaagactgggtcaaatggaaagaagcaataaaggcagagttaatctcgctcaataaaagaaaagtattcggtcctgttgatcgtacccccgtagggatatcccctgtaggatataaatgggtgttcgtccgaaaacaggatgagaacaaccaggtggttcggtataaagcgagattagtagcacaagggtttacgcatagacctggcatcgatttcgatgaaacctattcacctgtaatggatggaattacattccggtttttaatatctatggcagtcaatttgaacttagaagtgcagttgatggatgtagtgactgcatatttatatgggtcattggattctgaaatctatatgaaagtttccgacgggattcaagttcctgaagaaacaaaacgcaacatatacagtgttaaattgcaacgatcattgtatgggttaaaacaatccggtaggatgtggtacaaccggctcagtgaattcctagaaaaggattcatcaagaatgatgactgtccctgtgtgtttatcaaaaaatcagaacatggattttgtattatttctgtatatgtggacgatctgaatatcatcgagaccacacaggtgattaaggaagctagttcttacctaaagacggagttcgagatgaaagaattaggtaaggctaaatattgcttaggtctgcagcttgagcacactcctgaaggggtattgttacaccagtctgcatatatccagaagatattggagaaatttaatatgaaggattcatatccgacgagaacccccatggtagtaagatctctagcagtagagagtgacccatttagaccacaggaaaataacgaggaattattgggacatgaatgtccatatttaagcgcaattggagctttaatgtatctcgcgaatggtaccaggcctgatattgcatttgttgttaacctacttgcaaggttcagttcagctcctaccaaacggcattggaatgacattaagcaaatcctccgttatttacgtggcacacaagatctcggtttattctttagaaaaaatcaagatttaaccatggcgggatatgctgattctggatatctgtcagacccccacaaagcattgtcacagactgggtatgtgtttctctgtggtggtacaaccatctcatggaagtcgacgaagcagacgatggtcgcgacatcaacaaatcactcggagattataggattatttgaagtgagcaaggaatgcatgtggttgaggagggtgatacaacatgtacagaatacatgtggactaaatatcacaccaactccagccattatttatgaagataattcagcttgtgttgcacaaatacaaatgggttatgtgaagacgagtctcacaaaacatatatcgcctaaatcttctatatgcatgaattgcaaaagaaataaaaatcaaggtgactctcaccaagactagtgaaaatctcgcagatttatttactaagtctttgccaactagtgtttttgagaagcttgtgcatggcatcggtatgaggaggatgagagatgtgcacaaatcaaggggagcacttccctaactgtgttccgttgatattgatcatgcagatcagtatatcattcttgaagaatgaaagagttatccagtagattagcttatggttgtactctttttccctttagtgagttttctttgaagtttctcacatttaggtttttaatgagacaacagtgcaatataagtagcgtgtactatgtactccttctcctattccttttctcccactggatttttggaaggagttttgatgaggcatatgtatagcgcggtattcatccaaaggggagtgttatgaaaccgatctcccgaaggagtcggatttgtaggaccgtgatcatgaggatcacggtacctcctccttctattcttctgtttccttattaatgaagtgggcttataccaaatatatatgtatgtatccatataggatatcctattgtgggtataaatacaatagtgaggttgagggcaaagtaatacttgtaacagagagagaaacatcaataaagttgattgccctccactttcgtgtccgtgtgttcgtgtgtacttgttcgattgttgacaacgtgaattctaacactgactacgaatccgggacaaaagatagtctcgggtgaaatatctctagtaccggttggtgttaacaaccgtgaccaaagatgaaatctttagtcccggttggtaacgatggaagaggccaggtcccgattgatatgtttttttagttttttattatttttaactccttgcatattgatttcactcaattcccaaattatccgtaaatcgtcaaatccccaaataaatcacacatcaatcatcccaaatcgtgaaatccccaaatcatctccaaatcacagatcatacatcacaaaatctcaaagatggttacatcacaaatttaaaaacaaaacatcacttattcacatcacaatcaaatacatcacaaattctaaacaacaaattcaacacaaatcctaccaaaagattcttcctcctgcctcccagcccggccgccaccgaccccgcccggcggccgccgccacttctctcatttgaacgtacgtctgtcaattccatccaaatattgcgtgctttgttgttttgttctcctagagagacaagacgtactctccgtgtcttaccgaaaatatataaaaccttaattagaataggtactactcagtactccctcgtcaaaaaaaagataaaccctggttttcatgcctaacgtttgaccgtccgtcttatttgaaaaaattataaaaaaaattaaaaagacaagtcacgcataaaatattaatcatgttttattatctaacaacaatgaaaatacgaattataaaaaaaaatcatataagacggacagtcaaagttagacacggaaactcaagatttgtctttttttttttttttttggggacggagggagtacgaatttagtagagatagagtttttctttttcagaatggtagtataaatttctatatttaggagggagtacatagtactgtgtgtatcactatatgtacgtacatcagcacatgagatacattatgagatttctaccgattgaactacactagcctgtcttttcccgttacaagtcaggtttaattcccaattaattaatcctcttcacctagagtgtacatgtacgatacattacgagatttctatcgattggagacgatcgactatactacactatacgggcttctcccactaacacagaacacgtaaaaggtgtcggttgggaaacaccttaagatgtcggttttcctaaccggcatcacggaggcggtactgatgagtgctctaacaccaatcctattttaaaaaccggcacctttgagacccctcgtgagctaataaaaagctcaatgcattgagccgatgcatcgagctcatccaccccacatcacagaactccaaatcaatcgcaatccccaatctccaatcaaacaatatcacagaataagaaacgttgaagaacatcacagaaatctttcacagaaatcattcattaacattaaagaacatcacagaaatcattcactaacattgaagaacattcagatccgatggagggagggcgccgccgccaggccgccacctcctcttgtcccgccgctgcatcccccctcccttccgccgccacatgccgcctcccgccgctaggccgcccctccccggatctggcggaagggacggcgcggccaccgccacctccaccggccacgagcagcgagagagagtcgagagatgagggagagagatttgcaagagtctgtgaatgccttatctcctcatgataccggggccttatctcgtcgttcgtggtgggcccgtcagctcggctcaattaggaggtgcgggtttttaatattaaaggtttatttttaaaaaaaatcggtatctataattgtttaaagatgtcattttttttttatttcatattttgtagtagtgtcccgttacaggtcaggtttctatataaattaatcatcttcacctacagtgtacgtgtacgatattgttacgtcatcttttctagaatatagtagctatttataacattaaagttactcgtaaaactcataagataccatcacttctcgacttcatcttatccaatcataatcgtttctgcttatttaattttttttcacctaattttacatcttaattaattacaatcatatttaatttaattttacgcctctctacttacttgtcagggttatgaataccacatacctaatagtagtcgactaaatctcggcaggacacaccacataccatgtcctatacggaaacaacctgcggatataggagttgttccggataagaaaagacaaccagagttctacatggaaacgacaagaactactcggattgtatccatactggtttccctagttctacttggacaggggacatctatgggtataaatacaaggccccctaagaggagaggggacacactcaacatagacagaacaacagaagccaatacaagccaacatacgccaagacaagacaccggatatcgacttcagggataaggacggctagtcccctacggtgtctccggataatgtcaggagagacgaaagcgttatctctgatctcgccaggcacagactcgaggaggaaaattaccctgttgtcaactatgagtcaaaccttcataccgccatgtcgacaacagttagatagactaccccaaatattgtactggtgtgattataatgaataagagcatgttgtcgacaacagcatgtagggctattacttgacaattcaagggcccgaacctgtataaaaatcctcgtctctgtctcttttacctcagtctcgcgtatatcctggtaccaacgatccccataccacgcaaataccggaatcgcaacatcaaacgtcgacattactcttcgtgaaaagttttaaatcgaactgcttatatcattttgagactgagggaatatatgtgtgatagggaagtacaaggttacgaagtttataggcaagttgtaaacactacttgtgttgactttaatttgctattgaaattgatcctgtcgtgcgagctgaccgaaagtttctcaatgtttgcactccacacgaaagttgccgttttttttttttgataaattggtccttttcaaaaaacttattttgaaactagcccttaaaaaaaactttaacccaaaataggccgtggattttacaccacggaccttggcggtgagatataacttcccaacgccaatagcattgcccttgagctctaatcccagggggcataaatttgttgagtcatcatagctcagagccaagtgatttggtgttgaggtccaaataagatttaatagatgcgcaagcattatattgcaacaaaactgtgatagcttggtggttgaagtcttcaactgtgagccctaaggtgctgggtttgaattctactatccttcctttttttccttttctcttcctcctagcataattttcctaccattcttttcaaattaaaatgttctacttataaatttattttaattttcaatttacatcgcagatttgaaaacttaaattatataatatttatattactatctattaaaatctatataatattaggagagtaagacaaacttcctcctagcataccttcctaccattcttttcaaattaaaatgttctacttataaatttattttaattttcaatttacatcgcatatttgaaaagttaaattatatagtatttagattactatctattaaaatctatataatattatgagagtaagacaaaataagtttcttttctcttgactactcacttttattctttacaaaatgattgtttcatttgtaaattttttttattttgagtttgattttgagtgccaatatgaaagaagtatatgctcctttaaatttctataatttgttttattttaaatttgatttgaaatttcggtttaagttcccatttgccatataatataccactttaatattttttttcaaattcaagaaaaaagttgcaaataaagtatatcgtttgaagataatattacgagacaaacagaaaaggaaaaatatagataaagagagagaaaaaaaatgagagaaccaaaaagaaaaaacatataaataaatgaagagagagaaaagagaaatgggaaaactgaaaagaacaaaaaaaaggagagatgggaaccgaaccttggtgtatggggctatagctgaagcttgctaccattgtcctataggtggttcattggaaatgaacgcctttacattaatttaaatcgtcaggactttagcgccaaatatcttggcgatgagttatgatgactcggcaaatccatgtcacctcgattagagtttagcgccaatgtccttgacgctgagttgacggcatatttttagttgaaattttttgcaaggactagtttcaaaataagttttgagaaggatcaatttatcaaaaaaaaaaagggtcgaaagttcgtatatatgattaaattcccacctgatgacgtgaacttaatttccgtcaaaactcctacgtacagccaaatgtttgtctacatatatatgtagaaaatatgggtcagtggcattcgcccactcgctagctagtggaccatatagtggcctagtgggtttgaatggtttctgacaagggaggatccaatgtgattcatgggtactctctccatcctagtcatttagtcacagtcaaacttgcagagttttcaatataaatctttatttaaattactcatgtattataatgtttctagcaacaaaatcataataaatttaattataataaactatttataggtcaaatatttaatgagtcttaaaatgtgtgtgcgccttattgagtggggcagagagagtatttaagtttaatatccattaagttatggcaaacaaaaaaaatcatttgatatattatgcatgtgcatagaaaattgaattgaaacaataataatacaccttaaatggacaaaaattccatctgttagcagccctaagttgacacatttatcatttcagcttaattacacacttttatcaatgatatttatgtagagatgagctggctcgttaggacatatcttgaatggcatatttttgctaatattggtactttaaaacttgtcattgtcactttattgtgcttcacaattatgaatagttcgtgtacggaacaattttattgtcacggtcattttattgtcttaatttcattcatatatggatcaattttttttaaaaaaaaatgaatatcctagctccacaactaatttgtggaagtgtggatagctattttttaagtactagtcgtaaatataatggatgtcaaggaaattcagagttgggcaactgcagtttttacttcaaccttttcttcccataataagacagaattgtaattattttcactataacacaggtttaagaagtgagtaaattaacagtgctggttgtgatgtatatgttgtgttcacagctatgtcagtgggaatatatgtgatatgcgatcgaaaacattaattccattcttagagttgcctaaaaaccggctgccaataattaactgaagatctattcactgaaattgaatacacatgggttcatgctgaacaaagatatataggccaggagggttaagggccagattgttgcagcaggcgaattcaagaacttgcaagatgccttgcaaatgctgaagaaattctacaaatctgatacaattcctgtatacaataagatgctgataggtaggccgaataatactgataagcgcttgcatagagatgcttggctctggattggttcagaggtgatccatttgacggagttgattgtcaaattttgatctttgttagcaggactcccagaacatgtgagcatatataccttcgcggtcaaaggtgtgctatatatagtatactcaaaatggaaatactatttgacaaagctgataaaattacatactccatccattccaaaataaattgatttttgcctctttttcttggtctcacaataagtttctttttaagcaatcaagttgtattggagttatgaaagtaggatacaaatgcattggaagtgaggataactttattgggatttgataaagtggagggtatcctaatcctattattttatattgatatgtgtggaatgtgtgaaaaatgacagagatagtaatttcaagttttttctacgtgacaaaatgtggtggctacagttgacaaaatgtccttttcacttgttcttgacaaaatgcagtaattggttgcaggacaattattgtttctaaagtcgtatatttggttcttgaaggaagaacaatgttgaagaatttatatgtcttggaaaccttcttatcatatcctttgtttgaattaaccattgggttccatgtcaacatctccagctgtcaaacaggtcctaattaactacagtgatttattataagactgtattaaaagtctttgccagccgatttcttctgacagtagcatcttccactgacatccacataattttagcatccacatgttcccatttttatgagattgtaccttctttgaaacatatttgtgcacacgagactcacgcctcactttgaaattattttaattgagtaatgctatacatactatccagttgtacaactaaaaacatgaaaccataaatcaattaaaggagatcatgtgcatatgcactgtagtcgtttgcaaccgttgatcaaattcagtcgtgtgtgagttggatagttgaatcggatgcataacaatttccatttaattagactcgtgtctttttggctaacattacccactggtggagaaaccatctttactcctggtttacaaccccctttagtcccgggttgcaaaccgggactaagaatccgggacaaaatatctttagtcccggttgaaataaccgggactaaagataccggttggtgttaccaaccgggactaagttttttttcatcattttccaacatcccaaatcatccacaagaacataatcccaaataatccacaacaacataatcatctcaaattatccacaacaacagtcattctcaaatcacatatcgaatgaacaaattatcctcaacaaacaatctcaaatcatccacaacaacaatcattctaaaatcatagatcgaatgaacaaattatcctcaataaacaaacattcacaagggataaaagaaaaaacaaattcgcacggccgaccaccacggcggccctccgcaccggccgcttccatcctcgtgcaatggccctgccggccgccgccgggcgccgccctccgcgtgccggccgccgcggccctccgccgtcctcgctcttcgctcctcgctcgatctgcaaggagaggataaggcaagaaaaggataagctccatctgtagctagaaggaaggagaggatagtgcaaagaaaatgataagagagagtaagaataggagatgaggagtttgggaggataagtcctagggattatatacgatacatcgaattttagttccggtttgtgttatcaaccgggactaaagatccgaggggggggggctggcagcccctgacagcatatgaaccaggactagactaaagagcacatagtcccgttttgcttataaaccggaactaaaacccatctttagtcccggtttttattggaaccgggattattgtggtttttgcctgaccggataaagatggtttctacaatagtgaccacttcacctgccaagtggcttaaattgtgccttagctttataatgctattattaatctgcattaatttatggctgtgtaccaatacactggaaatgtttaaattcggtatattcaagatctaccgttattggcagctgaaccatctaattagactctttttagattacatacaaatatttgcgaatctaaagcaaagctaattaccaacaactattttcttaagcaaaggcaaaagcttttaccttgtgttttatgtacacatgtacattcttctttggctaatttattcataatccgaataatcaaaatcttcatgcacgttccggcgcgtccctaatctatccaaaatttagccactggttagacttccatatatattttaaatccgattttaaatcctagacatggcacgggtgctcgcaattacggctaattattttttaattggtaagctacatacccattgataacgaggcacctgtggtgacttcgccaatttcaagataagccggcttagtcttctagaggtgctaatacggataagatatgcatgtgtgcttacagggtgtgtgtgcacgtgttacgagcatctacgtttatactatgtttcttagaaaataaatcagccagtcatattaaattagggatatattaaatttgcagctcgacatgccggaatgtattctatatgtagtatattatcataaagtaattaatttgacgataaagattatacaccaactgttactgcggtgcacggctaacatgcagagatttgcacgcggccaagtcatatgcacatgaaaatgaaataaaaaaatgaacccttttgttatatcaccccgttaattaatgcatcacccccgagtggaaaaagggcgtaatttccggtgataaaatcataacgatcagagaaagcttcaatttatggatgatttttcttaagatgttattattggatgccttaagattacatgagagcatccatatatatggaactaggtgaaaccccgcgcattactgcggaaatttagtatgataacaataaaaaaaatagcgtgtaagatagctagataacatcagattaagtaaattaatgtggtttatgataatttaaatttaaatagtatgtagaatggtgattcaaacttaaaaagtaaggtggtatgactttatggaagaaaaaaagtagggagatagtttgaaccgtacattaatcatctaatggctaaaaacaattgatgtgatatgacttaattagagaaaaaaaggagagataatttggaccatagattaatcatttaagcactaactaagtgaggatgaactatataagtatataggatatcataaaacataataaagatatacactgaaacattatgtgaattatgttggatgataatttaacatgtttgtatttgaaacattatgtgaattatgttggatgataatttaacatgtttgaatttgaaaagctcttaaattataaaaactataaagatatagtatatttgcatgatgtttaaatgtgatgattgttagtggatgatgatgtggcatcttgttaattagtggatgatgatgtggcatcttattagtggataatgatgtggcatctttgcatgttaatcttaaggagttagtgggggataactttatagtaagataggataagcgagggaacacgttgaaatgatgatttgacatgcattgccaaaccaatctcatgttaaggatttattagggtttcttcgcaaaaatatatttaaatggtcataaaaaaagccaatcgagtattaattaatcttgttagaaaattaatactaaatttaattggggcatcatggtgcccggcgggctccaaaatgatatatatcttcaatcatttcagaaattttaattagagcaatagcatgatactgttatacattccagtagtgcgtgctagcaagcaaaacttttcttaatttgttgaacgtaccggatagttctcatttgagaaaagaaaccactacactggacaaggtcacctgtgacgggcccaaaccctcacctttgacggctttgggcttggtcagtgatcagtggtcactggtgagtccaatcacctttgacgggtgaaggaccgtcactgatgacagtcacctctgacgggctagaactcttccgcccgtcagaggtaagtgtctgcgctaacccatgccattttgtaacccgtcactggtatggttacctgtgacggctttttcaatatgaaccgtcagtgatgaggtacatccagacaaaaaaaatttctaaatattggctagcaaatcgctagccaatatttagaaattatatttcagcagcagtaaacagaagcatcacaaaatatatccatcacaaattagccaaaatataacctaaatttctcatcaacaatatatccatcacccataacagtaagggacaaatccatcacacacatgcacaaatccatcacacacattcacaaatccatcacacattcacaaaatccgtgccactgccgctccaagaatcaccgaatctagaaattagagaagggggaggaggatggggatggatgcggcgccgctgccactcacctcctcctcgccgccgcacgtcgtcgagccctcctcaccgctgcgtcgagccgctgcaccgccgcgcgccgttgagccctcctcgccgctgccgctgcaagaacaaccggcggcggcgggcgggcggatccgtgtcccccaacctcgtggaggctagatccgacacctagcagtcgggggacggcggccgtggcgcccggcggtcggggaggggggcgaaggaggcggcgacctggatctggcgtggtggaggcaggaaggaggaggctacccggatctggcgtggtgcaggcgggaaggaggcggcgacccggaggcggtgggcgaaggagctgacgacggggcggcggagagacggcggcggcgaccatgaggctgagggcgaaggaggcggcgaccttcggaggtgggcgaaggaggccgccgcctccgcctctggtccccgccgatggacgatggacggcgccgcgccgctgctccccgagacgagccccaagagccggagagggcgaagaggcggacgtcggtcaccacgacgcggcccccgcacccgccggcgccggtgccgtctccgcctccgacacaggtcgatgaagagagagggttgagagggagagagagatggggggagtggttgagatggataaggatgagccggtagtagaggataaggatgagccgggatgagaggggagggttatgagaaagatttttttttttatcatctttgacgggctcataaaatttgacccgtcacaggtgactttatctcacctttgacgagttttgtttttggaccgtcacaggtgactagttacctgtgacgggctaaatatttttggcccgtcacatgtaattttacctcacctttgacgggtttcatttttgaaccgtcacaggtgactagttacctgtgacgggtcacctcctgatggctcaccgatgacggcatcctgtaggacccgtcaaaggtgaccctcatcactgaccagcacttatgcccgtcacagatatgccgtcacaggtgcaaggatctggcgtagtgaacgtagccctttttgaaatttgagttcaaggatatatatgtctagtataagatcgaaccgtatacaaacataatataagatttagatgaaatttgtgttctgataattattcaaatttcaattacaatcataaacacatgagacatacattatactgagatccatcgaatcaatcttgcatttgtcctataaaacctttgtacaccataaaaattgatcaaattcttatagtataagcaaagtatctaccagagttccgaaacactggtttatctagaataattactagactcggaggatatcccgatccaataacaagttgattaattaccaccggttactgaatttattccgataaaaatgcaaatccaataattaaatttgtaaccggtaacatgcagaaataattctaaattttaccttaaactataaataaatatataatttcatatgttcttatggaatcaggatagctagaaattaacctccctccaattaggctttaaccggttatcggctgtgaacctactagcggcggttatctattattgagttgcatacacggatcagttcaacccaaaagattaaacagataagaaaagatggacaattcactttatattccaacacctataaccgcccgtaatggtaatcttggtagctactcgaagcagtgttgccggcatggaggagaccgtgagcgatcctgtctctaacctgttcggcggcggcggagcgcactgtattgccgccgccggcgaccactccgtcgtcgacgagctcgtcgtgtaggaggtcggcgtcgagctccccgccgctgcgctcgcagaggttgtgcagcacgcagcaggcgcccagcatgttggggagctccggcagcttcacctcggcgcgccgccgcaggcaccgccaccgcgccctgagccgccggaacgcgcccaccgccgccgcgcgcgcgtcggccacccgcgcgttgagcctctcctgcgcccacgtcaggttcggctgcgcgtacggcaccagcatccagctcgtcagcgggtagctcgcgccgccgacgagccactgcgggtcgtcgccgagcagcagcccggcctcgcaccgggcgtacagcgccgacttcgtgaggacggcggcgtcggagagcgagccggggtggccgatgcagacgtcggtgaaggcgccgtcggcgtccacgacggcctgcatggcgacggagtaggtggccttgttgttccggtcggtgaggcggcggtcgtagtactcgccggcgttctccctgggcgcgacgatgggg

SEQ ID NO: 31492 - DNA, 9896 bp, Oryza sativa
cgacggcggcggccaggtcgtcgcagagcttgtcggacaccgcgcgcggcatgcggaaggctcgccggaattccgcctccgggcacgccgccgggtccctcatgcggtcccaccactccgtgctccgctcccgcacccacacccgccggccacctcccctctccgccgccggctcgttcccctcgccgccgccgccgccgccgccatcgctgtgagacggcgagctcgaactcgacggcgccttcctcgtcctcttggacaagcgggacacgacgcccatggcatcgtcgtcgtcggcctggaaactccgcttcccactggcatcacctccgcctacggccaccaccacctccgccggcgacggcggctggtcaggatggtgaccggcaaaaaagtcgccggcggcgagcacggatgagtagtcaaaatcggtgaatggcccgaggaaggacgagctcatggcgatgaagtggaagtggggtgagggagcaggaagcgagtggtggtggtgatcactgatcaggcctttatatataggtattgggacgagttattaattttgggaggaggaagctatataactgggcccaggggctgcttggcacgcggtatggtactaaagtgagaaatatctagatgagcggcgccgtttcacgtgtgggcatgaggcacatgcactacggcccacgcgggcgacgtaagagcgatgctaatacttttgccggctgctggctgaatactactaccatgtcaatcgattatgcagaaaaatcatccatacagaataaaaaaaattaaacaaccaaaaaaattgagaagagagggacagtatcatacaacgcatggatatcagggcgctcagcattctccgtagatggactaattccagtagagaacaaccaaggtccttgagtcgacgaaccagtcatgcctggttgctgcaacgtggtgaaccaacatggtgcggacgagggcgccatggactgcgttattactgcagggaacaatgcaccgggtctgtaggtggaagcaaacgaaggcgggacgatgaactgaggtggcagcggcggcgcgatcggctgattccccggcgacgggacctccataggcgtcggcacacatgccctttgagactgccgccccatcttgctgcaggttggtgacgaatttagcatctagggtttaggaggagacaatttgggggcaaactcggttgctttggagtggattgaggatttatacatcgatttggcgggaggcgaggccaatttggcacgcggatgaaggaatctggcatcggggaggaggaacggcgaaggggcagagaaacgcacgggatcaggaggaggaacgaagcgccggcagatacgctcgcatcgggctgcaagaaggcttttttttctcgtacggcacgcttcagccgggcgataaatggaccgcccgctccgccctttttcgtctcttctcactcctccacctgggattttgatgatgtggaacatgttaccgcctgctaactaggatctattaaacttgctctaagcgagtggagcagtagccagcacctcgtacgtctagccacatgtccctctacgattcgcgggacgtgtctgttacgccttttttgttgtttcttttggtggggaaaagggtgttcgttagttcggtttataaacgttagtcggtacagtgatcatccattaagatacactaaaggacgatacatcaacacacaatagttgttaacgaagtttagtgaaaacctacatctttaggcctctgattataggtgctcctccccaatcaacatagcacataaccgctacgagtccatgggctcgccgcgctatcctctccctacgcgtttacactaaattgtagttgtcatgattacattgtggtgtcactctctctatttaagagtgaatctatgatagagtccgatttaactctatgctacacatattccaactctaagttcaaacttttagtaggattagtatgtttgacacatattctcgtagtagatttgtgtgctcaatcaataaacatatgctatttttttctaaaacaaggttgattctattaagagataatccaagaaataccattgacaagcgtccaaatccaagagataccatcgacaagtgtgagttccaataaataccatcgtacgaactattttgtcctaaaaataccatcgccgttagacttccgtccatctcgtgccattaaatgctataggatgaatagtatatttaacgacacggaatggacaaaaccctaacggcaataatatttttgggacaaaatcgtttgtacgatatcgaactcacacatatcaattacatttgttggattatcttgtattaaaagtaagaagcgattataaccctaccaccaaacatctaagacttgcctatataagctagttgcggattattagacatgttttactgaagttaaaagaaagaaagaataaacacactgccatcttctatattttttatggattgacgatgcaacttttttaagggatggaacgtatgcaataacgtaagtcagttgaatccacttaaacttttttatagctaaaatataagaagataaaaaaaactctaactaaatataaaattaggctctaaagactaaaatttaacatatatttttttctttttggaatgtaccgatgtgatattttaaattccgtacgtagcaatgtactggcattttgccagtatcagtcaaaaagacacaaaagtccaaaatgtgaatcatgagtcctcatgtcgtaaatatatatgtttctaagaatgtactcatgtcagaaaaaaaatgcgaattacatgcatgcatagtctcgacaaattggttggcaggacttttgatatacggtctgatgaaaatcagtgtagttaattaggacctctcttgacagctggagaggttgctattgactgcagtggttaattatctaaaaaatctaaaaattctctgaacagtactgttcttccgtttataccctgtcagttggaaagatacatatgacctaccctctaatcagtaggtttacttactgcaagaaccatgtgattattctctgatcagttggtgctactgtcaatatatgactgaggtcgatcaagaagcaaaaaacggcattttatcaactgtagccagtgaatggtcagcatgtataaaactagattcagtaatattatcatctttgtcaaatatttcattttaagtactgtggcacatctttgactgcaaactgcaaaggttttggcatccatccatgcatgcatgttttgtcagtcctgtgaaaaaggatcaggccatcacaaatggatcatcgatctctgaatcaatccagagccaagcattcttgcaaggaagcttaccatattttttcccctatcagcatctttctcaatcatatacagtttataaactgattttaagccacaataaaaaccatttccacagtattatagtaccttgaagactgtttttttttcattcagtacgatgtttggcataccattgtccacaaaaaagataaattaagacgatcaggtctgaaacactatgattaattgtaataacaggtagagaggccggcacgttgctaggcaggttcaatgtacttgaatgatcgatcatgtaaagattcatatctgaataaccatacataccaatttgaccacatttctttttgactgaaatttgaccacatttttaatgctccttttttcatactagttacatgcccataagttataacgggtcagatctatataactgaaatagactgagagcccatacattaatgcatgggctaaacccataattgaaaagtgacaaaagaacgtgctggcgtgttgagatgaggagataactaaaaggaggatgacttcgcttataaagtagtagagatacatacatatactaaaattcaattcagcctctacattaagtacgtatttttttttggcttcagataaaggtagcgacggcaagacctgcagccagcaaggtcttggtcagtgggcatatctaggatttttatatgggtgatccaacttatataattttttaaatactttaaatatataaatagatcaaatgtgcatcataatatatattagaaacaagttctttttcttttttttttcaaaagtttcttttcacatatgtgtatatatgcattggctagaatattttgggtggtcccgggaccaccctagatccacctagttcttggtgccggagtcttcacgacgagatgtgcctttcagtctgcttcacttgtgtgaacaacccagtgcttttccggcaggctagatctcccaagtttggagctgatttgaggattgctgcatttccagctgaagaacagtaaacgactaaaagtgtcatcgtcgtgtgtttgtccatggaccatgcatggttcaagaaaaatgaagcttggatggtaagtaaaaactacgtggaatttgatggaagatgtaggaacatatttgccagacttttgaaaggaggaaaaaaagaaataaactggtgaacatcactgtctagacctttaatttggatgtctggaaatgttggtatggaatgtttaattaataattacctcaaacaaaagaattctgatgtttcaaaatacatccataaattctccaaaagaatgttccatgcatgtcagttagaaaaatagggcaagccacgtacgtagggtagactcatttttttggaaccgcagtagaaagggttttactgcaggaagaatgagatgttagcagactaagggcttgtttagtttccatttttttcccaaaaacgtcacatcgaatctttggacacagacataaaatattaaatatagataaaatgaaaaactaattgcgcagtttgcatggaaatcgcgagacgaattttttttgagtctaattagtccatgattagtcataagtgctacagtaacctatatgcgctaatgacagattaattaggcttaataaatttgtctcgcggttttcaggcgagttatgaaattagttttttcattcgtatcaaaaacccctttcaacatctggtcaaacgtctgatgtgacacccaaaaattttctttttgcgaacttaacaagccctaattgacctcattcttttcagattatccaccggattattgtcgctggtcagattacttgctccacagttttcaaagtttgttttcttaaaaaaaaaactttatttgatccacgcttttaaaagtatatatatgttctctcataaaatttccttcgtgttcgttgcttagacaacttgttcttaagttattattttgtttataatatatataatatttaattcacctctataatcaattagatcatcctcaaccttcatatgtgccaatcattcaaaaaaaatactactataatcagtgttttagtgctcccaataactgagatcagcaagaaaaatgaaggagcaactgaagccgatgcaagttgggccggaacacatgcgggccaagcgggccattatttcttgggctaggccgaaatgatttgctctagctgcctgctccagggaagagcatgtgtcccaagctgcaagtagctagtatgggtaatattcctaattaatagctgtcaaaaaaaatattcctaattaatactctgcacatataataatatacgaccaaataactatatagaccaaatatacgaccaaataactatatacgaccaaataactatataatatactctgcacatataataatatactcgctgtcgacgtttgatgtcgcaattccggtatttgcatggtatggggatcattggtagtagggtatacgcgagactgaggtaaaagagatggagacggggattttttacaggttcgggcccctgaattgtcaggtaataaccctacatcctgttggccgaagccgttgttgttctttattcatctagatcacacaagtacaatacgtggggtagcctatctaactgttgtcgacatggcggtctgaaggtctgactcgtagtcgataacagggtagtcttcctcctcgagttcgtgcccggcgagatcaaagatagcgctttcgtctctcctgacagtatccggagacaccgtaggggactagccgtgcctatccctgaagtcgatatccggcgtcttgtcttagcgtatgttggcttgtatgttgtggcttctgttgttccgtctatggtgggcgttgattgtgtcccctctcctcctagggggccttgtatttatacccataggtgtccccttgtccaagtagaactagggaaaccaatatggatacaacccgagtagtccttgtcatttccatgtagaactctggttgtctttccttatccggaactcctcctatatccgcaggttgtttccgtattagacatggtatgtggtgggtcttaccgagatttagtcaattactattaggtatgtggtatccataaccctaacagtatcccccaacttcaatgcaaatgagcgagttcatattcccaaccgcagaccttgtaggaactgttatcgagctctcgtgaccgttctcggtgagttcagagataatgttagacttcctttatcagcctcgtgcgggcacctaaagggttcgtctgagtcaatctccgatgtcaaccaagaaagtataggacatgcgactaagtctcccgtcttgctgtaatcgagaatttggattgaagtcaaggaaattttatctcggcgggtacaccatttcttcattccgtattccttgtcgatatccaccaaccgttcttgagtgatcgagaaggcgcagagtctgcgacggagccttgtcaacatttgtcgtactcgccttagtcgatcttggtgtagaaccatagagacatggagtctttgataatgccgaatagaattttctaaaaccaatactcaaaaaagaatattagatagaaatagcccccgagcgagtgctcaaagggtaacatgttatagaatgtatgaaaaactgaaaatgaattaggtttacaaaccaatgttttgtatatgagcatctactcttttaccgacttcgatcagtcaatttgtttagttatacactctccctagcccccacccttgtcgtcgtagaatcgttctcggaggataaggctcttggacctttgacctacctcggttgaacaagcactgatcctagcccccagccgtgaggttggaaaatccatttccgattacacggcttggttaatacgcacggcaagaactcttacacgaccagatcttacatggtctttcgtctctaaaggatccgacaagaccttatccgctctagacttccccagccgaagttcccttaggttcctcagaggctttgtcaagacggtgtaaagggacattaggataggtttcaacgctaggtgtcttttgtggtaagggatctctgggtaaaacacttggagatattgtgtacctgatatcaactttgttgaagtagaggtaatgggagaatcgctacacctctggtcaagaaccaggtagtagtcgtaactcaaccactagaaataaatatacgagagatcgctacgattgactggttgagaaccagtgagtaggtgtctctcgatcatttgaagttgtcgtgcgaggactgctgcgttattactgtagtcgtacctcgaccatctaaggttgcggtgcgagagattgctacgtactggttcgaggaccagcgaacgtgtagaatcatctctcgaacaccaatggaggttgcggtgcgagagattgctatgtactggttcgagaaccagcgagcgagtagaatcatctctcgaacaccaatggaagttgcggtgtgggagattgctacgtactggttcgagaaccagcgagcgagtacaatcatctctcgaacaccaatggaggttgcggtgcgggagattgctacgtattggttcgagaaccagcgagcgagtagaatcatctctccaacaccaatgaaggttgcggtgcaggagattgctacgtactggttcgagaaacagcgagcgagtagaatcatctctcgaacaccaatggacgttgcggtgcgggtgattgctacatactggttcgacaaccagcgagcgagtagaatcatctatcgaacaccaatggagttttgcggtgcgagagattgctacgtactggttcgagaaccagcgagtgagtagaatcatctctcgaacaccaatggaggttgcactgcgggagattgctacgtactggttcgagaaccagtgagcgagtagaatcatctctcgaacaccaatggaggtttgtggtgcgggagattgctacgtactggttcgagaaccagcgagcaagcactggtggagaaaccatctttcgtcggtcggccgaattccacaatagtcccggttgtaataaaaaccgggactaaagatgatctttagtcccggttaaaaagggtaacggacatatttgatctttagtcccggttggtaacactcccggttcaaatgctgtcagggcttgtcaggccccccgggatctttagtcccggttggtaacaccaaccgggactaaagttcgtaactttagtcccggttggtcccggcgatctttagccccggttcctaacaccaaccaggactaaagtcctacccctgtatatatgtcttcttcctcctctagcccgagcaagcttcaaaatttcttcaaaaaagaggggaggtcttgccaaaattgctagtgaatttattttggtgattatatacaaatcggaggtgcctaaaaggttagcaacttcatcctccaatgttttttactgtcatattacatttggagctatgttttgcacacttttttgtctccaaaattttgttgtaagttgatgagagagaatttgtgtggggaagaaagaatatatagaaatttagtttatttgctaaataaggttttataaaatagttgagaaggaaaatatagtgaaagttaatcttaaataatagaaaacaaactaaaatgaaaactaaaagaagtaaaacacattaatattagtttaaaactttagaaatagtaaataagaattatttggtgtaatattttataatttttgtatgaataatgatatgtcattattgtacgagtgttgaaagagtttgtaattattttatcattattgtatgactgccattattgtacgaataattatttgtgtacgattttttttcatttcatgtagatggatcggcaatggatgtacgctgaccggcagtccaaagagtttattgacggcgtgcattattttttgagagtggccgaagctaacaggcataagggttttatttgttgtccatgcaataagtgtaagaatcagaaggagtattctgcatccaggactattcatttccacttgtttgagtcggggttcatcccaagctataactgttggacatcccatggagagcaaggggttgaaatggaagaagatgaagtggaagacgacaatattccgaactttgctcagtacgctggatttgaaggaaatcaaacgggcaaggaggaaagggatgctgatggtaacaacgttgcggatgatcttggtcagatgttgcaggacagcaaggaggattgcgaaagtgaaaagggggcccataaattggacaagatgttagaggaccacagaacgtcgttgtacccaggttgcgagcaggggcacaaaaagttggataccactctggagttcttgcaatggaaggcaaaaaatggtgttagtgataaggcatttggcgatttattgaaactcgtcaagaacattcttccggagggaaacaaattgcccgagacaacgtacgaggcta

SEQ ID NO: 31493 - DNA, 3351 bp, Oryza sativa
tggcatgaatccttttggagagatgagcaccggtcaatagcacttggcccattacgatgtgtatctacaacctccccccttggctatgcatgaagaggaagtacataatgatgccgattattattcaaggcccaagcaacctggtaacgacatcgatgtgtacctaagaccactggtcgaagatcttaaactgttgtggaagaaggaaggtgtccccgtgtgggacgaggacaaacaggaggagtttaacgtatgagcactgctgttcgtaaccatcaacgattggcctgcacttagcaacctatccgggcagtccaacaaggggtacaaggtttgcactcactgtatggatgaaacagaaagtacgtatcttaagcactgtcggaaggttgtgtacatgggtcatcgtcgattccttgcagcaaaccacccagtacggaagaaaggcaagcactttgaacatacggtggaccaccgtacgaagccaaaacatcgcagcggtaaaacagtgtttgctatggtgaaagatcttaaagtagtgcttggaaaggggcctagcagccagcctatagagagcgaagatggtcacgcggcgatgtgaaaaaaaaactccatattttgggagttaccctattgggaattcttggacgtccgccatgcaatcgacgtgatgcacctcactaagaacctttgcgtaaaccttcttggcttcctaggtgtatatggaaagtcgaaagatacactggaagcacgtaatgatctgaaacatatggaacaacgcagcaaccttcacccggaaccaaaggagaaaggaagccattacttgagtccagccagctacactcttagcaaggcagagaaggacagtatgtttgaatgcttggagagcatcaaggtatcgtcaggatactccacgaatataaagcgaataataagcacgaaggagaagaagttcacaaacataaagtctcatgactatcacgtgttgatgacacagctgctaccagttgtaataaggggtatcctcccagacaatgtccgggcaacaataacaaagctatgtgctttcatgaacgcaatttcgcagaaggtcatcgatccggatagattagaagcccttcagaataatgtggtgcaatgtcttgtcagctttgagttgatatttccaccttcatttttcaatataatgacgcatctgctttgtcaccttgtcaaagagatcggtattctcgaccctgtgtacctacacaacatgtttcctttcgagtggtacatgggcgttctgaagaaatatattcgtaaccgtgctcgtccagaggtaagcatcgccaaggggtatggaacagaggaggtcattgaatttcgcgtagaatttattgaagaccttcgccaatcggggtacttgaatcacaccatgaagggagactacggggaaaggggactctcggaaggaaagcaataatgacggtagacaacaatttatttcgtaaagcccatttcacagttctgcaacaatcttcattggtggctccttacatcgaggagcacttggctctagttcgtgccagaaacatcggtaagtccgatgcatggattacacggcatcacattgatactttctccgcgtggctgcgacaacatctcatgggtaacgagacgattaaccaacaactggccttcctggcgaggtaaccatctggcttgatcacgacattccagggatatgaaatcaatgggtacacattctacacgagagcccaagacatgaagagcacgaaccagaacagtgttgttcgtatcgatgccatgggacacgatggtacaactggcacgtattacggtgccatcgaggacatatgggaacttgactatggacctctcaaggtccctctgttccggtgcctatgggttaggttgactggtggaggcgtaacgaatgatgacagtgggatgacaacggttgaccttaacaaggttggatactcggacgaaccttttgtccttgccaatgatgtaacccaagttttttacgtcaaggacatgtctagcaaaggaaaaaaggctaaagggcttgacgagccgaagcgccacgtggttctcccaggaaaaagaaaaatcgtcggagtagaggacaagactgacgagaattacaatcagtttgatgggcaaccccctttcacggtgacgattgaccctagcatcctcctatcaaatgaagacaccccttactcacgtagccatcacaaggaaggaacaatagtgaggagaaagtacgtgcggtcaactgtcaccgctgatgtattgccgtaattgttctgtacacgatgtaaactatgttggatgtactgaatatccatacaaatcaattgttgtatggcatatgttaaatttgtatgattattagaatttttatcaaattgaaatcatccatatgctagttatatatgattattagattttttattaattatgtataattattagaattttaatcaaattgaaatcatccatatgctagttatatatgattattagaatttttaaaggttttaaatcatgcacgtggtatttacatatgttaattataattttcaacagtttaatatcatgatatgctagttatatatgattattagattttgtattaattttaaatcatgcatgtgctatttacatatgttaattagaatttttaaccatttaatatcatgcatatgctaattataaatgattattagaatttttaacaattttaaatcattcatgtgcttattatatattatccacgtattctagtacatacaataataatttttcgaaggttttatcattaattgttcgactttaaataattgtaatgcattatttactattttagaaacacatatgcaatgaaattcaagacacagctgctattatctttagtcccagttcctaaccctaaccgggtttaaaaagaatttgaaaatagcgggaaaagatctttagtcccaattggtgagaacaaccgggagtaaagatcttttatttagtctcggttgttgttacgaaccgggagtaaagatatttttactcccggttggtctcaccaactgggactaaagatccgggggtatatatattgccggtgcgccctcgtcttctccaccaacacttagacgtttttcaatcttggctcgatctccttcgccgccaccgtgcctagggcaaccctgcgccgacaccgccgtcgtctctcgccgtcgcttggcggtcctcgccgcctctgccgcagacgccgccaccgcatctcttgggtgagagccgccgctgcctctctctctctcgatctcgatctcgatatctctctct

SEQ ID NO: 31494 - DNA, 13190 bp, Oryza sativa
attccgccgcccccgcctcgagctcgccacgccgctgcgccacgccacgggactgctacgccacaccgccgcgacgccacgccgtcgccactgtcgccgcgatgccacggcgcggccaccgggccgccacgccactgctgcgcgcgcccaacagtgccgaacgttaacgaacgtgattgaaacgtgaccgaacgcgaacaaacgtaacgaaacgttaacgaatgcgaatgcaaacgttaacgaacgcgaacgaacgtgaacgaaacgttaacgaacgcgaacgagcgtaacaaaacgcgaacgaacgtaacgaaacgttaatgaacgcgaacgaacgtgcacgaaacgttaacgaacgcgaacgaacgtgaacaaaacgattacggaacgcgaacgaacgtgcacgaaacacttacgaatgtgaatgcacttgtactaaaagtgtgagaacgaacgcgtttatactaatacgatttactggtaatacatatatgattatatatgtaacttggcccgtttagactaatacattttcctggtaatgttgcagagaagacgtcgttatcgtaccttaagccaaagtggtagctagccatcgaaggaattcgcgcaggcaagtgatgtaaagaagtgattgttagatatttaatataagacggttagacttagcatacatgattattacaattttaatataagattgttatcgatttaatataatattgttagacttagcatatatgagtgttagagatttaatataatattgttagacttagcatatatatatatatgactattacaattttaatataagattagtagcgatttaatatgagattagtagagatttaatataagattgttatacttagcatatatatatgattattacaattttaatatgagattagtagccatttaatataagattgttagacttagcatatatatatatatgattattacaattttaatataagattagccgcgatttaatatgagattaatagagatttaatataagattagtagcgatttaatataatattgttatacttagcatatatatatgattattacaattttaatatgagattagtatccatttaatataagattgttagacttagcatatatatatatatatgattattacaattttaatataagattagccgcgatttattatgagattagtagagatttaatataagattagtagcgatttaatataagattgttatacttagcatacatatatgattattacaattttaatatgagattagtagtgatttaatataagattgttagacttagcatacatgattattacaattttaatataagattattagagattaaatataagattgttagagatttaatataagattgttagacttagcatatatatatgattattacaattttaatatgagattagtagccatttaatataagattattagagatttaatataagattagcagagttttaatattacggtacgcaaatacatcctatatacctaacaaatattttttgtttgcacagatggctgatcgcgatgaggaacagatactatacgacacaatcgcagagggaagcagccaatactggaacgaaggagaggggaacgaggatccaaaccagtacttgaacgaggagaggaacgtggagagggatgcggaggggaacgaggaggggaacgatgaggaggaggctagtggaagtcttccctccgctggacagaagagggcacgcggacaacgaggtgccgcgaagaagatagagggtcagcacatcataactgaggtggaccaagaattttgtacgccacagcggttgggttgtgagggacaacgtgcctgtcagcatggtgtactggcacaaaacaagggcacacggggataatgacagctttgtcccggactcggagaaagagatgctgtggaccacaatgctcgagacgttcacactacccgcgggtacggagaacatagtgaaacagtggactctgtagaaaatagcataacagtttcagagcttcaagggagatctctacaagaaatacatcctgaagggactaacaccgaacttcgacgtattcccaaagctaagggatcattgggacgagttcgttgcttacaagacagggcaacaagggcaagcgatgatggccagaaacaaagacaatgccgccaagaagaagtaccatcaccacttggggtcaggcggatatagcgtcgcaatgccgaactgggaggagatggaggcaagtttgattgagaggggtatcaaaccggccaccgctaaatggccggatcgatcgaagttttggtactatgctcacggtggaacgcttaacccagttgatggctcccttgtcttcagcgatcagatacgcgaggctgccagtcgactaacggacgcagtggtagactcttctcagggcacattccgacccgacagaaagaaggatgagctgtcactcgccctatagactcccgagcatccagggcgaacatgagggaaaggcgtgattccctggaagattggatttaaggaggacatccacacgtacaggagtcggatgaggagcaagagagataccgaggcgaagattgcaaatcttgagtacagggtatcgagctacgagctcagcatgcaagaggaggtggcaaggaaggtggatgaacgtatggccgcacatcggtcccaggatccccagccgtacattcatcctgcaatggtcagcccatcaggcaatcgtagcagctgcgcctcaacggggcaggtcggatcacagagcatggacgccatgcaaacccaggacgaaaccacctgccccgttgatgagatcacgcagcggacaccatgtgagctgtatattcccttgaagaacttatcaatcaaggtatgctcgtattttaatgatttttgacttgtacattccgcaagttgctgcttaggttgattactaatagataacctctcatcacgtgaaggtggcgtcgggaatggccatcccaacggaccctttcgggacttaccactgcaggccgattccagcaggatactcgagggtcgaagttgagctggtggaagccccgtacgaagatctcgagttggactacccaggaggagacggtgagacgcatctacgagacacaagccacgccatcatactatggcgcaagcggtacatcatccttcctgggctacaagcggcgtctcgtgcaccatctcctccggctccgccatcttctcctgcaccatctcctccggttcctccgccacgtcctcctgcaccatctcctccggctcctccgccacctcctactgcaccatctcctctggctcctccgcctccaccgtgtccgcctgcacctcccaagacaaggtctcgccaagctccaccgcctgcctgcacaagggcaacgaagaaggcgaaagttgacgccaccaaaaacaaggagccatcgtacgattgcagtcaagaggagcttgatgcttatgtggcaggagaggtgaagaggcaactcaagcctcggagtcctgaaaagaatatacctattgacccgagcgtgaagaacttcttcaagggaatgtccacaacaaacgaggcgttacagatatcggactatgaccaaacacttcagagagcctatcacaagaagtccaaaccagtccctcagcttggagaacaaccaaaccaagaggttgggccattggtgaccggcgaagattttggcataacggaattcatttcagacaccggtctaactgtggatcagttggttggaggcgcaccaatcccgaaggcggaagtggcatacaagtttgaactcggtaaaccgcttgtcaaacctgaacagctgcagtccctaccgacacagatgtacaaattccatgaacggtacatggaaatgagcgccaagggtagagagatgttcggagcgaggatcagaaaccccgacttcttgcaatgggaagatctctggatccatttcaaggatctcttcgatctgtaccagttggacgccctcgacatctctcttctgagggcatggattttgtgagtatttttgagttcgatttgtttcgttcaataattagctcctggcatatatgtaagcaataatactttcctttcatcgttgtagaatggagattcaaagggcccgacggcggagggtctacgatactgggttcatcgacccttggaaaatcaacaccgaaatgatcgacaagtacgagaaagacacagaggacaatctcatccatctcctaacgcagtagcatttcaagacgtacatactactgccgtacaacacagagtgagtttttattgtcgttcgaacaaattttgttcccatacatatagcatgtacattttcgatcatatatatctcatctcacgcatattccaaattccattgggtcctgttattcttcgacttggacgcatgcagagctatgtacgactcaatgaataaagaggagaagatttttgacaaggtcttcaaactgatagacatgtaatataatgccatctattccaaagtcacggggaatctattgctattatgttgatctcaggtaataattaattaatcatagcttgcaactgcatatgtagggcttgggatcggttccgtcaattggtccgcgggacttggaaagaaaaacttggacggaggtttcattttccagtgagtacatgcatgatccaaaattatattgaattgaatatctaattacagttaatataaatagtatattaaatctctcatcgtttctcatgtagtgtgcaaagcaggaccagggaactaacttatgcggctactacgtatgcgagtatgcccactgcctattaaaccaaatatgcacaacacgagagctcgatgtacgtatacataaaccattcaaaatttcattgctcgatttgttacgttgtttattaatttcatatattgatacgtcattatttttcgaacgatagcgtattcacatgagggataatctcccacacaaggattttatcacggctgttcaagaacaactgatgggattcatcaacgaagaagtccttaatcccgacggtgaattctactatgacggatcgacaattcataacgtcggtccttcctcttctgacataacgccggcgtcgaagtcgtagttatagctaccaagcaaatgaattgtactatatatgcatgtatatatatatttatatatgtacacatttacttttgtgttaatatatattttggtaacatatatatatgcacataaaatgttaagtgctttaaattatacatatgtgtgtgtaatatatgatttatacacacacacacacatatatatatatatatatataaaatcaaccatgcagcaaacagggccatgcaaataaaaaaaaatggtgcaccaatctttagtcccagttggtaacacaaaccgggactaaagatggtttggccggccacgtggctaatcgatctttagtcccggttggtaacacaaaccgggactaaagatcgatctttagtcccggttatttcacccgggactaaagataactatctttagtcccggattcgtagtctcggttggacaaccgggactaaaggggggttaccaaccgggactacaaacggtttctccaccagtgggaagtgcttggtgtacacggtgccgacgactccggggatcccggacaaggcctcgaacatggacgcggaggcggcgtgggagtccggccaccggacaaccctggtgaggaggacggtggtgatggcggcgcagacctggacgatgatgttgtggcaggtagagatgccgaggccgaagcggcgggacacctcgcggagtgggtcgccggtggcgaggcgccagatgcagacggtgacgcgctggggcacagggatggcggtgcgcagcgtggtgtcctccttggtgacagcggcagccaggtcgtcgcagagcttgtcgaacaccgcgcgcggcatgcggaaggctcgccggaattccgcctccgggcacgccgccgggtccctcatgcggtcccaccattccgtgctccgctcccgcacccacacccgccggccacctcccctttccgccgccggctcactcccctcgccgccgctgccatcgcagttggacagtgagctcgaattccttggcgccttcttcctcctcttagatgaccgggacacgacacccatggcctcgccgtcgtcggcatggaaactccgcttcccactggcatctcctccgcctgccaccacctccaccgacaccggcggctggtcagcaagaaagtcaccgtccatgaggaggaagtcgtcagcggcgagcatggatgtgtactcaaaatcagcatcatcggggatctcaaagagaggagtggagaagggctcgagctcgaggaaggcgttcatggcgatgggagaatactcaacattcaacaacgagtgattgtgtgggcaaatggccagctgatgatcaggcctttatatatacgtattgggttgtgtaaactgaggcagaatctgagacggagggaatagttgggttattgtatgtcatctaactgcttatgaaattttttttttaaaaaaaataacaagatagattaatatatgataggccactccacaaatatgcaagttaaaatttaactcttacaagttaaaaagaattaaattatgactagttaacatatattcacagtcaaatttgttattttgttgcaacttgtcgaagttaaaattagctttgtatgtttgtgaattgatttatcacatattaatctatcttgttaaatattcttaattttttatcatcattagctagatgacatgtaaataacgagtagatataagtttagtatagcttaagcccaatggctgcttggcgcgcggtatagtactatactgagaaaatagctaagatgagcagggctgtttcacatgtgggcactgcacacgcaacgcggcccacctcgtacgtctagccacgtgtctctcggtgattcgttcacagagttggttacgccttttcttgttacttttggtggggaaagggttgtttgatcgttagggcattcacagtgcaaggacgtacgtggcgctcagcccaatggtaagaaaccgaatattcgacgccacatcatcaatccatggtaagaaaccgaatattcggagctgtggacgaggatccaccatccgggccctatcaaagcccgttgtgtccatgctataggacctattgcctctgtcggatctgtgtcctaagttaccgcattcgatggatccctggcttctgagcaccgtcaacgccggatccgcggccaccggatccgcggttttccatcacaccggcctccttccgcggtttgccacccacatgcgtcctatcgccgacgcagttgctgtcatagagagctggcgcaacgaaggtggagaagctgaatgggaggagggagagggagtggtaaggaaaaggagggggagagagggagccgagagaaggcagagggttaaactgctacaaaacccctcatagatatcggttcataggtaaattcgacacctatgaacctcttcccacctccgtgtaatgagaaaaaaaatataaaaccaacacctatgtaccttttttttaaaaaaaaccgtcacctataacatattataggtaccggttaattaaaactgatacctataatatattatagatgccgattttttaaagaaccaacacccatacaaaactgagccgaccactcagtataaattcgagatcaagcctcctcattcctatcctagtgtccttgtccaatccccccttctctcgtcctcaccccctctccatcctcttatccactatgtcgccttcctctcaagcttgcggggccagctagctttagggggcgggggggggggggggggctcgatcaatatgacggctattttagagtgcagcaccgccatcgctgaagccaccgaatcgggagctcctctcctctctccttctatcagacctcctctccatccgccacccctccttctcctcttgaccctcccctcccccctcctcctctccatccggtgacagtggcagtggtggacaaggccggcgtgaaatggtgagctgtatggaaaaatttttctgtataagagtttcttaattaataaatcaaataagatttattttttaagttaatacttagtcatattctaatattctaatagatctcctcgttttccatgccaacattatatcagctcattctatcctctcgggcacgtacagccttcatctctagccctctcccataggaactgaaccaagagcgcgctacaagacggggaacctggaggcagcagtgatgctttagaaaattattcaccaaaaaatatgttgacatcgtaccaaccatagagtaaatttagaaactagcctgcacctatgctataaacagtcacagagccaatggcatgattgtatatatatcccataaaaactaacctagaactggatgtgagatattctaatactacaaatctagctagatatacatctgtttaaatttattgtactagaatacatcataagattcgtttgtttaggcggagggagtatgtctggacgagtaagagtatttcgcggtggccgaacactttttacaagcatcaatctcattcgacaatgagacgcgccagcagctcatacagctgcccgatcgaccagcccagaaactaagctctactaatcttgtggatcacctttcgtaactctctgttggaaatatataatgcaaaatgtcacgagcacaaatataacgcatatgcccgtactagaaaatccatttttccagacgattgtacttttttccaggcgagtagtcctcttggagctaaatgaccgcccgcgaaaataacaaccgtgggggaaatcgttatccacctgcgaaaataccacttaagcggtcgacctgcgaaaatacctttatttttgcaggcggacttcttaactggtccacctgcgaaaattggcgtggcatataaatagacgtgggagagacaagattttttctaagtcttggctctcctctcctcagccgtggaggggaagggaagtggcggcgctccactgccgtgggcagttcggcggcgagggcggcgggatgtggcgacggtgacgcgcgggatcggcggatcggcgacgacaaggcgcgggggcagcaggatcccgcgacggtgacgtgcaggggcggcgggatccggtgacggcgacgcgcgggggcagcggcatccacccccggcgcggctcccctcccctccctctagatccgaccgaagacggtggtggcggcggcggttcggtacccaccccgagcggcagcagcgcacctgcagcggccacccttaccttcccttcctctccctctccctctccctcccaaaactctaaccttagatcagccggaggtgggtaggggcgcgggtgggggtggaggcgattttttttttgttcctcgagagcatcttcgcaggtgggtgactggaaagtatacgaaaatcgatttttgcaggcctttgcatacaggtggacctttcctccacctgaaaaaatgatttttgatcgcctgaaaaaacgatttttctacaagtgtgtgagcatcaacagaattttacagatcagaagtttaataaacatgccgccagatctgcaaaagttggcggagagacatgcattatcatttaaacctttttgcatacaaatttattacgagctctggtatcttgtttcacagagggttctttataaagtccaagctttgaaaatttattggaaattcatattaggtttgattgaggtaaatcaaagtttcctgagatccttataatagtttctttaatatgacttagtaaatgaataggtcaatttttttagtatttttatcactagtgtcaacttacataaaaatcgttttttcgatgtttctcttaagaatactgtcctaacataaaaaaaacataatatttcatataaagtacgataatgataaaatttatatgaaaattgtagttctcaatgagctagctttgtagtcgaattggttttattttagatcgtttagggtcccaaatgttcgttacaagctgcgagatctattttagaaaattcttgagtttgagtttttcaaacgagctggattgagatatcctttggacgaaagaagatttaagtagatgactttttcatttgttgtcattaagagctcaaattatgtgttacaagtgttttagagagttcaagttaaaaaaaaatagcatctattacataattataaattgattcataggtgggataataaagatgttacgcgaggagtgggaggtacggtcctggttcaaatcctatataccgcacgaacacatttttcagtttaatgtttgcaactaagaaaaataaaaaattcaaaaaatgtattttcgcgggcatctccggtcctcttccataggaactgaagcaagagcgtgccacaaagatcttgaaggagcactgcaagcagcagtggccgtgagaacccacgctatatatgacactatttcagtacattattgatcaagatatttcgccatcatgtccagacataggcaatcagcattgacgtactagtgatgaaaaatggaagaaggtaatcgttcgcaaggaccaacttgtattcgtaccttcgttaaacaatagttgtactctcgtaaattgtaatcaactttcttttccataaaaggtaatagtaaattttataccatatatatttagagacaaatgtcacagggtcgcatcaatttttaatattctttttcacttaattaaccctacggttacaattattgtccgtaaccatgatgttaaaataatgaagaaaatacttattgttaccccatcgcatattagttgttgttataccttatatagcatagattatgttatgagaaaaaagtccatactatccttattaaatgatgtatgtgtggtcgtgggagaatagttgagggtataaaaaaagagaaatttgaattaaaagtgattgattggataagtaaattgtgataactattttgggacaaagtttaaatcataaagagataactaatttgggatgaaaatagtacattagtttctaccaggggcggagacagccaaattaaaaagacgccagggtcaatgtaaactagtatttgcaataccgattaaaaaaaccatgaaaaccgcttggttttttcaatccgctagttttgaatccttttcttatatagagttgacgaaaaaaatcttcgaaagtttattagttttaaatatttgttctaagctacacgaaaatcattgatttttactagccaacaaaccttatgaatcagagaggggaaaaactttatcaaaaaatgataacataaatacgtcttaagacttgcatgtaatctctccatcccaaaatataaaggattttagttagatgaatcatattctactagtatgaacttagacagagaaggagggagtagcatctaataatgtatatataaaatattgagaagaatgtactgatccattacaagtttgcttcctgccaatttagtaaaaacaaaaagttaaaagatacggagtactagtgaagaagatattcatatgggctgtgaacaacagatatcggttcctaatttcgttacttgaagttgtgctgaaaggaacattgaacctaagctgcatatactttgccatgtgatttcaaagggacctgtcggcttgtgggccttgtctagttcacgtgggcaatcaggctaatgggcttgcaaaccagccggctaatcacaaagatttaacggaactgctagccgactgtcaaattttttagccattgattccgctttaagatttatgctgagatattttacgatcggatctaaatcctcttttcacaaactagtcatatcatcacatgtttatggcagatttgttcaagttatatctaagttgcattctagttacatgctagttacattctagttacactataattacattgtaactatatacagtgtaactacactataactacattgttatctctatataaattagatataaagttacatatattattttaatacatatatacaagttattattattatagtatagttctagtgaaattatatactatatttagatttgaaagttttcctctcaagaaaacactcgacagttttttagctagtcccaagatttaattagtagttgtgctcatacaagatgatcagatgggctgggtttaaatcaacaattttgccggggtcacattcaactacaccataggtatcaagtggaatttagctccggccatcggtgtcctaggaccccggtgcaacaacggtagctccgtccctggtttctacatatgttgtattctgaaatttactccgaaaaaaatttgtgaaatcacatctatctacaacatgtgtttcttttagactaacatgtgccacatgaaagcaacaattccactattcagctacatgaaaatagtccgaattaccttccgaactattagacagtatgaattaccctcgaaccacaaaaccagacattttaaacctcaaactattgatactggatgaattatcccccccactctatccagagagattttggtcctacgtagcatacacatggtgtcaacgtgtcaatccaatcagaaaaggaataaaaaaccataaccccccacttgtcatatacctcacctgtctcttttttctctctatcggctcttggcgcttgggaatgaggcgggcatgggggtggcaggcaccaatgaaatagcgttgcaggcacgacagcagccgagagggcactacgggcatgggtgggaaggacggcatgggcggtctgcacatgcgagtagggcagtggagatggcgggcagcggcacagtagggagaacattatgggcgacgaacataggtgaggaggacgctagagactgtgggatgtgaagaggcaggcagcagcaagcatggctgaaggcggcaggaaggcactcctcgaggaggaccttgtaggacgctcctcgaggagtgtggctcaagcttgcatgcctgcaggt

SEQ ID NO: 31495 - DNA, 1133 bp, Oryza sativa
gtacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtgggccaaatacacggcc

SEQ ID NO: 31496 - DNA, 572 bp, Oryza sativa
cagtgcaacctccattggtgttcgagagatgattctactcactcgctggttctcgaaccagtacgtagcaatctctcgcaccgcaaaactccattggtgttcgatagatgattctactcgctcgctggttgtcgaaccagtatgtagcaatcacccgcaccgcaacgtccattggtgttcgagagatgattctactcgctcgctgtttctcgaaccagtacgtagcaatctcctgcaccgcaaccttcattggtgttggagagatgattctactcgctcgctggttctcgaaccaatacgtagcaatctcccgcaccgcaacctccattggtgttcgagagatgattgtactcgctcgctggttctcgaaccagtacgtagcaatctcccacaccgcaacttccattggtgttcgagagatgattctactcgctcgctggttctcgaaccagtacatagcaatctctcgcaccgcaacctccattggtgttcgagagatgattctacacgttcgctggtcctcgaaccagtacgtagccattctctcgcaccgcaaccttaaatggtcgagg

SEQ ID NO: 31497 - DNA, 1132 bp, Oryza sativa
cccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggccaaatacacggcctgc

SEQ ID NO: 31498 - DNA, 1019 bp, Oryza sativa
attccggtgcatactacctactcagggaagaggttagcagaactttatctgacaagaatcatgtgtttacatggggtacctaagaagatagtgtctgatcgagggagccaattcacttcaaagttctagcagaaattacaagaggaattgggaacccttctgaacttcagcactgcttaccatccacaaacagatggctagaccgagcgagtcaatcaatgtcacgcccggaatttctatccaaaattccaaacgcttacatgtgtgtaaaccctcgtccaggaatcagccgaggcacacaataacaaattgataatagagtaccattattactctaattaataagcgaataaaatgtcattacagaggtagatagttcctctcaatcaataaagatctaagcagcggaaaataagataaacggcgcagacgactccactccacaggcagcttgactagggctacacctaatcctccacaccatcagcatcattgtagaactcttcctctgatgaatgattgcaaggtgagtatacgacatatgaatttttgaagatttaatcggattaaaacacttatatagattttaattgaattatgacgcaataatgaattatttttgaaaaggaaaaagggaattattgcgtcagcggctagggtttgcggtggaccgggcgcacggcagcggttcacgggaacggacggccgagattgatccatccaaaacggacggccgagatcgagcggatctacggcggctcacggcagacggccacgatgacgtcggcgatgacgtcatcaccggcggcgactcgggcggctcgggcgcgcatgctcgccggcgaacgacggcacgacgacgcgaacggagggcaccaggacgatgcgggcatcgcggcgaactcaccggtgaccaaagcaacggcggaggatgaacggacggcggcggcgttgaagaaaaaggcgggggagttcttcggtttgacgacgacagcgatgctccggcggtctaccgcgac

SEQ ID NO: 31499 - DNA, 5797 bp, Oryza sativa
  unsure (1)..(5797): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagataccaatgcgagttcatactcctggaggtggcatgaccacaactcactactgcccatcaatgacagttgaaattcaagggttgatttttccagccaacctcattcttcttgagtccaaggaccttgatgtcattcttggaatggattggttgacacggtacagaggagtgattgattgtgctagccgcaccatcaagttaaccaatgcgaaaggagaagtggtaaccttccagtctccagtgccgcagaagccagggatcagtttaaaccaggctgctggtgaagaacaagaggtagcagtggagaaaaccactaagaagttggaggatattcctatagtcagagagtatccagaggtttttccggatgatctgacaacaatgccaccaaaaagggatatcgagttccggattgacttggtacctagaactgcaccgatccacaagaggccttacagaatgagagccaacgagttggcggaagtcaagaaccaagttgatgaacagttacagaagggatacattcgcccgagcacgtcgccttggggtgctctagttatctttgtggaaaagaaagataaaaccaaaaggatgtgcgtcgactaccgcgcactcaatgaggtcactattaagaacaagtatccgttgccaagaattgatgatctgtttgatcagttgaaaggagctactgtgttctctaagatagacctacgatcaggctatcaccagttgaggatccgcgaagaggatattccaaagacagcattcatcgctcggtaagggttgttcgaatgcacagttatgtctttcggactcactaatgcacctgctttcttcatgaatttgatgaacaaggtgtttatggaatttctagacaagtttgtcgtggttttcatcgatgacatacttatctactccaagtccgaggaagagcatgagcagcatctccgactagtacttgaaaagttaaaagagcaccagctatatgccaagttcagcaagtgtgacttttggcttaaggaagttcagtttctcggtcacatcgtgaatgctcaaggagtagctgtggatccagcaaatgtggagtcagttaccaaatggaccccaccaaggacagtcactcaggttcagagtttcttatgacttgcgggctattaccgccgtttcattgagaacttctctaaaattgctaagccaatgacacagctattgaagaaggaagaaaaatttatctggtctgctgaatgcaataggagttttgaagaactcaaacgacggttggtgtctgcaccagtcttaatcctgcctgatcagacgaaagttttacaggtctattgtgatgcatctcgtcaggggctaggatgtgtgttgatgcaggatggcaaagtggtttcttatgcttcatggcagttgcgtcctcatgaaggcaactacccgacgcatgatctggaattggccgcagttgttcatgctttaaagatttggtggcactatctcatcggtaaccgttgtgaggtatatacagatcacaaaagtctaaagtacatcttcactcaacctgatttgaatctcagacagcgaagatggttagagctaatcaacgattatgatatgggaatacattatcatcccggcaaggctaatgtggttgcagatgccttgagcaggaagagctactgcaatgttgcatgggtagagcaactatgttgtgaggttcaatgtgatttggaacatctgaaccttggtatagttgagcacggattcgtggctgccctagaggcacaacccacactggtggagcaggttcgcatagctcaagcaagtgaccctaaaatagcagagctcaaaaagaacatgagagttggaaaagcccgaggttttgttgaggatgaacaaggaacaatctggatgggggaaagattgtgtgtacctgaaaacaaggagttaaaggacttgataatgacagaagctcatcaaactcagtattccattcatcctggcagtaccaagatgtaccaagacctcaaagaaaaattctggtgggtcaacatgagaagggaaatagctgaattcgtcgcactctgtgacgtttgccagcgagtaaaggcagaacaccaaaggccagcaggtttgctacagccacttcagattccagaatggaagtgggaagaaatcggaatggatttcattacgggtttgcccaggacgtcatcggggcatgattctatttgggtagttgttgatcgactcactaaagtggctcactgcattccggtgcatactacctactcagggaagaggttagcagaactttatctgacaagaatcatgtgtttacatggggtacctaagaagatagtgtctgatcgagggagccaattcacttcaaagttctagcagaaattacaagaggaattgggaacccttctgaacttcagcactgcttaccatccacaaacagatggctagaccgagcgagtcaatcaatgtcacgcccggaatttctatccaaaattccaaacgcttacatgtgtgtaaaccctcgtccaggaatcagccgaggcacacaataacaaattgataatagagtaccattattactctaattaataagcgaataaaatgtcattacagaggtagatagttcctctcaatcaataaagatctaagcagcggaaaataagataaacggcgcagacgactccactccacaggcagcttgactagggctacacctaatcctccacaccatcagcatcattgtagaactcttcctctgatgaatgattgcaaggtgagtatacgacatatgaatttttgaagatttaatcggattaaaacacttatatagatttaaattgaattatgacgcaataatgaattatttttgaaaaggaaaaagggaattattgcgtcagcgggctagggtttggtggaccgggcgcacgggcgacggttcacgcgaacggacggccgagatcgatccaatccaaaacggacggccgagatcgatcggtccacgaccggctcacggcggacgaccccgatgacgtcagcggtgacgtcaccgacagcggcagcggctcggcggagcggacggctcgggcggcgcacactcaccggcaaacggcggcgctaggacgcaaacggagggcaccaagatgtagaggacaacacggcgaactcaccggtgacctaaacggcggcggaagaccaacggacggcgacggcgacaaggaggaagcggcgggaaccttcgggtcgacgacggcgaagctgctccggtgatctccggcgacggcgaaggggcgaacgaggacggcgacgacttggcgagcacgacggtggtcttcccgagcgacggcgacggctgaaacgacggcggcgcacggctggagcggcggcggcgacggcgaagctagggcacacggcgctagagctcttccgacgacgagaggcgaaagcgaaggtggcgacgggtagaggagacaccggggatccttttaaaggggctcggagagcggcggcgaaggcccacggctgccggcgaagagaaggaaaggtcggggttcggaggaaagagaccgatccgattcgacctcgaatccacgaatttccaaagcgatttagaggatgattccaaaagagaaaaggtagaggagatcccgaagatcatttcccttctatcgatttcaccggatcgggaaagacgcgaccgaatttggaaggagacgacggcggcgcggcgctagggtttcgggcggcggccgacgcgaggaagacgacgactccgacaggcgggccccacctgtcagcggcagcgaactcgcgcgggcggctgcggctgcgaactgggccgacttgggccggggagagagagagagggtttttgggctgactttcggcccaaagacaaaagagacttttaaaaacctttttcaatttaaattattcatgaaatacaattccatttattaaaaatacttccttagctcaaataaatcccagaaaaatctaggaattatagaattaagcaaagtatttaatgaaattttatctggccccattttatattggaatttattaattaaaattagatcttctcttctaggctttttttaaaatcatttctaaaaattctaattaaacaacaatttatatattttgaatttttagggtgtgacaatcaaatactagaggatatgttgagagcctgtacgcttgactttggtggagcatgggacaaaagcttgccgtatgctgaattctcttacaataacagttaccaagctagtctgcagatggcaccgtttgaagcactgtatggatggaggtgtcgtactctgctcttctgggatcagacaggggaacgccagttgtttggtacataagttttaaatgaggcagaagagaaagtcagagctgtcagggaaagattgagaatcgcacaatgtcgacaaaaaagctatgtagacaaccgccgaagagagctcattttcgaaacagaggattatgtgtatctccgtgtcactccgctcaggggagtacatcacttccaaaccaaaggaaagttggcaccacgctttgtgggaccatacaggatcttggaacgtagaggtgaagttgcttaccagcttgagcttccctccaacatgcttggcatccacaatgtgttccacgtctctcagttgaagaaatgtttgagagttcctgaggaacaggcaagtccggatcaaatcgaaatccaaaaagacttgacgtatgtggagaagccgactcgtatcctcgaaactagcgagagaaggaccagaaacaaagtaatcagattctgcaaggttcagtggagtcatcactcagaagaagaggccacctaggaaagagaaaatgagttaaagaccgcccatccgcacctcttcaccaattcttccgaatctcggggtcgagattccgtttaagggggggtaggtttgtcacaccctgaagtttcccccccttttcttgctttaaaaaaattggttaaataaattgcccgaagaaattatcttaattaacctagagctaaatccctaattaataaatgcatttaataatcgaattcggcgtggtggaatttttcttgagttccccatgctccaatacattaacatgatttttagtggaaattttcagagccttggaaataattttaaccaattaaaattgagcaagtgcaatatttttagtcccaggaaaatcctttttctcttttttcttttcttttccctcctttttctttattgggccgtcggcctatccctctcccgcagccccttctccttgtgggccggcccaagccgcccctccctcctctctcgggacgccgacaggtgggccccacctatcggtcgtctcctacctccggccgttggagccggagctccaaccgccgctgccgccgaaaccgccacgccgccgccgtttcccgccttctccgctccacgtcgcgcctccactccgcgcccacacctcgcgc

SEQ ID NO: 31500 - DNA, 6844 bp, Oryza sativa
tagccgctgccgctgcctatctccggccgcgcgccgctgttgctagagccgccgccgcgccgtgcagtcgccgccgtcgcgctcacggagcccacccgcacctctgccgccgcttggttgccgcgaatcaccgccggagctccgattccttcgcgccgccggtgagctcgccattgtttccatctccggccatttcttctcgccgtgccgcggctcttctcttctccctcaccccttcaccgccttttcccaggtcgcgctgctcccgtccgctgttttccgaagcgctgccgccgctcatcccctcccactccggtcgccgcccctccggtgacgactccctccccctcccttttctccccttcccgcgtgcgccgccgcctttggctgtgccgccgcctttggccgtgtcgccgctccagccgtccgccgccgcctttcgcgtcgtccgccgccgcctcccttcgccggtcgtcgccgtcggcagccgcgcacgccgccgccgctcgccatggccggtcggtcggctttgtgccgagccgagccgtgcctagccgccgcccgcgccgtccgatcggtctcgggccgatccggtgtcagtcccgtggaccggcggtggaccacctgcgtggtcccggtccacggtagaccggccaccttgtgccgctgccagtggagcccacttgcccgagccccctctccctgcccttgtgcgctgacaagcggagccctcctgtcggcgcagccgcccctccccccttggatgacgtcagccctgggatttacagcgcaataaattgattaaggactttttctttattagtaaaaacacagtttatcttctaaaattcatatgtaattcatccgagcttcgtttaagtccattcaagtctcagtaaattcataaaaatgcaaagaatccattaaaatgattttgtttcctgtttcagtagtcttatagcatgttttgcttgtgtgctttgtttgtcgcgtagatttcggccgtttcgtcgatccgcggtttctcgaagacgttgctgaggtctcatcagtgcgagagacaggcaagtcatgctttacatttgatcatattgtacccaatttacaaataccttgcatttctattaattgttgcactcttttacaatgtcatgtgggatgggtcctattactcagccatatatcgtttaccatatgccattgataactggggtatcaaaatgattagatgttggtttaggaaatgcttagccatgcttagttcaactagtacacaaaaggggatcacattattacatgagcatagttcaattttgactatgagcatagttctggttggtgccaccgcaatggtgttagttatttaaaatacactgaatggtgggttgtgcgtgcatggttttgctggtcgcacccatggcaattaaggaccggttcacgggaaacactgggagacttaccgtgcttaccacaagcgggagtgggtaactgcttgatctgaggtatagctcaaccctttcctaggcaccggtggcgagggtgggcgtgatggagttgggtcggccggggtgtccggttgtctagctgccggattcaccgcggcacaagaggggaccgcccactaccttttgaggggtgggggtgaaaccttagcatggtgtggatggttagggaagggttatgaggagggtcttgtcacgatttccccctttgcagtgtcatggtgatacttcggggcatggcgacatgtgtggaatcgtgtcttgtgggtacagttgtacacctctgccagagtaaaactattcgaatagccgtgcccgcggttatgggcgatcaaccagatttaccgtgattagtctcacccctagtttagcttaatgaactggtgtagttcaggtggttggttgggcctattgcaatgtggtgtagcgttggacaatgtttggttaatattgattaattactacaactgttttactgctttcaactactgtttttaaatgcctgctttgtgcaaagagcctttagcctccttcggttatatcctgcatcatacctcctcttccggtatgacttgctgaatacagttggtagtactcagtcttgctctcttttcccccacaccagagctgaagatcttcctagtgggaagtgtcttaccgaagttgatttcgtcgctgtcgtcaaggattacctgtggagtggagtcaccccgctgcagaagtcaagtttccaagtctagctcgtttttcttttctgctgcatttgtaatcatctccatttttgtaagacgtggatctgtatgtcaaaaattgtcgtttgtgtaccctggctggtcctagacagggatttaatgcacattcagcttcgaaattctggttcgtgaatttctgggcatgacacatgtcttcttggcactcagtccactcagtgacgaagtcggctaaagcttgggacttgatcgaagttcgcggcatgaaggatatatccagggacatcaattctaaggcccactttgctatccgcccatttgcttcacgattatgaagtatatccccgagtggaaacgatgtgaccaccgtgaccgagtgaccttggaagtagtgaggtaatttgctgacggtcattaaaacaccatataacagcttttgaacctgaggatatcttgtcttggagtcagccaaaaccttgctaacgaagtagattggtcgttggactttttgaacatggccttcttcttcacgctcaacaactaggactgtgcttacaacctgggaagttgccgacacgtataacaacagcggctcttgcggatgtggtgaagctaagactggtggagtagtgagaagttttttgaagtcttcaaaggctttttgtgcttcgggtccccactagaaattgtctgttttcttcaacagcttgaaaaagggcatccccggctcgccgagtcgtgaaacaaaccggttgagcgccgccatgcaaccggtcagcttttgaacatctttctaggagctcggcggtttcatgttgaggatggcattgattttctccgggttggcttgtatgcctctacgggacaccataaatccaagcagcttccctgacggtactccgaagatgcacttttgagggtttagtttcatcctgaaagcgcggatgcttgcaaaggtctcttctagatccgtaatcaaatcatccttctgcttggtcttgacgactagatcatccacataagcttcaacgttgcggtcgatttgagttgaaaaacatctttggatcatgcgttgataagttgctcctgcgttctttaatccaaacggcatggtgatgtagtagtaggccccgaagggcgtgatgaacgaagtctttaagcagtcggatctgatgatatcctgagtaccaatccactgagtagctcgcagccggccgttgagtcaactacctggtcaatgcgaggtaacgcaaagggatctttggggcaagacttgttgaggtcggtgtaatcaacacacatgcgccattgtcccgtcttcttccgaactaggactgggttggccagccagtcgggatgaaggacttccttgatgaagcctgctgctaacagcttggtcaattcctccttgatcgcatccttcctatcctgtgcaaaacggcggagtcgttgcttgattggtttagcgtcttccttaacaagtaaagagtgctcaatcaccactctaggaataccaggcatatcagatagtttccacgcaaataaatctttattattttgaagaaagatgatgagcgcgctttcctatttacaatctaactcagcgcctattacagcagtcttagtaggatcagaggaatctaggggaatcttcttggtcttggcgtcgccttctccgctctttggcatcttggttgcgggcacttctccttcgcttgctgtggacgtagccagtcggatttcttctcgggcgagcgtgatctcgcgggtctgggccatctcacagctttccttgtcgcatgtgacggcttgcttgatgtcactccgcagggatatgtctcctcgaggaccaggcatcttcatcatcatgtaggtatagtgcgggacagccatgaacttggctaacgccgggcgtccgagtatgacatgatgttctctgtacggaaattctcccgagtgctgaaagtaataggaagagtgtggccgagtggtgtaacaaatagccccgggatgactctgtgaaagggcgcattactcggctttaattccgtgcgagggatctgcatgtcgtccagggtcttggcgaaaaggaggttgagtgcactgccaccattgatgagggatctgcgaagcttgacgttgtgaaccaccgggtctagtaccagggggtaccgtcccgggtggaccactcggtctggatgatccgagcggtcaaacttaatcgttgtctctgaccaccgaagatattggggcgtgtcaggttgagcagcgttgatctccgttcggtcagcttttgctttctcttggattcataagccaggggtcaaccaaagatgtggttgagctccttgcgatggtcttggaaaccagtcagtgcatcatcttcaccatccttcttctttgacgtgctttgatctccgtcggaggctttatgtgcgttcttggcgtattgttctgcaaactgtttgtagacgaagcaatctttggccgcgtgattggaattgggatgatgcggacattgggagttcataatcttgtcaaaggtgttgacgtgcgaacgttgtcgggaggatggtgtagtagttgccacaagttcctcgggcttacgcttgcgatccttgtgattggtacttccactcccccctgtagtcggtgtatctttcttcggcttccaagtggtgcccgactgcttggacgtggtaatggcatcttcggctttggcatactcattggctttttcgaacatctgcttgaccgtcctgggaggcttgcgcccgaacttgccgactaggtctgtgtggcgaacgcccttggtgaaggcggcgatgatgacgtcgtcggtgatgtcggagatcttgttgcgttgctcggaaaagcgtcggatgtaatctcgaagggattctctagacttctgaatgacgttgtagagatcaaactgtgtaccagggcgttcaaaggtaccctggaagttggcgatgaagtggtcgcgaagttccgcccatgatccaattgtgccacagggtaacccgtgaagccaggaccgggcagaatccgctagggccacaggcaaataattcgccaattgcgagaccgtagacggtgagccaagactccgggttagtggtgccgtcatacttctcgattccaatcggcttgaagccggctggccaatccactcgacgcaggtcgcttgtgaaggcagcaactccatccacgtcgtcgtcgtagcgatctggagaatggtggggagcgtagcctcttgccgcgcggcgctggttgatagtatcgcgaagatcgacggggcgcctgcgatgtggggagtgtggtcattcaactcgatgctccctgtgtcgtttgggtggcgagtggatagatcgctcgtcgtgacccctactcctgcgagtagatcccgcgccgacgacgctgaggcttggttggtgatagtcttgagatcgaagatggggaactcggctgccagtcggcgtgtggacgcttgcggagttaatcgggaccaaggcggcgatcatggtcttggtctggttcaagatgttgacgacgtgattggcttgattgagcgcgtcttccttgaggaggatgtcgaggagggtgatcgctgcaaccgcgttctgttgggggggcggaaaaccgctgtcccctcgacgtcttgttgcccaataagttcctatgcttgtcgcccggcatccagggcacgttgtcgccagtcctcagcctcttttgcagcccgttcgcgttcctgtggctcacattgtagccgttctcgctcttatgcttggcgctcctcttccagtcggcgtcgttcggcttcctgttgtacacgtagttcttctgcttctcgggctttacgctcttcttccgtctcattgtcagccatgaagatgccgaagtagaggggtgtgtagttgtcttcaaagccttcgtcgaagtcgtcgaggttgcgtagtcgtagcggtagccgaagtcgtcgtactccacgatctccgatggtcgcgagtcgatgccgggggagctgaggtagccatccagttgttcgtcgaaaccgtgccgagaggctggagtatgacaccgacttccctggagctaggccgggccggggctaaagccggatcccacctaggcctacggggagaagacgcccttgtggtgaatacagcagccaaatcatcgggagtttcatcaggattggcggataggccccatcgtcttgatcgggtcgtgttgaagtagattggatcccgtccgagtggtttgaagccaactcggtggagatgatcttggggtagacctcggccgagttcgggataccgaactaggtggagatctggcctcttcccgactggtttgaatccgagtcgaggagagaaatcttgccgaagtcgttggtgatgaagtcgaggctgccgaattggaacgcctgcccgggagggaagacaaagtcgtcgatgccggaaacgaaacccatcgcactagtcggcgaagaacttgacgcttcccatacctggcgtgccaactgttgaaacaagatttcgacaatactaaaagggggtggctatcaggctggaaaagtggatgggtttaaagacaaggaattttatacaggttcaggccttctta

SEQ ID NO: 31501 - DNA, 4903 bp, Oryza sativa
gaacgcctgccgggagggaagacaaagtcgtcgatgccggaaacgaaacccatcgccctagtcggcgaagaacttgacgcttcccatacctggcgtgccaactgttgaaacaagatttcgacaatactaaaagggggtggctatcaggctggaaaagtggatgggtttaaaggcaaggaattttatacaggttcaggctttcttaatcaagaagtaataccctactcctgtccggggattgatccaccaagtatattattgatcatatgatctgggaaaaaatcgtgcccctagaggcacccgtacctctccttatataggggaaggggtccgtattacaaaatacagtccatatccctaacggaatatgtagttacagataaaatacaatcgtaaccgactaggaactcggatgtatccttgacatacaagtttagaatttaacccgagtccttctaaagatattctatctagacatggcaccccatatccagtcggactataaatgccttgtaggcatggggtatccataatctccacacagctataggttgggcatgttttatatggtgtaggattacattatagggtatatactgtttgccacaagcgttttgactttgttctgatcgaaatgaaaagattgacctgctgaacacactccgttcacgtcgagtagccatagtagcttagaaccgaatgtaggcacacatcgtaaagttgtaaatgcaaccatagtagacggtgacgataattaatttcaacaatgtactaggatttatccttacagaggcattatgtttaaacttgcatgacatttttattcagatttgtatcaccccgatgtttcaacttgtcacacacgatgatgcatgactttatttttctctcctgtactactatactggtacaattcaataccagataccaccgacggtgggaatgctacagggagcagtgttgtagcttgggtagataccgcatattgacggcatgtttagggccaacatagcttgggcttgagcttgactctgatcgaagtagacgctagcaaactgttgtagccgtagctgctgcacaatagcctgaacactgctaatggcctggcagtgagactgttgcgcgatcatcctgagctgttggcagcactgctgctgcatgacttggcagtttctcagttgaaacacgggtgattggaagaaggggatttccactgtgctgcactgctgccttacgaactcaccgcatgggctaagcatctgttgctgcagcatgagatgcggctgcagctgatattgcctgtaaacatgagtaacagcatcaaactgcgtagaggcgctgcatgcagcaatagcaaggagagcaaagaagaaaatgatcttcattgtggtgggtttctagttcttatgcttttgctgtaatgtttgagttgtgagaatgatgaagtgggtttacattgtgcttgtctatttatagatgcgatggatgggttttctttgaattccttatcggttgctctagagtgtttgtttttgttggatattctattgggatcagagtgagtcatgtcatttggaagttacatgatgtgcctccacagatgtccttgtataccatcgtcaaagtaactttattgcccatcacagatacttgatggttggcaagatagataatgttatgactcctcactcactttatatctcagtgtgacatggtgtcacacccagaaattctcgaacccgaatttctaagctgaatgtgcattaaatccctgtccaggaccagccagggtacacaaacaacaattgttgacatacagacccacgccttacaaaaatataaaagattacaaatacagcgggaaagataaaagcgagctaaaccgggaagcttgacttcagcagcgggcgactccactccacaggcaaaccttgacggcagcgacgaaaccaacctctctgagacggctccaactgagaagaacttcaactctggtgcgagggaaaagagagcaagactgagtactactgtcacgcccgaaaattcactagtaatttccgaacttatttgtgcataaaatcctcgtccaggaatcagccgaggtacacaaactgacaatttaatatacaaattcatcaaattaactaaaacgataaatacttacttaagatgcacttagtcctcaccatgaagaaaactgcagcggaaaataaaatctagcgaagctccggctccactcccacaggcagctcaactggggtataagccaaacgtcttctcctcctagatcttttttcttcaactgaggttgattgattattgcaagaatgagcatatgacatactcaacaagccacacagcaaatatgcaagtgcacaaggataccaaaggatggcataatataggctcatttgcaaaagcagcatttagcaaaacatttaagagaaataaaacagtggagtaattaatcagaaattttaatcaacactgaacaacacacccatgctgcacaggcccaaccatcctgaacaaccatacccggctgtacagatctaactccaaaccaggagctaagcaaattattaccaggtataacatctataattattgtgagaggtgtgagactaatcacgaaaaacattgctcaacccgcccataaccgcgggcacggctattcgaatagttttactctgatcagaggtgtaccactgtacccacaagacacagccccacatcatatcaccatgtccctcaataccaccacggtacctcgaaaaggagctgtgacaataccccttgcacaacacaatccaccatagcgcacctttcctggatcataatcacccccttataaaacaaggcatggactccccagcgacccccgtgggcttatctccgccacttctcagtctagtgctccgcaatgaaccatgttatacaaaaggtaaagccgttgcccacgctggcttgtggttggcatggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataataatgagtcataagtaatcccaatagtgtgctaatgtttctaagcatggctaagcaatcatatctaatatctagctgaaccaatatatatagctcaactagtcaagttataataacccaaggtatcaaggaataaagtaatcaatgcaaacaggccataacaaaggaatagattcacaccacccagtgacattcgaaaataaatgcacagttgaaataaatagaaaatttaaatataggatcaacatgctcaaaggattgtgtttaggatctgtgtgacttgccttgcaataatcggtcttcaattaatcttcttgaatacttccggcgcactcacgaaccttcgcaacgacggaaacgacaagctaacacgcaaaatgaagaaaaagactaataaaaaccaaataaacaatacataaaaagtaaacaaacatgtagatcataattttagatgaattatgagacttgaacggcctcattgtgacttcatatgaatttattatgaattttacaagattaaatcggattaaaacacttatatggattttaattgaattatgacgcaataatgaattatttttgaaaaggaaaagggaattattgcgtcatcaaaggcggtccgggagcacgggacggtctaaggaaacgaacggccgagatcgattctatccaaaacgggcggccgagatcaacttgatctaccgcggttcacgggacaaggcgacgatgacgtcagcggtgacgtcatcaccggcgacggctcggcctcgcgcgctcgccggcgaatgacggcgcaacgacgcaaacagaggacaccaacgggtagaggacaacacagcgaactcaccggtgaccaaaaccacggcggaagagcaacggacggcgccggtgacgaggaagaagaggcgacggtcttcgggtcgacggtgacggcggtgctccggcggtcttctgcggcggcgaagaggtggacggggacggcgacgacctcgcgatcccgatggtggcgacggcgaccgacgacggtggctgcaacggcggcgcggcgcggctgaaccgacggcaacgacagcgacggctagggctacgcggaggcggcgctagacgggacggcgggctaaggcaaaggtggcggcggatagaggagagctcgggggtgcttataaaggggctagcgagcggcgacggaggcccacagcgaccggcggcgagaaggaaagctagggttggagggagaaaagtcgatccgaatcgagctcaaatccgtcgatttccaaacgaaattgaccgaagtttctataagagaaaaggaagaggagatcgaggagattatttcccctcaaacgatttcaccggaaacagaaaggatcgaccggattggaaagcggcggcggctagggtttcggccggcagcggcgcgaggaggaagacgggcccgacaggtggggcccacctgtcagcgggagagagagaggagagcggcggctcggttgcggactgggccgacttgggccggggagagagagagaaagagagaggttttgggccggctttcggcccaaagccaaaaggaggatttaaaaacattttctatttaaattattcatgaaatgatattccattgattaaaaatacttccttggctcaaataaatcccagaaaaatctaggaactatagaatcaagtaaagtatttaataaaattttatctaacccaattttatattgagatttattaattaaaataagatcttctc

SEQ ID NO: 31502 - DNA, 3799 bp, Oryza sativa
aagtcataccggaagaggaggtatgatgcaggatataaccaaaggaagctaggggttcttttgcataaagcagtcatttcaaagcagtagttgaaagcagtaaaacagctgtagtaattaatcaatattaaccaatcactgtccaacgctacaccacgttgcaacaggcccaaccaaccacctgaactacaccagttcattaagctaaactaggggtgagactaatcacagtgaatctggttgatcgcccataaccgcgggcacggctattcgaatagttttactctggccagaggtgtacaactgtacccacaagacacgattccacacatgtcgccatgccccaaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaactgaacacctcggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgctatgggtgcgaccagcaaaaccatgcactcacagcccgccattcagaatattttaattaactgacacccttgcggtggcaccaatctaaagctatgccagtagtcagagtctatgaaataatgtgatcccccatttgtgtactagttgaactaagcagggctaagcatttcctaagccaacatctagtcattttgatacccaagttatcaatggcataaggtaaccagtatgtggctgaggaatgggacccatcccacattacattgtaaaagaatgcaacatttaatagaaatgcgggatattggtaaattgggtacaatatgatcaaacgtattgcatgacttgccttgctctcgaactaatgagaccacagcaacgtctttgagaaaccgcggatcgacgaaacggccgaaatctacgtgacaaacaaagcacacaagcaaaacatgctataagactactgaaacaggaaacaaaaccatttttaatggattctttgcatttttatgaatttactgagacttgaatggacttaaacagagctcggatgaattacttatgaattttagaagataaactgtgtttttactaataaagaaaagtccttaatcaatttattgcgcaataatacccagggctgacgtcatcaaaggagggggcggcgccggcaagcggggcccgcatgtcagcggctcaaggcggccggtccacgggaccaagggtccggatcggcccaagccgatcggacgatgcagggagcagccaccgggctcggcctcggcttcaagtcggccggcaagcatggcgaacggcggcggcatgcggtcgctggcgacggcaaccggcggcgtgggaggcggcggcgggcggcgcgaaaagcggcagcagcggccgaaggcgacggcgcacgcgcgaaggatggcggcgcacacgggagagagggaaaaaggggagcagaggggagcctcaccggcgagcacggcgaccagagcggaggatgaaaggcggcggtgacccggcgacgaggaggggtggacgggcggaggcgacacctataggaaaggaggagagggattaggggtggagaggacgaccgcaacgaccaatgtggccggccggagatggatgaaaaaggagagctcaccggcgagcgagggaaacggggcttcgggggtgattggcggcaaccaagcggcggccgaggagcggacggcacccgcgagcgcgacgacagcggcttcatggcgcggcagcggctctagcggcggtggcgcgcggccggagacggcggtaggcggcggcgcaaggggcgagcggcgcggcgacgataggaagcacgggagggcgcggcgagtgcgaaaaacgagagagggggacgtggggagtgatttataggtgcgggagggggcggacgtggccggggaggtggccgatttggctggcgacgtgggggtggagagagagagaatgggggggattcaaattcgaatcccgccccttgcgagcgcgcgcaagggtcgggagatgcgggggagagggtggcgacgtggggaggacgcgggagcggcgcggcgtgggcgcgggaggagcgaataaggcggcggcgcggacggtttcggcggcggttgccgtcgtggggcgggcggctggaggaaggggacgacctgataggtgggccccacctgtcagcgtcccggagagaggggagggagggaggacttcggggaggggaaaggggaatgggccggcccaaaggaaggaggccgagcgcgggagggagtgggccgatggcccaaaagaggaaaaagaaggaaaagaaaaaagaaaaagaagaaaggatttttcctgggattttaaaaatattgcgcttgctcatttttaattggttaaaattatttccaaggctctgaaaattccactaaaaatcttgttaatgcattgtagcatggggaactcaagaaaaattccaccacgctatttccgattattaattgcatttattaactagggatttagctctaggttaattaagataatttcttcgggcaatttatttaaccaatttttaaagcaagaaaaaggggggaaacttcagggtgtgacacatggattgctgtcattttcaaactaagtttgttatgtattgtaagctattgttttacaaatgcactttacatgtcaagggcgcgtggaactttcatgatatatccagacagatatttgtatgtgtaaagtgagttatgaaaaatatattagttatcaataactgcttacgttcaaatgagatatgtagtaaagtgcccttacgacgacatgtctaatactacaacggtttagacattccgtgttaaaaatcttatcatagcctttaagaacgtcatcgattttatgaccactttggaaaaaaatctgaaagattagcttgcgtttattttgccaaggagttaaaaaacacgttagagagaaaaaatcacgaaaggaaacgaaatcgtgacagaggagacattatttctcataacagctcagctaacacgtattgacaacgatttgcctataaaactagctagatttttctcacggtcctagatggaagaacgaaaggacatttaggaggcagaacataaatgaaaatagccccttgctagcatcaaaccatggatcgattgtatcacggcggtcatcaacgataccagcaaagaacgaaatgcctacctattcactctcaggatagagcagcggctatattttgtgactttaggtgaaaacagatgaaaccgatatgcatgggcattaatgtggactattaagcatatatgaattttatttaggcagcaatgcttaatgtttttaacttataaattgatatttccgcgaccaggccttcaaatatgaaaatttaacttcatgttacgcggagcgtcttgtttcggtgacaaggtaagattgaattaacaatgatatggcaaatggtcccatcgatacttacattttgaatagtggatttataaccgctataggttgggcatgttttatatggtgtaggattacgttatagggtatatactatttgccaaatgcgttttgactctgttctgatcgaaatgaaaagattgacctgcttaacacactccgttcacgt

SEQ ID NO: 31503 - DNA, 6459 bp, Oryza sativa
gcctttacgacgacatgtctaatactacaatagtttagactttctgggacaaaaatcttattatagcctttaagaacgtcatcgattttatgaccactttggagaaaaatctgaaagattagcttgcgtttattttgccgaggagttaaaaaacacgttagaaaataaaatcacaaaagaaaacgaaatcgtgactgagaagacattgtttctcataacagttcagctaacacgtattgacaacaatttgcctatagaactagctagatttttctcactgtcctagatgtaagaacgaaatgtcattaggaggaagaacataaatgaaaatagccccttgctagcatcaaaccatggaccgattgtatcacggcggtcatcaacgataccagtaaaaaacgaaatgcctacctattcactctcaaggcagagcagcagctatattttgtgactttaggtgaaaacaaatgaaatcaatatgtatcgacagtgtgatggccatcaaatgaaactaataagcattgctgaattttattaaggcaataattcttaatattttaaaactataagttgatatttccacgaccatgtgacatcccggcctagagcttaataggattactagaatactcatatcaacaagttgcaacttcttttcctaaagccgatctcaaaagaactccgaggttaagcatgcttggcctggagcaatttcatgcttaacctggagcaatttcgggataggtgacccaccgggaaattctttacgggtgcgtacgagtgaggacaaagtgtgcagaaaagggttgtgttggtctgtgagagcagtctatgacctatgaaagctgtcagatgtaagcggggagaggcgggacgttacaaagtggtaccagagccgactctcgtggtttcacgggcgcgtgtgtcgcagttacgcgggcccagcctgggagaggtgggacgttacaaagtggtatcagagccgactcttgcggtttcacgggcgcgtgtgtcgtagttacgcaggcatggtgcgcatggctggtgtggaccaggatggtcacacagcatggcacatgagctggcactggacacacggacgtggccaaaaggggacgttcctggcccggggtgaccgacgaggtcgtcgatgtcttaagggggtgaggatgtgacttcccggcggtgtcttaagggggtgaggatgtgacttctcggcctagggcttaatagaattactagaatactcatatcaaagccgatctcgaaagaactctgaggttaagcgtgcttagcctgaagcaatttcgggatgggtgaccgaaaggcttgtgttggtttgtgagggcaatctatgacctatgaaagctgccagatgtaaccgggctcagcctgggagaagcgggacgttacagaccatgcctttaaatttgaaaattatcaaacatcacaatggcgtttctctcccttctatatttgggcaccgtccccgagtataggaatcctggaccttctcaatttctattgacgagatgatccaggtcaataaacttttctctatgatggttgatctgaaaagaatggtctaacatgtgttcatatcgcctgcatcatcgtcctccgtgtcacgcctagaaattcactagtaatttacgaacttatttgtgcataaaatcctcgtccaggaatcagccgaggattttatatacaaatccattataataacatcgttacatacttacaaaagaatagaaaaacagcagcggaattaacggtctaacgatggcttaagctccactcccacaggcagctcaactggggtataagccaaacgtcttctccttctggatcattttcttcaactgaggttgattgattatttcaaagtgagcatatgacatactcaacaagccacacagctaatatgtaagtgtacaaggataccaaaggatggaataatataggctcatttgcaaaagtagcatttagcaaacatttaagagtagtaaaacagtagagttattaattatcaattttaatcaacactgcacaggcccaaccatcctgtacaaccatacccggttgtacagatctaactccaaaccaggagctaaacaaattattactagttatagcatcaataattattgtgataggtgtgagactaatcacgaaaaacattgctcaacccgctcatgaccgcgggcacggctattcgaatagttttactctggctagaggtgtaccactgtacccacaagacacagcaccacaacatgttaccatgcacctcaataccaccatgatacctcggaaaggaactgtggcaatacccctcgcacaacacaactcaccacagtgcatcatacctggattataatcaccgaggcatggactccccagcgacccccacggatttctcgccacttctcagtctggcaccccataatgaactatgctatacaaaaggtaaagtcgttgcccacgctggcttgtggttggcacggttaatgtctcataacagtagctcgcgaactggtccttaattgtcatgagcacgaccttcaaaaccatgtgctcacaacccaccattgtcaagttttaattatcaattaattatcataacacgattaaccatcgtgagctaccattaaatataaccataaataataatgtagtatgatccattccattaatgagctaatgtttctaagcatggctaagcaattacatatatatagcttttagctgaaccaaaccaatatataaggttcaagctaatcaatttgttacccaaggaatcaaggaatatggtattcaatgcaaattggccataacaaatgaataggttcacaccacccggtgacattcgaaaataaatgcacagttgaaataaatagagaatttaaatataggatcaacatgctcaaaggattgtgtttgggatctgtgtgacttgccttgcaacaatcggtcttcaaatagtcttctaaaccacttctgacgcactcacggaccttcgcaacgacagaaacgacaagctaacacgcaaaacgaataaaaaggactaataaaaaccaaatgaacaatacataaaaagtaaaaaaaaaacatgtagatcatgattttagatgaatttagagacttgaacggcctcattccgagttcatatgaattagttacgaattttacaagattaaactgattttagccttataaaaaaaggattaatgatttattttagaaaagaaaagggctttatgacatcattgatgacgtcatcgccggaacaaggcacgggaccacactgtcgccggcgctagaggactcggccggaccaaccgagggcatctacgcgaagaggacgacgagacgaactcaccaaggggcggcacgacgacgaaggacgacctacgacgagctccgaacggcggcgaagtcgggacgacgaggacggcggctttccggcgacgagcagcggcaacgaaggggtggacgggcttctcctcggtgctgcgatgccgagggaggtggcggcacaggtcggggacgaccgaggcgacggcacggcgcggatggaggcgaagcagatcggcttgacggcgtcggcagcgctccggcgggcttcggcttcggccaagtggtggacggtgtgcagctccttctcgcgaacccgatggtggcgacggcgaccggagaaggcggctgcaaaggcggcgcggcttgaaactcggcggctacgacggcgctaggacagacgcggctagggcgctacggccgacggcgagctcgggcgagggtggcaaacaaaagaggagagggaggggactctatttatagccacgggagagagatcgggcgtggaacgcagggaatcgcgccgggaaaacctagggtttggtggagagataaactcaaaaacgaatccaaattcgcgccgaattcaaagggataaaataggatttttgggggaagagttagaggaggataagggaaacaaatcccctcaactaattttagaaacagtcgagagaattgagcgaatcgggcggaggaaacggcagcgtcacacacggctcggcggctgcacgggctctgtccaagcttgaagaccacactgtagcaggtaggcgaattagactttgactggggttctttttctccagcccgattgaaggagggacaggaaatggacttcagaggaggaataaagccagctgaaaggaagggagaatgggccgaggactaaaggtgaacttttcgagtttcagcccgaaaaggaaaaggggattttaattacttttccaaataaattaaacactgaaatgatgtttgaattgttaaaaatactttcaatgctcagataatttcaacaaaaatcctgaaaatacttggacaaccaaagtacttaacaagattatagtcagaccatttaatgattaatttaatatgtgaataattactgaaatgttctttgtatgattaaaattaagaattgagcttcaaaaaatcaaagaaaattccacatagtataattaaccatggagaatttaataaaaattaaatccatccatgctttatatttagaaattttgatttcccacatcactagtaaattaatgaacatttaatataaattctaataataatttattatataatttataaatcctgaaacgaaaaccaggatgtgacactccgtcagacccagggtttgaaagatcgtgtccacctagcatgtgaacacaagggagaacctaatcccacttgggagacacccaacaaaaatgagaaaggggctccttatagacggatgaaaaaattattccgccacaaggttatcatcagtgcccaattacatctaattgttgaatagtcccacattggttgtggaagtgcaaatgacctaagatataagtgggggagcccctcacctcaatggctagcttttgaagtgtgaaagcccctttacgatactacaattggtatcagagtctgactaggttaacatctctgacccgatgaacacagtgtgtgaagatctgatggaccgtgggtgcctgcggggctcgtatacttgatggaccgtggacctgttctgtggggtctatacacggtgaaggggcggtgaagggctgagggacaccaatgtgtgaagggggagattgttgaatagtcccacattggttgtggaagggcaaaggacctaagatataagtgtggggtctatacacggtgaaggggcggtgaagggctaagggacaccaatgtgtgaagggggagattgttgaatagtctcacattagttgtggaagggcaaaggacctaagatataagtgggggagagcccctcacctcaatggctagcttttgcggtgcgaaaggccctttacaatctacatgtgatgtgtcatacactccaatgctaagtaatcttacttcaaaccttttatttatttgttaagtcatgatagcttaaatgtcttcttgatgttttctgaaggaattcgcagtcctcatttccaacactcctctaccatcagcatagggaaaagaaatctcacaaatggtcagccatcccctctaccgattaaccaagctcaaagaggccaatggctgagaaagaatctcaaaagtgagcgctaactgccggtggtccaaagatcgataagtggataaacccatcaagccaaagaacgcagtcaagaacaccaccaacaaaactatccgagcagccgctgcccacacagtcaaagccatctatgccaccgtctcccaggcggcgcggcggctgctggcggacgcacggcggcggctccgcgagcgaacgacaacgacgaggtgcgacgccgacgacgaggcgcggcggcgggcgcgacgacgacgacgacgtactacgaggcggcaccgccccggatccaggagcggcgagcctgggcgggcggcggcaggcgcgacaacgaccgtgcggtgccagcgaggatccggccggagcggcgagctcgggcagcggcggcgtggttctcgcggcatcgggcgcgacgacgacgaagaggcggcgccggcccggatccaggagcggcgagcccgggcgggtggcaccggcgcggatccggccggagcggcgagctcgggcggcggcggcgtggttctcggggtgtcgggcgtgacgacgacgacgacgaggcgcggcggcgggcgcaacaacgatgacgaggtggcgccgccctggatccagcagcggtgagcccgggcgggcggcggcggccgtgacgaggaccgggtggtgccggcacggatccggccagagtggcgagctcgggcggcggcagcgtgtttctcgcggcgtcgggcgcgacgacgacgacgacgagcggtgccgacacgggataatccggctagggttaggtttttttttttcaattttttttgttccttttttttcccgtgcggctagta

SEQ ID NO: 31504 - DNA, 22122 bp, Oryza sativa
ggtttgtaacccccctttagtcattgtttcctagccgggagtatcaatccgggactaaagatcgctatctttagtcccgggtgaaataactgggactaaagatagatctgaccttttttttttttttgcatggccctgttgctgcatggtttatatatatatatatatatatatatatatatatatatatatatgtttcaatacatatatatgcatacatatatatatgtatatatatatatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcaccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgttttttgtggatattggtcgagcattgcgatgtttactttccgagggtcgatgaatccagtatcgaaaaccctccgccgtcgggccctttgaatctccattctacaacgataaaagggagtatattattttctatagtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgttcatctccatgtacagctgatggaacttgtacatttgtgtgggtagggactgcagcagctcaggcttgacaagcggtttaccgagttcgtacttgtatttcacttccgccttttcgattggtgcgactcctagcaattgatccgtagttagaccggtgtcagtaataaattgttctatcatcatttctttaccggtcaccaacggctcgatctcctggtttggttgctctccaagctgagggactgatttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcaccttcttcgttgcccttgtgtgggcaggcggtggagctggggggccccttgactttgaaggtgccggaagaggagcttgcgggggagtaggtgtaggagcacgaggaggagtcggtgcaggatcctgaggaggagtcgatgctggagccggaggtggagacggtgctggcggagcatgaggaggagacggtgcaggatcctgaggaggagatggcggagccggaggagatggtgcaaaagacgccgcttgtcgcccagggaggatgatgtaccgcctgcgccatagaataatggcatggcatgtgtctcgtagatgcgtctcaccgtctcctccagggtaatccaactcgaggtcctcgtacgcgccttcgaccaactcaacttctaccttcgagtatcctgctggaatcggcctgcagtggtaagtacctgaagggtccgttgggatggccatgcccgacgccaccttcatgttgtgagagattatttattagtaatcaatatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccatccttgccacctcctcttgcatgttgagttcgtagctcgatacccggaactctaggtctgcaatcttcgcctcggtatttctcttgctcctcatccgactcctgtacgtgtggatgtcctccttgaaaccaatcttccaaggaatcacccctttccctcgtgttcgtcctggatgctctggagtctgcagggcgagtgtcagctcgtccctatctctgtctggttggaacgtgccctgagaggaggcttccactgcatctgttagtcgtcgcgcagcctctcgtatctgatcgccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacatatctcccttgaacctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacctaaccgctgtgacgtacatagttcttggcggcttcggccggggcagtaagacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttcctcgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaactctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagatacaaaaagatgtattaggataaatgcgaagtaacatatatatatatatatatatatatatatatatatatatatatatatatattgcatttcacgttaacgttcgtcctcgttcgttcgctcgttctcattcacgttcgttcgcttgttctcattcacgttcgttccctcgttctcgcttgtcttcgttcgatcgttctcgttctcgctctcgttcgttcgatcgttctcgttctcgttcacgttctcccggcaacgtacgttgacgtgttcgttctcgctctcgttcgttcgatcgttctcgttctcgttcgttaacggcggtaacgtacgttgacgtgttcgttctcgctctcgttcgttcgatcgttctcgttctcgttcattaacggcggtgtggcggcaatcggggcggcggttggcgcggaggcgtggcgttgcggggccgtggcggcggcggcgtggcgtgacggtggcggcattgcgcgcgcggtggcgaaggcggcggcggcgtggcgacggcggcggcggcgtggcgttggcatgcggcagcggcgttgcgcggcgcgaaggcgtcgtcgtggcgcgtcgtcgtcgtggcgcggcgtctcgtggcgggcgccccgacggagagagatcgagatcagagaagatcgagatgcatgaagggagatctggcggcggcggctctcaccccagagatgcggcggcagcggaggaggcggaggcggcggcgaggacgacgagctcgagacgacggcgagatacagcggcgtcggcgcggggatttgccctaggcagtggcggcgaaggagagaggccgagagagatcgatcggccgaaaacgtctaagtgttggtgaagaagacgagggcgcaccgggaatatatatacccccggatctttactcccggttgttgagaacaaccgggactaaagatatctttagtcccggttattgagaacaaccgggactaaagaaaagatctttactcccggttgttgagaacaaccgggagtaaatatcttttcccgctatttcgaaattctttttaaacccggttagggttaagaaccgggactaaagattatagcactgcatatgattttcccttacatatgtgtttataaaatagaagttaatgcattaacattatttaaagtacaaagattaatgacaattacttcgaaaaattatttttgtctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaattatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatgtgaaattgccacctgtgtgatttaaaacttttaaaaattgtaagtatcaaatataactagcatatacatgatttaaacttgttgaaacctctaataatcgtgcgtaattaacatatgccatacatcaattgatttatatggataatcaatacatccaaaatagtttacatcgtgtacacaataattacggcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacggctccaccaatcaacctaacccattggcaccggaacagaggaaccttgagaggaccatagtcaagttcccatatgtccttgatggcaccgtaatacgtggcagttgttccatcgtgtcccatggcatcgacacgaacagcgctgttttggttcgtgctcttcatgtcttgggctctcgtgtagaatgtgtacccattgatctcatatccctagaatgtcgcgatcgacccagacggtcccctcgccaggaaggcaagttgttggttgatcgactcgttacccatgagatgttgtcgtagccacgcggggaaagcatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcgttattgctttccttccgagagttccctttccccgtagtctcccttcatggcgtgattcaggtaccccgattgggcgaaggtcttcgataaattctacgcaaaattcgatgacctcctctgttccaaaacccttggcgatgcttgcctctggacgagcatggttacgaacatacttcttcagaacgcccatgtacctctcgaaaggaaacatgttgtgtaggtacatagtcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttattccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgtgatgtttaggcttcgtacggtggtcggccttatgttcgaagtgcttgcctttcttccgtaccgggtggtttgctgcaaggaatcgatgatgacccatgtatacaaccttcctacagtgcttaagatacgtactttctgtttcatccatacagtgagtgcaagccttgtaccccttgttggactgtccggataggttgctaagtgcaggccaatcgttgatggttatgaacagcagcgctcgtaggttaaactcctcctgtttgtcctcgtcccacacggggacaccttccttcttccacaactgtttaagatcttcgaccagtggtcttaggtacacgttgatgtcgttaccaggttgcttggggccttgaataataatctgcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcgaaagggtgtctcagcatcccgtcctgttgacgctcttcagcgtgccatcgcaacattctagcattccccttgttcctgaacaaacgccttagtcgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcctccctggcgtcctgcaatatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatctttagtcccggttggtagcaccaaccggggctaaagatcaccgggataccaaccgggactaaagttggtaataccaaccgggactaaagttacgatctttagtcccggttggtgttaccaaccgggactaaagatcccgggggggcctgacaggccctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagattgtttctccaccagtgcacataaaaatttttatttttccagacgactgcctccagacaggcaaaatccccacacgggaaaatgaatttgaccgtccgaaaaaatagttcatgtagaagtgcgtgttcgaggccgacaaccaggtcaggaactggaataatgatcaggagctcaatcaagtcctagtatgtatatgtataagtgaaacactgaggttgttaaagtgccccagaatatctactgtaactatcacatattagagactagcatattgggcatgcgttgcatcgggattttaattaaagaaaactattattacctcattattactattattttatgcatacattatcttaaatcctttggcccgttctacaatcattttcttttttataaaatgtagagagtttgtgatggggtgtctgttggcccacacgtccttcttctttttcaagatgtggagattatggataccccatatctacatggcatgtatagtccgactgggtacagggtactatgtatagatagaatatcttcaagaggactcgggtgggttaagttttttgtatgtgaaggaaatatccgagattctaatcggttacgattgtattttatctgtaattacatatttcgttagggatatggactgtattttataatacggaccccttcccctatataaggaggggtccgggtccctctagggacacgttttttctcccagatcatacgatcaataatacactcggcggatcaatccccggacaggagtcgggtattacttcttgattaagaaggcctgaacctgtataaaatttcttatctctaaacccatccacttttccagcttggtagccacccccttttagtattgccgaaatcttgtttcgacagttggcgcgccaggtaggggtagcatcaagttcttcgccgattaagtgcgatgggttccgtctccggcatcgacgacttcgtctttctcccgggcaggcgttccggttcggcagtctagacttcatcaccaacgacttcggcaagatttctctcctcgactcggattcgaaccagtcgggaagaggccggatctccgctctgttcggtatcccgaactcggccgagatctaccccaaggtcatctccgacgagtcggtttcaaaccactcggacgagatccaatctacttcaacgccaccagatcaagacgataggtcctacccgccaatcctgatgaaactccccgatgatctggctgccgtctttattacaaggatgtcttctccccgtaggcctaggcaggatccggcttcagcaccgatccggcctagctctagggaagtcggcatcatactccagccactcggcacggtttcgacggatcaattggaaggctacttcagctcccccggtgtcgactcacaaccaacagagatcgtagagtatgatgaattcggctattgttacgacgaccacaacctcgacgacttcgccgaaagctttgaagataactacacccctctctacttcggcgtcttcatggccgacaacgagacggaagaacagcgccaagcccgagaagcagaaggacgacgcgtacaacaggaggccgagcaatgccgactggaagaggagcgccaagcacaagagcaagaatggctgcagcgtgagcaacaggaacgtgaacgggctgcaaaggaggctaaggaccgatgacaaagagccttagacgcagggcgacgagcgcgagaacttatcgggcagcaagacgttgaggggacagcggtcttccgcaccccccaacagaacgcggttgcggcgatcactctcctcgacaccctcctcaaggaagacacactcaaccaagccgatcacgtcgtcaacttcttgaaccagaccaagaccatgattgccgcctcggtcccggttaactccgcaagcgtccgcacaccgactggcagccgagtcccccatcttcgatctcaagattatcaccagccaagccttagcatcgccggcgcgggatccaaccgcaggagcaggggtcacgacgagcgatcggtccactcgcctcccgaacgacacagggagcgccgagttgaacggcctcgctccccacctcgtaggcgccccgtcgatcttcgtgatacaatcaaccagcgccgcgcagcacgaggctacgcccaccgccactcaccggatggctatgacgacgacgtggatggagttgctgcctttactaatgacctgcgtcgagtggattggccagccggcttcaagccaactggaatcgagaagtatgacggcaccactaatccggagtcttggctcaccgtctacggtctcgcaattcgcgcagcaggaggagacagcaaagccatggcaaactacttgcctgtggctctagcggattctgcccgatcctggcttcatgggttaccccgtggcatgatcggatcatgggcggaacttcgcgaccacttcatcgccaacttccagggcacctttgaacgccctggcacacagtttgatctctacaacgtcattcagaagtctggagaatcccttcgagattatatccggcgcttttctgaacaacgcaacaagatctctgacattaccgatgacgtcatcattgccgctttcaccaaggggattcgtcacgaggatctagtcggcaacttcgggcgcaagcctcccaggacggtcaagcagatgttcgagaaagccaacgagtatgccaaagccgaagatgccatcatcgcgtccaagcagtcgggtaccacttggaagccaaagaaagatgcgctgattacgggagggggtggaagtaccaatcacaaggaccgtaagcgtaagcccgaggaacttgttgcgactactacaccctcctcccgacaatgttcacgcgtcaatacttttgacaagatcatgaagtcccaatgtccgcatcatcccaactccaatcattcagccaaagattgcttcgtatacaaacagtttgcagaacaatacgccaaaaatgcacggaaggcctccgacagagatcaaagcacgtcaaaaaagaaggatgacgacgatgatgccccgacaggttttcaagaccattgcaaggagctcaaccacatctttggcggacctctggcttatgagtctagaagaaaacaaaagctgaccgaacgggagattaacgctgttcagcccgatacgccccaatatcttcggtggtcggagacagcaatcaagtttgaccgctcggatcatccagaccgagtggtccacccggggcggtaccccctggtactagacccagtggttcgcaacgtcaagcttcgcagatccctcattgatggcggcagtgcactcaacatcctcttcgccaagaccctggacgacatgcagatacctcgcacggaattgaaactgagtaatgcaccctttcacggagtcatcccagggctgtctgctacgccactcggccagatcactcttccggtcacctttggtactcgggaaaacttccgcacagaaaacgtctgctttgaagttgctgatttcgagacagcgtatcatggcatactcgggcgcccggcgttagccaaatttatggctgtcccgcactatacctacatgatgatgaagatgcctggtcctcgaggagtcatatccctgcggagcgacatcaaacaagccatcacatgcgacaaggaaagctgcgagatggcccaaacccgagagatcgcgatcgcccgagaagacatccgactggctgcaaccacggcaagcgaaggagaagtgcctgcaaccaaggtctcaaagagtggagaaagcgaagccaagaccaagaaaattcctttagatccttctgatcctactaagactgctgtaataggcgctgagttagattgtaaataggaaagcgcgcttatcacctttcttcaaaataataaagatatctttgcgtgtaaaccatccgatatgcctggtattcctagagaggtgattgagcactctttacacgttaaggaagacgctaaacccatcaaacaacgactccgccgctttgcacaagacaggaaggacgcgatcaaggaggaattgaccaagctgttagcagcaggcttcatcaaagaagtccttcatcccgactggctggctaacctagtcctagttcggaagaagaccgggcaatggcgcatgtgtgtcgattatatcgacctcaacaagtcttgccccaaagatccttttgtgttgcctcgcattgaccaggtagttgactcaacggccggctacgagctactcagctttttggattgctactcaggttatcaccagatccgactaaaagaatacgactgcttaaagacttcattcatcacgcccttcggggcatactgctacatcaccatgcctttcggattaaagaacgcaggagcaacttatcaacgcatgatccagagatgtttttcaactcagatcggtcgcaacgttgaagcttatgtggatgatgtagttgtcaagaccaagcagaaagatgatttgatcacggacctagaagaaacctttgcgagcatccgcgctttcaggatgaaattaaaccctgaaaagtgcaccttcggagtaccgtcagggaagctacttggatttatggtgtctcatagaggcatacaagccaacccagagaaaatcaatgccatcctcaacatgaaaccgccgagctcccagaaagatgtccaaaagctgactggttgtatggcggcgctcagtcggttcgtttcacgactcggcgagcgggggatgcccttcttcaagctattaaagaaaacagacaatttccagtggggacccgaagcgcagaaagcctttgaagacttcaagaaactactcaccactccaccagttttggcctcaccacatccgcaagagccgctattgttgtacgtatcggcaacttctcaggttgtgagcacggtcctggttgttgagagtgaagaagaagaccatgttcagaaagtccaacgaccaatctacttcgttagcgaggttttggccgactctaagacgagatatcctcaggtccagaagctattatatggtgttttaattaccgtcaggaaattatctcactacttccaaggtcactcggtcacggtggttacatcgttcccactcggagatatacttcataatcgtgaagcaaatggacgaatcacaaagtgggccttagaactgatgtccttggacatatcgttcaagccatgaacttcgatcaagtcccaagccttagctgactttgtcgccgagtggaccgagtgtcaagaagatatgcccgaggagaagatggagtattggaccatgcactttgatgagtcgaagagactttcgggcactggagctggggttgttttaatttccccgactggagaaagactgagctacgtgctctggatacatttttctgcatctcacaacgtggcggaatacgaggcgctccttcacggactacggattgcaatctctttgggaattaggcgtttgacagttcgtggagattcacagttggttgttaatcaagttatgaaagagtggtcttgccttcatgacaacatgaccgcttatcgacaagaggtaggcaagttggaggataagttcgatggacttgaactcacccatgttcttcggcacaataatgaagcagctgacagactagctaattttggatcaaaacgcgaagcaactccttccgacgtgtttgtcgaacatctttacgaaccaaccgtaccaagaaaagaaacagctgaggccatgtgtcgtgaccgagaaaaatacattttcccgaacgctagtgtattaatccctatcccaggaaaagccggggtacaccacacaaacatgatataaaagacacatctttattatatcgataatatttacattattacaaaggcacttaaggcctgacaataaaaaaataaccagcagcggactagcgggcctacggctccatcttcacagacgctcaactggggtataagccaggactccacctaagacttcttctccaaagcttctcttactgaagggtggggggaaatgattgagcaagaatgagtacaaccacagtactcagcaagccacaccggcagatgcatgattaatgcaagagggtacaaggggtaataatataggggttaagtttgtagaaaacagcatttaaaagtcacttagttgcccaaagccattttataaagacgatcctagagttacacagtgttattaatcaaggccgtgaaccctcacgaacctgccttaacccaaggcctacgatgattcagaccgaactggcaacccgaccctaggtcccagctcgtcccaagccaacccaggccaaccattccacattttagttgttaagcaaattttaagaattaaaacactaacttgggtacattgctaggcttgcccataaccgagggcacggctattcgaataggttatactctgatcagaggtgtacatctttacccacaagacacatcttcctcacgtgtaaccacgtgccacataccaccacggtatacggatggaagacgtgacatagttcccaacccatcctagccataaacaagagtaccgacccaaccccacctacggccggaacctccgggacaggcaggcaggattgagcccctagcagcaggacaccagccctgtgcaatgacatctcgactaccgggccgcagctcgagtagccttcatttgtcctagagatgtccatcgacccccgacttcgtccatctccatccgtgtacttttgtttataaccagactgagccacaaactaagccttacccactagacatgtggaagtatggtagtgctttgcaacagtggcccgagcttaatccttatagtacccgaggtacgactaacaaaaccgaaccacgcacctcgagcccagctgtcacgcccggaaattcactaataatttccgaactaatttgtgcataaaatcctcgtccaggaatcagccgaggtacacaaactgacaatttaatatacaaatccatcataataataacgttacatacttaaaaaaaaaagaaaaacaacagcggaattaacggtctagcgatggcttcagctccactcccacaggcagctcaactggggtataagccaaacgtcttctccttctggatcctttttcttcaactgaggttgattgattattgcaagaatgagcatatgacatactcaacaagccacacaacaaatatgcaagtgcacaaggataccaaaggatggcataatataggctcatttgcaaaagcagcatttagcaaaacatttaagagaagtaaaacagtggagtaattaatcagaaattttaatcaacactgaatagcacacccatgctgcacaggcccaaccatcctgaacaaccatacccggctgtacagatctaactccaaaccaggagctaagcaaattattaccaggtataacatccataattattgtgagaggtgagactaatcacgaaaaacattgctcaacccgcccataaccgcgggcacggctatttgaatagttttactctggccagaggtgtaccactgtacccacaagacacagcctcaacatcatgtctaccatgcgtcacgatactggaaagtacccaaatagaggctgtgacaataccctctgcacaacacaactcaccacagtgcaccattcctggatcataattacccccttataaaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaacagtagctcgtgaaccggtccttaattgccatgagcacgaccttcaaaaccatgtgctcacaacccaccattaatcatattttaattaccaattaattatcataacacgattaaccatcgtgagctaccattaaatataaccataaataataatgtagtatatatgattcatcccattagtgagctaatgtttctaagcatggctaagcaattatatgtaatatctagctgaaccaatatataaagctcaactagtcaagttataataacccaaggtatcaaagaataaagtaatcaatgcaaacaggccataacaaaggaatagattcacaccacccagtgacattcgaaaataaatgcacagttgaaataaatagagaatttaaatataggatcaacatgctcaaaggattgggtttaggatctgtgtgacttgccttgcaataatcggttttcaattaatcttctaaacactcccgacgcactcacgaaccttcacaacgacggaaacgacaagctaacacgcaaaacgaagaaaaagactaataaaaaccaaataaacagtaaaaaacaagcataaacagtacatgtggatatttttaacatgtagatcatgattttagatgaatttagcaacttgaaccactcaaaaccgagttacgatgatttagttatgaatttccgaagatttaatctatttgaaaaacaggaaaaagaaaaacgatgatgacgtcatgatgacctcatcaatggccggaccaagatggcgacctcgccggagatgggatggtcggctgcgactttggaggacatgaacacgtagaggatgacgagacgaacccaacggtactcaccctcgaaccaaacgacgaacgacgacggccggcgacgaggtctagcggcggcgcggcttcggtcgacggcggcgacggggctccggtgactggcgacagcggggagggagcggccgagcttctccactctcccgcgcacctaacggtggtgacggcgaccggcggcgacgacggaggcggcggcgcgacgcggatggagctcggccggcgatgacggcggggtggagcacgtggcggcggcgctacgaggcacgggagatcacaggagagggggcaaacgaaagaggaggactagggcgtcctatatatagccatgggaggccgggatcgagcccacaacgacgggaaaaactcaggaaaatttagatcttcgccggaaaaaggaaaggttgaaccgcgaaattggaaaggatttccatataaacttttggggatttcttggggacaaggaagaggagattgagaggattccattcccgcaaccaattcggaaataagagcaacggagaggttggattttggaaggggatcggcggcaacaggcacggcacggctctggctctggctctgtccagagctggaagatgaacagtagctcagggagggaatgtagacttcttgccgggcttgtcttttctcagcctgattagaagagggagcaaaaccagactttggctgagagaaaaagagaggatgcaggctcgggttgggccggcggaagagagaggaaggaaaggaatgggccgattcagcctaagacaagggaggagaattttatttcttttccaattaaaataatcacttaaatgatctttgaattgttaaaaatacttccaatgctcaaataatttcaagaaaaatcttgaaaatacttggacactcaaagtacttaaaaaatttataattagaccatttaattattaatttaatatgtgggtaattactgaaatgctctttgtatgattaaaattaggaattgagctccgaaaaatccgagaatattccagagagtataattaatcatggagaatttaatacaaattaaatccatccatgctttaaattaaggaaattttatttcccacatttaacttcacttgtaaattaatgaacagttaatataaattcgattaataatttattaaataatttataaatcctgaaacggaaattcaggctgtgacaccagcctaaaaccattttgggggttttgaatagagggggaggtgtgtgtccaattccaacataagccaaccattctatagtgtccaaatgatatgagaattcccaaagtctaaagttataaaaccacctaatgttgcctaattaatcagcgaagcatctacctaaattcatactagtggaaccatgaatagagtacccactagttagggttttgtttatcctagggtgaacaaggtaataataacaatagcaataataataaggtcataacaaaggtaaataggcatggctaaataaaacagtgataacgcgggaatttaaataaagcgataatgcaataatttaaatcaaaataattttataaactgggattcaatatgttcaaggatgatgtgacttgccttgctcagagataacggccttccgaaccttcggcgacgaccacaaaccacgcttcgggaacctccagaacgacgaagactacgcgaagcacacaagcaaagctacaagcctataaagaagcaataacaatacataaaaagaaagcacagggttctttaggttataacaaacattaggagacttgaacggatcgattcggagctcgtatgaccaagatatgatcatccgaagtttaatgctgttacatggagatttgcggattattataattaggttttgcagctataaaacatgtgtaagcgctagcctggaaaagacaggaaggctgcgccgttgacatgcggaccccacatgtcaacctaaaggaccgcggtagaccgagtacacagagacggtccacgggtcgacagaagcagatcccgtgtgtcaaccgaggcgagtggccgataaacggactccactagacactacacgggctgcacacgtggaaaccacgcggctaccgagcgggcacactaacacggtcaccacacgcacaagcgaatgactaccgacaccggtacacgggtaccggggtcgacaaccgcacaacgggcacgggtgacaccgaaaggacaaggacggggcagcgaaggagagatccttaccaccatgcgacgaggcgagggaacgacaacgacgaacgggcgcgcc

SEQ ID NO: 31505 - DNA, 9366 bp, Oryza sativa
acgatggaccgcgaaggggttcggtcgaaggggaggcgaggccgagggcgaccttgccgctgcgatgccggaggtggagacggcgacgtcggccggtgcactggcacggcgaaaggggctgccggagtgggtgccgacgagaccgagggagaggcggcgcgcgcgacggcgttccgacgaaatacgggcgacgccgtggcttggccggggaagaggatggcgttccgatgccgggagaggtggtggcaacgtcggccggcgcacaggggacgcggcagaggcggccggaggcggaacagtggcggcaacgccactgttgccggcggggatgcacgtccggaggtcttcgcgggaaacagagggcatgccggcgaagaggaggtggctgcgacgctggaggaggcgacggcacggccggccggcgtgctaatacggcggcaggggcggctgaagacggccggcggcacgggagagaggggacgacggcggggaggtggctagggaccacgggagatcgcgggagggggctaaaacgatagaacggagcgagaggattccgttttatagcggagggaagcgagccgagcatgggaggagcggggaacggcggcggaaatggcggccggcggccatggaaagcggccggagttggcgcgtccgttcccggcgattggaggcgccattcaagggggaattaagggggaaatagagaggagggaaaggggattaattccccctaatcaattttggaattcccggtttgaatcgtgcggatttgagggaggaaatggctagggttcacggagtaggaggaggctgggcgggaggaggacgacgacctggcgcgtgggccccacgcgggcgcgcggtcagcgcgtgcacgtgcgcggcacggtcgggagggcgcccctcggcttgggcccggaggcggcccaggaggagaggagggagaggcagcccgggagggagagggaggaggagggagtgggccgggagggggagggaaaaagaaagggaggagggaatgacttcggccgcgggcctggggagagagagggaggctttgggctagacttggcccaaaggaaaaggaggattatttttaggttttctttttattaagctttgataattgtttttgttgcttaataaatatttccggtgctctgaaaattcaagtaaaatttgagggctcattttagaccaaggagaatttaacaaaaattctccgggccacattcgaatttttcttatacgtattttagtgtttgccaatttctttttgaattttaatttattctattattccttttagggaatgatttttatttcgggatgaatttatcaggacgtgacaccatggacactcaagatgtagcaatgattgaagccgactggagagagccccttatacgatttctgaccaaacaagaactccctcaagataaagatgaagccgagcgaatctctaggcgcagtaggctctatattattcatgagaccgagctgtacaagaaaagcccatcaggaatcttgcaatgctgcgtgtccttagaggaggggagacaattgttaaacgatatacattccggcatctgtggcaatcatgctgccgcacggaccattgttggcaaggcttaccggcaaggttttttctggcccacagctgtgtccgatgccgacaaaattgtgcggacatgtgagggttgccaattttttgccagacaaactcatcttccagcttaagagttatagactatcccgttgtcttggccgtttgcggtttgggcccttgacatggtcggcccgtttaaaaaggcaatcggcagttatactcatctctttgtagctgttgacaaattctccaagtggattgaagctaaaccggtcatcacaatcacggcagacaaggctagagatttcttcataaatattgtgcaccggtttggggtacctaatcggatcatcactgataatggcactcaattcactagcggagtatttaaatacttttgtgaagacttcggcattaaaatctgttatgcctacgtagcacaccccatgagcaatggacaggtagaacgagccaatggaatggtactccaaggaataaaggcacgagttttcgaccgactgaatccttatgccggcaagtgggtggaacagctgccgcctgtactttggtccttgcgcactactcccagtcgggccacgggccagtcgccattcttcctagtttacggggcagaagcaatgttgtctagtgaggtggaattcaaatctttacgttttcgcaacttttgcgaggagcactacggagcagaccgagtagatgatctgaaacgactggaagaggcccgcgaagcagccttaattcagttgactcgatatttgcaaggattgcgccgttatcataatcgcaacgttcgatcacgagcattcttagtcggcgacctggttctgagaaaaattcaaactacacgagatcggcacaagttatcccccttatgggaaggtccatttataatctccgaagtcactcggccaggttcctatcgactcaagcgtgaagacggtacttctatcgacaactcctggaatatcgaacatcttcatcgtttttatgcttaagcattacttttgtatttccctattttgactgctaacatcaagctttcccttgaagttatcagtcgggggctactataataataatggagtatgatttttatcaattcaatttgcttacttgatttatcattgccttgattaattttttggcttagtcagtgaggactgaaagttttttaatagcttttgctggttttaggctcaataaggtttgacaaaagcttttaagaaatcagaagctaagttcaaaatattgagcacagcataaattcatcagtattgtacaaattgttcctccatcatcatcatcatcagaatcattgttatgacataacatcaatcggtatcagttttttcatcatcagagttatcagatccagtcggccgaaggtcgttgtcctggaatctttcaactacatcaaatgctatcttatcagcggctttctgcgcatcattgatgaggtcaagagcagcttcttcgctcgtcccatctacaaagccatcaatggcgtcaatgtcgatcttcgggtacaaggacttggtcattgccaacgccaggcttgcccccatacttccagcctctttgatattcttaaaatatgtatccagagtaactctcagcttgtcgaagatttcggaagcatcaaatgtactcggaccattgttattgaagaacatggcttggacgagtggggtagcagcgttggcgacttcatccctggctccttcaagcctcttgattttgttgactaagacatcgaattgggcctgcgacttgattttgcggtctgcataaacagatccatatcaatgagcaagcataaagaggataatggcttttggagtattgattgctggtaccttcaacgtctttcaaagccgagtccctctgccttgccaattcagccttgtcattttccagagtttggatctgcttttccagttgagatatcttggcagcttgcactatattgcctctggttaattgatattacaaagatggcagcataaataagttggacagagattgtgtgtaccttttgaggagccactcagttcgaagttggagtcttgcagctcggcgatccgatctctcagaacatgttcagttttcctagcgagctccctagcttcgtgtagctggtttctggtagcctcaagggttccaaggtggggaactaacctctcaagagttgcagttttcgcttcgttcctgagatggattctctgcaatacaattttatcggcatttgagctgagtggcaaacaggattgttgaggccgtgcatgagggaacttacgtttacaatgcgagtagcctggctgagtgcctttttcagtaggcatacttcctcatcttctttttgcttgtttatcacgattctctaaggttgcatatcgtcatcccaccacttgactagaatgggaaggcgagaatcttcagctgctcgtatccggaggactttttcttcatcaccaatcattggcccttgtatattcatgaataaaggtgagacaatcgaatgaagtctgttagatcaaaatgatttcaaagaatatgtttacctgtgatgatttccggtcggggacgagtagtcttttgtactttaacaggagaactggaccctgggtcattactggtatcatttctcggagggctgtccgtttgagttccaacttcagggatctctcagtttggttctgcgcccgactggtttccagtcgggggcacctgattaaccccgattctagcttcggccgactggtttccagtcaggggctcgtcgctgggttttacattgtcgggatccggctgattattacttgggtgatcttctgcggtcggctcggtctcttttgaaggacccgtctccatgtcagttggttcagaatcttttccagaaggatctatgtcagatggcttcctacaagtttgagttacgccattattattgcttcaatagtgggtgagcagcgctacgagggaggtagtcaaacaatttgtacctagaagatttcctgatctttggtattggacgactagatgttttcttcttagggttggtttgccttggcagttttctggttgcccctttattgctggattttccagcatcatcgccttcatcatcactcaggaccaatttcctcttgcgcgagtccgataggatggttgattttgagatgtttgattgggtttcagaccggatttttggtcctccgcttgcctgaccagtctgctggcgaggtgatcggcgttgggtaatcggagggtttgatttcatcaaggcgaattcctgggtatgatgattcaagctttttatcaaccttgcagataatgaaagaatgcttagaaacgagctgggattttaaatacataccggtggagggggattgaaggcattgtatggcaccacaggcagcaagtgcgaatagctgactacaattgcattggagaagattttatacatcctctccttcatgaccttgaattcaagagattcgggatcttcatggttagggtcatgtttgccgtcgaattcaaaggctgtgcgagatctttctttgataggagctagccggctcttgatgaagtgccgggtgatttgttctccttgcagaccttgctcctttagctttagcatgtgatccatcagggcgagcgcttgggtggcttcttctcccatttgaagtgaattccaggtgtcctgataaactggagggagacaggagtactcggggagtgcaggctcggggttttgtacataaaaccaattcgcatgccagcctttgtttgaagttttaaacggcatggagaaatacttttggctcagagttccccttagttggaatccagctcccccaactacgcatggcttacttttgtttggttggggcttgaggaagaagatgcgacggaatagggcaaagtgtggcctaatgcccaaaaaaccttcgcagacgtgaataaagttggcaatgtgaactatggagttcaggtttaagtgatgcgggctaatcccatagaaattcagaattccccggaagaatcttgaggttggaagagaaaatccgccatagaagaaatgagaaaatatcacaacttcatgtgtgtcgggggtcgggaacgcttcgtcgaatgctggacgccacccaatgatttccttcgccggaagaacgccgtgcgccaccatttccttcaggttttcctctattacatcggagggcgcccattggctctcgaagctttctctctcctccgccatggatgcgaattgggtgatgcgatttgctttggaaatggcagagagtggatgagggatcagtgcggtggttgcgcggaaggttttttgtggagttttggaggatggattggagcagatcgatgaaccctagctttgccggcgcaattttgcactgtagcaggaaatggggaaagtggcgagagtctcggcgaggaagacgaagagacgttttatttctctttggcgttattagggtatcaggagtactaatgggcttgggcctaaaaacagtacttcagcccaattctattttcagcgtggcttgttgtgatccctggggaattaggcattttttgctttggcaatttgtgctcacaatggtgtggcccgatgctgttaaaatcctttttaatgcagttagatgatcctttggaatcactacgatgcgaacaaaaaggtacccaacagaaaagtgttatactatttttgtaagcttttttaggctgcaaaagctgtttgggttgattcgagatgattagttttctcatggtcattctcttagcatgttatatgcttattttgattatggtgagagtcatagcctaagctgtttagactcgttaattgccatgattcttatcatatttggtggatcatcttaagagttttttactcggattcttgtcaaatatgtttatttatggaccttaggagtgtctatcactcgggctttctcatatttccgttcttggtatgttaaagctaaaagcagtcggctggatgttttattgaatgccgcatatgctttgttatatgatgtttggttgtaaaaccacttggttcttgactatatgtttagttttctaactaaccacatagtctggggctacacctaattaggtgcatctagtcgatgcacccggttttttctattttaaaccttcacagtctttggttttggtattcggagatctatacagaagaaattgaagcactgggattattactttatgttccaagagaaggctatttcgtcgactgcaaagatctcgggggctactgtggagattatggataccccatatctacacggcatgtatagtccgactgggtacaaggtaccatgtatagatagaatatcttcaagaggactcgggttaagtttaaacttgtatgtcaaggaaatatccgagattctagttggttacgattgtattttatctgtaattacatattccgttagggatatgggctgtattttgtaatacggaccccttccgctatataaggaggggtccgaatccctctagggacacgttttttctcccagatcatatgatcaataatacactcggcggatcaatccccggacagaagtagggtattacttcttgattaagaaggcctgaacctgtataaaattccttgtctctaaacccatccacttttccagcttaatagccaccccttttagtattgccgaaatcttgtttcgacacaagagtaggtaattggtggccaacacgtcctttttctttttcaaagagtaggtaattcgtgatgagagtggtggtagattcaccttttttttacgtggaaagagtaggggaagccccagggtgattttcatttaataaaaacaaaaattgtacaagagagattatagattgtcaatccatgtttgaagataaggtctggaaactaatctaagcttaggtaaatgtagacttagttcctccttgagagtggtagattcaccattcattcctaaaagagacgtatatttttctcgactataaacttcttatctattgtctatttgtgtcaatattagatatgtgtgcacgtacgtgtgcatatatctgtccgctcagaaaatttatacggaagcgtctaaattttgacggcatgaaattttcattaattccagtccctttgatgataatccaatttttctgatctaacttgctacttattagctatcactcactccagtgattgaacaataaactattatacgtgaactattatgacgtaaacaatttacaaaattacaaggaacaaacttataactcaaaaaaattacaaaattacatgaaaaaagttaaatagataaaaataaaataaagttacaattaaaagaaactaaaaattgtacatttatagcaccataattttaagtgttgtactttttgagtggaagctggtagcaaaatttatccaactacgaaagtagctcgcgcacatgtatggacatcttatttaatattgcttatatttttattacaatggtttatatccgggtgatattttttactaaatattatttgactccttttgaaatatgtatttcttagttatttgtttgggcattgactatgattttctactaattacccttacaacatataaattttaaactataaaattatttagaaccgtctagtattgaatttattaaaaaaaatattatgttacaataaagaagttgattcctatctattttcaaccatgtgtttcttttttaaaaaatatttagtgatgtggactagggttcccaaccttccgaaggttgtgataaacatttgatttggtagagtcacgacacaaatcaatccggcttctgaacgaacacgctcttgagccccgcaatcgcaacaccacgtctcctctaattatcaaccgtgtcgaaacccagttgacctcgccgagaaggctaatccctgcttgcgaatcgaagaacacaaacaagaacaagaaaaaatacaaccaaattgcagaggaatgattaagctcacacgttggagtcttataaaccgaaggatcggcgaaactgttcttgacagattaatctaagcaaaacccaaaacctaaaggtggtggtggctactaatatatagagtttagggtcatgcaaacaacccttgagcaactctaatgagctccaacacgatacacggctcaaaggccataatacggaacaaattctatacgtcaactttttcggttgattcccgattacttggaaagaatttggatatgggacaagaaccattggaaaggctatcttcttagctttccatccatataaagaacgccccaatccgagtacgtatgcgacctagaagcccgttttactgcagactagtcctagactccgagacgtactcgaagtcgatttggcttgggcctccatcttgacttggacgcctttgctgatcctccatgcctctaagtccctctctaagtgtctccttgtcctctccattgttcctaattttaatataataattaggtagcaatctattctcaaaatcatataagaaagaaaataggaatgagctcacctctaaatttaattgtcgcacgcaagctcttgtgattggtccttgaatgaacggtggagaattgttgtgtatatctgaaggagagatatccttatcatttagcatatttttttgagttttcaaacatcaagtaatactttttt

SEQ ID NO: 31506 - DNA, 8870 bp, Oryza sativa
agtaccaaaatgtaccaggatctcaaggaaagattttggtgggcaagtatgaagcgtgaaatcgcagaatacgtagcagtatgtgatgtttgtcagcgagtcaaggcagaacatcagaaacccgccggtttgttgcagcctttgaagattcctgaatggaaatgggaggaaatcggtatggatttcatcactggtttacccagaaagtcatcaggccatgactctatttgggtgatagtcgacagacttaccaaagtggctcatttcatcccagtaaagacaacctattccggaagtcggttggcggaattgtatatggcaaggattgtgtgtttgcatggcgtccctaagaaaatagtgtctgatcgaggcagtcggtttacttcaaatttttggaagaagcttcaggaagagatgggttctaagctgaactttagtactgcttatcatccgcagacagacggacaaaccgaaagggtgaatcagattttggaagacatgttgagagcttgtgctttagacttcggtggaagttgggataagaatctaccttatgcagaattttcgtacaacaatagttatcaagctagtcttcagatggctccttacgaagcactgtatggtcggaagtgtcgcactctgcttttgtgggatcaaacgggagaacgtcaggttttcgggacggatatcctaagggaagcagaagaaaaggtaaagatcattcaagaaagattgcgtgtggctcagtctcgtcataagagttatgccgacaatcaccgcagagatttgagttttgacgaaggagattatgtgtatcttcgtgtcacgccttttcgaggagttcatcgtttccacaccaaaggaaaattggcaccgcgttttgtgggaccttataagattgtcagtagaagaggagaggttgcttatcagttggagttacctcaatttttggcaggagtccataatgtgttccatgtgtcgcaattgaaaaagtgtttaagggtacctaccgaagaagctaatcttgaacagatagaagtccaagaggatctgacctatgttgagaaaccaatccgtatcttggaaatagatgagagaagaaccagaaatcgagttatccgtttttgcaaggtccaatggagtaatcactcggaagaagaattaacttgggaacgagaagatgaattgaagtcagctcatccgcatttgttcgccagttcttccgaatctcgaggacgagattctgtttaaggggggtaggtttgtcacaccctaaaaattcaaaatatataaattgttgtttaattggaatttttagaaatgattttaaaaagcctagaagagaagatctaattttaattaataaattccaatataaaatggggccagataaaatttcattaaatactttataatttctagatttttctgggatttatttgagttaaggaagtatttttaataaatggaattgcatttcatgaataatttaaattgaaaaaggtttttaaaagtctcttttggctttgggccgaaagtcggcccaaaaccttctctctctccccggcccaagtcggcccagtccgcagccgcccgcgcgcgcgctcgctgtcgctgacaggtgggtcccgcctgtcggagtcgtcgtcttcgtcgcgccgccgccgcccgaaaccctagccgagccgcgccgccgtctgtttccaaattcggccgcgtctttccttctccggtgaaatcaatagaggggaaatgatcttcgggatctcctctaccttttctcttttggaatcaccggctaaaatcgtttggaaattcgtggattcgagttcgattcggatcggcctctttcctccgaaccccgacctttccttctcgtcaccggcagccgtgggcctttgccgccgctctccaacccctttaaaaggatccccggtgtcgccgctacccgtcgccaccctcgcctttgcctctcgtcgtccgtagcgccctagcgccgtgtaacctcgagccgccgtcgtcgccgccgctccagccgtgcgccgccgccgttccagtcgtcgccgtcgctcggggagatcgccatcgttgtcgccatcgcgtcgccgttcttgtccgccccttcgccgtcgctattgaccgccggagcatcgtcgtcgtcgtcaagccgaagatctgcgccgcctttcctcgtcgccgtcgacgtccgttgatcttccgccgcttctttggtcaccggtgagttcgccgcgtcgcgctctacgtcctggtgccctccgttctcgtcgtcgcgccgttgttcgccggcgagcgtgcgccgtccgagccgccgccggtggtgacgtcaccgctgacgtcatcgttgccgtccgtcgtggtccggtcgtggaccgatggatctcggtcgtccgatttggatggatcgatctcggccgttcgttcccgtgaaccgccgccgtgcgctcggtccaccgcaaaccctagccgctgacgcaataaatcctttttccttttcaaaaataattcattattgcgtcataattcaattaaaatctatataagtgttttaatccgattaaatcttcaaaaattcataactaattcatcttagctcggatttagttggttcaagtctctaaatttttctaaaattgagatctacatgttaaaaatatccacatgtactgttcatgcttgtttatgtgctgttttggtgattttgctcttttctgtttagattccgtcgtttccggagagtccgttttcgcaggagaagaatttgaagagttccaaggccagcaaggcaactcacacagatcccaaacaaccctttgagcatattgatcccgtttaaagctactgtttctattcaactattgcatttattttcgaatgtcattaggtggaattaacctattgtttgttatagctcttttgttcttgattactttattccttgataccttgggttattataacttgactagttggtctatatatattggttcagctagatattagatatgattgcttagccatgcttagaaacattagcacactattgggataacttatgactcactattatttaatgatggcttaatgatagttcacgatggtcaatcgtgattggttaattaattacttgccaactaaaatatgataatggtgggttgtgagcacatggttttgagagacgtgctcatgacaattaaggaccggttcacgagtttcggttgtgaaacattaaccgtgccaaccacaagccaacgtgggcaacggctttaccttttgtatagcatggttcattgcggggcaccagactgagaagtggcggagataagcccacgggggtcgctagggagtccatgccttgttttataagggggtgattatgatccaggaatggtgcactgtggtgagttgtgttgtgcgaagggtattgtcacgatttccccctttgcagtgccgtggtggtacttcagggcatggcaacatgtgtgaaatcgtgtcttgtgggtacagtggtacatctttggccagagtaaaactattcgaatagccgtgcccacggtcatgggcgggtctaacaatgtctttcatgattagtctcacacctctcatcataataaaagatgctttaattggtaataatttggttagctcctggtttggaatggtatattcctggtttggagatagaactgtacagccgggatggttgttcagtatggttgggcctatgcaacagggtatgttgtatagcgttggattaatattgtttaattattacttaactgttttattaaattctgaaatgtttattaaatgttgtttatgaaaatgaaaccctactatgccatcctttgttatcctgtgcacttgcatatttgctgcgtggcttgctgagtatgtcatatactcaccttgcaatcattcatcagaggaagagttctacaatgatgctgatggtgtggaggattaggtgtagccctggtcaagctgcctgtggagtggagccgtttatcttattttccgctgcttagatctttattgattgagaggaactatctacctctgtaatgacactttattcgcttattaattagagtaataatgttactctattatcaatttgttattgtgtgcctcggctgattcctgtacgagggtttacacacatgtaagcgtttggaattttggatagaaattccgggcgtgacaagttggtatcagagcccccttgaccctaggttatgccaaatggttacccattgcaaaagtagaactgttctcctctccttctcttttaattaaaccaaactaatggcacatgcatttcatgatattttttagtggttctcattcaaaatttatttcagtgttattagtactgtacatctattactgtactaatggctcattttacccgcaaaagttttacaatattgttttatttaatcttgctgcaataaaataaatttagcatgttaattttataactttcttttatttcttttggaacccgatgttcaaaagtacaaaatttgtaaccttgtttccaactgtttcaacttatcttgcaagcttggtttattttatttacttacctttttactttgattttctaactttattcaaattaatccaaaaacttgtgctattaattggataaatgtcttaactccctcctttcacttgtctttagatgtcgcgctacaagcctgagtacttgtttggtgttgagggatttgttcagaagttgcgtacgatgtcctttgtcataggatttgggactgcccctttttatgcccagattcctcatgatcgtcacgaagagaagtgccgagtcaaagtcaccttgaacagtaatagtgaagatatcccctcagtgatgttcgaggctggaggaagaaactacatccatgcatgtcaggaggtggcaaggatcgccataggagagctccgcgatcgctacagtgatcagttggccgacagtgagtatcgctaccatcctcgccaaccacagggaagtgaccgtggcagctacctagagaccgagggaattgagaatgatgctaccacaaagcatttggttgagatgctgtgggctatggatgaaacccgtgcggagactgtgttagcggctcaagatcgtgaagaccggaatcgtggtaagatttgcaagctagaggacaaagtggatcgtttggagaaggaactagccgcattaaagggagaagcaccgccgcagaaggccaggattcgtcttaccgcaaggaagagagctctatttgtccctcgctaccaattggcgccaaaggtccgtgtggtggagaaagaagttaccccagccctagcggatcctccggtcatcaacataagtgatgatgaagaagaagaatccaagcacactcattccaagattgagtggggagcaactcaagatgatgaagacgagccgaacgagccttcaatcaactccgatccccggaagaattagagtgccatgtcaagtcgttgtcttagatcgttgtgttagtttgcttgttttaagtttggttgcgtgtgtctcgcatgtgatttacatcagtggtgggatgtaagtgcatgcgtttgtttgctttcgagtgttaggtagttggtgagtttagtggtgtgagagtctttagttttgtaataacgaaactcatttaagatcaataaaagttaaattaattccctgtcttaagtagttttccccggtttctcttcttgtgctcctgtccatgccagatggtgctcactcgcagcaacgggaatggccccaacaacaccaataataacaacaacaatggagagaatcccacacttgcccaagtcctggctcaacagacacagcttatgaacatgatgatgcagcaactccagaaccagcagaaccagggaaataaccatgcacctccccagaacaagttagcagaatttcttcgtgtgaggccgcctattttctctagtaccactaatcctgttgaagctggtgattggctgcatgccatagagaagaagttggatatgcttcaatgcacggatcaggagaaggtctcatttgcatcacaccagttgcatggccctgcctctgaatggtgggatcacttccgcctgaataggactactgctgaacctatcacttggcttgaattcaccgctgctttccggaagacgcatataccatcgggagtggtgtctctcaagaagaaggaattcaggtcgctcactcaggggtctcgctctgttacggagtatctgcacgagttcaatcgtctggctcgttatgctccagaagatgtgcacactgatgaagagcgccaagagaagttcttggaaggacttaatgatgagctttcttacccactcatgactggggattatcctgatttccagaagttggtggataaggctattcgtcaggaggacaagtacaatcgcatggagcagaagaaacgccggattgctcaattcaagacacaacaggggaataatcagaagccgcgtcttactttaggaccccagtctatgccacagggaggtttttcgtctgttgttcgtccgcagcgtcagttcttcaacaataacgcgggcaacaacatccgtaatcaagctccacgccctgttgcagctccaacacaacaacaacctgccaagaaggagcaaggcagcaagctcgtagtgtgtttcaactgtggagacccaggacattatgctgacaagtgtccgaagccccgacgcgtgaaggttgtccctgcccagagcaactctaccgcaccagcatcaaaggctcgtgtcaatcatgtcgctgctgcagaagctcaagatgctccagatgtgattttgggtacatttcttgttaacttagttcctgcaacagtgcttttcgattctggtgctacacattcattcttatctatgagttttgcgggaaatgatgggatggaagtagaagatcttagacgtcatttgatggttagtaccccaagtaatcaagcactctctttgcagcatagtccctctgtcagaatagaaattcaaggagtaccctttctggccaatcttatcctattagaatccaaagaccttgatgtcatcctagggatggactggttagccagacataaaggtgtgatagactgtgctaacagaaaagtaactctcaccagcaatgatggacgagttgtaactattcatgcattgtcatctgagtctttaaggccaagtctgaaccaaataactttggaagagattcctacagtccgggagtatcccgatgtgttcccagacgatttacctggtatgccgactaaaagggatatagagttcagaatagatttggtaccaggaacaactccgatccataagagaccttatagaatggcagccaatgaattagcagaagtcaagaggcaagtagacgatttgcttcagaaagggtacatcagaccgagttcatttccatggggagctccggttatttttgtggaaaagaaagatcatacccagaggatgtgtgtggattatcgtgcactaaatgatgtgactatcaagaataagtatccgctacccagaattgatgatttgtttgatcagcttaaaggtgccaccgttttctccaagatagatcttcgatcaaggtatcaccagttgagaattaaagaggaagatatacctaagacagcttttaccactaggtatggattgttcgaatgtactgttatgtcttttggacttaccattgcccccgctttcttcatgaacttgatgaataaggtgtttatggaatacctagacaagtttgtgttggtctttattgatgacattcttatctactctcgaacaaaagaagagcatgaagaacatcttcgccttgtactagagaagctacgagaacatcaactgtatgctaagtttagcaagtgtgaattttggttgtctgaagtgaagttccttggtcacgtcatctcagccggaggagttgccgttgatcctagtaatgtggaatccgtaaccaactggaaacaaccaaagacagtttcagagattcgtagtttcctaggcctcgcaggttattatcggaggtttatagagaatttttccaagattgctaagcccaggacacgattgcttcagaaagatgtgaagtacaagtggtcagaagaatgtgagcagagttttcaagagttgaagaatcgcttaatatcagctcctattttgattttgcctgatccaaagaagggtttccaagtgtattgcgatgcatccaaacatgggttaggttgtgttctgatgcaagatgggaaggtggttgcctatgcatctcgtcagttacgtccgcatgagaagaactaccctactcatgatcttgaattagctgcagtagttcatgcgttgaaaatttggcgtcattatcttttcggtactcgtacagaggtatataccgatcacaagagtttaaagtatatctttactcagccggatctgaacatgagacaacggagatggttggaattaattaaggattatgacatgggaattcattatcacccgggaaaggctaatgttgtagcagacgctcttagcaggaaaggctattgcaatgctacggaaggacgacagttgccattggaattatgcaaggaatttgaaagattaaatttgggaattgtccgaagaggtttcgttgcagccttagaagcgaagcccactctaattgatcaagttagagaagcccaaattaatgatcttgatattcaagaaatcaagaagaatatgagaagaggaaaagctatcggtttcatggaggatgagcaaggaactgtatggttgggtgagagaat

SEQ ID NO: 31507 - DNA, 1310 bp, Oryza sativa
taagccgtgctccaggtgctttacatctcgatgctccctggctagcaatgaggttatatcttcaatcttaattagcaaacctatcacacctcagcatgtcgccatttttattccatgctcgacggtaactacctgctgctgttgcgcatgtcggcggcacacagcgtccatttgtacaagtttttgttgtgcttggctgagtcctatgtatggtcaccagcttgtggtatttgaattgtggacatgacacatgcttttttatggtcaccaacttataaattcaacatgacagaaaattatcatctatcgcacggtcacatgtttttttatggaaatttgaatgacatgtaaaatgttggagtatggtgtgcagctatgattttatgtcatgttgaatttataattttttatttccttccacaccatcgatctaatttatacttgtaaatgtttacaatgataaatttattttcaatttcttacaatgttccactgatatttggttggcatgcaaagaatagggttctactctttcccttttttaatatatcgctccgttgaccttttgatatatgtttgaccattcttcttattaaaaatttatttaattatcatttattttgtatgacttaatttatcgtcaaattttcttcaagcataacttcaattttttatatttacacaaaaaaatttaaataaaatgaatggtcaaacatttataaaaaagtcaacagtatcatacactatctcggtcccaaaataagtgcagccgtgggtctccaacgtttgaccgttcatcatagtcacacataaagtattattcatgttttatcatctaataacattgaaaatactaatcataaaaaaaattcaaataagacgaatggtcaaacgttggatatgaaccgtgcaaagcagcacttattttgggatggacggagtattaaaaaacggaggtattatgtccaaatgacatatttccatatatagcatatattatcagtaatattgatattatagtgtttcgttgtatttgattatcatgcaaagaataggtgttatccaggtgacgtatttttgtatttatcataatatgagtaatattgatcccatattattggtttaataataaatttaataatagttccaataaattcgaaaacggagatattgcttaaaagttatggcagtagaactatctaattctacacatgtaacactggtggagaaaccctttgtagtcctggttcgtaaccctcctttagtcccggtttccaaaccgggagtaccaatccgggactaaagatcga

SEQ ID NO: 31508 - DNA, 710 bp, Oryza sativa
tctatctccaaaccaggaatgtaccattccaaaccaggagctaatcaaattattaccagtttaagcatcttttacaatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccaccgcagcgcaccttcctagatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccaacaaaaccatgtgctcacaacccaccattaccaggttttagttggcacattaattaattaactaatcacgattgaccatcgtgaactatcatgaaaccatcattaaataatagtgagtcattagttatcccgaatgtgtactaatgtttctaagcagggctaagcaattatatctaatatctagttgaaccaatataaataaa

SEQ ID NO: 31509 - DNA, 713 bp, Oryza sativa
  unsure (1)..(713): unsure at all n locations
attttttttctttttgcttttggtaaatgtagccaaaagatcattgatacaggagaatattatatttatcttaacgatcttgcgaactctgtcaaacctatgggctcactggacaataacacatgtgaattggcattaattggtctgtctactgatatcaaggacaattcgaagagaatttttcctgccagaataggagtgagtatataaaatttacaaattaaaatctctttttaatgtactattactatcattgcaacaccttatgtttttttttccacatggtgcagggatatttgttggattcgcagttggacaggaatgagctcaagaaacacttcgatcaaacgagagcgaaccatcttgaccataaagaattagtaagaaaatatatattccagctgtcaatgatatgtaaagttactttttcctgtctgcttgtagaagtaacttaaatgtctttgcaaattaactcagcatgtttgtggaagtaactttttctgttatattgacaggaaattgtattttgaatcactttttattatccttttatacttactaaatcatgattatatttactgaaaaaccttctttccactcccctccctcttttcacttgaatgcaggcattntttcccattctccaagaattgggtaatgggaatgataaggctagtcactatttcgtggtgtgccttaatctgaaagctgaa

SEQ ID NO: 31510 - DNA, 852 bp, Oryza sativa
ttacagcattcacagttgtatatcctgtccaacacatttgcagctacaatgaatgcccttgatccataattcctaacaggacctccattcggttctactagatacatgttttcagaagttcaggtcaatttatatgatgttgaagcaataagctctttttgaaatctgttgaatataggccttgtgtagacctccaatgcttttgtttccatgggatagttagcccacatagaagggattgtttcttctgcttcaaactcattctgatctgttgcaacagtgattttttcttgaatcttcttgtactgcaaaaataagttgtatatgctgttttgaggatttacatagcgcttcagcactgcgttaaatccctcactccgtgctgtagtctgaaggaaagggaagaaacagtgcataaagtatgctgggacccaacaccgtctcatttcccaaaggtgtcggaagtgctcactatcttgtaaatgatatgttgtcaacattgcatcccatttagcatcaaactcttgctctgtccagctgttgtcaaggcagtcattgaatgcatcacacaatgctttgtcatgatctaatatatggccaatcttcttctgagcattctgcattatatgccagcagcagttgcgatgcttagcatgtgggaaaactagcgctatagctgccttcatagctaggtcttgatcagttattatgtttgtgggctctacaccttccatagcctctagaaatgcttgaaacaaccatacaaaggtttctgtcttttcattccatagaaatccacaacccagctgaatatcaaaaataatacacataaggaagtcagtacagttttga

SEQ ID NO: 31511 - DNA, 1047 bp, Oryza sativa
tccagcaagaacctagttctgccagttgaggacggaggaggtctgcaggaactctcctcactccagtcactcaggatttcagattgtggcagaatgttctctcgatggtgcatggtcgatgcaggagctcgtaccagcaagcccctcccttcttccctcagggagctcagtatttgtagagagtcaagcatgcagtcgatggctctgctctcaaacctcacatctctcacacatcttacactattggaatgtgaagacttaacagtagatggatttgatcctctcattacactcaacctcaaggaattggtggttttaaataattgttatgagaacaattattcttgttccatagcagcagatttgctctcagaaatgacaaggaccaaagtattatctgcaggttccttacaactggaagcacttaaggtggacaatatctcaggagtgcttgttccctccatttgcagcctccttgccgccaacctccacaagttaattttcaaatctgacttgcagatggaaagcttcgatgaagaacaagagcatgcgcttcagctcctcacctccctcaagcaactatattttgccgactgcccaagtctgctttccctccccgatgggttgcatcacatttcttctctccagaaattgcacatatataattgtcctaaaattggattcctacccaaggagggcttcccctcttcattgagagatctagtgttatcagagtgtagcgtcgatctacaagatcaattgaagaaattggagacatcaaacccagatttatttgtacaccacatgaggtaaaaaggaaagaaaaagaagtgttctctcaactactacttatttcagcatccatctgtaaccttcaatactaaactaaaactgctctgctttgtttcctactttgctgtgaaggatgggccgaatcagtctggagatatagcggactatctgcatccgcatgcgagtaactcaatagcacatgcgggccaaaggatcgatcggttcttccctctgcaacaatctggaaggttcttg

SEQ ID NO: 31512 - DNA, 1012 bp, Oryza sativa
taggccatccccaaccaataaactattagtttccatacttgtcatgtcatatagacactatatgtagacactatgtattcaatggatggtgtatctatctatcttctatctatctatcttctatctatctattatctattatatactaaaagtccattaaacttcctacaaacgctctaaagccgccacgtggcactcctacaaatattcctaagtcgccgcatggcactatctaatcttaccgttgattttcacttaaatttgtggacccgttattttacaccattagattagatctattattaaaaaaataataacttccacatgtttataacatacaaacgctagctgctactgtccgtatgtatgagattgtacgatacaaacgctactgatgttctttccgtaacatacaaacgtacatgattgaaaataaaatgatcaagctttcttaaccttcgctggaagaaaaaaaaaaccatacacttgtacataaaaaagacagaaacaacatacatccataaaaatcaaccgtttttaaaatatgattttctacaatataaagataaaatatattacttcacatgtataaatatatttagttaaattaagatctataataaatatccaatcaatgttctttaaaccatcttctaaatctatctattatatactaaaattacattaaactttgtacaaactcttttactctgctatgtggctctcaaataaattagagaaatcctagaaatctattatatacttaaaagtctattaaacgtactgcaaatgcttctacattgtcacgtggcgctttaataaaattacagaaatcctagaaattcagaataaaaaaagaaaagcatccaaccttcagttttcacttaaattagtggacccattattttaaacaatggattagagctcttaaaaataccatgatgctaatctctatcctggaaaaaacataatgcgcttacgtcatacgatcgtctccctcccggaaaaaaaa

SEQ ID NO: 31513 - DNA, 439 bp, Oryza sativa
ctctcacctaaaactgtttagcttagatctatgtgtgaattagtttgggtggaaacgatcgcactaatcctgtgcgtcgccttcgtgttaatatatatgtgatgggaacagcccccatcgtggcgatacagagttcggcgcagctgagaacaaccgaagccgagattgatgaaacgactgcatgcagtaacagaaaacagaaaacaaactctaacaaacatctgttatcgcatgtggaggaaaggctaacctgatccgcatggatagactaacctaatccaaactaacctcaacaactacatgcatgcaagctgtcaggtcgtgatcacatgatccgaacctttcatgctaactaacaccctctctcaatccggacctaaccaggttcagattgcttttgaaattctccaggagtcttactgacagaggtttagtgaat

SEQ ID NO: 31514 - DNA, 472 bp, Oryza sativa
taattaaaacatgatcttctcttcaagactttaaattatttctagaaattccatttaaacaacaatttataaattttaaaattttcagggcgtgacaatcctcctcgcagcagcagcagcagcaacctcgctccgcgccccgaccccaattcgtggtgcgcgtcccacagccgcagcaacagcagggtcagcaagggacccgtgcaccccgtcctcctgcgccagctgtgcagcctggtcaaggccgcagagacgctcaaggacagcagcgtctgtgctgcaactgcttcgagcccggacactttgcggacaaatgcccgaagccgcggtgccagcaaggccaagcgcctccccgccccaacaacggtggtaaggacgtcgctcggggtcgtgtgaaccacgtgactgccgaggatgtgctgacaactccggacgtcatcgttggtacgttcctcattcattccattcctgc

SEQ ID NO: 31515 - DNA, 733 bp, Oryza sativa
tcagtgatagaacccttcctactgtaggatggataattttgagcaaattggatacatggttacatgcggcatctatgccttctattattgatttgattttctttgacatatctactcgattgaatgtcaacttgccaacatggtcaccggcaccatctcgtgtagaagaagaagaaaagcatgaaaggcagttaccaacggtacggtgaagaacatggtggccatggagtgcctggccacgtatgctgctgtctaccaccggggtggcctcatgggtgccatgaatttggtcctggatgatgaagtactggagctcatccagcgtgtcctcagcctcgtcagccttcttgctgagaatctccaaaagcccaggcaggccagggttgctcacgtccctcctcatctgagcctcgtggagcagcccttgcgtgaacatgagatcgctcttgatctgctccatgttgaggccaagctcggtgctggccacgtaggccttcaccaagctatcggacagctgcgtcaccaccttgccgacgagccagctcgccgcaccaacggccacctccatcgatgattgatctcagccggccaagccagatggagcttgcctgccaagggcaggggttgcttaggattggctctaagctgcccaggagtggatggctctaaagctgggatgagtttctctacaagagaaactatataatgacttggctctaggcttttcctattt

SEQ ID NO: 31516 - DNA, 7320 bp, Oryza sativa
  unsure (1)..(7320): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaaaatgcaataaaaaatctgttctgcaagttcaggacccactattttattggcaggttctcttctccagaaaaaaagtcaatacattttccaaatcagtgatgcatctgtgcgttgatcctgtctgacttgctgtttctcaggttgcaacagaagcagaccttggtttagcagatgcctacataaatggctgcttctcttttgtcaataagagagaaggccttctgaatcttttccttgtaatactatatattttagttcattactttcttggtaaagcaatatccatagtgctatttattaatcggttttcagacttaacccatcaggcttttttactgcagatcctcattgccagtagagatgcacacaggagttcttgcaggaattctagtcgaaggtatcaagtcctctgctcttcactaaatccctttcgactgtttgatcaaaatgaagtagcatatgttgtgtgagattatcagtttgataaaaatattgccttgttctcaggggttggtggacacccttgctttttactgccggcgttgcatctgctaaatattttctgcgtcacatctcaaggaagaactctgtaacacaaactcgtcaaaatgtctctcagcactatgatttggtcagtttgtatatgtccttttttaattatctatcaaaattaacagatctaactccttgctgaatgatgacttagctcaaaatagttagcatgttgatgctttctctgcctatacagcttctggatgcttgataattttctttaattcccatgtctacataattgactagtcaacaagagttaccctttcttatcctatatattttacctgcagagtaatgatttcttctcgctttttctggataagtcaatgacctactcatctgccattttcaaggtaagtgaaacatatgaatttttccgcagcttgtaaattatcataagaatatgttggactaatgcacagttgatttattgccctattaatttgttaggatgaggaagaaagcttagaagaggctcagctgcgtaaaataaaccttctaatccataaggtgataattctatcatatagtagtttttgtgtttccacctatctctctctcaccacataatgagagagaacatatgtcttgatcgatatttactatgaagatgaacccgaccctttcttatctatatacatggtctgatgttccttcaatcttttacatgtccacttaatgaaaggctaaagtgggacaggatgatgaagttcttgagattggtagtggttggggcagtttggctatggaagtggtgaagcaaactggctgcaaatatacaggagttacacagtctgtggagcaacttaaatatgcccaaagaagggtgaaagaagctggcttagaggttgcgtactatttactctctctccctttcacatcatctgcgcatatgatttactggaatcagttttagtgttagtttagtctcctatttaaatatgtatggtgaaatccctgataagttagcattaataataactatatatttttatttattatcaggaccgaataacttttctgctgtgtgactaccgtgaaataccatgtcacaaatatgacaggatcatatgctggtaagtactagtactaccatgtgagtttcaattgaaatagagtaatcaagttggttttctcccatcacctgaaaaataaagttggttatcatcgatcaacactgggtacatgttcatgtgattccgccagttactaattgcttccagcctattgcataattcatcagtgagatgattgaagaagttggtcatgaatacatggatgaattctttggctgctgtgagtcccttttggctgaaaatggcatatttgtcacccaggtgtgtacaaacaacctttgtcattgtcattgacactgactgttgatatatcccacttaaatttacatgggattattccagtttatctcaattccggaggaacggtatgatgagtaccggagaagctcagactttattaaagaatacatattccctggtggatgccttccttctctgactcggataacatctgccatgtctgctgcatcaaggctctggtatgttcaagatcagtcaattgatgctcaatacaatacagtgctcacactcgtacattgatttattggttttggattggatgcacgtcgagttcatttgcagcattgagcacgttgagaatattgggtaccattattatacaactctgatacgctggagggacaacttcatggccaataaagagtaagtacaagcatggccttctactcaaagtgagcaactagtaccaatagggtatgtgttacacagaggcccaaaagagttgaaatttcagaaattttagtcaaagcacagaccctgccttgtactttggcagtgttaaaagtgtcctttccaatttcttttatctccaattgaacaataatgttaaaatgatagccatagtgtgttctagcaaattaccataaaacaagagtgtcctatggcaaagacatgtttttgaaatgtcttacggcaaatggcacaaaattatggtgccataagcctgctgagcaagcaaatgcagaaagtagcagttcaaaaatccaaagtatgaacacacagtatggcagttcagagtttacacagaatttccctcttgtattttcagtaaaattttggccctgggctttgatgagaagttcattcgtacatgggagtactatttcatatactgcgcagccggttttaaatccaggacacttggagactaccaggcaagtactgtactactgtacgtatgaacatatatagagaactatttattactcacttggttgcttgaccctttcagattgtattctctcgtcctgggaacaccaagatgggatctggcttctaaactcaaaattgacctctgccctagagcacgagccaacctatttatctttgccattgtgtaataatttacaggaaactttggtcttcatgcttgaagatcatgtttgaaaaaaaatgaataagtctatatttgaaatccttcaactattggcgactcaatccatgaactttaaaacaggacaaagtacaaccctggagaaattaccgccattgcttgtttaaggcatgttctgtgccatgtcacccttgtttggaggggtgactagtaaatattctgatgatctattacctcaaataaattccatatggtgtatatacacgatgcaagatgcattgcttgtcctagcattgttcttgccatttgagcgcattaaagatatgttgggtttggttggttttaaaaatgaaggttaccatattttggtaatgtgaattttctgtacggaagaatgatttgaatgtgttaagagaaacatggaggtgtttgcaagcggatttgattatggatattttgagagttcacaaattactagcatatgatgtcgtgcattcgcgtgactatatgcctcctattacgtggcatgtgggggtggcaatccatttttcatgggtttctcatcgctataaagaaaaaacataagtcatttattgcaaaattcatatttgcctgagtcattgttttatatgtcatcgtggttgcaaaaccccttattttctattgcgtgcactctttatagcctacgtataaatttttgtatgtttttaaggcatgagtttgggttcattttaaattcgtgtgaaaatcatgattgtgcatgtagaaatattttcctcaaatatattaacaattaaaatatttattgtaaaattcatatttgcccgagtcattgttttatatgtcttcgcggttgcataaccccttattttctattgcatgcactttttatagcctacgtataaatttttgtatgtttttaaggcatgagtttgggttgattttaaattagtgtgaaaatcatgattgtgcatgtagaaatattttcctcaaatatattaacaattaattgttccaaacaaaattaattatatgaacgtacatttgtatatgttcttaaatagctcaatcttgacaggtgaatataagagagtttatttataaaatagttttttttattataggagcaaatcgtaaattatatgtataaccttgtaccatcctatgtctattttctatctttttttccttcctttctttcctcttctaatagctttgtctccaaaagcctctttaattattgattttaccatccatttaatccaatagtcaagattcatttattcttttccgtcctatagtgaatccaatggcaaatatttatcgaatgatgtggctcattctcgttttattttgagtgtcacttttcattagtttgttaccggctactaaggtatttaaagtgttcggttatgttctcttattgaaatagcataagcatagccagagacactttgggcctattcagattgtagccaaaataaaccttaccaaattttggcaagttggcaatattgccaaaattttggcatgattccttatgtatttatcaaaatttagcaacaaattaaacgtatacacatttttggtaactttgccaaaaaaaggtatgattgaaaataacatcaatctgaacagcccctttgtgaagcgttttgtgttagtttatcttcaaggctttgtgtttacctgaactaggctgagttttacaaacgttgggaaagtttgggacaagatttggattacccagatatcgaaaaaggaatagctccatcatttcgtttaagcttatcaaatacaactaaaatttaaattttacatcttaattttataattttgattttttttatcgtactttattttctactattggcttttaactcttctcattgcatggcaaagatgcaaagatatatcactggcagatagagcagggtaatcagcacaacagtatattctacacccccatagaataacttaacatgacatgacatagaatttccattaatagtggatgacaatttacataaccaatgtttttctcaaacgattatatctagtccttatcattctcaaaccaaaagtaaatctttgaaatccatggagatgaatcgaatttcgcacgtatcaccaccatcgacgattcacgattgatgtcgaaccaaaacgaaagataatattactgtcaacggctaacatcaaaccagagcaaaagatcgataatgctgaagagtaactgagttgtacatataaagtcaatcttgtacagctatataataatacatgttcggaacatgcacacaacagcaagagagagaggcatgtgggagctcatgcttgtctcccaaatattccaaacttggaatccacagaaatagtattaaaaagagctcatcctcgttgtcaccttcaggttgatcctaagcatgccgacgtggatgctaaatccttccggattactgcacggatttgtatatctccccttcgatctccaccgaacttccagcccaatcatggtcgtcgttggatcgagctgatcatgtagctagcgtgtggtatcatgggccagattgtactgctaccacttcagaattaagccacctatgtcgtctctctcgctgcaggctgcagctgcctgcctttgatctttcttatctccttctcttcctcctcgatccatggtcaagtgatcgtatcttcaattcctacaatggcgatgccgtgggagacggtggcgtgcatcctgcggaacgtgtgggcgctgctcgacggctggatcgccgtctgctgcctcgccgccgacgagctcgcgggcctcctccgctcggcgctcggttagctgatcgacgacgtgctcgatcggcgcgcgtggccgatcgagctaactaactactccactaattaactgcaggttcgtcggttgctttatcattcttgctctggttgatcattgcttaattccttctcaagtaatgcttctgttcctgcatatgtgtatattttggacaatgcatgtttcttagttactccatctctctctctctctgcttaattagaccagtagaactttatttctgtggtaattttatcattcttaagaaagtatcgggagcaagggcggacccataattttaaagttgtgtattcgaaatataaaggagccaaaaaaattttaattagcatgcacgaatcatcgaaatgagccgctagacttgcacaaattaggccattagaggagagagaggatggagcaaggcctagaaatatggttttatttgttttatttaaatatatttatatataaatataattttattatatatatgtattacattgtatatacttattttgttttgtaaaaaaagaaatgaatacccttcgtccacctctgatcgggaggtaccatattttctattgtaaattcggtacatataagtagaaatatcttgaaataccaaaaattttattgtaaaatctcaatagctcgaggtactttctcattaaaccataaagtttctcttatttttcacataactcattttctcacttacatatgggacttggatcatcttgttggcacgaatttgctagcgagctatgataatgtacctgcttacatcatatgttcgctgcaggcagttggaaacatatctcccacgtatgaaaaatggagcggtccattagcacgtgattaattaagtactctctccgtcccaaaatataataacctaggatgggttccatcctaggactacgaatgagtcatatctagatttatagttttaggatggccatgtctagattgacccatcctaggttgctacattgtgggacggagggagtatttgctatttttttaaaaaaggatcgatatggttttttaagtaactttcatatagaaactttttgctaaaaacacaccgtttaatagtttgaa

SEQ ID NO: 31517 - DNA, 4757 bp, Oryza sativa
atgcagaggtacctagatatttaaggtggtgggagcccgacctaggtgccttaatagtcatgatcctcctggctgtggtgcgcccgcttttcaaactactaaacggtgcgtgttttgtaaaaattttctatagaaaagttgctttaaaaaatcatattaatcaaaatttatagtttttttagctaataactaattaatcatacattaatccattgctccattttacatgtcagaggtgagggtttcacctaggaacacggccaaggatgtgttcttggaaccctcaccttccgcacgaaaaacagagcgatggattagtgcatgattaattaagtattagctaaaaaactttttaaaaaaataggtcgctatgaattttgaaagcatctttactgcggaaaatttttacaaaaaatacatagttggtgaaacgtgtgtgtggaaaaaaggaaggagaggatgggaatcagctgagccgaacacaaccatatggtatctacagacgatttgtagtgatgaaacttgtttggtagcaatatacattattatcgaaaaccatcgtcatttgaacaaaaatcacatttgaacgaaaaccatcgtcatttcgacaaaaattacatttgaagataatattaatccggattcatgattttgagtttaaaagtttaccaggttttaaatttagcgttaatactgcactcagaacgaagtttgaggtaaacaactgaatttttcaaaataaaaataaaagccaaactctgcataagcttttgatttttttttttcaggggaacttcgcataaggtttagccgtcaagtatgctattgaatgaaataaccccctactcttctaaactgacaaacagtggaatcaaatcaaatagtatatatcagatagaaaaggttcaactttgaaattcattttgtctttgctgatttgtttatttaaaccgatgatcaccaaacgacagtggtatttccagcggggtatagatggccattggacattggacaaaatcaatcgagccaatcatacgtttgctattattggtcagaacatggccagatggacacatgtatgacaagtgatactatttatatataaattacatgagtaagcttgtcgtcaatcatgtagtaactgaaacatgatggtcgccagctctagtctgctacttgagactttgaattatgtgatttgaagaatcgactgatatcgatctgttttcgtgaaaaccacccacataaacaattgttttagaccctgggaagtgtaattttgtctcccttttcgatttcaggtctttcatgttgcacggagaagaggctgatcgatgtacagacaatttcttttttttctttgttaatgtaactatgttaatggtgaagtgatcatgcctttttgttctgaaaaagaaggtagatcaattaatgtacagacgtgaatgtgcaggatatatattgtaaattttgaacttcatttgttatagattaattattgatgtatacacgaggctctttagcagattttacttgttcactactccctccgtcccataaaaaaccaatctacttctagatgtgacatatcttgattctacgaatttggacatttatccaaatttatagtacagatatgccacattcgttttttatggggcggacgtagtacaccacaccaaaaaggaggccgctgtcggtattttttttcgctagcactcaggccttatttaattcgcgaaaagaaaatttttgtgtgtcatatcgaacatttgaccggatgtcagacggggttttgggacatgaatgaaaaaactaatttcataactcgcttggaaaccgcgagacgaatttattaagcctaattaatctgtcattagcacatgtgggttactatagcacttatggctaatcatggactaattaggctcaaaatattcgtctcgcgatttccaagcaaaatgtgcaattagtttttcattttatctatatttaatattctatgtatatatccgaagattcgatgtgatatttatgggaagaaaattttgggaactaaacaatgcctcgatatgccgggaaatgtcctgtcacagtgtctactggtgaaaattctgtggtagtagttgtttgtctgtcgacacgtgtagatatgcatctagcttgccaaagattctgaggcgacctaagagctattttagactctctatatgtccatttagccaactgtttaaaaaaattagctagtcatatttgccttttactccaatagtctctccatctcactctccaatcttatagtgggtcccacatgtcagtctctattacttctcccctttcccacatgagcccgcgtgcatgcggatgaggcggccacggaaggaggtcgacgaatccacggagggggtcgccatgcaagatcggcggtggtcgagacggcggtgggggctgcagccagagctccaaacggcagatccggcggcggcactcggcgggggattcggcgggcggatccggcggtggcactccctcgttgactcccctgtgccgtcggcgggcgaccgagcggacagatggcggaaatcggcggcgaagacgacgttgctgctgcttgcaccagcgagaggcggcggcgatgctgcgcctactcgtgccggcaagctcggcagcgagcgggcatacctctccatcggcgacggcgacgaggagtaggaggcgcatacgacgggaggcgacgacgatgggagtcagcttcgacgaggatttggccgccgccgccgccaccaagattggcgcctccgtcgtgccatccccgttcgccgccgctagctgctttgccgaggcgtgcggcggtgccgacgacgggcgccgggctgagaagggtgtggagccgaggaatccgggcggctgcgacccgcagcgccggtgggttggcgagacgacgctggtgacgaggagagcacgagtcagggacgcggaccggtggttcgacgcctcctccgagttcgacgccgccgtgccgcacagcatcgatgctgcgccgggaggacagcagcggtggcgctaggcggatggggcggcggcgctaggtgaatagggcgctgggaggatgacggcggcaacactgggaggatggggtggcggtgctgggcagatgggacgccgggaggacgtccggcggcggtgctgggcggatggggaaagggggagagagaggatagaggaggtgggacccacaccagatggcaagccgtcctggctagccaactttggtcaatgaggttgggaatttagccagtcggatggtttggagagccatttggctagtttgttggagtaaattttttatccaatttagctaaattttagcttggagaaccatttggctagtctcttatagatgctctagatagtggggcgggaaatgagaggcggcaaggagggaaaagtggcgggatgtgaaactttcagggctctctttcccccattccatttcctcgatctgaaatcaatccccacacaaaacacccacaccaaaccaatccccacaccagcagcccttcccccatccacaatagccatgatgcatcgcctctgctgcttcattgtccgtacgccgcctccaacgagctaagtgttcctgctcaacgacccaggaaagctttggacggagcacgagaagcacgaccttcacgcccctggctaagtctggcacacatggagaagagaagagaaaagaagagaagaggagagaaggaaaaaaggctattatagctagctacagcacgaacttcaatacgttatgtgtgtatgagatgtgagaccatatgttaatgatttatagataactaatgtatgaatgagctgttatattggctataaatgatttgtagctagtaattgggtatactattaaacttgctctgaggaagcaatggcttatctataaattttatatgaatggtccaacttatataatttttttaaacaccttaaatataactaagttagaaatatctattgattaaatatgtatcataatatatttataaaatatttataaaggagcttttttctcctttttttcaaaagtttattttcatatatctatactttctatattgttagtacccactgataattattacttcatctgtccctaaatataagggattttaataggatgtgatatattctgtccagattcgctgtactaagatatgtcacattccaccaaaatcccttatatttagagacggaggtagtaaaagctaaacctcaacatccaaacatgtcacctcatcagctactaacaatgagcatctaaaattttatacgagcatgacacatcatcttctcccccatattattttcatagcattttaacatcatcatttgtacaatattttacatatattcatgcatcaattccgtagcaaagcgtgaaataccacctaggtatatatatgcatttggctatgatttttgagtaaagtccatcaccggtccctaaacttgtaccgccgtgtcatcccggtccctaaactcgcaaatcgaccgttcaggtcctcaaacttgttcgactgtgtcatccggtccctaaacttacagatcactcgtttagatcctccaacttgttcagttgtgtcaccccggttcttaaacttggatttgaatatcatctaggtcaaataggatggtctaaagactttatatttaaaaataattcataactttttcatgtgaattctaatgaa

SEQ ID NO: 31518 - DNA, 1643 bp, Oryza sativa
aagttatgaattattttttgatataaagtttttagaccgtcctgtgtagggaccggggtgactcaactgaacaagttggaggatctaaatgactgatctgcaagtttagggaccgggatgacacagttgaataagtttaagaacctaatcgatcgatttgcgagtttagggaccggaatgacacagcggtacaagtttagatggactttactcttttttttattacccccagatccgtctatgtgaggaaccaccggcactgtcgtcttctgaccgcgccgtggattcctcaccctcctgaagctcgagacgacgttgttgttccctccacagcaaggtcaaggtcatgcatgcgcactatataaatttgtacgtactatatgattgacgtgctcgcttatcgcctgtataccatgtggaactatgttttcttatatacaatagttcaattttcataatgcaaaaacgtgcagtcaaaaggagatttcacataggtaatatgaaattgtttgttatagtgttagtaaatagcaaatcattttatcactgtatcaacaaatactaaataatttggagatgaaacattttaaatataccacatttactaaagttaatataactacaacataaatcattttcccaagcggccggaacatattttcgcagaagggcaaaacaacttcaggtgcataggtgtatatgaaaatcattattttcctatgcaggtagtgcaactgcttgcaaaaattgtatttttgcacgtgggtgcgttaagcctcccgtcgaaaaaaagttggcaaaaaattaaaaatttcaaaaaccaaaaatccaaaaaccctagatccattcatagggaaaaaaatatcgccaacacagtctgcgccatcaatgtcgtgccgaagctgcctctgtcatcacgtcaggatccgcagacgttgtcgctcgaatccattgtgtcgtcatcgctcgaagccaccgccgccgctgtcatcgtcgcagctcaaagtcagcggctgtagcggatccgtaggtgagtacggtggagtggcggcaggatccacaagggaggggcacaaatctctagatctgctcctcccgtcaccaccactggcagatccatgtgcatgggggttataggcgacaggattcacataggagagggagagggtacgagatccgcccatcccgtggccgccactgacggatccaagtgcaaggacgtaaaggtggtgggatccacatggtttgaggcggtcgctgctcccactattgtcgtcgctagcccgagtgagaagggctgatgggagtgggatggagagagagtaggggaggaggggataagtgggaggagaggagagggtggaggaaaaggagtgaggagacaagaagaaaaaaaggattgaagacgaaatggaaatggaaatgattacggcgattaccttttttatattatggtaataccgcatttctcatactatttctttatttgattaagagtttataggcccatcgacttctcaattagacatcttacttgagtacaaggttaaaaggagacattttataatttacatagtgtaacttgaatttccttatgtaaagttaaccgtgcgattttatcgttcaatgtttcttatatgttt

SEQ ID NO: 31519 - DNA, 5586 bp, Oryza sativa
cacttgattcccctatagagcctcgcagagcaaataggcatggtacacaatgctattccaggattcccagcattacccctgagtcctgatacacgggttataaataaaaatatgcagctcatcaacgcagcccatccccaacctaaccccatagcctcgcaggtcgcagttgcctctccttccaaaaactttaacttctcgcaagtcgcagcagtagggatcgacgcagacgggaggccggcgagtgcttcaacaccaccggatctgaaggagcagcagggactcagtgactttatagtgggaatcttggaacagcttcgacggtatggattgtgggtgtaggtgtgcacgggtgcagatttgcttttctatatatataggagttggataatatgaaccaaggtacatatgcacctacatggatagtttgactcgtgtacataattcccttcatggtggctgcaaggtttggtacatgttacaatttttgtggtcaaaaatacccttcaagtagtactagagtagtttgaacaaatattttttttacttcatgaacagattagttgttactagttcaatatttgtgggtttccttttttttaagtactgttatacatttatttaatatgttgataaaaatatatattatatttctcaaaaatatatgatgtagatttagtacaacatattatgagatgatatatgtaaattgatattttattcaagaataataaatttccatccccccccccaacggttgtactaactttctatgggtggattttgtgttctctttgttttgcatttgcactttttttttctcatgattgtctagtcaatttatttggtatcagtctttcaaatgtcatgcaagttatgagtttagataaaaattattatctaaatgctatttagagatgtgtcatttgcatgttccattttaagagaaatgtcattagtatgaactttgggagaccatttgcacatttatttagatatataaatcattttctacatgctatttagagatatgtcattaagaaatcatctgcaaattttatatttcatagaaagaaagatatatgatatatcattacaaacatgttcaacaaatctaaatatatatcactcaactataaagtgaagagagataaaaaaaataccaatgtttatctgtaccagtacaagatagaaatttgctttgaatcaatgaatgcttgtgctgtgacatactaatagaaaagggcaattagggaagaactcaaaatgtgacagtgccattgtgtctctcccctatatagtaaaccatcatcttgtcatggcatggtacgtttcactagcacaaatctcaagacccttcaatgttgtagattgttggtgcatacgaaagttaattcacataccagccatatgaagatgtgaagatcgagtgggattaatttgcacagtgaatttgttagcttgtaatgaagtaggagtactcacaacatagttacagatggataattatatattggagttataagtatagaccattgccatgaggttatactacaggacatgcaatctttgcgacggtgaaatcatcgttggttatcctagaaaactgttgggaatgctatggccgatagtttacagtcggggatttgtcaactcgcttatggtgattctatataccgttggccattacatttccaacggaatattgccgaccgtaagcccgtcgggctttcatggatttccactatgtcctctataacagataccatgattccctacaggataatttggattaccgatagattgtaaactattggcaatatttgttagagaaatagtgaataatcgatgacattattagcggtttacatagtataaacccaatattagccacaattatacattgagaagcatttttcggcaatttcccaccacttcatcagtatgataaaattgagcaaatatttggcttgatgcaatagttttcttaatgaaattgaagctaatagttagaatgcatgttaagaatatggcttcatctaagcacaacatccccatgatcatcaccatagtaagtgtgtaataaactatgaacatcttcgagttacctcttgcaatagatctattgcgctctatcctgctgactcgttggttctgaaaggaaattaattatagttagctaaaccatgataggaaataaataaataaataatcagctaagccaccaccctcaggttcaaatccttttgtccataaatttacacacccacaaggttaagaattcgcagctattaattttctctttaagcaagttaagtgacacattcacgggtgtatgtgaatgtgtctcccttgtaatcatgtaaaataaacagacactctgattgcataatatatgagaattttcattcatttgttatgctgattttctttttctgtatctctttttctttcaatcagttaggctcatctccacaatcctgcaagaggagtcagggacgccgaagccgaaggccaaacaaattaatcgaggatgcaagcctgaaaataaacatgcacaactgttgtcagtgtctctacgacagtagatgtgttttcagttacacatatatgggcaaataaactatagttgagatgatggctcatgggagaaacctccatgggttccaatcgccgccgattgagacgaagagcgaccgggctggggcgtggtcgactggagtccgattcgctgccaatcgggatgaactgcgaaccggagcagcccgtcattggcgaattaagtcaatctgatcatgtgccctgttcctcttctgttggcgtccgcatctgttctcttcataacgaaggtagcgagatcgtttccatttgttctgttcttaggaagatatgatcgagaggccatctgaagaaaaaagagattggactgctcgttgagaaaaaaaaacacgtacggtctggttgttgagaaaaaaagcgtaataggggctttataataagcccatgaggttaaattttttatagacagtaatgatagtacgatctaaataatcaatggctaaatctttttaattaatgtgcttgtagaaagtgtccaatttttaaaaattgcccgattattataggtatagatatagatataaatagatatcccgatactttccattcaaattttaatttcttttatttcctttaggcataaagactgaatgtccagatatcccgatactttccattcaaattttaatttcttttatttcctttaggcataaagactgaatgtccggtactttgattgtgtttaagcagaaatataggacaaacgaataaaacgatgagaagaatagcatctaccctatagttcagcaagttgttttactcattactcatttgtcatgtcacacaaccaatgatcatccaacgtcccagatcagcgcgcgtgtcccacgcctccctccgcatcctctcccgcacctccctctgaccctctctgccgcaatcgccgcgcctcctccgcatccgcgtgaccgcgcgcctctcacgagtagagcacctcccgatccgatccagagttccagacggatcacctcccctcccctcggcaaatcacagcgccctccaccccggatccctcgcctccgcgtcgccggtctgccttcgcgccgcccccggtcagcgcctgcgaggaggaacgcctcgccggtcgcctctccagtctcccaccctcctcccagtcgcgcagctcgcgctcgacctccgacgattgcctgtcgccgccgcctcagctggcatcgccgctgtctcctcagcctccgcctcaaccggcatcgcctcgcatcgccgtcgccttgccctcaccgtcgcgccgcattgccgatttcttcccgcctgtttgcatcacctccacggtgagtccgtcgccgaccccacggccgcgttcgccggggtcaccggttccacgcctcaaagcccggtcgcaaaaccttccctgcatcgacgcctcaatggctggcccacgcgtcgtcgaagccaggggagtcgggcgcctgaacggtcgcagatcatctccaactgcctctccgattgatgaagccgcaccctctgattggtgagttcaaccatcggcagcaccatcagccgcccgcgctctctgattggacgaggtcagcatcattggcagcaatatcaccttaaactttgcttgcattatgtgatttcagcatttcccttctcttcagaactaagattattacttcatgttgagttttcatatgaagtattctttatattgcaggttcaaaggcacagagaatccaccattacaagaacattacaagggggtttgtttttcagcacaaaaggtagaagcttgtgacataataagatatatgtggaacaattgtatagtgtataggcaccaagtacagggcttgcgatgctttaatttgattccgttgttatagatcagaagcagcctgctatagattaaaagcagtcctactgtccacaaggatcactagaagataatatgccctttgaatgctaaaacggtcacagtgtgacaacatgctttgaatgatggctttcaaggctaaacatttctttttcagattttcagggcaatggtggtcactggattgaagacaatggaattgtattctgatctgtgaatgcaactgaggtaccacacttcttatgcagcaaaagtatggtgtgattcgtgaaccttccatgaacggctgaactcgcaggtctaaacttcatttgtcctgaacctgaagttctgaacttctacttaagtcaagtagtactgaacttcttaatgaccgcttgttttttaagaaaaaaaacttggtttaatctgtaaactaaccgtacttgtatggttattttgatgattgcagggaggtcaggatcttcaatctctctggtttcaggttagcagagcatatgttttgagttttattaaatatcgatcttcttgtgatatatatatgtactctgtatgcctaattttttcaggaatattatggattcagtttggcaatctgttcttcacatctggtacatcggcaggtactccttaatttcatttcattgagcttttgtacaatggttctcagaattttttttggttatattccttaatggcttcactcaaatgcttcttgcaggggaagaagagttatatgcagcccatttaatttctatgatttttgtagacagcatcagatagtactgtttgttgtttgccatggaggtgcgacagcagggcaggtacgatcacatgtatactccattccaaacttataacttcactaggccatgcaaacttggataaaataagttaagtattggatcgatggaagttgcttctatctatactataaaaaaacccttgcagctgattcggtgtggattgttgtgccccttgaaggtacacttggcagccaccgtgtattgatccgatccatgtgtgaccctcttgatcccaggcactaaaaatttatagcggtgacttttttcggtggattaatttgttaaatcaaataccacatttattaaggtaaggtcaggaaggctgtg

SEQ ID NO: 31520 - DNA, 15480 bp, Oryza sativa
attttctaaagctatgtttcttgtcatcacttgttctggataaataggtatctcacatttagtgatagcatgttatctttttgtcttcttgctgattagggttgcattattttaattaacatatttcctgtacataagagatatgtaataatactggatggtatgtttatctttgcctcttgctgatcagggttgcattgttttgattaacaacatatttcctatatagaagagatatttaataatactgaaactcattagctctttatattaaaaggacatatttcttagaagagagcttgtctaagcatggaagcagggttgaggccaaaagtggcattggaagagagcttgtctatgcatggaagcagggttgaggccgtgctgtagcgtgtagtttgacaacttgacatgttaaatgaaggttgtgccaaagtggcggatgctacgacgaaacactgtattaaaattaataaagttgtagcagtagaaagataatctgatgtaatattgtattttttttctgtacacatgataactcaactataatcaaaggatgtggctggctatttattctttagatggcttcgattgaacttttggctcttggaaggatgtatgccgctggaaagcagaaacatacaacaggaatggcttgcagcttgctgacaaatacttagcttgaatgcttgaatcaatgataaccaaaagagtattatagtcatggcagaaataatcaaaagacaatatatgtttcagtaaaggatattgatttaagacatgcaaaagaagtaatgataagaagagttatatattttgttgttaatacctcctattataaatatttgaggtttactctccggtagggtttaaaaaaaattcaaacttattagactggcttgataacaaaaatgtttggttttgtgttttcggcaagtttaaaaattcaaactgactttaaatttttgacaaaattcaaccatattttacctgaagtcaatggtttttgcagtaatcggttgggtcgttcgcggtgcatacttacccaaaaaaagattcatacttatctatcttgatttctcgaggaatagctcaaccattctttttggcatggatatgcattgtcctcgtatagtgtatattgaattgattagatataatcgttgatgatcttgaataaataattttaagttatatcataatatttttttgatatatgaccttggactgaaagcttaaatggacagattttaggaacattattttaattgcaatcgaattttaataacttattaagaaaaatgttatgacaccgtagcgttaggacgggtatattactagtcactataaggccccgttgtaagcgtagtagtcaacggatttttgctgtaaattatttgcaccatgcttttaaaaatacgatttctcatattggccgtgggtgatctgtttagactacttgttttaaactgttcgttggcacctttttggtaaatacgtactcaatcacttaaatatttacggtgctatgaaatattatcaaccacctcgacctagaaaagctcttgatcaagatgggtttagaaaagataaaaaccgactagcaaaactgatttagagatcaaacacttgttttgtgagtaaattggaagcatatcgcactttcacggtgaaggcatacgatttaccgtgcaaatgcataaagatggatgaactatgatattattaggtagaacataaagtagaaaacatgactgaaaaaagtttaggtaaaattatgattcgattcattgtccagtacaagagtcaggagttagaatcgaatcgaccgtagcccttacaaagcaggttggtcttacatccacaagcattctccatattaagcattctccatattttattttattcagagatcaactaggactaaataaaacctcatgtataagcaaacaaacacgaaaacaaccatagttttggatttggactcggggttgccggtccgaccactcaaacaactaaggtccgaccgtccctatgccgctggttggaccgacatcgtatagaaggcccaggtcctttaatttccaaatcccgctaaaatttactatattttgtacttggtgccatatttggttttcaacactgttttgttacgtttttgtaacccatgatatttaatttatcatcagtagaccatcgatcaacctccatccgcgtttcatccaattcagacgctacctaagaggttgtagtttcttcgtcaactacttcctccgtttcataatgtaagtctttctagtattgcttatattcatattgatgtaaataaatctaaatatatatgtgtgtttagattcattaatatctatatgaatgtggacaatgctagaaagttttacattataaaacggatggagtagacaatattacttggctagtaaactaagcttgatctgttctgccatcttctcatatgattttttttttcacaactaaatgaaaaaaaaaatgctgctgctagctacttacaaaagagatatatagcagccgcgtcagcttattgctggatgaatgatggagaataagtgaagaactacggtacacgcccgtgacttaccccctccgtcccataaaaaataaatctagtaccggatgtgacatattctggtacaattaatatggacatatgtatatccagattcatagtactagaatatgtcatatccggtactaggttgtttttttatgggacagagagagtagctgtagtttcgatcatgtcagacggtcggaggagccgttgaattcatattgtcagacgtttccataaacaaaaaaatccagctgtgtaggacaaattcttatggtgcaagtaagatgtgcatgcagatgcggttactatgcctatagaacaggaatagattagtctctcgaaagaatatcgcattgttttttcatgttatttaaatagttataagaaaattaaaaaaaattgataagataaattaatgtaggatatataattcgagaatctattttataccactgagtttgtcatagttcaacaatttaccattgacattctctttttataatatactgatgacttatcaattattcaacaatacgcctttggcctccttaaaaaaatatgaaagtttatatataggttttatttttttttacattttgacatttttaaaatataacttatatgttatatgctatctaaaatgctttttttttgtgtttttgtttttaatgtaaattatctttaacatgctccataagattttttttctattatctcttgtgtaagcagtttgtctcgatatacctaaaaatatttttcctaaagtataaaaataccaaaaaaaacttaaaacttattatatacaaacttctctgttgtgtaagaaggtcaaataaaaagtttcatattttgttttaaattctaatgagataaattaattgttagcctcgtatgtctctaagggtattttggttttttttctgaaaaaggctcagcacagtggtatattataaaataattgataaaatcactggtattgttgatttctagtatcggcaatataatttataaagtgcactagatcaatgagagatggtgacacaaatttatactggttcataccctcgagatgtggtaataccctactcaagttggtgcagattggatctatgccggtgtgcgcaagtcagtgatgaagcagccaatggcgcgtataaatgacggagtgtctaacccctaagggtttctcccggcgcggcgccctttatataaagctagtgtcaccggtagccagttgatacatgccatctatttacaagggataagattgatttccctatcctatatctctttcttagattacaagttagccgcatgggcgttgggcacttggcccatcccatgccgcacagcccaaaggcctttccttaggtacccaggtaccatgtaccccataggtaatattgtagaaagagaatattagtagtaaatcgttgaatgagataaactcagtggcatataggtagattctctcaactctataagcaagcaacttaaaattcgatccacacaagttgtaacaaaaaaaaataataaggagtattgtgcacatacttcaaattcaatttcattctttttatacttagaaatgcagacttgtagttattgaactaggtatatttataaagattaataatattgtaatttaagttcttagatttgtttgtttcaaattttaaaagaagaatgaatcacaagcaaaacatgaaacggaacaagtattgaaaaaaacataaataagtctatgaatgatggggctcgaacaagttggtaggagtaaaccaatttaaccaccgcactagcttcgctaactaggcagcggcgtggggtagggtgaccggtggagaaggcagtggcaatgcccggcgcctacgacggtggtgcgacggagcgagcgcgaggggtagggtaaacgggggagaaggcggcggcaggttggcacactcaaccgtgagcgaagattccttttttttctttttcttttgattgatcggtaatttctgtaaccaatgtttatgcggagcagagatttctaattccagagatggatcgaactcgtggcatgaaccattggatgaaaagatctaagggttagaaaagacgtgtggatgaaactggtatatttttttattagtatagatttgtaaaaagcaccacatatgtcacttgaagtttgatgttctatcccataagtccccataagtccttttgttgcaaatgctcacctatgtaatcaaaattttttttttcaaaaaccaccctggtgcatacgtgattaaccaaataaatatgttttcatatattatgagccactaatcaatatgtctttatcaaaattaaatacttctagagtatagtcttgacatgataaagcctgagttccactcgaaatactcacggccataattggcccgatcttttggtgagttgatgataactacgatttgggagaaacgttgacgactcgactacgaccgtacaacacgttgttgtgttgcgccttaccgatcgatacacctctccatgcgttgtttatcttgctgatgcagatcaaccttattcctacaagcaaatcgaataaacaagtaagaataataaaaaaaacaatctgaattacaaatataaattgaatacaaatgataagttggggttctgtaacgagtaaaccggtgatctaaccgatcacggaattacacgacaaagtaagtgaaactaaactttaatctaatcaaacccgagaaacgatgcagaggtacctagctatttaaggtggtgggaggacgacctaggtgccctaatagtcatgatccacctggctgtggtgcaccctacatggctggggtgcaccccacatgggccctacttgggccggggtcccagatgaagttacaatcccatgaggtccattataggcgacgcagcatattgtttctttgattgcggttatgatggaatttgggaacacgactggatcacaggccaaaaacagagctcgtatgcagatttggcggcagtttgaagttagcaatgtagctggtggccgaatcggattgtaatacttggaggacttgatattgatatccttttattgattcatgatgtgagcacggttgtatccatagtagccatagttatatcatgacactttttgagattccacaaataaaaaatgcttatgagagcttaaatgttttcgcactaagtttcgctatacccaaaacaaaattttaatgaaacatgaaaaaaataatctaagattgagacttggctagcttagcctgtggtagccctaaagcgatattaggctgattcacttaaaaatatatggactgagatggtttttacaagaaaacaaagtaagggatggacatttgtaataaaataataaaatgtcaaacgtcaagtgacatatgaggtgcttttacaattttccccaaatataaggaggctgttgaccatgctgtaacacatgtcctaaatattttggttacttctacaatatgctttctccgtccaataatataagagtattatttccaatttagcacaaattaagtaagatgaaaaagtgcatctaggacttcaagagtacacattggatctgcacgaagtacacttttgaggaacaaactattgaacttcggcatattagtaccaagtacacgtgattttcgccgtgcttttctcaaatgggaacgggtgggactactgatcgttgatgtactgatcctatcgggatcgggataaccaaaacttcctataatcctgaacaaacgcccggggtgggggtgggtgttgtgtttagtatgtaccacattggatgtttggaaactaattagaaatattaaactagactattaacaagacccatttcataaccctgaactaattcgcgagatgaatctattgagtctaattaatccatgattagcctatatgatgctacagtaaacatatgctaattatagattaattaggcttaaaaaatttatcacgcgaattagctctcatttatatgtaattagttttgtaagtagtctatgtttaatactccaaattagtgtcaaacatctaatgtgacagggactccaagttggtccctggatccaaataagatccaaagttgtgttcggcaagtactcttcctaactttactttctcgttttatgtaatcatgttttctaaactgttaaatattatattttctaccagaagaaattgagaaatttgtcttaaaattatattaatttattttttaagtttttaagctaatacttaataaatcatatataaataagtagctcgttttatgtacataagagatgagttacgaccacagccaagagaccattatcccctatagtatagtgctggagagagggagtatctggttgtcgttctccgggtcaaaacagaggtttcccctacgatttgacaattgtgtaagcaaacgacaccgatccaacaaatcatagtgtttccttgcttgttgccgagttgtaaaagttcgattttgacaacgcagttggggaggaaccactagtgttgtgatggtagagtcatgggtgtatgacttcacccaccaagatttaaatttcggtgtccataaatattacacacatgttgctaggttttcaacatgactttagtgacatcagagatgtgttgttgtttttgtctcttaagcatttaggagacgcattcgtagggatgactgtggtgttgcgtgtatagtggtgtgtgcgtgcgtatgtcatgtttgcttctttttttttttacatttgatccttttagaaatttattttacaaatcggccctaaaaagcttattattgaagattcttttcgtggcgtcagtgttattggcgctgtggtcaaatattgttgtgccaattatgttggtgccatgtcctaaccctccggtgaaagcaaagtcactaatgtgaaggggatggcgccaatgttgtcgacgccgatgaccaatttataattttttaaaaagaacctattcgtaaaaaaaaattcaaattataataaaaaatatttacatataggaccctagagcaattattggcaccgaagacctatttgtaaatacttttattacaagtaggttcttttctgctacgagtacatcctttttaaaattttacaaatatattctcggcacccaacgataattggcatcgtccccattcatattagtgacttaacttttactggggcgagggggatgacgtcaatgttattggcgctgttatattggaccacagcgccaataacgttggcttaaaataagtttttcaaaagaacaggaaggtgaaaaatctagtctgtggtgtaattaaaaaaataaattttgacaacgcagttttgcgagcccacaggccgaaatacctgactcacaaactccggagtaagttcactttgggtccctctatttgtcacccaatctgatttttgttcctcgatcgcaaaactgggtataataggtcccccaacttacgaaaccgtttaaataaggtccctcggcagtatttgactccggttttagctaaggtggcgcctacatggcaaatttaactcggtctttgtctgatgtggcattgaagtggcgcttacgtgacaaattcgatccaaaaaataagaaaaacctatgagactcacatgtcagtttcacacacactgtaacaagaaaatggtggggtcatcctcactaccccttctctctatccactctctttatcctctctctctccctcttctctctccagccggagggtggggtggagcagtggcggtggtggagcggcggccagagttgagtggggaaggagcggtggcaaccttcaacatagtatgtatttggggtaaaatttgtgtgtgtgctaccttctctcccatgacttcttggatttgggcgacatcgccggagatgctgtgcatcacctcgccggtgctcacctccgtgtcaaagaatccgatctcctgcctcagcaccgccttcaggtactcacgccgcatccgcagcgccgacctcttgccgatgatcctccagcaggtgatctctgcttgcacagagtcagaaactcataattcgattcaagagattcccaagaattgaactttgtcatggttaattcgcaaaaatgctcatcaagataggctcctacgacgagacctgcagcaaggaacgccatgtacacactaatctgcatcaagcaaaaaaaaacgaaaaggagaagatcggatttgtatcaaagctgagaaatcgaagaaggagaaggagacgtgtagctgttcgtggttgtcgcgcgagaaggagacctcgcgggaggcggcggtggcggcggccttagtgtcgctgtaccggcgtcgtggccgtgcgcggagtagacggcggagtcggcaacgacgctgtcgtcgttgctggcgaaggaggtgttgtgttaggcaccacgacgatggcgcggctcgcgtcggtcaccacgctctgcagctccagccgcctgccgccaccggcgacgggtctgtgcgccgacgaggagatgtcgcggtagtgcgggcgggtggaccgcctcgacatgtagtagtccctcgccgtccgccgaaacagcgcggggcggggaggagtgggccaggcacctgatggcgacgacggcggagggcggcggggtggaggagtcggagtgaggaggagccggaaggaggcgatgcgggccggcggttggcgtccgagggaaggaggcagccacacggcggcgccagacctggcacgacgatgggccgggccgaggcaagggcggtggccgcagtggtcgtcgtcgcgctccacccgccgctcgtcgccgctccacccgccgcctgccacctctcagctccgtcgccacccatctgcgccgcccgccgccgctcgctattctcaggggagagagagaggggggagagagggaagaggaagtagagagaggatagagagaggggatagagagaatgggtagtgaggatgataggtggtgtccacgtgggccccatcatttattattattgtgtgtgaaactgatatttgggtcctatagattttattatatttcggatcaaattgccacgtaaacgccacgtcagataaagaccgagccaaattagccacgtatgtgccacctcagctaaaactgggtcaaatacagccaaaggaacttatttaaacggtttcaagttggggacctatcgtacccggttttgtgatcaagggacgaaaatcagactgggtgataaatagagggatgcaaagtgaacttattcccacaaactcctatgcccgagaagctaaacaatcctggcccggcccattacttttgatgggccagtattgcgggcccaaaaaacaggccttatcgtctcgtggaagcaatccgccaatcacgccttccttataaacgcccccgctttgattcctctccatttcgaaatttccgaccgttgctcctccccctttcctttccccacccaacggcatctcgtctccacgcgagggatggcggcggcggcgagggaggcggcggagagcccgaaccctaggtcggcgccgcggcgtgcggcggcggcggcggccaaggacgccagcagcttcctcagcccgcgtttccggtcggcggccgcgcaggccgggtgggacgaggagtcgctcctccacgcggcgctcgtcgtcgaggacacccccgtccgcgagtcccgccgcaggaggcgggcctccaccacctcctcctccgccggcggcggcgggagcgccggatctaacactaggtaggtaacccgatcccgcctctgccttcctcaccttccccttggttggtttcttgtaccttttcttggttccggagaaaacgttgcgttgctccaggaagcggaggtcgtggaggcagccgccgggatcgatcccgccggtggtttttctgctcgacgacgacgagaagaagccggataccacggcaggttggcgattgcttctcgcttgctttgctgatcgatccatttcttgagtgtttcttggtggggtatctcgaattctcgatccgttgttaatttgggggatctgcagatggcaagaaggaggtgaaggaggaagaaaagaagaccgtcgtcgttggggagaaggaggcctgttccgagaaagcagcggcaaccagcgagctgccctgtatggatcgcctccgggaggagctgtcttgtgctgtaagagggatttgctgctttattttatttcgactgatattttgctctcgcatagttgatttgacgttcttggagagtaatttgtctgttggatttttttttccttttttgcagatatgtttggagatctgcttcgagccgagcaccacgccttgcgggcacaggtaattttatactgtactgtttattcgaaaggaagtggcttaaattcagtaaaaaaagtatcatgaaacaaagcattattagcttctgcaatcgaaagggatttggcatagagatgcatgtatgtatctatcaaaaaagcagtgcactgacaatttcaggaattagtatgctttttgctgaattgtgttggtgttttgcatcagaataaggcaaattttatttgcaatctggatttgcagtatagatatcctgcagtttgttgtctgtgagttatgattttgctaatatttggtcattttgcattttattatgtagaacaacattactcatctcactcgataaattgttccgtaaatcatttactcaaatcatatttaccactattcagtcatcaactactaagttcaatatcacttccttgaacttgattaggtcaacacattttagtggaaactggaaaacatgaactggaatcaatttgaacatttccttgttctgcataacttttggaacctcgtaatagttgcccttttcagttttcactagtcagcttctgaaaaatatgcttaaatttcaggaattagtattatcttttctgtttagtgaattattcgtcgtcatttgaatctggactaaagtgaaacatatttctagtccatatttacagttttgagataccttgagttttttgctttgagttcgacaggcatctgcctggaagaaaaatgataactttcatctatcatagctggagtagacagaacagatactaaatatttccttaaatttggaatttaccaccttttacaagtggtactcatcttagttttcatataaccgttcataaattgttaattgaaattctctccccaaattgtatccaatggtaccctggtgtttgattcaggaacaaatgttgtgagtgaaatgttgtttcctgagggaaaattccgttgtcatttacccatttggacctggattaaaacaaatcatatttgtcatctaaagattacagtttagattaccttcaaatccttgctttgtctgtgttgatagtttgtcagctggaatacggtagttaattttcatccattatagctggagtagacaggctggatactaaatatttgtttaaactggaaatttatcatttttacagtactactcttcttagtaatcactacaaccagtcataaattattccatgaaatcatctttatctccgaattatatctaccactacctggttaaatactgttttcaacttgacttacagaacaaatgctttctctctgaattataatgatttctctctgagtttgattgagagaacaaatgtgagagaaatgggagctgtcaaatgttttattattcctttctcaatggtacagaattaccaagctcatatttttgtcactaattttgctgaacagcttctgcatgaaatgcttaaaacatgccgcagctaaatgtggaaaaaggtgtcctaagtgccggcaattaatcaggtaaaaagctctacagttgtgcaatgtcattttctcgtagcatgtatagtaaagaactaaacgaattgtaccctgcagcaattcaagatcttgcacagtcaacacagtgctctggaacaccatccagctgctatttcctagtgaaaccgaggcaaggaggacttcaatcgcttcatcctcggaaaccaacgacgacttggcgcaacaaatctctcaaagaagtaacagcatggcacaaggtggcataagaagcagcagttccaatggcatcggctacatcacgcagcgcagcacaagaagcagcgctaccaacaacaggagcttcacaacaacaggcagcagaagaagcaccttcgtcgcacaggagggcagcagcacagcaacagggagaggctttgtccgggcttcgcagctggtccctagtgccagggtcgtctcagtgagatcacaccagtctgatgacgcggcattggcgtacaggctgcagcaggaggagttcatgacggctttcgagagcgagggcgagaggcagccacctcggagcagcagcagcacggtgtccgctgctcgagcgaatctgagagctatggcctcccgggccattcgtctccgagctcgtggctggcctgtctagttttggttgcctgtttgttctaatcttttctgcttactaattgctgattcttcctcatagtcatagcagaagtgtcgtggggtattctattgagtggacagatgtaatttgctacgaaataatggttcttcgctgtgtcaagtggccatcattcgttggcactcacaaggttcagtttgtgtaacagtcatatggcatgtcaagttaactcaacttgttcagtgttattgttccttgctaattcgaacatagtcggtttagcctgctaatgtgcctgcttagcttttattccgttttgtttttttttcccagtcaaacttctttatatttgaccatgcttatagaaacatttagcaatatttacaatacagaattagttacattaaatactatattgaacttgataatatgtttgttttgtattgaaatattgctattttttctatagtttgatcggaaaaagtcaaaccgacttacaagatgaaacggacattgtacattataagggtaagtgttaaatcttcccttcaactcaacggtggaaccgcgcctgggcttgagacatggaaaatttttgatggtcttatacttagaaattgatcagtaccatgcctcagccctaggcttagggagtgtttagatctagagtataaagttttggtatgtcacatcagatattatatagagtgtcgcatgggtgttcgggcactaataaaaaaactaattatagaatatatcagtaaaccacgaaacgaatttattaagcctaattaatctgttattagcaaatgtttactgtagcaccacattgtcaaataatggagcaattaggcttaaaagattcgtctcgtaaattagtcgtaatatgtgcaattagttatttttagcctatatttaatacttcatgcaggtgttcaaacgttcgatgtgatagggtgattttggggtgagatctaaacaccctcttagactgattatttagactgcttgtttggactagtaagaataaacatatagcctaacaatcctacaaacaaaaccatatgcttcagcgtctcgtcctccaactcctagaaggctagaatcactgtgatatagccgcggcggtgcatccgcttcaagttccaattctcaatgaaactgacttgtttcaaataaactgcaaaagcacgcacaaacgcatcactatacatacgaacaaactagctttatttttattatgttgttgtttttttagaaaaaaaaactgactttactatactaaataatagatatgcttctttccatctatagatgcgctataatttattgggtaaattgtaattgcgataatttattgggtaaattgtaattgcgaggatagaatgtagagaggggttttatggaccttacatcgtacttttggatagctttagtctttagttttgagcgctaggcttagagaaatcctggctctgccactacttctattcgctccatcgaaaagtctaaaacatatttctttttatacaaagaccaatgagcaattaactcattcaccatgtgacaaaaccaatgaatatgtaactactcccttcgtcccacaatataagggattttcagtttttgcttgcaacgtttgaccactcgtcttattcaattttattttgcaaatataaaaaataaaaagttgtgcttaaagtactatagataataaagtaagtcacaaataaattaattaataatttcaaaaaattttaaataagacgagtggtcaaacgttgtaagtaaaaactcaaaatcccttatattataggacggagggagtaataagcactaaaatagtttcttgggttccaatcaataatttaatttagcacattgtgactaaaaaaaaactttttttttaaaaaaaaaccaaagaatgtactcagtcttaaactttttgatggagagagtacctggcaagaagcattgtgtgattaataactactccctccttcctaaattaatcatcatataatagaatccatgatttctcaaatataaccgcatggagacacggatttaatcgaaatacaatttttttagcatgctagggtgtaattggcatagtgtcttaaacgatgcatgcattatgggccggagaatgtgtgcatgctgtcttgattgatgtgatttaaattatgcttagtataggtgtataaatatatatatatatatatatatatatatatatatatatatatatatatatatgatgattaatttgggaaggagggagggagtactgctcaatcatatggttgctatcggcaacaaggaataattaataaattatgctatttgcagtgtcaatgagtttttgct

SEQ ID NO: 31521 - DNA, 3467 bp, Oryza sativa
acttagaatttttcttagcaacaccaagatccttcatctcaaactcactagtcaattgtttcttcaatatagtgatttcttccttgctcttggcagcaatcagcatatcatcaacatataatagtaagtatataggtgatccattaataaatttaatgtatacacaactatcatattcagacctcttgaatccacgtgacaacataaatgaatcaaaccttttataccattgacgaggagactgtttcaaatcatataaggatcttttcaacttgcaaatataatcctccttactaggtattatgaactcttctggctggtccatgtatatctcctcctcaagctctccatgtaaaaatgttgtcttcacatctaactgctcaagctcaagatcatgcatagcaacaatactgaagaatgtacgaattgaactatgctatacaactagagagaacacatcattataatcaacaccaggaatctgactgaggccttttgctattaaccttgccttaaacctccgaagctcactaagagataaaccctcatttcccttgaatatccatttgcaatggatggtcttcttctgttttggcaagcgcacaagctcccatgtgccattcttctcgagagactgcatctcctcctgcatagctgagatcaacttctcacgatcatcagaaacaacagcttcagtatatgcagccggctcatgagtattcacttgttcagcacaactaaaagcataataaaccatatcacattcctcaattagatggactagagctccacaactcctctttgttctgcgatgtgcaataggttgatcttgtggctgcaaaacaggggatgagtgcttgacagtatcatgaacatcattatcaacaatttcaatttcctgatcatccacgtgctccacttgcacgctgacatattggtgctcctcatcaaaaccacctggtataacatctgtggacaagctctcattaaacataacagattcattgaaaacaacactcttgcacatgacaatccttttagtttcaggattccataacttatatccttttactcctaaaccataaccaagaaacagacacttaatagctctatgctctaattttccattatcaacatgagcataagcagtgcagccaaaaactctcaactatgaataatcagcaggtataccagaccatacctcaatgggagttttcttattaagtggggtagaaggtgacttgttgatcaaggcggtgttagtagcctctgcccaaaaacgcttgttcatacgagcgttggacagcatacaacgagccttcgagatgatggttctgttcatgcgctcagccacaccattctgttgcggagtgtacggggtggtgtgatgcctgacgatggtttccttcctgcagtaatcatcaaaagcatccgaacagaatgcaagaaataaggccacacttttctagagtaattatcgataatggtaagcatataacgagcaccaccattagagggcttacgagaaggccccacaaatcagcatgtacataatcaaatatacctttggtgcaatgaactgaggtattaaattttaccctcttgtgcttaccaaaaacatagtgctcacataacttcatgttaccctgagtacagctatccagcaggttcctcttcatcaattctaccataccaagttcactcatatgtccaagacgcatatgccacatgttagtcttactaggttcatcattagaaacagtggtagcggtaacagaaccatgcaatgtacttcctctaaggacatataactttgcagaattcagatcacctatcatataaacgagagagccttttgatacctttacaactccacctgaactggagtatttgtatccttctgcatcaaatgtgctgagagagatgagatttctcaccatccttggtatgtgtctcatatctttcagcgtacgtgtcatgccatcatgcgtcttgatctgaacagagccaatgcccacgatctcacgtgggttatcatctcccatacgcacgacatctccattctgcacaaacttgtaagaactgaaccaatctctgttaatgcagatatgaaacaaacatgcggtatcaaatatccattcatcatgaccagcaacacaaccagcaaaaacaataagacagtctcctgaatcagagttttcagcaccgagacgacagaggccttaccattggatttccttttctccttattctacagcttccaacattcttcaatgaagtgatctttctccttgcaatacttatagaacttcttacctctggacttcaaacaatctccaccggttctggctcttgccacgatcgttgctgttgttgtaggttctttgctctgacctgcaatgcttcgcccttggaggatgacacgtcagactaaaccatacctttcatcttctccctgttctggagtgcctcataaacttccaaaaggattagttcttcacggcttaatagtatggtgtcacggaaatttgcatacgaactaggaagtgagcataacaatagaagacctaaatctttatcatgaaactgtacctcgatcgacactaggttggcaacgatctccttgaagactgatatgtggttcaacatagaaccagtttcctgcaacttgtgcgagaacaacttcattttcatatgaattttactggttagatccttagacatgcagatcaataccagtttgagccaaagttctgcagcagtttgttcctgcaacacttttgacaaaatatcattagatagatgaaattgaatcagtaatagagccttacgatctttcctcttctcctcagcggtccattcatccttcttctttttcccgaagctttccagcgcctcatcaagatccgaagattgcgttagaacagcctgtgtcgtaacttgctacagcgagaatctcgtcttttagtctagcagcagtagatcatacttcatcgatgccatcccggaaccctaatgtgagaacaaactctgataccacttgttaggaaatgataggaaaacaaacaataaagaacaatagatcaatcatagaaaacacgagatttaacgtgaaaaacccttccaaagcaggagagaaaaaactatgaacaccagccagcaaaatatcttcactatatcggggtgaggttacaatgccgaacggcggcttacgagaagtgtgttatatatatatatatatatatatatatatatatatatatatatatatatatatatatatatatatatatgaaggtgaaatcctaaaaggataaagatccgtaccgtgacccccctagacgtcccgggccttcgcttcgctccgtccaaaactagcctttatatgtgcgcaaatgaatttggatcacaactcaacaacggcgacatgtggaacaggagaataaatcttcatttccaatctagaa

SEQ ID NO: 31522 - DNA, 17212 bp, Oryza sativa
cattaaatatatattaaaagaaaaactaattgcacagttagagagaaaatcgcgagacgaatcttttcagtctaattagtctataattagccataagtgctacagtaactcacatgtgctaatagcggattaattaggctcaaaagattcgtctcgtcgtttctaggcgagttatgaaattagttttttcattcgtgtccgaaaacctctttcaacatccggttaaatatccgatgtgacacccaaaaattttaatttcacgaactacaggccctatatttcttctctgaagaagaagtttcagacgatgggttcaaatcgcttttaagaccaggaagtacagcggcgccagtctagatccaaaacttttcttcaaatttctaattttttcatcacatcaaaacttttctatacacaaatttccaacttttcaactaaacttttaattttgacgtgatctaaacgcacccatactgtaagcagcgtgaaccactgaactggcgctacgctacatctctgaaagtccaacgtttgtaaaatcattgacgctgtccaggaatttttccatttgaccgtcaccatttttcccttgaagaatcatgttgtccggtgcatatgaaatttttggagatattatattttttgaagtataaatttagttttttttcttttggatttattttttctttttttctttttttgccatgtggggggtggttagtccaagttacccaacatgtggctctgtccctctttccaatactacaaaagaaacacgagcttttctccgctacatgaagacgtccgatcaaaggggaaaagtactttttcggcaaaatttatagtattaagctaaagtttggcggtcattaatcataacaaaaagaaccataaattaatctctaaagtttaaaattcgatatagcttacaagttacaagagaaatacgccacttattgacttcttttattcattaggcaccatatcctgtacttttacatcgaaatcacacaggcttgcttctctgcttagtcacaatattaccagctccagcctccaggttacttagcaagcacaaaactttaacccttattattatcccaaaacataataaaaataataaaaatctatctatcgctaatcattacttaatttaacttaaacctcactaagctcctctcccttaaactcgtacgcgtcgctcttcctgacggcgacgaagagcggctccttcttcctcgtggcgaggccgaacgtctcgtcgaggttgacgtcctcggcgcgcacgccggcgggcagcgcccactcgaagtggtagagcaagctggcgagcgacacctgcacggtggcgagcgcgaacgtgtagccggggcaccctcgccgcccgccgccgaacggcagcagcttgtagtccgggtccttgaggtcgatctcgccgccgccgccggcgctctcgaacctctccggcgagtactccagcgggttgtcccagatctccgggtcgcgccccatggcgaacgtgttgatgaacacccgcgtcctcgccgggatgtcgtagccgcccagcgtgcacggcgcgacggactcgcgcggcactagcaacggcaccgccgggtgcagccggaacgtctccttgatgatggcgcgcatgtagtggagctcgccgaggtgggactcctcgacgcggccgctgtcgccgacgactcgccggacctcctcctgcgccttcttgaggatccgtgggtggcggactagctccgtcatcacccactccagcgtcgcgaacgtggtgtccgtgccggcgacgaacatgtcctggtggttgttgtcacgtcatgtcaagatcagaggaggagcaacaatggcggcgagtcaattcgagagttttaatggtgggtattaatggcgtaccaggacgagggccttgagattgtcgtcggttagggggacctcgaggtcgggggatttctggacgcggaggaggacgtcgacgaagtcctcgtcgcggtcgccggggatgcgctggcggttgccgctgatgtgttcgtccacgatcacgtcgcaggcctcgcggaggtcggcgaggcacttcttgaggcggcggcggagtccggtgacggtgctggcgacgggctcgagctcggggaagaagtcgccgatggtgaacccggcgaagaggtcctgcgcctcggcgagcaccgcgccgagcttgtcgccctcgccgtgcgggaaccggcggccgaacgcgacgcggcagagcacgtcgttggcgaggttgaggaagcactcgctgaggtcgacgggcttcgccggcgaggtgttcttggtgaggtgcgcgagcaggcggcggagctccttgaccctgacggcgccgtacgtggcgacgcgacgcgccgacaggagctccgacaccaccacgcggcgcgccatccggtggtacggccccgccggcgcgaacgtcacgtcggagcagccgaacgacaggaactggccggagagcaggtgcggccgcgacgccagcgcggcgtcgttggtggtgagcgcggcgcgggcgaggtccggcttggagatcaccaccgccggcacgctccccagccgcatccggaacagcggcgcgcgcatggtgcgcgccagctcggccagcgcgtggtgcggcatgccggacatgaggtggaggtgcccgatcaccggccaccccggcggcgacggcggcagccgccgtggctttgacgacgacgaccggctcctcctcaacgcgaccaacacgtacgccgcggagagcacgagcagcgcgagcgacatcgtcgacgccatggtgagctccatatcgtcgaacacttggggtgcacgtttggtccaagaaacttaagcagcaatggagatgtgttggtatgaactaaccgtggttaagtggggaagggtttatatagtgggtggttggttggaggagaggtagatgcacacgttgggcactgaagattttcattagatttatcacatgagttgaagagatcaacgttatctgagatcaaggtgtggaatgcgacagatagtgtatacttgtgtagtactctaactagtaagatggatgttgaaacagcgaattaatgtggaattaattgcatcaaattatttatgcatagactactgtagacagaaatatataatcatcatgcatgattgcattagttgctaccatccaagataaggaaattaatattgacggcatgaacagtaatgtgatagaaagatggcacgtgtgaagtgcgtatcgaccaagcacgctcctcctatactcctgtgtctagttcgcgaaaagaatttttttaatgtcacatgggacgtttgaccggatatcggaagaggttttcgaatacgaatgaaaaaaataatttcataatttgtctggaaatcacgagataaatttattaaacttaattaatctatcattagcacacgtgagttaatgtagagatccaaaagcccaaactgattaatgaagcaattcaaagccctaatttctgaagtttaaaattggttgccacggctcagtcaagcatgccccaactaccaaccagagaggtctgacctctatattttatactttatatgttctccctttgttttatactataagccgttcttttctaaacaaccgtagttaggtttcactgaatttataaaaaaaattaacaacttccacaacaccaaattatttcttttaaatataaaattgaatatatattttgataatatgttcgttttacgttgaaaatgttactatatttttctataaaaaattatcaaacttaaaaagtttagctagagaaaaaaatcaaaacaacttacaatattaaacgaagggagtataatatgcccactttacagtcacagatgttacatataaagcacaaaggctttgtttagatcccaaacaattttggccaaaaacattacattaaatgtttggacacatgcatgaggcattaaatgtggggaaaaaaccaattgcacaatttgcatgtaaattacgaaacgaatctttcgagcctaattacgccatgatttgatatgatgctaccgtaaatatttgctaatgacggattaattaggtttaataaatttgtcttgcagtttacaagcgaaatctgcaatttttttttgttattagtatatgtttaatacttcaaatgtgcgtccgtatactttaaaaactttacacccaaagaactaaccacacccaaaagaaataaaaatcatgcacagatgtcatttgagaggaatatataatgtgcccgctgcactttgacttagtgaaacggacaaatggacaatactgcagaaaagtcaacccccataagggctgtgcttagttcacactaaaataaaattgaaagtttggttaaaattagaacgatgtgacggaaaagttgaaagtttatgtgtgtagaaaagttttaatgtgatagaaaagttaaaagtttgaagaatctaaacacggtgaaggttcaacaatctacccagaagccagatccggagtcagaaaatttggttttccattattttattaaaaaagtagagaagagttttgcctttcaaatatcaccagcaaataggtacaacgggagtagaacgtttgcagtatgaaatgcgcaccgggtggagatatttcatcatttgtgttaattagcattttgaaaactaaccttacttaaaaaacataatagaacttaaatacatgcatgagtgccgtacattaatatggaaaacaaaaataatttgacatgttgaacattcttgatataattaagggttaattggattggtgccaatataactttaacggttttcaaatacatcgttactatttaacaatttgtaatcatgccattataatttccctattatttgatatatgtcattacgtaccctttagaccattctacaattttttttggactaaaatgccctcgtcttcctcctccaccctcctttctaaacttcatcccttctcccctttcttctactggctgcagctcagcttctctcctccatctctccatctcctccatccctctccagtctctccaagcttgaaaaacgtgtggcactcgcagcgtcgccgctaattcatgtgcacgcgctgtgacttaagagcatggaaggaggtgtcgggaaggccaatgttatcaaatgacaacagcgttcagatgtactgtgtgcgtggaagctgaatcacttggacttcggtggcactgcatgcacgagttaagttcgctgcccccgaagtagcagccactttgaatacaccatgaaaagacaaacatttaaataccacaagttcagtggtacggaaccatatttgaattccatgtggcatatatgtcacatcaatattacgtaagattatgaagggatccctgcaatcttggatcgaaatgacacactttatattggtggagaaatcatctttgatcggtctggcaaaatccactttatacaagattgtttttagtcccagttataaaaattttgatctttagtcccggttggtaatctttagtcccggttcatcccctgtcaaatatatgtcagggggccgaggatctttagtcccggttggtgtcaataaccgaaactaaagatcaccactttagtcactgttggtattaccaaccgggatgatctttagtcccggttgataaattgaacacgtatatataatccctatcacttatcctctcctccacagttacaacttaggcagatcgaatctcgccccctctcctcagatctatcctctctaactctcttcctcatcccctttcctccaactcctccccttcctcctccccttcccatccggcgggcggcggctagcgcggcgggaggtggggcgaaggccggcggggccgcgcccagcggtcgtggcgagcggcggcagtggcattgttttttctttttttaaaaaaaaaattgtgattcactaagatgtacaaatttatgattcattgtttggatttgtgatgtatttgagtattttttaggatattgtgatgtatttgatttgtgtgtataagtaactttatgatttgtgatgtggatttggtgatgtgaatttgggacgttactttgatttggggattgatttggggatttgcctaattgattcgcgagaaaataaaaagaaaaaaagaaaaaaaaaggggaccatctggtaccgccgctattatctctttagtcccggttggtaacattaactgggactaaaagatcctctctctttagtagaactaaagatccctattatttcaaccgggactaaaaatagacatctttagttccggatccttactcccggttgaaaaaccgggactaaagaagggtttccaaccgagagtaaagatagtttctccaccagtgttaagaagtttaaatagctgtatctataagagttttagaaactaaatgacatggcctcaactttagatagctagcgtacttcactcataatatattcgcagtatatcaataaatataaaacaacatcgtacgttgtattcgatcaggaggagcactgaagtacagtgacgaatccaacatgaggcaggtgtgcttgagcccccgctacatactgttcaattcttccggataaataagttgttagggaagaaaaggataaataaatacaagatcactattaatttcataaagatgcttatatgtaaatattagatttattttatatttagtcaacttggaatatatttagtcaatgccattcttctccggaggaaaagatgccgcataatgtgtaccctaaaatttagttctacgtttgccgatgctgaagtacggtgtacgagactacataaacaacatcgttgaagtatactccctccgtccaaaaaaaacaaaccctaaatttccgtgtccaacgtttgaccgtccgtattatttgaaaaaaatataaaaaaaattaaaaagataagtcacgcataaagtattaatcatattttatcatctaacaacaatgaaaatactaattataaaaaaatttcatatagaacggacagtcaaacgttggatacagaaacccaggtttctcttttttttttggatagagagagtaaacttgaattgcactagaatataatcattcatcaataaattaagctcatgtacattttttttatctttttagagaagggtaatttttacccggcctccacatccaactggatatatacggccattgaaatagagaacttagcaccgtaaacaacccaatctaaaattcgctcctacgaagatttgaactcagaactttaaggtactactcggataactgcaaccactgtctctcgtaagctcatgtacatacatgtatgaaatagcttaaaagttaaaaagatgaaaagaacagaagttgcgccgttcgttcactggatcccccaaacagtcaaacgtcgggaaggacatgcgacgtgttcctcttacgacgtgttcggttcataggccgttcctcttacgacgtgttcggttcatgcctgcgagactttcgtcggttaatccctcctctaagaaaatcaacaggatttatcttgtttctattatatgtggaattaatcccttcaattcgcttatattagagattaaccgaccaaagaatgagcaaactaattaaaggattaactaaataaactttagtgaggttaatttggcagtagcatgcaggtccgggaggtcagccacggaatccaaggtgccgcggcgcccatcgatttcgattctattcgatttgaccgggacaacccgatactactctctccgtctcgaaaaaaacaaattctaagtttccgtgtccaatatttaactatccatcttatgttaatctttttataattagtattttaattgttattagatgataaaacataattaatattttatgcgtgacttatctttttattttttttaatgattttttaaaataaaacggacggtcaaacgttggatatggaaactaaaggtttgtcttttttttttttacgggggagtacgcttcaaactactgtagtatctaccaacctagcggtgagcttagccaacgccggggtttttttgagaacagccaacgccggggttgaccaggcgtttcctggcttggctgctcgctcgctcgctcgacgacgatgacctacatgaccgaccaatcgcgcacggcgtcgatccggccgcacaggcttacgtatacacacgcatattcggaaaaagcggttggaaagggtgacatgtcgtaatcgctacggtgggcacacgcacgctcgtgcccatttcctgaatttcaggcatctaaatatttataaattttcagtcacctagaaactactctctccgtttcatattatatgtcggtaagcttttttcttagttacaattctttagatttgacgaaatttatatagaaaaaaagttagcaaaatttacatcaccaaattagtttaattaaattgaacattaaatatgttttgataatatgtttattttgtgttgaaaatattagtatatttttctataaatttgatcatacttttaaggtggtgtttgaatctcctgaagataaatatcaagataaagattaagtgtttcacgcaaaacgagttggtaataacgtgtgcttaattgagttttagttattacaaacttgaaaaatagattaatctaatattttagaataacttttatatagaaagttttcgcacgaaacgcaccgtttagcagtttgaaaagcgtgccatgaaaatccaaaacttcatccggtatttctagtgaaaacgaatggggcctaagtttgactaagaaaaaaccaaacaacttataatatgaaatagaggaagtacatggtattaaaatttcatatcaactgaaaaaattggtacagtgggagtggtgatttgtaacgattgggacagtgccatatattttatcgtgccgagcgtgccgatgtgctgctaatctgaactaaatctttagttacggttattttacgtgggactaaagatagccatatttaattttagattcatggtcctggtttgcaacccggaactttacgagagttgcaaaccgggacggtttctccaccagtgagacccggtgggggaatttgggatcactaaactgatgattaaaactgattcactgaaggtgacaaatatgtgcctcaaatagaattcgataaatgatttaggacgtgaaaacaatactaaatggattcccataatcaaaggtggtgtggactcggcgctcgccgaataaagttagtcatatgttagctgaagaagatgtttttgtagaggtgttttatgacatgggtttcggtttctccggaattcatttattaatgtttggcagatgactgtaagcccgatatacatgttaatagagctaggcccgatttattatattaaatctcaaaggcccataataaatgttaagaataataatgccacctcaggaattaaacgaggagtatctcaacttaaatagggagttattggaggctccctgttgaccggttgaggtggaaatcggaaagccacacgcgcgccggggcgagggcgtggcgtgcgttgtgtctgcctgcctctatcctttttgcaacgaccgatcccacgattgcctccgtaacggccaggcgattcaattccaattatcgcgtcggtcgatatcagtcctgcgatataaggaaaccgctaatccgatcagatctctctcgcttgctttccatctctggtgttcttcctcctccgcgcgcctgtgctgcctctgttctacctccccgcttctgatcgtttgcgcgcacgagagatcggaacgagcagggcctccggaaccacaccttcgcctgagatctgcaccggataggcgggtgatcaggtttttggggagtgcttccgccgccgccgtcgccgtccctggagccgctgccgccgtccctggagatggcgcgccaggagccggagccgctacaaacgtcaacgtcaacgaaggcagttctgcctcacaatccagcggagggacattctcggggtatatctttctcctactgttaactcattctttgatacctctgttagtcgtgttagtcgcaattctattgcgtttttggtatgttcatgatgcttattataccttaaacatgctcctggttatatttgattttatcactagatcaccccacattgttcatgccatgattattgtcttaatattttggattaaaatatgccgatatatgactatatttccaacaatccaaaaacctgataggtcattttcggtagttggctttgctgctgcactaaaatcatatgcatttgatggttctaactataagaggtggaaagcacgtacactattgtggttgacagcgatgcaatgcttctatgtttcacggggtaaacgaagtgaaccacctctctctcctgaggaagaggttaagttcgaggcttcggattgcctgttccgtggagcattgatcagtgtactggctgacaacatagtggacgtgtacatgcacatgccttccgggaaggacatgtgggatgcacttgaggccaagttcggagtttccgacgccggcagtgagttgtatgtcatggagcagttctatgactacaagatggtcgatgaccgttctgtagtagaacaagctcatgagattcagatgctggctaaggagcttgagaacaacaactgtgagttgtcggacaagtttgtgtcaggtggcattattgccaaattgccaccttcttggtcggactttgccacttctctaaagcacaagagacaagagttcagtgtttctgatcttattgggtctttgggtgttgaagagaaggcgagggcaaaggacaaccggggcaaaaaggttgagggaggttctagtgccaatatggtacagaagaagaaccctcatgcatcccacaacaacaagaaagtcaagcctgatgtcaaacccaaggctacaaccaattttaagaaaaaaggcaagggaaaggcaaagggagactgctttgtgtgtggcaagtctgggcattgggccaaggattgtcctaaacgcaaagacagaaagtctgccaacatggtcattagtgagagcggaggaacatcggcgtacggtaaaatattacctatagttctctctgtttttcattcacctgattggtgggttgatactggtgctaatattcatgtatgtgctgacatttctctgttttcttcttatcaggtcgggagaggttcctccttgttgatgggaaacaggtcgcttgcggctgttcatggtgttggtacggtcgatctgaagtttacttcgggaaagaccgtgcagctgaagaacgtgtagcttgtcccttcaatcaagaagaatcttgttagcggctctctattgtgtagagaaggttttagacttgtgtttgaatccaataaatgtgtcgtatctaaatatggaacttttgttagaaaaggttatgacagcggaggcttgttccgcttttctttggataacatgtgtaataatcataattttgtgaaccatattagcgacaatgatgagtctaatgtgtggcattcgcaactttgttatgtgaatttcagttgtatgacgcgcttatttaacatgagtttaattccaaaattcactttagtcaaaggttctaagtgccatacttgtgttcaatcgaaacaacctcgcaagcctcacaaggcatctgaggcgaggaatttggcacctctagaacttgttcattccgatttgtacgaaatgaacagcgtgttgactaaagggggaaagaaatatttcatgacactgattgatgattgcactagattttgttatgtgtatctattgaaaacaaaggatgaagcattgcattactttaagacctataaagctgaggtagaaaccaacttgaaaggaaaatcaaacggttgagatctgatagaggtggggagtatttttccaatgaatttgcatccttttgcaaagagtttggaattattcatgagaggacgcctccctattcaccccaatcaaatggggtggctgaaagaaagaaccgtactctaactgagatggtgaatgccatgttagacactgcggggctttccaaggaatggtggggtgaggcagttttgactgcatgtcatgtcctgaataaaattccaatgaagcataaggaagtgacaccattcgaggagtgggaaaggaagaaattaaatctctcatacctacgaacatggggctgtttggccaaggtaagtgtacctatagccaaaaagcgaaaacttggaccaaatactgttgattgtgtgttccttggttatgctattcatagtgtgggttatagatttttaatagtaaactctggagtacccgacatgcgtgttggtacaattattgagtccagagatgctacattctttgagaatgaatttcccatgaaacatacacctagcacttctagtcaagaaattgtcataccccatgagcattttgcaccgatagaacacaatgatcaaacgcctgagggaaatcctaaggaggacaacattgtagatactcgtaagagtaagagacaaaggtttgcaaaatcctttggagatgactacattgtatacctcgtggatgacaccccaagaaccatagaagaggcatattcgtctcctgacgctgactactggaaggaagcagtacgcagtgagatggactcgattatgtctaatggtacttgggaagtcgttgagtgtccatatgggtgcaaacctgaaggatgcaaatgggttttcaagaaaaagcttaggcctgatggtacaattgaaaagtacaaggcaaggcttgtggccaagggtcatacccaaaaggaaggcggggattttttcgacacatactcaccagttgctcgcttgaccacgattcgattagtacttgctctggcaacctctcatggtcttctggtccataagatggacgttaaaacagctttcctaaacggagagctggagaagaagatctatatggatcaaccagacgggtatgtactagaaggtcaggagggaatggtgtgtaaactgttgaaatccttgtatggccttaagaaagcacctaagcaatggcatgagaagtttgacaccacacttacatctgctggctttggtgtgagcgaagctgacaaatgtgtgtactatcgctatggtgggggagaggcagtgatcttgtgcttatatgtcgatgacatattgatctttggaaatagcctcaatgtgattgaggaggttaaggactttctgtccaagggttttgaaatgaaggatttgggagaggctaatgttatccttaacattaagctactaagaggagctgagggtgggattacacttgtgcaatcccactatgtggacatggttttgagtcgctttggatatagtgactgcaagccagctcttactccttatgatcccagcgtgctattaaggaaaaaccgaagaatagcaagggatcaactgagatactctcaaatcattggtacattgatgtacttggctagtgcaacgaggcctgacatctcatttgctgtaagcaagctgagccggtttgtctcaaatccgggagatgatcattggcaggctctggaaagagtaatgcgctatctaaagggcactatgagctatgaaattcactataccgggtaccaaaagtactagaagggtatagtgactcaaactggatatctgatgctgatgagataaaagccacaagtggatatgtgttcacacttggaggtggcgttgtttcctgtaagttttgcaagcagaccatcttaacaaggtcaacaatggaagcagaacttacagcactagatactgctacagttgaggccgagtggcttcgtgaactcctaatggatttgctggtggttcaaaaaccagtgccagctatcctaatgaactgtgataatcaaacagtgattattaaagtgaacagttcaaaggacaacatgaagtcatctaggcatatcaagagaagactgaaatctgtcagaaagcagaaaaactccggagtgatatcattggactatgtccaaacggctaaaaatctggcaggttagtttatcaaggggctaccacataatgtgttagacagtgcatcgagggaaatgggcttgatacccacctaaggttgcacaatagtggaaacctgtccattgtgatcggagatcccgtgaatttggatggtgaaataaactattgtgtgaatgagagaagagacccttgaaaatggctcattttcatgatgtacttctcttcttttctgcatggtaggatggctgatgccttaatgtgatccgagtggcttttctaagcagagatgttgacctgcagaacatctcaaaaggaacacacctatatgagtttgactgctagtcacagtctatgagatttgggcgatctctagatactcatgaaaaggcctgtagtttgacttatatgctccaaacagaggggatgcgaacggcagcccagtaccagtcaagggtttgagtgaaacctaatcacacaagactgataattcaaggcatagtccattgttcagttgtggtttgatgtagctcatttcctaggtggaagttcaacttaacagtctccaccaaaacactggtatatcaaacagtcacaaccttgagaacatttcttgtgagccttgaaacttggtggggattgttagaataattgggctaggcccgatttattctattaaatctcaaaggcccataataaatattaaggataataataccaccacaggaattaaacgaggagtatctcaacttaaatagggagttattggaggctccctgttgaccggatgaggtaggaatcggaaagccacacgcgcgcgttaaggttgtcacgaccggaaataacccaacgggcgttccttacgtgcgtgcattattccttgttccaggaggcaaggtacaccaaaagttgatacagttcagagtttaacaagcggaagcgtaaatagttaatttattacatgggcggcgaaggcccagcacacacaaagacaaacgggaaacagtggaagactagggcgacgaccacaggcgcttgacggtaggcacgagctagacaccaaagccttcatcttccaggggctcctcttctgggtttgggaaaaaattgagcaagactgagtacaaccaccgtactcaacaagacacacccacaagtgcagcataaatgtaagggagtacaagggagttataatataaaggattagggtttgcagtaaacagcattaaaagacacttagttgctcaaagctattttgcaaacacgattctagagctatacaatattattaatcaaggccgtgaacccacacgaacctgccttaacccaaggcctacgatgattcagaccgaactggcaacccgaccctgagtcccagctcgtcccaagccaacccaggccaaccattccacattttagttgttaagcatgttttaagaattaaaacactaacttgggtacattgctcggctttcccataaccgaaggcgcggctattcgaatagattatactctgatcagaggtgtacatctttacccacaagacacatcttcctcacgtgtaactacgtgccacataccaccacggtatacggccggaagatgtgacatagtttccaacccatcctagccatagacaagagtaccaacccaatcccacctacggccggaaaccccgggacaggtaggcaggactgagcccctagcagcaggacaccggccctgtgccatgacatctcgactaccgggccgcagcttgtgtagccttcatttgtcctagagatgtccatcgacccccgacttcgtccatctctatccgtgtacttttgtttataaccagactgagccacaaactaagccttacccactagacttgtggaagtacggtagtgctttgcaacagaggcccgaagaccggtccttatatggccgaggtgctactatcaaaaccatacaccccgagcccagcctaaaaccatttggaggattttgaatagagggggaggtgtgaatccaattccacaataatccaaccattccatagtgtccaggtgataagaatatcccaaagtctagagttgtaaaaccacctaatgttgcctaattaaccagcgaagcatctacctaaaatcatactagtggtaccatgagtagagtgtccactagttggggttttgtttattctagggtgaacaaggaaataataacaataacaataataaggtcataataaaggtacataggcatggctagataaaatagtgataacgcgggaatttaaataaagcgataatgcaataatttaaatcaaaataattttataaactgggattcaatatgttcaaggatgatgtgacttgccttactcgctttcccaaacatcggcttcaacctccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggtcatttgaagtttatatgctctttaaatgaatatttgcgaatttcttcatttaaattttaattttaaaagggtttattgcgtcagccgaggggagggggcgcgcggaccgggtccacgggagtggggcccacgcagcagcctcacggtccacggtggactgggcgcactcgggctcgcaccggccagcgccgtgggtcccacgcgtcagccgcacctaagggcgcgggcggctgatggccgggccccacgcggcagccactcggtgcgcccgagggcagccaagccggcgcagccggcgggaggcggcgcccgcgcccctatggtcgccggcggtggccataggcacggcggagcggtggccgagagaggggaagggaagagggaaaagaggcggcggtccacggctcaccctaggtcgacggcgacgacgaaaaaggcggccggagcgaaggaaggcggcggcgcggctcgggtcgacggggtcgacgga

SEQ ID NO: 31523 - DNA, 8431 bp, Oryza sativa
cggcggcggaccggagctcgacgacgacggcggagagagagagagagcgatggcgcgagcttgattccggcgaggaggaagggcggcgagaggcggaaacggacggaggaggtgcggggagggtttaaatagagccgggacgagagagggcggccggggaaggaaggaaaccggcgcgggaggtcggccgccatcaatggcgccggcgagatttgcgggggcaaatctgcccgtttgaacgcgggagagagagggaaaaatggggggaaagggagaggggatcacggggagtgattttcccctctttattgcacgcggggacggcgggattcgcggcggcggtggcgctagggcgcgggcgaggcggcgggagcggcgggaggaaggggatgacgggtgggccccacccatcagcgagggtggcgggcgggcccgcccgtcagcggcgcgcgcgcggggagaggccggatgggccgcggggagaggagagggagggggagggagatgggccgagccggcccaagagggagagggagggaaaggggactttttagagtttttctttttataaaatcattttaactttgtttatttcttaataattattatttgtgctctgaaaattccactaaaatttatttacgcattttaggcttttaggaaatatacaaaaatccttcaagccttatttgacttttaactttgcacattttaattgttggaggctttcacacggattttaattattctaggtataatttagaggatgtattttagagtcgttttgagacgcgacaaaggtgggcatgggcgagggcgtggtgtgcgtgcgtgcgttgcgtctgcctgcctctatcctttttgcaacggaccgatcccatgatcccacgattgcctccgtaacggccaggcgattcaattccaattatcgcgtcgttactatggcaactggcggatatcactcctacgatataaggaaaccgctaatctgatcagatctctctcgcttgctttctatctctggtgttcttcctcctccgcgcgcctgctatgatataaggaaaccgctaatccgatcagatctctctcgcttgcattccatctctggtgttcttcctcctccgcgcgcctgtgctgcctctgttctgcctccctgcttctgatcgcttgtgtgcatgagagatcggaacgagcagggcctccggaaccacaccttcgcctgagatctgcaccgggtaggtgggtgatcaggtttttggagagtgcttccgcacgactgctctcgacttctgctctattcgtcgtcgtctcgtcatccaccatgtttgcaactggagccgccgccgccgccgccgccgctgccgccgtccctggagatggcgcgccgggagtcggagccactgcaaatgtcaacgtcaacggaggcagttctgcctcataatccagcggagggacattctcggggtatatctttctcctactgttaactcattctctgatacatctgttagtcgtgttagtcgcaattctgttacgttcttggtatgttcatgatgcttattatacattaagcatgctcctggttatatttgattttatcactagatcacccccacattgttcatgccataattattgtcttaatattttagattaaaatatgtcgatataagactatatttacaacaatacatcaatctgttatatactaaagtccattaaaaatcgtacaaatgttcctgtgacatcttatggtactactacaaacgatctaaaccatcatgtgacgttctaatctctatctctactattataaaaattcaaggtgtttttttcaaggatttttagtacgtcactaggagatcatgtcggacacagttatcgtaaacttcagacgttcccatttctttccgttttttcgtctgttggaatcgctcgcgtcggatgtgagaatcatggagcgaaggagacaacccggctgctcacgaagatacaataaagtggcgagcccacaggccccagcccaccaccgcacggcccctctaggtgatgagcgtgtacaggtaggcattgaggcttacagccggccagcgatattcaacggagaggtgaatcaatctactcatttatccttcttcgatccattgtgccttgggttgtgtttgtatgctcggtgtagataccatacttctgcagacctggctaccagttccagcccatcttaaattcaggaagttgttgcggtgcatatctatatatctatatacctaataaaaatacgcaatgactccggtgaaaattttcgtccgtcctcacctaaattttttttcgttcgtaacatctgagttcaagaaacaaaatcatctagagtctgcgtcaaataacacaaaaaaattaaatcaattcgtgttacatcccaaatacatgaattgaaaaatggcaaacgaaggaaaaaaacaatcgaacaaaaatctagccaccggacctcaccggaaacacgagtggtacgagtttgccaccgtggagctcgaagccaccgtcgtcgccttcgagctactgccactgcctcccaaggccagatccggtgaggaggaggcacggagtggccgccggtggtggcttggttgagttgtcactgccgcccgccaccgtctcccaaggttagatccggtgagcctcaagcctgatttggcgaggagcgggtagcgttggcaccctgacgaggaggaaaggggctaattgtggggagagggagagcgccggtgaggggagggcgagggggagcagtgccgcccgtgaggaaaggggagggagggggagaggcgccgccagtggagagagacggcccacggcatagagagagcggtgacgccattgggattagggttttggcgattcctgggcgaccgggagacgccggcgatatcccacattgtgggatggcttaggatggagttcttctccgatccggttacgtcgtttgcagggttttcgcctgccttgtttaacatcatggaggggtttttgtctcgggatcttacgtccttgggacaggtgattggttctcgactcggaggccagttcaagaaaattagtttttgctacgataacttaaggttggtaagtttttttcacatctatgatccatacatatcccctatcagactccgtttcagggatgttaggatccggaaggggaagaagtgccatgttcaatctaatctgttggagtctgtctcggtcaaggactctgtcgttcagtgctataaattggagagcctagggcaaggatctgcaccctgtacaagttccctgaagacaatcttgcaaagccgcaattccaatctgcgtctctcctgcttgtttggtgttctcatggcgtagtctgccggtgggggtgataaagggatcatcactgcgatggttgcccacccgaagccggccgggggaggtgagatcgtcatggcgaatcaaagggaggaggttctgaataaaggtactttagcaatcggggtagcaacaccagatgaaaaccaaaccacgatggaaggtgcgggtactgctgttgaggtggacagtacgactcatcaggggccagcagctttcattgagggggaggttgtggaggaggatgaggacgcaatcgaagtggttatagaggaagaggaagtgcagaaggctggccaatggactatattagcaagattctattccttgaagtctccaaatcttgccgctctctttgaagacatgcgtcgtgcttggcggctgcgatcagacatgacttacaaatcgctgagggataacttgtttatcatatcttttggtgctgagggggattataggtttgttatccaaggtggtccatggattcataggggggatgccctgttggtggcagagtttgatggcatcacctgtccgtcaaaggttactttggatgtgattccagtatgggtgcggatttatgatcttccactggtgctaatgacaaaggcaaggggtgagatatatggtagcaaactgggcagagtacgggaggtggatgttggggacgatggccgcaataaacatgacttcttccgtattcgtgctgatctctcagtcaagcgaccactaaaggataagttaaccatcaaaatctctgcacaaggtagagtggaaacaagaagttttgcacttcgatatgaaagagtgccacacttctgtttcatatgtggcttcatggggcatgctgataaggactgcgataagagaggtgcaaatgtggagaatccctttcgcttttcagctgatttgagatgctcacccttaaaaccgtttgagcgaaaagttaacaaggtcagagcaatgcagaacactggagcagctcgcaatctgttcttccgtggagctggaagtgctggctcatcgtcctcaaagcagagagatgtggaacagtgggatgaagccattccacccagagtggatgctcatgataattttgatgacaaggagaaggagggggatagttcagtagatgagcaattggctctgcaagccaatctgatgaatatggcagggacagaagggatagacaaagagcatgatgatagtcaaggtccgaagttaaagagtgggtctaatgttgtggccctggctggatcaacaggggaggccataccctcaaaagagatgattcatgctattgcaaatcttcagcaacaagcctcctttggggatgggtcgtcagatgactggagtggcgggaataggaagagaacgcaagacacgacagaaattaacaagccggggcgggtccagcaagcgctggtaatataccagagtgcaacggtgaaggatgcggcggatagtagagaagccggcaaggacacaagagcgctgaagcgttccaggaagacggaaggaggttcggaggtgtctaattcggaggcaaccagccatggggccgctggtaaactgacaggacctatgatagggtctcgtcaggagcaatgaattgcttggcatggaattgtcgtggtattgggaatgccacgacagttcgtgatctcattgccttggtgaaagaggcaaattcccaggtggttttcctcagtgaaacgagacagaagattgaaagaatccgcagacttcgttctagattaggtttaaaaggttttgttggatgtaatagtgatggtttgagtggtggtcttgctctcttttggcatgagtctatctttatggatgttaagagtgtgaatgaaagatatgttgatgcgtatatgcgtttgtctccggaagatcctctatgtcatgtaacctttgtgtacggagaaccgagagtggagaatagacatcgtttatggtctcggctcctggatctcaaacagtcctcccccctcccttggatgattattggagatttcaatgagactctttggcaatttgaacatttttctgtttctaaaagaggtgaggctcagatgagagctttccgagatgtgttacaaatatgtgagctggttgacttgggcttctcaggggtcccctatacttatgataaccgaagagaaggtagatcaaatgttaaggtgcgtctagatagagcactagctgataatagttggagagacatctatagtaattcccaggttgtgcatctaacctcgtcctgttctgatcactgtccaattctcctgaagtttgctgcggacagtagacagtctaaccgaaagaagtgtttccactatgagatttgctgggagcgtgagccggcctccactgaggtgatttctttggcctgggctgaagtaggagaaaaaagaaccttaggggacattaattttaccctcggaaaggtaatgggagcacttcaggggtggagcaaggtaaaatttaagaacgttagccgtgctatagaaaaggccaggaaggatttggcaacccttgttagccacaatgctgactatagtgagatcaggcgatcctctgatgtcttgaatgaattactttatagagaagagatgctttggctgcaaagatctagaataagttggttgaaagaaggtgatagaaataccagattatatctaaattgcgtgggcctgatggtaccgtagtgaagtcgactcatgaaatggagaaaatagagacagattacttcaaggatatgtttacagctgacccctgtattgatcagtcaagagtatcccgtttgttccaggaaaaggtttccccggagatgaatgtggatctttgcaaagatttcactgagcaggaaattgcagatgctttatttcaaattggaccgatcaaagcccctgggctagatggtttcccagctcgtttctttcaaagaaactgggatgccattaagaaggatgtggtttcagccgttaaatctttcttcgaaacatcaatcatgccagagggtgtgaatgatactgcaattgtgcttattccaaaagtggatcagcctatggaactaaaagattttaggcccataagtctgtgcaatgtgatctacaagattgtttctaaatgcctggttaatagacttaggccaatcttggacgaattggtctcacaaaatcagagtgcctttgtgcccggtaggatgattacagacaatgctttgctagcttttgaatgttttcacttcatccagagaaataaaaatgcgaataaggcagcgtgcgcctataaacttgatctttcaaaagcctatgatagggtggactgggtgtttttggagcagacaatgtgtaagttgggtttcgctccccggtggattaaatggatcatgacatgtttgtcctcggtgagatattcaatcaaatttaatggaacccttctggatacttttgctccctcgcggggtcttaggcagggagaccccctttcgcctttcctcttcttatttgtggctgatggattctcgagactaatggaagaaagagtagctgctggggatattacgccggtcaagatatgtcgaggtgctctaggcatctctcatctactttttgtggatgatactctgctgttttttaaggctgactgtgagcaggcaagactgatcaaaggggtgcttaatgagtatgctttaggcacaggacagctagtgaatccgaacaaatgttccattctgtttgatgatacttcccatgctgaaacacaggacgcaataaagaatttactgcagattgtgtgtcacaactttgaagacaaatatctggggttccccaccccggaaggaagactgaacaaaggtaagtttcagagtttacaggagaaaatgtggaaaagaatcatcttatggggagaaaactatctgtccagtggaggcaaagaaatcatgttgaaagttgtgatccaagctattccggtttatgtgatgagtatctttagactaccagagtcggtatgcgaggatctgaacaaacttgctcgcaatttctggtggggagcagataaaggaaaaaggaaaactcattggcgggcctggagctgtctgacaaaaccgaaacacaatggtggcttggcttttagggactttcgtctctttaaccaagcgttgttagcaagacaggcctggcgtctgcttgataaaccagatagtttgtgtgcccgagttatgaaggctaaatactatccaaatggatccttagtggacacggcttttggggggaatgcttccccgggatggagagctattgagcatggcttagcccttttaaagaagggcatcgtctggaggattgggaatggccggtctgttcgcatctggagagatccttggatccccagggaccattcttgtagaccaataactactaaaagaaattgcagggtgaaatgggtttctgatctgttgggacaggatggatcttgggacgttcagaaggtttcccgggtttttttgccgattgatgctgatgaaattctcaaaattaggacatcggtgcggctggaggaagatttcctatcctggcatccggataggttgggacaattttcggtgagaagtgcttataaactggcaatatcccttgattatgcagatgaaagttccagttcctctggacagaatccacagaagatatgggatctgatttggaagtgcaatgtgccccagaaggtgaaggtcttttgttggcgtgctgcaaacaactgccttgctaatcaggaaaataagaagaaacgtaacctggagcgttctgagatctgctgcatttgtgggaatgaaacggaggatgtcagtcacgctctaagtcgatgtccccacgcagtccacctctgggaggccatgaaagctgcagggagcctatccctgaatgttgccggaaatgctacaggaggctcctggtttttcgaccaaattgaaaatacaccagctgaggaaagaatgatgttgtgcatgatgctgtggcggatctggtttgtt

SEQ ID NO: 31524 - DNA, 5822 bp, Oryza sativa
cggtggtgtggagggcggcggcggcggatccggcgatggggaaggttgtggcgacggatccggaggcggggaactcggcggcgggccgaccgtgtgtggtcgagcttctccgcccgcccgaccacgatggtggccgtgctcgccctcctctccaccggcctctccctgtccctctcccgcgcggacctcgccgccgtcgtcgtcgctgagccgcggctgctctacgcgaaggccgaccgtgcgtcgtcgcgcttctccgcccgcccgaccgcgatggtggtcgtgctcgccctcctctccaccggcctctccctctccctctcccgcgcggacctcgccgccgtcgtcgtcgctgagccgcggctgctctacgcgaaggccgaccgtgcgtcgtcgcgcttctccgcccgcccgaccgcgatggtggtcgtgctcgccctcctcttcaccggcctctccctctccctctcccgcgcggacctcgccgccgtcgtcgtcgccgagccgcggctgctctgtgcgaaggccgacaccatcgctgccagcgctcggttgggtcatcccgtccgtcgtcgtcgccgagcccaccgccgccgacgtcgcccgagcccgccgccgccgctgtcgcccgagccgtctaccgccgccgtcgccgagccccccgcagccgctcatcgacgccatcaaggaggccggcggcgaccacgtctggaggtgagggcagaggcggcgtcggccatggttgttgcaaacggcgttgtcggtggttgtaaacggcgctcatcccatccctccctcgttccttgaaccaaacaaaaaactgggatcatcctattctacaaaccaaacacccgaatggaatcatcccaatcctcaaatcagggatggtttcatcctatcccacctagtcccagaaccaaacacacgctaagtggccgaatcaaatccgatctttccaacccaaatacccaattaaatagtccgagtacagagccaaattaagtgtcaaaatatacagctgagagtccatatacacagtccaattacaattatacactcccattacatgtttgcagtccatctacaaatttcaattacaattggaatgtacaaattctatttcctttttccctctccctcagcccagctttcttccctctgtcggcccagcaggaggtctgcttctcctccctttccctcagccaggcaaagccagcacgcacgcaaggtgttgggtgaaatgcctgcaagccatgccatccaaccaagccacagcacgtgaccctaccaactcgaacgaatgttggtgtcggccttcaagtcgtgggtccagccacgacaacctctctcccctctgcacccaaacatccagctcacaggagccctccccaaaaatcggcaacacagtgagaggaagctcacaccgaatgcaaagccgagtacacaccgaaaatgggagagcaagcgcagcatgaagcttaccttatacagtactcctccctctgtggatgtcgacctcgtcgccatccatcccatccgccgccgacacgtgctcgggggaagcctttgaccgacggtcacaacgccgcctccccaagccgctactcctcgtccacacgctcgtccttgtcctccactgctcatagacgggcgtccacgctgcacgccaccacgccgccactgtgccccaccgcgatccttctcctcgaagccattggcatcacaagcaaaaccaacgccaggagcgactcttcctccttgtgccgctctctcccctccgccgccagccacctctttccccgcgcgagctccgcctccacggccacgccggcccgcgcgacggcctccccttccatcgccgccgccgccgccggctgcctccccaaccggcgcccgaccacctcatgcccggcgcaactcccccacttccctcctctgactggcgctgcccccgcaactcattgtatagcaacgttggcgctgcccccgcaactcattgtatagcaacgtttgttaaaatatataacaagtaaatttaatataaaacatatgcacatttggttgattacatggttatatctgagctattgtctcctcatcaccttcttccccatccacccgaccttctcccccatccacccgacgccccctggccgccctcagatcgccgcccagccgggaacggccgcgccgacgcgggccgctccgagcaccgcccacggcagccttctttcccctgccgccgagctcctctctccccacctcgccggccatcctccctcgccgcgccgccgtgccgcctcctgccgcgccgctcggcccgagccgccggcgccccagcctcctcttccccaccaacgccgctccctctctcctctctcctttcccccaccgccaccctgtgccaggccaccatcgccggcgcctgtcttctctcgggcgcgcgtgaagtgaaggagccgaaggcaaagaagagaacgagagagagagagagagaacacaggaagaatcgggaagaggggaagaaaccggaaagagaagaaaaggataagaaaaggaaaaagggaagtggcacccacagcggggcccactgtcttgactcatctcggtggaacactttgactcaccaaaagtctatatcactaccctcttgctcgcctccactaagaagttggaataagttcactttgagtctttctatttgtctatttgtcgtccagtttgattttcgtcctttaattgcaaaaccggtacgacagatccttaaacttacaaaactgttaaaataaggtctcttagcagtatttgaccccggttttgggtgagttggtgctaggggtggaaacgagccgagccgagccaggctcggctcggctcgtggaagctcgcgaaatgccaggctcggcttggctcggctcggttctccaaccgagctgtacattaggctcggctcggctcgtggtctggctcgagccggctcgagctggctcgtgagctttgcaatagcagcagttgtattgccagcagcagttgtgttgctttgcaatgacttagttattcagataataactctcaagtccctacaaagataattaggtatattgtatgcagccaacatataacaaattgatgggcttttttggttttcggccagaagtctttctattcaaaccgagcctactaagctcgtgagctgctcgcgagctggctcgggctcggctcggttcacaaacgagctaaaacccaggctcgggctcggctcgttcaggattcgagccgagccaagccaggcgagcccgagccgagcttgagccgagttcacgagcccgagctatttgtccagccctagttggtgcctatgtggctagtttaactcggtacgtggcattgacgtagcgcttacgtggtaattcgatccgaaaaataataaaacctatgagacccacattgtcagttttacacaacaataataaaaaaaaatggtggggcccacgtagaccccacctgtcatcctcattacccttctctctcatcctctctctccctctctctagccggagtggcggggaggagtggcggcggccggagtggggctgggaggagcgggtcgggcacccgacgaggaggccaaagaacaggcggtgcgcggccagggcgacggaggcggccgccgcggcgccgcacgccacgacgaggcactcctgagatatcttcctgatggccctcaccacctttagcttccttgccaccttcctgtggctcgacttgatgccgcgaagaatggacgagtacatgtcgtggacccgccggaagctgctccgcgtcgctgaacgggttgctccgcacgacggcggcggcgccgccgtcgtcgctacggcgccatcggtggcggcgacgctgtcggagatggtggcgaggaagcagcccatggatatgtagttgctctgtgcgttcttgatgttcgtcaggaattgcctgcagatctcagacgcctcgtcgctgaagttgaagtagcctaccatcgccagctcgatctctgacgacgtcctccggtgcatcatccgctgcaattccgcggggacgacgcctctggtgcagcgtgctgatgcactcctcctcaatgctcatggattccatggctgtgttccaatacaaaccagaatttctctgcattattgatggcaaaatgaactgagtaacggacacacaagaacagataaacagatgacgaaaagctcaatgttctatctctttttttcttctctctactgatctcaccatggtgtgatgggcacatgaattgtccccattccaaaactcaatttcttcgagtttcttgatcttttgggacaagcactgtttgctttcttggagttccttgatctttttgacaagcccatcctaggataagtccattatacctcctcccgtccagaggatacccttgagaatatttctcccaaaattaaaggaagcctcttccaaattttgggtatcctttttcctcggtatatataaatccatatgaacttcagaaattcatatcttgcgaactccgattggctccgttcaacttccgtgattctcctaaaattgagatccatccaatggcactacgggtctaggatgattgttactttatttggaggattttgtatggttttcttgtattgatcgcatattaattaaatattcgaatagtcgtgctcatggatattgagcgccgggacttgtactactcttggctagcctcatagattgtaatcttgcttagattaggaattgaggtgtgaccttgcccgatgggcgggaaggtcattatgatgttgggaatgtggaaaactgaatgggagggtaaaccggaccaagcgaggcttggggaagatggatgaaccctcgcggattaatgacaacttcaacttaacgttgtttttcagttaaaactgctaggtcataggtttgtgaaatgaattatgaaaactagctttatgcaaagaaaccaagccatcctttaacccctgtgtgcactaaaggcatatgtagtggcggcttgctgagtacggttgttactcacccttgcttaactaaatcttttagataggaattggagttgaccatacatgcactatgctgatgaagagatgtcgaagacggtggagtcagacctaggttcaccagtcgatgcctgtggagtatattagaccaccgctgcttcgcttcctctatctcatctatttgttttggtactttgtaacgtacatgatcatgctcggtctatttggatcctgttttggctaccttgtattattaatttataaattaacctgtgtaacgatgtcagcctgtgatattcaactgtgccatgtgtgtactatctacggattcagagaatggtaatgtaaaacacatggggttttcggtgtacaaaaccgaaggcccatggtaggcctattatttttaaccattagatcaaatttaaaaaagaacaaataatttctgcctctacctccctctctgtaggtgacaggttagatcaaacttaaaaaagacatgtgcatgatgtctcctcgggtacgtatatacgtactctccgtccattacactggtggagaaaccatctttcgtcggtcggccgatttccacaatagtcccggatgcaataaaaaccggggctaaagatgatctttagtcccggttcaaaagggtaacgggcatatttgatctttagttccggtttgtgttaccaaccgggactaaagatcatctttagtcccggttctgaatgctgtcagggcctgtcaggccccccggggatctttagt

SEQ ID NO: 31525 - DNA, 627 bp, Oryza sativa
  unsure (1)..(627): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccttgacttgtctggacattcggttggttcacttttgatgccaaatttgtgtctacttggttggttttgagggcaagacattttttttccaagattcaaatggctaagtcagtggcatacgataaagcattaccataacctatagttatgtcggaggaccaaagctaggaaacacagccaacacaaagaagaaaacttgcctcgtccccagtgctgtcggtgatgtggtgcagccatccatgccattcagggggcacttgggatgcattgtagcgccctttctctgcatattctacccacctgtgccttcctgcaggggtaccagtatattcttttgtagaaagcatctctatttggaggagacagaaagtaataaacgttacattactacaaagacatgcgtaccaatcaagcccagggtgatcacttatgagca

SEQ ID NO: 31526 - DNA, 24609 bp, Oryza sativa
agaaagcacctctctttggaggagacagaaagtaagaaacgttacattactacaaagacatgcataccaatcaagcccagggtgatcacttatgagcaaagttacaaatctcaaaagtggaagaaaagaaaacaagatggcaaaaaaaaaaaaaagcaaaacaggatagcatagcatgtcttgttgtgagaagataattgatgctactctagtacattccatgattgaaatgaattaaaattgcataatagaataaaatgtagcgtatgcgagaaacctcactcaccatactgagtgtcatgtagtttttcataatatttgttgccgaacttgtctactcctacaagtgtggcgccgatattgtggattttagtttgcctgaaaagagaggatgataattactacattaggctgcggcgacctgtggggagacaaacagacacatccagatatgtgtaaaaaaaaagaataaacggagagctagtaagaagggggaacttacaagaggtttccatccagaaggcatttgctgcaaatgatacaaaagcgatattcagtttgatggagcaagcagatggtatcgagaaatgcagcgaaaagaaaagcgagggtcggatagccattggccaatcggttgggctgggcggcatgaagcaacaaccctaatcgaggggattcggtgctgaatcgaaggggagaggaaactagtatggatcggggcctaattaaagaggagaaacaggtagcggacgggacgcatggagatccggatcggcgccctgcgtagcatagatggaggaggagaggggttataggtagcttacaagtagccttcgtcgcgggcatggcggaggaagttggagaggcccttctcccggatgccgttcaacacgccacgcaccaccgcagccatggctcctcctcctcctcctcctcaatctctctctctttcttccgatctcctcttgggttcctgcggctgcgggtcggagtcggaggaggaagaagaggaacatggatgggccaaccacccaccagacttcatctgtatgggctcctcattcacctgggagcccatttctgggatgggccgagttttaggcgctgccaaaacttaatccaaatcacttagtatactactccagtacaagtactccctccgtttcacaatgtaaatcattatatcattcccacatttatattgaaattaatgaatctagacatatatatttaggttcattaaaatcaatatgaatgtggaaaatactagaatgatttacattgtgaaacagataaagtagtagattattagaaatctccaagagctccctaataccagttctaaaagataaattataggaatctaatctaaaaccatgtcttaaagagatatccaaagacggtcccaatatttactgacacccaaaaccattgatgaaatcatgggaggattttgccgctcgcaccttttcttctcctctcgtgacaatctagagttgtcgcatcctgccgagcgctcctggtgttggtgaccctccgtcacaggggcagtgctcagaaaggcatcgacaagctcgcctctgctccgactagtgtgcggcatccattccgtccaaggcgtcgctacccctccgtctagggcgtcgtcgagacaaccaagaaacctcatgtgttactctgtagtgccctgccgcgagatggccgagccctgtctgccctcctcgacgcgccttgtagacttgctgatgcccacgctgtccgctgtcgcaactgcaaggcatgcacgagatcgtcctgttgcacagcatagtgagccgctagcgtgcgattggttagcagcgcctagcatcgatccctctcttaccggaaaaataaaaagacataaacggtcgaagcagaacctacttgagatgatatggcatattttaaagttggtggaaatcaaatttaggggcattcttggagtaggaggtgatatttgggcccaatttttttgggacgatactagctaatccaagatttttaggagtaaaattttaagatgctcttacatcactactttttttttagaattacacagtacaacacagacactcgcgacgcactattaatttgtgcttatattcatcttctttgtatttgtttgggggttaagtacaacatatgcagctcactaggcaaccatgttatgtacagctagctacagatcgaccaataatatgatactgtgtatgatcgccaggccatatcattatagtaatatatgcagtggagaatcaaacaactttctgttccttccattcttgatgcaagtcgccatacgactactgtagtgcactagtgatgattgttatatctaattaggaatattatacacaaacacacacacacttgaattgatcagttactagcctgcactgcatgcagaggaaagaaaatcacactcgatcgatcagtaccaccagttctctgcgagtaatgtttttagttactcctccattccatgccttggatgcattaattaggttcgaccaaactgctctcatctgtaacgatgtgcggcagtgaattgaatggactccatttgaattataattggcagtatatattaagaaaagcatttctaaaaaaaaaactatggatgtggactattgaatttgtttccatgtaaaagaagagagtgctagtattgcagcctaattattaatctctgggtatatacggctggtttttgctggaatagccgaaggagaccatccaatattattaagataggaagaaaatgttacaagaaaagttttacattgacagttggctatcaagcaaggatgtacaccagagcacacgccccggatcatgtgccaaccacctaaacacatgctacagagagggaagccgggcaccgaattggctatcgctatgcgagaccgatcaccaccaccacggaacgaagactctaaaaattacgccctcaagaggtaaaaattatgccctcaagagggtcgcgacaccgaaagacgccgtcgtcgtccgtccaaaaaactagacaaggtttacacccagagctctttgctaagagaggaggggtacctcaacagtgtcctctggagggttaacacgcccaaaagtatgatcattgttggcccaatgacttgggctaagctttcgctcggaacccctacaacccctgcctccatggtccgtcgcccaaccctaaaccaccatccaaacatcggcaggttatactaaacatatacggccggttataccacagtccatgcacttgctgatctactgcacatactacatatgctctgagttttaactcatggggttgctagctgctagcttaatttaatcgatccttgtccattcattcattctaccttgtcgtctaatccttggaaacgagaatccaactctagctactctagctagcagtgtggcagctccaaaatgcattttgtttgattaataatttttacagatatctacacaagaatcatgggtcaggcatacatatatactagttggcagcccgccccgcgtctttgccatgggttttatagatttatcgtcaaacaaaatcatagttttaaatggttaagtgcaactctatgtatatataaaatatatgataatgtggatttatatatgccttatgttattacaataccattcatgttttgttttttcaagtgtcattgtgtattgttataatatatgaatattatcttcatgcgcaatatgggtatcgttgtagttaaacagtttgcatctctctaccccactcaagttttttctgaaaatggattcaggtaactatacctaataattatatgcaaccttatcatgcataataaaataaaacatacatattaaacaataaccacatattatatccggaaaacatggtgttatgcataaaatatgtagcagtgctacgtgtgactatgaggtggagcaaagggaggtgaatagatggataactaataaatgattgaattgaatgaataagtagcttcttggttcagcggttgttatctttatactaatatgatctgatggcttaaaattgttgattatgtggctttatagaagtaaatgcttcttaatgggtaccaactatatataaagataggatatatattcagtactacttaagtccaagggatgcacatcctatgcaatactgttgatatagtagcagcggatgacatgtgggcccggacaatccccactaaattccaagtattaattacaattagcggatgacattgtaatcgttcgatatgattgtcgatgaactacatgcacacagtttaattaatctagctagctgtacttgcaattgcttgcataatcatcagatatatgatgaatttctcatgtaaaaagaaccatgccgtccgtcgaattaaaggtactatggagtatagctttttatctggagggcatgcatggatatgcctcttgctgttgatgaaagctgcctaatcatgcatatggaaaagtacacaagatagatagcacatcgacagtgaggatcggatgaattaattgggggagatacagtatatgtatatgaatggatgggtgaatggattgatacctgagatcgccatggccatgcacccatcaacaattgttgatcaatctatttagggtctgtctgtctgacagatatatccatcaatcagtcccgtccgtgcccgccgacccactcaaagatcaatcaaaacaataactatgcatcaaagtaaaattaacagggtggtagtgaaaggaaatggaaatatatatacataaagcctaaaaggagagatgaatggatgatggagtaactctagtatagctgtaggtgagtgacactagtactcatcatcatcatcatcggttgttgttgatgtatgacaagactagctattacctatctcttgctagctatatatcgcactatctagcttcgatcgatcgatcgatggggatgtggggtgtgttagttccttcgtcttctttccgttgtgctggtatatattcatatatgcatgcaagggcatggcatggtggccacaatatactctagttaagtcgtcgtcgtcgtcgtcttcttcttcaatactatatacatataatccctgtccggccggcctgattaatctcctctggaattaatatggagatctcttgctagcgagatatatagcgtcgatcgaccatgtgtgacagcttgttttggcagtcgtcggccgaccaaggggacctctcggatgtggtgagggccagccttcagctgcagacggcgcctcgccatcaggctgcatcgccgccgtatgtgcacctcttaggaggaggaggaggaggaggagaagaccagcttgcagcagtgagccaacacgctgagcagcagcagcagagcatggtggatgcttctgcagcttgcgaccttctccatgcgctgttgccaccaccaccagtagtgcaggtgcagcagcagggagcgtcgaggacgaggacgacgattgaggaggacaccaccggcgacggcgaggagttatttgctggtgctcattatgtcgttccgcccatcaagcgaaggtacgtaggtattctttaacttcttatactggagtagtacctagctagctgtaaggatgtatatatatatatacaggaagagccagacgaagaaggtggtgtgcatcccggcgggggcgagtggcggcggcggcggcgaggtggtgccgtcggacctgtgggcgtggaggaagtacgggcagaagcccatcaaggggtcgccctaccctcgcgggtactaccgctgcagcagctccaaaggttgctccgcccggaagcaggtggagcgcagccgcgccgaccccacaatgctcgtcgtcacctacacctccgaccacaaccatccatggccaacccaccgcaacgccctcgccggctccacccgcccctcctcctccaactcatccaacatacgcctccaagacagtactccagttcatcatcagagtcagactggccacgatcgtcttacgaccactcacctcaagcaggaggacgtgatcatctccccctccctgctgcagcccgaccaccatcagctgtgtaccattattgacaccaagcaccacctcttgtttcatcaagactatcctcacagcttcggcttgttcgactagccacactttcttgtaagctactagtagctagctagctactttaccatctatatatagcctaatgtaagctagcgtacgtgcttaattacttgttacagagcacgccacaattgttagttaaaatgttactccctcccgtcacaaaaggaatatcgtttagaatgcctccacattgcacaatcatgtgatgattaatcttggtgatgaacaattatcaaagtaaagtatttatttaaaatacagtgaatagttttttttattgtggacggtttttgtcggctctaggagtccagtcaaaccggtggtgttcgtgcagtctaactggagtgcccgacggtcgaaccggcagactccaggagggagtcggttttggattgtttttgtggaatttatagattgtttcatgtatatgagttctagatggtttttattcgtatgtgatactattgtgtgctgatgtgaatcaagttggtgcgaacttatactcaaatatgaaattttttgttcttcatgtgtaggtgttagttgaggccatgggaatgtagctggtgatggattgggacttatcacgctagacaatgggatgttcaggctagagaacaatgcatgtggaggtgaaggttttcatatgacatacacgtagagttgtgcctatggaaagataggtcaaatttaaaacggagtccaagtttgagaagattggagtgtggagttgtatggtgacattgtttgcctggtttgataggtttcctatgttgattaggagtgctagttctagttggattcgtggctaggggcagtaatgttatgggtataaatagaagactggttgagactagaaggatatcaacgttttgggagaggaaagttactatttgcttcgggcctagttcgtgagttgagagggaggagtgttttagatgcaatttataaacatatattaatgcaataaagttgatctactttcaagagtttctttgatatgtttttatttggatctcaacggtcacatcgacggcaaagcggcggtccaactggtggtgcggtggtggtcaaatcggcggtatccacgtctatagaccggtggcgtcaggaggttgtagcggtgagcaaggcagccagatcaaaagagcatcgtcggccaaaccagcggcatctacccagtcaaatcgaaacacacacgtcggtcagacctgatcttcattaaatttgagggtaactttttaattttgcaaaatagatttggtttttggtgttcctaccattcacccctcatctagtaggcttagttcttgttattcaatccttcgagaagttaatttgactataaggcttcctctccctccttccctcccgttcctccttgtctcgtcggccgagacggggcaaagccgcgttagaggcgaacggcggcgttgacgtaggccctagctagcacaggtcgtggtgggtatggaggcatgatggcagtgacaacggaggtggtgggggcattctgagaggtggaagggtcgacggtggtagctactagcggcatacgaagtggcagtgcttggggcctaggtggcgatggcggtgttggtggtggtgctggcagtagtagcggttggcttgcttggtggtgatggtggtggctgatcagctcagcggcgcgctaggagcaatgccaagggtggtggcagaggttaggggtgaagacgactcgatagtggcgactctccaaacaagatatgctgtgatgttagctcggcgaaggttgtggtttgtgatgacaatggtgttgtggcggcagctctccagcgagataagctactgcagctcgacggaggttgtggtttgtggtgatgacagcgtggatgcgatgattctctagcgagataagcttccgtgacttgtctgatgtgagattctacggtgacagcagaggggtagcatgatcgcttttgtgcgatgtggcgatgacttttggtgagataagctgcggtagcttagcggaggtggtattttacgacaacaacgacatagcggcgatggatgtgctcatgctaaggggggcattgattgtccgtctggtatgaggctggtgcttggtgatgtcaaggcagctgggcggactagtcctggccccttcctttgctcatggcagagcaaatgaagtttttacggttgctacagtgtcaacgagagagtgtgcaggtagaaagacatgctagctccacatccgatgtttgaagtgatgaggaaaaacatgaagttagtgtttttgtcttttctttttggtggtttgtttttttaatctcgattatgagatgtggagtgtatgtatttgtgtaatctttggttgtgtatatccatttatagatatagaaaccgattctctatccattattatgaaaatgatgtgtcgattttggacatattaaaatatttgtagccaagtttatccgagcaatagatttcatattataaaaccttggatttatacaaaagaaattaaatagtcgtattaactttgaaaagtccaaaacccattttcttctagtgactaattgagggagtagtagtatgatcctattaccctgttatttttactgaaacaaaaaaaaaagccttttgctgctatatgataatgaggaaaattgaggcaaaaaatatttcgagaaaaaaaaactatcgatgctatagagccaactaatgatagtgagcaagctgcatgccgaaattaaaggtcagtttgatatgtaatttcacgctgacgctgttaccagcttggttgttctcgatcaatgtcttgattcaacattctactgaatggagagtgatatgcatagggtaactagcaaacaagctaaatcgattattaacaacgacgtgtgcctgaatctggatctctatatatctccatcacttcgcagtgtcccaatctgcatttcgtaatgaatgagatggcgatattcagtccaaaggacactgtaaaccccacaaaagaagggaagaaaaaaaattgaaaagaaggaaaagagagatgggcacaggctgaaaggaaaacctgaggtccgaaagctaagataaaaagctcaaacgacaagaagaatcttgttaccacaatgcaatccctgttgctgctagggtgctagctgatgagactggacaatgtaggaaatatatagcgtcttgttgattttctcgaccaattccgtctcaaacactccctggaactgatgatcaacaaggcacatcgtgtccgctatgctcttatctttaggtttatgtgtgcatgatgtagtcatcatcatcatcagtaactgaattcagaaactcaaaatcgcctggcgatgatcaacggcattcaccctcgagcagaaaatctactggccgcaatctgagaaaacaacaactatgcctttgtgtgaccagagtgtccatatctaaactctcagagaaatattgccatgttaaaagttggcctgaagcttggatgaagacgttaagtagaatcgatgtgtgtgcaagaccaatttcttcaccagcagcagttatcccactattatgctgaatattgtacatagcacaagacgggtgggctttatcagccagattgtgcagaaaacaaaaccagatgagaatgcatcaaacaacaattgggaaaaaaataacatttcaaatcagtgtgaggaatgcagtagttggcactcagtactcatcaatctgtctcgcatgccaaactccatcatgtctgtcctgatttcctagctgcagaagttgagcttctttatcacttttgcataagctaagtgcactaatgcaggcttccgaagtcttcttttcgcttccttcgactgcaacaacataaacaatagcatcacatacaaactcggtgtgcactggccggcagtaccagctaaataacatagtgagtagaaatgagaagttaaagtggctatgagtaactttgatcatataagaaagacatggatgcatcaatgaactttggaaaatgtttaatgagttctgcaattggctatgtggaaatgagtttgattcgattctgtgtagcgtataggaggaggaagggtagctcaagtggtgttgtcagattttgttacaactttttggagaccgaagttacaggacaactgaaaggtttaccgaatcggtccactatattcatctctctctctctctcgggcgtggaaccaatagattggcgttggactatggtaaaactaatcatatcgaggaagagaaaatggcagggcaaccatgttttcatgatgagacatatgtggttttgcaaagataacagagcagagagttcaccatccaacatataacagtaacaaatcaaaatttccatttagacagcataaatcgaaagtttggtactgaacactggtacaagcaacaggcattcaagagagaagttaaagtggcaggaaaggcatgggggagaagagaagatggtcattatgattttctggagactgaagttacgggacatctaaaaggtttaccgaattggtccatattcatatctctctctctctctcttgggcacggaaccaatagattggcgttggatcatggtgaactacatattgagagagagagagagagaaaatggcagggaaatccatgtttccacgatgagacatatgcggttttgcaaaaaaagatagtaacaaagagcagggaattcatcatccatgatataacagtaataaactgaaaaatcatgatacatcattattaaatcgaaaaattaggtttcactaggaaaacaattggatacgtacaagcaacagagagatgataaggtcctaggcctagcaggaaaggcatggggggaagaagatggaagatggtgtaccttgaggtgagcattgtggcgcttgccggctctccacctgcggacctggccgtcattcatgactctgaatcgaaacttcatggagctagtagtaaaaaagtagtaagtgagaagttgataatagtgattgaatgatggaagagaggagtggaaggagggatgcgtacgaggggggcttgatcttgtacttcttgaccttggaggtggtgggcgtccgtggcgcgcgcgatctgtccttggcggcgaagtggcgcacctgctgcgtctgccattgcatcggcggtggggaggagggatggagacccagaggaggagtcaagaggtggtggcgggaggagaagggcaatggcctggggctggggatgaggtgcgccggaagagggcggtgggcaggggcggagacagaggaggagaggaggcggcggccgaggccgaggccggcggcggcgcaccaccgccgcatcgtgcaatgcctctctcttgtctgttgttgttagggtttgttcgagaaggggaggagtccaagagggatcgagcgacgagagagatgaaggcccatattgcatccagcccaattgatatccggcctagtgacgtgggcccagttaagcccatcagtctgtgtcgctttctcgtggctgtcgtgggtcaccaatccttttcccttataaatatatgtataaataattgaaaaagaaaataaaaatccccacgaggtcaaaacagcagctcacaggttgcaagtggcagtggagtagtcatcaattttccgtggagtattgtatttgtatgctactacctccatagttttgcactatttatgttcaacgtttgaccgtccgtcttatttgaaaaatttatgaaaaaattaaaaacatttagtcacacataaagtactattcatgttttattatctaatagcaataaaaatactaatcataaaaaattttcaaataagacggacagtcaaacgttgaacatgaatagtacaaaactgcacttattttgggacggagggagtagtattaatttactactctatccgtcccaaaatataagtatttttatcacactaataaatcaaacatttttaactttgactattaatagaaaaaataaaaaaagttcaatcatgtaaaattgatgttactaaatttattattaaacaaactacagtttttttacttaaaacatctcgtttttatagtatatactattggtcaaaataatatagatcgtattagagtctagaaatgcttatattatagggtgtagggagcaagttaatgaggtgacagagaccgtgacgatgcaagccgacaaatacaactactaggagttggggtcttgttcgccaccattacaccattccattccagtggtagaagatccgagatcgaggaggaggtgaggagaggagcaagaagaagaagaagaagaagaagaagaagatgggcatggagagcggagatgcccaactgccgctgctccaccacaaggttctctctttctactactaatatatatccccaattctaaatccttcctaattaagcttgttttagctcccatatgatcggcagtactagtatatactccaactccacggtagaaaggaaggggagggaaggaattaatttcccattggattggattggattggattaaattgagcattctcaatttctcaccgccctgtatcgatcagtactcactgtcttcctccctccctatgcttgcaggcttccgcatccaatcagcactataccaagccccccttcaactggaaggctcctgctcttatcttgggtagggtaaccccagcccccacccccttcttaattaatttatcttcctcctcgatccaccagtcgcatggatctatctacacatacataattaattaaccatatactcctatgaaaaatgaatataacgcctttccacacttgtcagaatacttgtcttgtgattgcagaacaactgtctagttaaatctgccaatttggcatttttttaaatctaatcacggactccatagttgtatcctaatataaatacttcatacatcttcattcattgtagcctttgaattcttggagagcattgcctatgctggcatctccctcaacttggtcgtttatcttggaaccgtcctccatggaactaccgcctctaacgcagccaatgttgatacatggaacggaaccacttttcttacaccggtgcttggagccttcttggctgatacatactggggaaagtacaagaccattgccatctctacagttttctatcttattgtaagtgcatccgccatgtactagtatcgttttgtgcatcgtttaatactagctagctatctagtagtaattcctctcatttgcatttgcatgtgttgtgctcatgccatataagtatgtactatctgagttatatatgtccacaaacaaacaggggttgcttgtaattaccgcctctgctgtcatcccatcactacaacctgctccatgcaatgggagctcatgtcctcctgcaacagggtttcagtattttgtcttcttcaccgcgctctaccttatttcggttggcaccgggggtgtcaaatcagcattactcccctttggagctgaccagtacaacgattcaaacctcgaagagagtaaaaagaagcaatctttctttagcttgttcttcattgctatcaaccttggagtgttcatttcgggcactgtcgtcgtttggatacagcaaaatgttgcttggtctctcggattcggcatctcctcaatatgccttgttgttgccacagttgcctttttggcaggaacaccagtgtacaaggtccagcttcccagtggaagcccactcaagagtgttgtaatggtttttgttgcctcttttaagaagagaaaactggaggttcctgccgataacgcactcctgtatgaaggggatgatgctgatttaagcaatggacaatcagtcaaactagcacatactgatggtttcaggtacttctgtgacttaatctttatatacgctttgcaattcaaggcgaacatatatataagctggccttaggtagttcttgttcttcttcctctaaaaaatagctgatatagttgtagttgtcttgaattttttttctttcgagaactcatcactttatttataagattaaaaacacagttcaaggggggacgacgtcccagtgtatcgccgcagtagatagattgtacaaaaaaaaaacaacaacactacccattcataaggcaaaagccgactgaactaaggagtgagataaaccgaacaacagtaatggatgggatgatcgacagggggctgtgtcacttgtcctgaattttgataatcttaatttgtgtaaaaggttacttttggatatagacttatatttgtttcatttcaggtggttagataaggcggcagtggtttttgaggaggtggaagagataaataaggatgagggtgggggtggagggtggctgcagtgttcggtaacgcaggtggaggaagtgaagattctgctgcggatgctgccgatatgggtgaccagcgtgctgtacgcggcttccttgggtcagacggccaccaccttcgtgcagcaggggaatgccatgaacaccaagatcggatccttctctgtcccggcggcatccctcaactccgccgaggtcatcttcatgatgatctgggtggtgttccaggacacggtggtcgtcccgatcgccaggcgctacaccgggaaccccgcggggctgacgcagctgcagcggatgggcgtggggcggttgctggcggtgccggcgctggcggtggcggccgtgctggagacgtggcggctgcgcagcgtcagggacggcggcaacctgagcatcgcgtggcagctgccgcagttcgtcatcctggcctgctccgacgtcttctgcggcatcgctcagctggaattcttctactcggaggcccccgtgtcgatgcggagcctctgctcggccttctccttcctggcgctctcgctgggctactacgtcaactccctcgtcgtctccatcgtcgccgtcgtcaccaccacctcgaacaagggctggctccccgccgacctcaacgacggccatctggactactatttctggctctggacggggatcagcgccatcaactttgtggtgtacgccgcctttgccaagaattataccgtcaagagactcgccgtcccgcactcgcactgatcgtctccctcatccacccaacactgccttgtattattccaatcaaccattcttgtattattattccacttgattcgttgagcatgtttattaacccaataaaaaataaaccaaataaagggctgaatccatgcattaccttctgcagtttcttaacaaaaatctttttttaacggaaaatagcactagagtgcctttttattgaatagagcaggagaaaatacaacccctaggggcaacaggaaaaaatctttcagcttttaaaccagatcttctctgctagaattacgtacatcctaccgagatccatcagcagaccaaaactatgaaaacacgcatattcccaacttgtgaacattgtattactgttagggctcacaaggattcactcaagcacacacacaatttggcaacactatgatagtttcctctcagatccaacaggatcgagccgctgccgcctacgcctccaattgccaattcaatgtcttaattcaattcaacagtatttaactaacaccaacatcacgccagctcacatgcgagcaagtgactcacgcaacccagtctgggccttggaccttggtattgggcctcctcagacgagctgaacgacagccccaagtcttcagcttgtcttcctgcttcttttgccttctcaatacttggctcccttctcttgtccttgtcttcttcaggatcacacttcctgacaagcccttccccttgaaaattggcttgtccccaagccaatgcagctggaaaacgggaacgcagatcctccatatcttcccaagtggcttcctctgggagagaatcagaccattgagttagcacttgagtgacagttgaattacctttcttagccaaacgcctgtccaaaatatgcaagggaaactgcaatgtagaagtatcagtgggcagtttggattgaacaagaccagagaatccaacagcggacttcaattgggacacatggaacactgggtggatagaactatgaggtggtaattaaagtctataagccacactgcccacacgctaaatcacttgaaaaggcccaaaatacttgaatgataatttgtgattagctctgacagccacagaagtctgtatatacggctgaagtttcaagtatacccaatcaccaatagcaaaagttctgaaacttcttttcttgtcggcaaagtgtttcatttgctgctgagcgcggtgaaggtgttgctgtacaagttgttgcatcaacttcttttccttgaaccatgtatccatctcaggaatagaacagtctgaaataccaatgccaaaatggtttgggggatgaccataaaggacctcaaatggagtagcatgaatggcagagtgataggatgtgttataccaatactcagcgagatgcaaccatgcagcccatttggaaggaactgaatgaacaaaacaacgcaagtatatttccaggcattggttaaccctttcggtttgaccatcggattgaggatgatatgcagaactgaaatgtaacttggtgccagctccctcaaacaagtgttcccaaagttggctagtaaaaaccttatctctaaaaaaaatgataaccaggggcaaaccatgtaacttaaagatatttttcatgaacagcttagcaacagatagagctaaaaatgggtgagctaagggaaggaagtgactgtacttagagaatttgtctacaacaaccaagatgcaatcagaatgctcagacctgggcaatccttcattgaaatccaaggatatagtttgccaagctccttcaggaacagggagaggtttaaggaggccagggtactttgctctatcaggtttggcctggagacaaacttggcactggtgaacaaaggtttttaccattttcttcatgtttggccaagcaaacagttgtttgattttcctataagtaactagaaagccagagtgtcccccaatgggactgtcatgcagtgcagacatgagttgaagctgtaaattatcattgttaccaatccaaactctgcccttatatttcagtaacccagcagagagagaaaaatgcttcctggaagttggacagacagataattcagtgaggaattgaagggaaaagggatcctgagcatacccttttgttacttcttgcaaccagagtggggtggagctggaaatgtgatacaattcactgttatcatcctgaaacttgcgagagagagcatcagctgcagcattactggtaccttttctgtaacaaattttataattgaggccaaggagtttagtgaaagctttatgttgccagggtgtgtgtaacctttggtcagaaaggtgcataagactatgatgatcaataaggataataaactcccccaactgcaaataagacctccattgatcaactgccatgaggattgccatgcactccttctcataagtagacaagccttttgttcttggacccaaggccttactaatgaaagcgataggatgattgtcttgtgataacatagccccaataccagcttcagaagcatcagtttccacaatgaagaccttcttgaaatcaggcaaggctaggaccggggcagtcaccagagcctacttaagctggttaaaagctgagtcagttgcagtggtccacacaaaaggaacatccttcctcaaaagatttgtaaggggcttactaatgagaccaaatcccttcacaaattttcgatagtaaccggccaatcccaagaaaccccttaatttcttgatagtggttggtactggctagtttaacacttcctggatcttgctctgatcagtatggacaccggtagcactgatggtgtggccaagataagtatgttgttgttgagcaaatgagcacttgctcaatttaaccttccattgatgttcagacagtaaggctagtacttggtgaatatgatccagatgggactcaaaatcagggctgtagatcaagatatcatcaaagaactgttttcagagtatcattcattgcactttgaaaggtagccggagctcccgtcagcccaaaagacattactatgtattcatagtgtccagtatgagtttggaaagccgtcttatactcctcaccaggggccattctaatttggtgatacccatctcgtaggtctaacttagaaaaccacttagcctgagataattcatctaaaagctcatcaatgattggcatgggataagtacccttgatggtaatggcatttaattttctatagtcaatgacaagtctccaagtaccatccttcttcttgaccaacagagctggggatgagaaagcactgtggctaggctggataactccagatttcaacatatcagaaatttgcttttcaatctcatccttaagagcaggattaaagcggtatggcctcaaattaacaggtgttgccacaggtacaagaggaatactatggtcacaatatcgcttaggagggagttcagtaggttctgaaaaaacatcctggaacttgagaagtaaattatgtactgcttcaggcatagtgtcacagatttctgaaacagaagatgtcaattggaccaaatacagaatagacccctttctagccatacccaagcattgttcagcagagatagcattgcaactgttagtctgggaagttataccttgcaacctgacaggctggttgttaacttgaatttccatccatttctgtgaccaatccacctgcataggactgaattgctccaaccagtccatgcccaatatgatatcatagccacccaagttcaagagtctgaaattactagagaaagaatgcccttgcatccaccacttacaattagcaatctcatgggaacataacaaggacccaccatcagctagttgcacagacaagggcttcctgagtggagaaacacccaccatcttagaaccaactgtttcatccataaaggaatgagtactgccagagtctatcagcatcaataattcagtaccctgcacccagccgatgagtctgatagaacgagaggattcagtcccccaaactgcctgttgagaaatagacatcaaatctcccacttcatcaatttcttgttctccaccagaagattcaatttatgtaggagattttgagtgtaaaatatcaagaagctcctgcacaacatgtaattgcactgctgtggcacatttatgatccttaccccatttttcaccacaggtgaaacagagccctttagacctgcgataggatttcagagctgacagtctgtcatctcttgctcttgcagcttcagtgccccttctatcttcagtaatttgaggagagaagattttctggggtgtggaggcctgtccaactatcggggctggtgagttgtttctaatcataactgaattgtttggtctcttgtagccctggaacttaacaccttccatagcctcttcctgaagtaatgcgactgagcaggttgaatccaaatcttgtggcctttgaaccaaaactaccattctgatgtcacttctaagcccttcaataaacttagtcacaaagtaaacaggcaacagggagttgtaataagctagcaactgatgcatcagactatcaaatttttccacatactctgaaacactgccctcttgcttaatatggaaccattgtctgataagagcttgctgcctatccttaaaaaatctggagcataccaaatcacacaaagacacccaagaaatcccactcatctgatttctaacagattgaaaccaaaaggcagcattaccagaaaaattgagtgttgcaatcttaacccagtgaactggcaatattccatagacatcaaaatattgttcacagtttgacttccacatttgggggttatcaccagtaaattgagggcaagtcataggaggaatagcactacttagattcattgtccccattccgttaccaaaagtgggtgatgccgaatcgcaattgaaaggaataggggaaggggaaaatttctcaggcgtaccattaggagtaaacattcccgcaacacctccgaactgctcctccttagctcctccttgaacacccgaagcacttgcagcagagaatggttcaaacttgacttgccgcatcgtgttgccttccagctgctcgaccttggtgctcaaggactgcagcgactcacctagttcttccaccttcttctccatcgccggtatgcggccctcgaccgtcttcttcaactccaagtagtccgccctggtacgctcctccgcctccatcctcttcttctcgttgtcagcaatggtcttgaacaagagatcaaacttggcgtctagatccatggctagttttggaccgtaatccctcacatgctctccgaatttagccaaccagattgagggagccgaaacttttgtggatttctcaccgccgaagcagccaaatcccacctcgctctggagaaaaatttacagccaaatcaagaggaaatgcagcacggaagggctctgataccagattgttagggctcacaaggattcactcaagcacacacataatttggcaacactatgatagtttcctctcagatccaacaggatcgagccgccgccgcctacgcctccagttgccaattcaatgtcttaattcagtttacagaacagtatttaactaacaccaacatcacgccagctcacaggcgagcaagtgactcacgcaacccagtctgggccttggaccttggtattgggcctcctcagacgagctggatgacggcccaagtcttcagcttgtcttcctgcttcttctgccttctcaatacttggctcccttctcttgtccttgtcttcttcaggatcacactccctgacaattacttgctccttgctagttggtacttccttcacctaataagctaaggacaggatttccacacaaattgcaaattcggtttcttctggcactagtatggatcagtcttgtaattttggtcacatattatttggtggagtctgtatcgccaaggtaaacagaagaacaaaataataaacaaaggtatcacatgagctagctcagcatgctatacgctgccgtagtagtgctctttggctagctggagtcgactctggacggtatcaacgtctattgcttgaagattgtaatgctccttatgttcaattaataagtctctcttaccctcacaaaagaaaaggacagaaatttaacagcccaaatgcatgaggaatttttttaaaaagtggaatggaatatgggccaaaagcctattatcattccgctgcccaacctaacccactggaaaggaaaatatcctcttcccaatcccacctgcaaatcaaggaataagttcacttaggatcccttgtcttgacgtagagtttgaatcacgtcctggtaccacagtaccagatataacacgtctctcaaatcctaaaactagtgcagacaagatccaaaaacggtttggattggttggtggatacctacatggttagttgttttgacttagcccttgtctcgtgcggtgttgaagtgtcattataagcaaaattaaaaaaataaacaaaatgcttgtcagtgggtcctacttcccccacttcactctcacctctctatctcccctggcgggcggcaccttctttcccctctctctcccaacattccccctccctcctcatgctccctcaccgatcggccaccgccacttccgctttctcactactaaaggtgggcagtgatggagcgcaacgagctcaaagaacggcgggcgcaagctatgtggtcttccccttccctcctctccctccctagccacagttggcgatggtgaacacgatgccgctgccgcccgcgccgccggagatcctgctcgtgcccatcgacgagcaagatcgaaaggcgggagtgaggaggaaggatggggagttgcacggccgcagcgatggacatgaaggtgacaacgcaccccccccccatggagcaagaagatggtgaagtccaatggacactaccaagtccccgtgcgctaccacaggcaatgagaagggtggttgtgcccaagctcgaccgccgctgtcagcggtggcggaacgacatggggatttggatgcacgcgggcaacgatagttatctcatcaccctacgtgcctccgcgcgtctcatcccatgcgcccttgttggatctacgagcattgacatcatcattggcggagttcaggctcactacattagcgagggtggtggcatgcggagaagcaggtttgcacgacggtgtactctagtcaagctcaagctcctggtgcggtgtgcgactgtccaggacacgctctagcacatcattgtggatgtttgtgacatcccgggccaattagaatgtggcatgtatggcccatgatagctgcatgcgcatgtttagtatcacagtgctagtttagcatgggtagaactaacttataagagcctacccctccaaccatatcactccgagttaactcttttacacgaagcgaggacgaaagtgtaagtgggatgatatatgtaagtgggccgacccattgggctctgcggttttggagggtgggttgttacaaatggtatcagagctgaccctcgtggttgcgcgtacgaatcaatgtgcgggctcatggcgcatgacacgtgtgggctctgtgtgaggcacatgttatgtcatacgccaattaggatgtggcctatgtggcccatgagaactgtctgcgtagccgaccctcgtgattgtgcgtatgaatcaatgtgtgggcatatggcgcgtgaggcacatgtcatggcatgtcatacgctaattaggacgtgacctatgtagcccatgagagttgtgtgcgtatgtttagtaccacaatactagtttagcaagggtgaaaccaatttataaaggcatgacactccaaccatatcactctcgggttaacccttttacatgaagcaaggatgaaagaataagtgaggtggtatgtgtaagtgtgcccacccgtcggatgtgttgcgctacgaggttctagagggccggttgttacaatgtcccccacttgcaagagccctttttaccacctctcactagcaccggtgccttcttgtagccttctcgtcgtgggcggcacaacgacaaccatcgaggtgtataagaccatagtcgccttccttcgctcgatggtctgggacactaggtcctcctaggctgtgaacatgcagccttctttgtgcggcatacgccgctgactgaatcacaacaccctcctccacccccttcttgctcaaggcactcctggtggtgaaggagcatgggacgagtgcaacccggtggtgaaggggtgcagcattaccaaatatgcctcccgatccggcgggcagtgtggcttgggcggcattggtgatcaaaatggtgagctcaatgggctccagtaggctatccgcacgctcgttgttccttgccctggtcaacgtcatggctgtcatcgagagcatgctccggcatggtgctcccgttgacggagaacgctttatctcatgcccatcccccaccgatggagagagaaataagaggatatgagagagagagagggcagaggaagaagatgccaatgatatgtaaggtctgcatatttcatttatttatttattctaattgaaatgccaacattgacgtcacgcatgacaaaaccaccatcacaaccgcctaggaacctaaattgatctagttttaataattgagggacactctatatctggtttcacggaacaagggatcctctatatctggtttcgcggtagaagggcatggattgaactttggctatagttggattgaatgtggtagaatccaactactagttgctgccatgcccaactccctcaaatcagatttgagccccatggatttgggtactgctcgaatctcgatctgttttaagtcatggagtagtaataagacttgaagtttatgaataccactagtattagtatgcgaggattcaaccagcagttgggttctccatacgcaaacgtggctgccatctccttgctggattcgtgccatcgccatccctgcgccgtacgggatctcacaccgttgctagctgcatggattcacgcgcgccggctgctgcaatggcgaaagaggcgacgggcggagggaggtgagagcatatctacaaaaattctaggtagaaacacttttgtgttcggctggtatttttgcagctgcagcagtagtactccctatgtactacttcctccgtttcacaatgtaa

SEQ ID NO: 31527 - DNA, 41149 bp, Oryza sativa
gctaatgaatctcattagcgtcaatatgaatgtgggaaatgctagaatgacttacattgtgaaacggaggaagtataatataagggattttaactttttgcttgcactgtttgactactcgtcttattcaaaaaaaatttaaaatttttatttattttatttgtggcttactttattatccaaaatactttaagcataacttttcgttttttatatttacacaaattttttgaataagataagtgatcaaacagtacaaataaaaaattaaaatcgaacggaggaagtagttaagaattgctgtagtttacagcgaatttatgatgcagtagctgtagcttatatggctgccgaacatagccactatgaatttgggttctccgttatgccattttcacacggtccacacgtacggaagcaagctcgacacggacatatgaacttctatcaattttagaggtagagattcaatcccaactagtgcatgcgacgtgcaattttttttaatccattcaattccagcagttccagttgactaagagatattttggtaggcaactaagcaggtgattacagtagagagtacgtttgcacttcacgtggctcacatggtctctcccctgaataatattgaggtttctagttccagacttcagagaagcaatttaattattataattaactaccactagtaatgtaattaagcggccaatgcaaatttatttttgatgtatagtcctactccagtaggaagtcagaatagatcgttggagaaaagaagtcctaacgacaaattaagttgggtgctttgccttgcctgtgattagttttagtcgatcgatcgagcctagcgaacggtgctgccctcattaatctaatcaaatggatcgatcaatcaattaatctactgactgactgagtgcggttgggtcgtcgtctgtgtgtatacactactggagtactatggagtatattgctattggcctgatgcttggctgctggccgaatccaacgtgcctgactaactatcctcgtatactaatactagtggtattcgatcttaactacaagtcttaccccatgacttaaaacagagcagtagacgtagtattatttattttacaagtaggattaattgtagataaatatagtcagctgtaggccagcttaatttctctgggagttggacgcgattattcagtctgaaagggaaagggttgttcatagtttcaggtggtagcagctgctggtaattgaattaagccgcatgccagtgccatgctgccaaattggttcgatcgaaatgcattttgggttgttaggttgctgctatatacaatacatagatagatagatagcttgaattgaagggaagcaatctagccacgcaaaggcaaattaaccaagttagctgcagctgcagctgggatggcaagatggatggatcgctcaactaccaccatgaattgaccactgtgtgggtgtggagtagtagttgctttgctatgctatcttgtatcgttgcacatgtatacgcatgtactggaggtgatctttatccaaaaatgtaacggaggtggtggttggcaagctggatacatggatggttgtggctgcttctcttaattcttcacatacacgtatcggttagttatgactaccgtaattttgataaattgaccgttttttaaaaataaactatgtcaaaaactaattccaaacgccgtcaatcccgatggcgttcagctaaaatttctcaacgccactttagttgatactgaaaacatgttcgacgtgacataaattagcgtaaaaaggagctcatcgccatgttttaaatctcttaataggtttaaaatggtgcgcgggctaaaagaattactatttattgttatcattcacgagctagcatttttgtaattagttgagttagatatcggctttccattctcaatcaggttcatgtcctgccagattaagacgatagacagttttctccagctagccagcgcggtgctttgactttgtcatcgcgcgcgcgcatatatactagtactggagtctggagtcgagtgtatatatatatatcgatatgtatgatgatgatgaagaagatgatggtatcgaatcaaactaattaaaccggacagttgttgttgatgatgatatacgatcgagcaggagcagctgaggattagtacagaatccatatattggtagctacgagcctacgacctcgctgcctcgtatcgtgaaatgagatactagctagaaaggtggtggtaggggatagatccggggcgggcggcatgagcatgaataatatgatgggtagtccaccaagtcgtagcaggggcagggatgagaagaagaagaggtggaagtggaagcttgggccggccaccatcctggggttcgagctgctggagagcatcgccttctccggcgtggcgctgaacctggtggtgtacctggccaccgtccttcacggcaccctcgccttcaacgccgcccatgtcgacacctggaatggcaccaccttcatcgtccccgtcatcggggctttcctcgccgactcctactggggaaagtacaggaccatcctcgcctccctcctcttctacctcgccgtaagtcattcgctctttcatactcgatccgatccatacatgcagcatggagatggataacgtaccagggcgggccttgtgcagggccttgtgctcctcaccgtctccgccgctgtcccctccctgcgcccggcgccgtgcaccggcgtcccatgctcaccggccaccgggacccagttctccgtcttcttcctcgcgctctacctcacctccatcggaacaggcggcgtcaagtctgcgctgctccccttcggggcagagcagtacgagcgcgacgaccacgacactgatcaggagggcgccccggccccggagaagacgaagcaatccttcttcagctggttcttcggcgccatcaacctcggcatcttcgtggccgggacgcttgtatcgtgggtggagcagaacgtgtcgtgggcgctgggcttcggcatcgccacgctctgcctgctcatcgcgtcggcggcgttcctggcagccacgccctgctacagggtgcgcctccccacgggggacacccccatcaaggccatcctcagggtgctggtggccgccttcaggaacaggacccggacgctgcctcccgacgccgacggcgatggcctgtacgaagtcgacgacgacaagaacaagaacggcggcgatgatgagaagctggcgcacaccgaggggttacggtggctggacaaggccgccgtgagggtggacgggggcggcgtgtgggaggtgtgcacggtgagcgaggtggagcgcgtgaaggtgctggcgcggatagtgcccatctgggtgacgtgcgtgctgtacgcggcgtcgctggggcagatgaccaccaccttcatccagcaggggatggccatggacccgagggtgttcggggggaggttccgggtgccggtggcgtcgctggtgtcggtggaaggtggtgttcatgctgctgtgggtgctgctccacgacgtggtggtgatgccggtggcgagaaggtggtggcgctcgggtggtctgacgcagctgcagcggatgggcgtggggcgtgtgctggtggtggtggccatggcgacggctgctctggtggagaggcggaggctgcgaggggagaagcggtcgatgagcatcttgtggcaggtgccacagttcgtggtgctggctggatccgacgtgttcagcggcatcgcgcagctggagttcttctacggcgaggcgcccgggtccatgcgcagcatttgctccgctttctccttcctcgccctctccctcggcttctacgtcaactcgctcgtcgtcaccatcgtggcggcggtcaccaagaggagcgacggctccggcggctggctggcgccggacctggacacggcccacctcgactactacttctggctctgggccctcatcagcctcgccaacctcgccctctacctgctgctcgccgcccgctacaagtccaagaagccctcgccaccgcattcttcttctcatccctagccactaccactatcatctcctcttcttcctccaccattaattgttcatccatcatcatcatagacataccatatatacgcacgcatatctcatctcatctgtaagatggatcatacatagtctgcagcagtgcatcttgtatctttctacctatagcctatagtttgcttctgaatttaacatcggaatccagggaattgaactgacgacaaacttttctgcatacgatcgaattggtagcttttgggcagaaacagccgtttttttgacaaattgacccttttcaaaaacttatttcgaaactaacccctgctaaaaacttcaactaaaactaggccgtcggctcagcgccaagcgcattggcgctgaggttggccgtgtcagcgccaacgggactggcgctgacattgtgccaccgtggcggccgggccgatcccccagctgacgtggcagctacctcagcgccaaccgcttcggcgctgaggtgcccaacatcagcgccaagtacgttggcgctgatcttggctactttgagcccggccgaggccgccccagccagttagtcctctgtttttccccagccgcccgcctagggttcggtcgccaccgcgttctcctcgcccaatctcccccaaaaacctctctaatcgaaggtgatttgtgtggcattgagtttgggatcggaagagaaggtaaacccctctataaaccctaagttccccaaagttttattggatattttgtattgttttggttgtagacgtggtttgataatagttggctaaggatggattattagatggataatgtgggtggggatgaagtgtggaggtggcatatctttatccatttggttgttgttgatacatttgacaaaatatatttgggatgaatgtttggtgatgcactagggtttgatgggagatggatgtgtggtgatggcctaggatgtgggatgtatttgtggtgattgagagggtttgaaaggggttgatgtgtggtgaagggtaggtaatttgtaggagtagagttttttttatcaataatgtgtagtatttgagtaaggtacttatttattggaaaaattagacatgttgttagcttttgaagtattggtattgcaatggtaattacatattattttcaagtaagtaatttttatgcatgggttaaaaattgtagatggatagattggtccggcttcattatggtggttgtgtggtagatgaaagtacacatggaagccaatttgagggaatgacagttagacaattagtgttttctgtgaaacctacctttgaggagttaatgtctcgcatcaagcatgaattggattggagtgacgagtcggttggtatgcaagggagatacgatgtgggcggcggtgtcatgtcacataagtttatgttagacttgaatggagagatcgaatggcaaacatatatagatatagtgtggggtcacatttcaaatctcttgaggtgtttgcatggaagaaagatggtaggatagggacgaaagaacttatagaccttaatgaaagtctactcatagaatcacccattaactgtcacgaactgtcggagaggtgtagtaggaaggaaaaattgattgaggaagacgtggaggggggcgagggagtaaatgatatggcggatgtggaggtcagggaggagaatgacccggtaagggaggaagtacatgcagaggagaatgtgccgttaagggaggaagtacatgcagaggataatgtgccgttaagggagaaagttaatgtggaggagaatgtgctggtaagagaggaaggagatgttgaggatggtcgggaggtaggagatgatgtggagttgcctgaggaagaagcgaatgctaagaatgtaagtatgggcctaagggagttggctaggctgaaattctatacccgagaggagtgtgaggaggctatgatacgcagtggattgaacccaggctggttggagtatgatacagaggatgaattggatgaatccgcttccgactccgatgatgatcgtctagtgcgtaagatgtcagagcatgaaaggactgtgtttgcgaaactggtgggtagaaacccggaaataacacaattcgagaatcttaccagatccgggctagcaattgctgatggggatccacaatatgacggtgccttcgaaccaatgtgtgatgaaccaaggaaggggttggagtttcgatcgatggatgatctgaaaatatggctacagagttattctatccgtgtccaccggccgtaccatgtgaaggaatctaacgcgtcagtaaagtatactgtggcttgtctcgatcgccattgcaaatggcagattaatgcaaggaagagtggaggagataggtggcgggtgactagggtgggcgaagaccacacatgctgtagtgcggaagtaaccggcaagcatttgcaacttacttcaaggtttattggaaataggttacatgcatttgtgcgagctgaacctactttatctccagcagcgattgtcgaggcagttgagcaaatatagcactatcggcctacgtatggcaaagcatggcgtgctaagcaagatgctatgaaggtcatttggggagattgggacgaggcgtatgttcgcttgcctacactgatgcgtgccatcaaagcaaagaaccctaccatgcatttccgtgttgaggctcaccccgagaagtccaggatggtggatggagtacagagacgagtatttggacgtgcatattggatatttggccagtccatagaagcattcaagcacttgaggccggtgctagcaattgatggcactttcttaaccggtaaataccaaggtacattgctcacggcaataggggtcgacgccgggttacatcttgttcccttggcgtttgctctggtagagaaggagaatacatccaactgggagtggttcatcaacatgttgagaaacaagctgatcggtcctaatagagaagtgtgtataatttctgatagacaccctggcattttgaactccatcatccacatcatgcctcatcacctaaccattcaccacaggtggtgcatgaggcacttctgtgctaacttctacacagctggagctacgactgatcagatgaaagatcttgagcgcatatgtcaaataaatgagaaagcatttttcctagatgagataaaacgcctcatgggtgtggtcggagagaggccaaagaagtggctagaagaccacatgccacttaaggtcaaatgggcaagagcatttgataccaacgggcgtcgccatagcatcatgactagtaatatggccgagagtttcaataatgtattgagaggcattcggaaactgccggttacagctattgtggcatacacattttcgaagtgcaatagttggtttgtcgatagacacaaagaggcaactgtagatatcctgagtggaaagaagtggcccacaaaagttaaggacatgttggaggagcaacaaagacgaaccttggggcaaagagcagcatgttttgatttcccttcgatgaagtatgaggtcagcgagcaaggcggagtcacggcggctggggttcaatggggtggacgtcactacgtcgtggttgctcgagataacacatgtagttgtcagttccctcagctccatcacttgccatgcccccacatgataaccgtttgtaagttgcgaggtttggatgtggaggtggccccccgaatgtgttatgaagcttccaataaggctgtgcaggactcgtactcccctaggtttgaaccttacctagatccatcgcagtggccaagttatgatggagagttcttcgtgcccgacttgtcgttaaagaacaacacacgaggaagaagaaggacaagaaggttcaagaacgacatggacaaagcatacaaaggctcagccaaccgacggtcacaaaagccgaacaatacaaattcagagccggtcatgcaaaatagatactcgctatgccacgaactaggccataagaaaactaggtgcccgaagcgagacatgtctaaggatcgaccgaaaaagcgccgtaggacggggggaggtggtgagggtagcacacaggtgggattggatgtcattcatttgttaagttcatattgttgcttcaatgtttactttctgttgtcctcctttccgttctcattgtgatttttccatttaatattttttcaattactaatgattccattttcatttgcaggatggagcactttccggggttggaggatttctacgaggagaagcaccgggccccacagattgccagcggagaggttagcatcaacaatatggaatttttttatgatcgaatttattttttcttctatgattttagtttgtacagatagatcatccatcatagagatatctcaaataaaacacacacaaaatatttgaagttggcccaatgccctgttgctgttgcatatgcatatgctatcctgttaatatttgctagctttgccctgttcatttgtgcatatgcagaataatactacaactataaatatttgatgtttaagataagttttttccataattttaaaagtttaatcgaattctgtcataaacatcaaacaactatgactgaaggggataattttttgaaagaaagaaaaatgaatactccgaattaaccagttatgaaatatggttgtttttttacactgtacatagagagagagatcatgattcaagagcctcaaagcagaacatgttaacacacagatcttcttttcagttttcttgctcaatcccaaaattaaagttcctagttgcatgatgtattttccacaacccttgtatatgatatattgtcgctaactttatgttattatgtttggctattgatgcagcgcttgaagacccttcgagtaagaggtcacacggcgcacatactattcgacgactggtacgtcccgtacctacagcgggcgaagctcttggcgttcgtgaccatggcacagcgaccggtgcctctgtacaacgccgctgctctgacggccctagtggaccggtggcgtccagagacacacaccttccacctaccgtgcggggagctgacggtcactctggaggacgtcgccatgatcctgggtcttcctatccggggtcaggcggtcacaggtgacacagcatcggggaattactaatgagtcttcctattcatttgttaatttttttgcaattactaatgattccatttaatttccggtcacaggtgacacagcgtcggggaactggagggagagggtcgaggagtaccttggtctggagcctccagtggcacctgatggtcagaggcagacgaagacatcaggggttcctttgagttggttgcgagccaacttcggtcagtgtcccgctgaggcagacgaggctacagtacagcgatactgcagggcgtatgtgctatacatcttcggcagtattctgttccctgactctggtggagacatggcttcttggatgtggctgccgttgctcgcggactgggacgaggcgggtaccttcagctgggggtcggctgccctagcctggttgtaacggcaactctgtgatgcttgccgaaggcaaggcggggacgtgaacctagcatgctgtgtttggttgctacaggtaagttcacgcatgttatgtttcgtaacatttcaatttcttgctaacatgttggaagctaacgtatgtgacgcaggtttggatgtggatgaggcttccagttggtcggcccatgtggaggacccatcaggcttggccgcaccaggatgcagaccgacgtccctctgtagctcacctgtgggaatcggtcccatctccagtagtaggccgcaggaatttggcgtactaccactacacaaaagagatggactacctacagccagaacatgtaagctattcggggttctatcacacatgaagatggtttcttactatatagtactaaatgtgcttcaatgggttttatttttgttgctgcaggtggtgtggatgccatatcaggcacaggaagcgctcgagctagaactgaatcccatgtgccatatagaggatgcgttgaagaccctacggtgcccactgatctgcttctatgcagtggagttccagatgtgccaccgcgtgatgcagcaattcgggaggcttcaaacaatcccgcaccgtttctccacgagtatcgacctacacaagttagtaatttcacttaacaatttattttgcttgcccaatcagtcacttcaacatttactacatatttgagttggacattttgcatacgtgcagggttgaccgtcggaagaacaagaaggtgactgattgggcttactaccatcaggatcatatcacgcaatgggagaagttcgaggagaatggagtaccagaccagggtcagcacaacgggacggagttcgacttgtacttggcgtggctccacaggccctaccgtcttgtcctacgtccggcctggacactagccgacatagcggatgaccccgaggatgttgaggagcagaacgagtacgatactcgtacccgtctaggtaccacggtcgagacgggacctgttcgcgacagagtggttagtttctagcattaatattgtatattatttcatttcaatgccatatatgttgtgacttacttcatttcaatcctacaggctcgagagctcttgcggaccgtcaacgatgcgggagtggcgctaggcacggctcctggctccgaaggagagggcggcaccctccgcaacgccctacaggtaatcgttggaaagagatgaaattacggtgttttcttccaaaagcgataacttaacatggattattttttatgcagagactacggcagcgatgtcggaagttggcagcaaggctcggctgcaggtcgactgatgtggttgaacatgctcatgcccaccaagagggggatgaagaaggggaggtgggtgacgaggagggcgagcaagacaaagaggcggaggaaggagatcaggaggaagaaggggatgaggaggaagaagaggagggggacgaagaagaggaggcggatgagctcggtccctcgcagctagaggacgcaccagagtcgtcacagccggatctctcgcagcccggcccgtctcaaccacgacgccggtgggctccttcgcaggactggaggtacacccccgacgtgcctcgtcctcgcactagaggtaggaggaggtgagtgcatggttcaatggatggatggatagatggatggttggatggatagatggatggacttgatgcatggttcgatagatggatggacttgatgcatggttctatggatgtatggaatgatgttgggattgatggatggatgtatgttctgtatggttctctggatatattactgcctgtgaatttatgtgatttgatgtttgcctgtgttgtgtgcaaagttttgctaaagtttagcaaggctgggacctcaatgccaggataaatggcgctgacatgtccaacctcagcgccagtgcacctggctctgagttcccagcccagccatccagaaggcttgctgggctgggccatggccgaaacggccaagtcccacctcagcgccaggccggttggcactgagcttcccacggtcagcgccattatggctggcgctgaggtcccagcccgcaagccatccagaaggcttgctggtctggaccttggtcgttgtggccaagtcccacctcagcgtcaggcaggttggcgctgaagtagctgccacgtcagctgggggatcggcccggccgccacagtggcacaatgtcagcgccagtcccgttggcgctgacactgccaatctcagcgccaatgtgtttggcgctgaggcgacggcctatttttggttgaagtttttggcaggggttagtttcgaaataagttttccaatagggtcaatttgtcaaaaaaaagggcagaaacagagaagcccaagcccaatagatatacgaccagggcagcattgcattgtaccggaaagtccttttagcacctaggtgctgcggcacctaggctgacaaccacacgatggcttgaagattcgtgcacacttttacagtatcagatagtatatgtatgggctagcatggtatttgtttttttttattgctcgctcaaatacagcctgacccaccgtaagattcccagactccctgtggaagggtagtacgcgggaccagctcgtgtgtacggagtacgaccccatgtatcctccgccacatatccgttcgatacattctatccctttccagttttcatctctctccatcgtctgagagccaccatgaccgaacccacacccaccgccgccggtcgccagccgcccaccggcgccgtcccccgccccaccggccccacgcactactcgcatcctcctggaagctgtagtggctgccgccccgcatctccattgcatcttccgtcggcggaatcggcgcaccgtccggtctcgtcgagtatccggccgacgaatgtccaagggagtccatcaggtaagatcttcttcaatgcttagaattaattaggacccttgatcagcaatgatctaacggatagagagagaaagtacctggagaaaggttttaaaagtatgggctaggtatgtaaggtgaaagggtaaaatggtaattgattttcattaaattatttttcggtgaagggcaaaagcgagagaagctacaaacatttcagcaggaggaagaaaaaaaagagaggaagaataagaacgcgtgcgagaggaacctacatgaactacctgttggtcgtcgtcgctgccgtaaaagcctgccgctcgccgccgctgtacacgccctccggtcctagcgtacgaaagcagcagccggataccgtcaccgccgccgtcacacgcgcccgtagcgcccgccggtcgcagctgaggtacgcagcagcaggtcgccatcaccaccgccgcacgaatccccgggctgctgtctgctctgctagttccttgctcgttctttgtcgtcaggccttcatgcatccagtagttgtattccaggttctgaggatcgattttgccagcaaaaacaaatcaacaatgccctgcgctgcgcatccaatcccctgctagtttctgcgcctaatttggctatttgatcactacgtacatattctgaagatcgattgaggtgagccgctcgccacctgcatgacatcgtggatggccgattggttaggcactcgacggggtgagaattaagtaattactaagctacccttgttaataaaaatttttgttcctaaattaccctttgaagattaacggtggataacagttcgttaaagaggtacctagggtaccttccaagcaccgtaaaagaccactcaggaatttcccctccacccccatcccctgatgccacattagtccattcagataccgcgacgcacagtaccagcacatgcatggatgtgttcatttcttttttcatcacattagcatttgtattttttccgtgaaaatgcacaagcagtgcgtagctttgttgttaatttttgtttctttttccatcacgttagcaatttttttcctgtgaatccataagcatttgtgtagctgtgtgtttaattcatactattttttttctttttgcctatccacagcatatgactgatggatcggagggctaaaactgtatcatgggctccaggcactggacacgctctcgagtcagattcaatgtaaggggatcctgccatcgcaggggacccacggacctgccggtgcagaacacagccggctgggaagctcgaggggcaaccagcaggagttcatcgaaacacttggagttgaaaatcagtcctaggaatgttaacagagtgcttggcattccatttgagggcatggaggtgtgtccaatgccgcacaacacaaaaaaggagaaagactcttttgtgcaatattatatcagtgctcctggcttcgagtccaacgcactgaagggtgctgaggaagtaattaagaggatatttcccagcgccatgaacaattgggctcaggaccatttaggaccacatttgttgtgtggattgtcggcatgtttcttgcaccgaagatgtcgcacaaatctggatcgaacgacttctggggggcactccttaatgtggaagaaatcaagaactacaattgggcgaaatacgtcatcgaccaccttattgacgttgcaccgaaggcacagcacgacatcaagcataaagataaggtggcgaacaaggcgggatgctcactgcttttgcaggtaagttcagcgtggcgccgtcatgaatcgctaacacaaacaagcaccgttattcatcactcatccaccgtgttttatttttttctttagatcctttacctggacaatgccgcgttcgagggggagctgagcattccacaaaacgtcgagccaaaattagcaatgtttgaccagaagctaagatggatgctgacacgcttgcggggcggccgaagcatggggagacacccgtctacggtatcagctgggtttgtacgcaatgtacatcagcattggaagaaaatgggcgccacatgccttatagatttgtgtggttcatttttattcataaattacattggttgaaaataaaaaaaaaaaacttctgctccacatatcaacatgtacctcaaattcaactctgcaccatgacttcctgcgggctgcatcgaagtaccttagtgtgtttagatcctaaaaaaaaagttgaaagtttaggaaaaattgaaagatttggaaaaaaaagttggaagtttatgtgtgatgtgatatagtgtgataaaaatttagaagtttggggtagttaggggtgaactaaacacggccttaccctcaaagcaccaactccatccacatgaccggtgacaacgtactgggtggattcccctagttctccgtctacagggaacgttggcttcaaccacaacctcttctgcaacacgatgcaatatttcttttgtcaggttaactattgtgggctcaaaatttttacaaaatcgagaaggaaggtttttttagatttaaacacaatacctgtttgttagccttctcagcgttggcatcatcactctctctatcaaactggagctttgcaaactgctcgatgaaacggttcaaggtggagtttctaggcattatgctcttcagcataaagttggcgctctcactgcgctgtgtgctggccatgcgcgcgcagtacacacctgtcatcccctccaatggcgccatcatcccctccaacaagcacaacggagtccggtctccctcgactcctactccgacggttacattttttacaatttgcagctaacatgacaccacgcttggctaaccaggagcaaaaaagacatggaaaaaaatgcacggagacctaattaccttggaccaacaccttcgtcacacgtcaatttaaaagtattcgagagagaaaaaaaaacatcataaaatttaaaaatgaagttacatccaaaaaagaagcgaggtcttttggtttgaagtctcactctctcaacttcatcttgctatcttcctttgccagcagaggaagcaggtactgtaccaagcccagagagcaatacacatataggtgtgctcctagatgtcccaataacaaataagctcagataaaaaaaagattttatttaagttcgaatcaattttggtcatcccaaaaattggctcgcttggtcttaattataatcaataatttttaaacaacatctcagtaatcagaatgtgcaaaaacaaatgtgctgtaggtttctttctttcgtccaacaaaatgtatgggaaaaacaagcaaccatggacaaattcgttcaccattattgctaaaaaaaattgaaactttaaaagccctggagttcttgcgtggcggcgacgaagaatgcgtgctcctgcctcgtctcagcgtctgccaatgaacggatggagaaggacctccaagaagctcgtgttgttccttcgtctcggctcgccggcgtccgctcacagtacgaatgaaaatcgtagtgtttgggcaggggaaggatgctgccgagcagattgtcgcagcgctcgagcaggccgcggtcagtccggagctcgtcgggtgacaccggacacggctgctggactttgcggggcgtgaacgcctggatgctgctcatcagcttgcctcagctccatctcatcaattagcattgcggcgccaggagtgctctctttcaatgttggcaaccaataagcactgcaggcaaaaaagatgctcttttttttttaccattccacaagtggtgttccggaaaaaaacttcaaaatgcagagacggattcaaaaaaacaaaccttccgtcagcttgatccaaaggacagtatatcatcatctacagcctgatccgaagaaacaacccaatctgaagagacaacatagtcataatatgcatcactattttgttttggcaaaaaaaaaaagagttttacgaaacgcagaacgcgaactcgcaataccattttctgtttcgcaaaatgatgacaaacaacaaactcaccacgaaggattgctggactcaggcggctcactcgcattctctgcatagcaattctcctggtcagaataggtatgtttttgttgttcgcacacgccagtaagatcactctgcacgacgccccccacattcgctgcttgctgttccacaatctccatcaagtagctatacgggcaatctccactgaacaaagaaaaaacagggctatcgcctatcggctcaccaccaagactggacaaagaaaaaaaaaagagacacagctagctgataagggcaatcatccaaagagcacggggcagaggacgcttacgcgaatccgaccatgggagatccggacgacgagccgcaactcaggatgagatatgtataggacattgagctcgcaagctcttcttgagcgggcttgttgctcgacacaccaacctcatctgccgctgtgcatccatcgccgatggcatggtgtagaacagccagcttccggttagtctgcggcgtggacgccatcgccgccgtgtcggcgaggctaagcggggggtgggggcggaggggcgcgggggagaaagggggaacaccagggacggcatgtcctggaacacaccagccacaaaagtagtacagtattttctgtaaaagaaggtggaaggcggggaccacgcaatgtaaaaagtagtattttctttaccccgtatatgattggtaacatacagtaccgtcgaaaacaccgcaccaatcgcgggatccatccaacggcatgaagcccccacctcctgcattgtacctcttgctggcgacgagcaagtgaccttgacgaggggaggccaggccaggagggtcgaggccggagagcgagcgcgagcaagtcaagacaacggccatcgcgtcgcgtggtgggctggtggcaccaagactacgattttgagggttaggggtagtgatgaaaactgtttggaaaatttcacctgcttttgaaaatgaaaagtgtcgggcataaattttttcaaacaaacatattcccattttttttcttcgaatcaaaaatggaaacgaatacggttagatcactgtctgtcgaaataggaatcggacagaagcattcctgaaacgaactcggattttcttatgggaattggaaaaaatatatatatttatcatatataggataaaatctttagccttatctattctagatgtacataattatatatttgaggtgatcagttgaatgggattttttttttctagcccaatgctctagaactgtttttcttttgcctaatgacttttttttgtctttttaaagccattccatactggttatagttatatatgaatgtagttttgcttattgtaagtctccagaaaagtaaagtgtataattagttctattattattaattgataaaaaattagaaatataattttactgttttattagaaaaatattgagctatatcttttcgttgatttgagaagctaggttagatttcttcatattttaataaatatttgttaccttatttgctctatatttatgcaatgccatattattttatagtggaaacttttgggtgtcacattaagtctatggagaaaactttccttgataatatttgattatattttcgtatacagggttcaattcctactgcatatgagaagatataaaactcatgatatagtaacatttgttcaaacatataataagtaaaccttatataaaatatatgcacttttagattgttgatgtgtaatataagtatggttataaccatacccgagctagtaacatcctcatcacataccctcgctcgttgctacggggtaaccgatcacttgctaagcattgtacaatgatcgattctctatttaccaattaaaaagggttacatagtcacgggattaaagcccatataaataaaaaaatgatatcaatcaaattggtgcaagccatgaacctccaaaggcacaaagatggtgaaagacatatttagtcaacaaataatggttatttaagaaaatcgacaaataattattgaacacactaattaagtattacgatgcacctcttatcatgtcagtactactatgcacatataacttgtgtactaatttgcagcagtactatacacattatcaatttttgatgttcttaacatgtcagtagtacattagtcatataatctataccatatataaaattacaacccactaagtctaaaacttaatatgtataccatatataaaattacaacccactaagtctaaaacttaatatgtaaccataccatatcattatccactagcaataattacacatcaaacctcattcaagcatacaacctcatctatgatttattgaattctacaaaccgaaatgcaaacatattcaatcatcatccttcacatcttttccacaagccacaatattttaacatatatatctatcatatctataatacttaatatatatttatcaatatattctgcatcaaagcatggatatcatttgtctttttcacgattagtattaatgaactgtgacatttccttaatttcattttgctcttttgcttctagcttaattgttgaaaaaatattaaaaacctttttaagtaattcacgtaacaaagcgctttacggtactactttacacactacaaattgcaagccgttgccacttgctacctctaggcccaatggatgaatattactagaaagttgatttcaaagtatatgaaatgaataaaaaagggaaaggtaatgcactcaactagaggtgggccccgcacagatcggacggcccagattattcggctcggcatctggaatccacgacgggcagggcagggcaggtaggtcgtctcctctctcgtgtctcccccctggctcccttggctttggctccgctccaggctccagccgagtacccgcctcctcctcctcgctcgccgcggaatcttctggaagcttctagatccggccgctacgatcggcgaagaagggatggggcaggccttccgcaagctcttcgacgccttcttcggcaacaaggagatgcgggtaccccaagcttttccactcttgtctgtctcgtctcagattgggttttggacggatcatggatgatggtggttttggctggcaggtggtgatgcttgggctagatgccgcggggaagaccaccatactctataagctgcacatcggcgaagttctctccaccgtccccactataggtaggttcactctcatccctccctccctccgcctcatcgaatcttttattttgttttgagccaaatccaaacccaacctaacatcatcatcatcatcatcatgcaggcttcaacgtggagaaagttcaatacaagaatgtggtgttcactgtgtgggatgttggtggccaggaaaaattgaggcccttatggaggcactacttcaacaacaccgatgctctggtcactctttttttcccctcttcttttatccagcggcatagggaaacatttcttacacataacgtacctcctttgaacaagcaattcactttgtgactttatttctcttgcttatcaaaaaccacatcaatcccaccaagagcaacaattgctatgccaaatagcattacagctcctaataatcttttgctcaagattgcctacaaggaccttttatgttacagatccacgttgctttatttaattagcacgcacattttggtttcagaaacacttttcttgcgttgtaaattcctctcttcttttgtaaactcgcagatctacgtagttgattccctggatagagagaggattgggagagccagagctgaatttcaggtttacatatatgtataaataatttattatgaggcagcaagtgtttgcttctgcactgacatttgttgccttgttgctctaacttactgtgtggtaatctgtctttcaggccattattaatgacccttttatgcttaatagtgttctattggtgtttgctaacaagcaagacatggtatgctcaacttgtctctttttctttttccagaacctgtatttcttatggcagctactttaacatcatctagcttgttcagatgactatattacctttttccaatatataattgtttcctgtatatgtaaattcatcatctgggtagtacatgaaaaaaatcatttgttattgaagttcacatccatgtaacttgtgtttcccatcgcccatgtcactatgtgagattgctgccattcatggttgatgcacttctatcttttgttgagtttgcagatgatgaattaattgttggcatgtttccatgcttatggtatgatgatgctaaattttgttggcattgtgcattcacttatgaaaccattggaatagtatgactctgcactagataacttaatggctttattatttgccactgaattgttgctcacccatgtaatgtatctgctagtgtagaggggcgcaatgactccgatggaagtatgcgagggccttggtctatatgacctgaacaaccgtatatggcatatccaaggaacctgtgctctcaaaggcgatggcctctatgaaggattggactggttagcaacaactctggatgagatgcgagcttcagggcggataacttcaacatcatcgtcatgaagaataacaagggatagttgatccttgcgctatgtggattgacttgatgcctgcatcttgctttcttttccatttgatttcctcctctcctgttgtagctattggtcgtgaactgggcgaggctttttagtaaagctttgattcaggcaaaactgtagtgttacgaaagacaggtgacagtgatgcacttgcacttgggaggagtggttggtttacttactgaaagttcatcttttcgtggaagcgggagtggttgtaaatatatgaagctgctactgtactgatataattgtggttgctcttgaaccagttgtattcgtgaattttcagattcgaagagttgtgtgtatattttttttcctttagtaggaaagggcactcgatgcatttctcttctgacgaaaaatggctttgtatcattatgagagcatggatgtgaaatagatcgtacgatgccaattcattcattggttgggttcagggggcagagtattggcgaaactctggctgggtatgcctgtctccattggtgatggcatcatcggcaacctggccctgtctgcgtagtcactctagtaactaactagtagaggtgttggttgtgatggcgttcaattacaacagaacagatacaattctcactgtacgactaggagcaaccaccgcaaaagctaagcgtgctcacaagtaacacaccaaatagatatacaattacaaattcagtcggtcagaaccgcctcttctgttgagtaggataaccggggttctgcatccccatcccttgatcagctttccttctcaactgttgcacatatcaaaagccaatcaaatgttgcatttgtcacaggcctttttccaagcaacatttacttccaaggcagcagtttttacctgatgcggatgagattgggctccagcgcccctctgcattggaatattaccaggattcatcccagctatgcctccttgcggagctgcaccaaaggccgccatgtttgtaccacccattctcgacataccgaccatgggttgttgcatttgcctcggaatgggtctcggtaccacagactggttgccaggagctgcgttccctgatggctgaaatacaaatgtacaacattataaaaatgcacctcataaagcaacccgaatcaattctgcaagaaaatgtgccaacatggagttgggttccttaaatcacactggaccaaatctttgatggcattgaaaaccatgtatcgacttgttttgaccaattgaatatgccctaaagcacgatatttttgccaactgtataaagaacttagataattgaccaaagaaaatgcatattctgtatatcgcttcccaatactaagtaatactgataagtcttggtaaaaaggtggcacagggacagaaatccattaccgcttgagttggttgaaggcttgttgttccttcaaaatcagttgtggtatcaactggacgcacaggatattgcacaattttctctccagcctgcgatggtaaaagtgcactgaccagagaaagattttagtcatcttcatttgtggaggaaatgtaaagccaaatgtttaagagttgcaagttagggaaagtatattaagaccctgattacacataacttacttccgtccaggcagaggatccattcgaaagtacctatcaacagaaaagggttgttcagaaggattgctgtagtaaatcatactccctccatttaaaattacaagtcttattctgagtgggcaaaaatgattagggagggtggaaaaccaagagaaagaagagttcaaatgaccatgccaccatactaaaatacctcaagaataggtgtggagatggttagtaagatgcttcttataaatgtgggagagagactatgtaataattgtgggcacataaagaaaaaaaaattcaataccaacatgcaagccttatattttgcaaaatgattgaaaaaactctaggcctttcaaaaagaaacagaggaagagggaagactatagccttacaaaaagaaacagagggcctatagccttacaaaaagaaacagagggagtaataaacaatagcaccacaacgaaagtagtatttcctcgagttttcagcattaaaccttcatccaagccactagagatgaaaacatttagaagtatagcgaatcaaactaaggattgcatatatttatatttttaaagtaaaatatataaggtttaggatgcacaaatatttacaaggaaaaattgaccgttagccactctaaacagatggtcttggcaattttacaccctttaagccacaccactaccaccaccactccagcccaccccacaaaatcagctccaactgaggaccatcaagacctcgtccaagtatcaaaacctcgtgcaaataaagcataactgtttttcttgcatggttgctaaactagattcagggaagcaattagaactccagatcgcacttgctgtacactgagaacataagaagtatccaactaggcaaaaaaggaataatgaataaatggagggatgtagttacttactcatgttccaaagcttgcgcagctgttatacgctttcgaggatcatacctgaaacaggaatatataaggttattaaaacaacatttagtagtacaaaagatgaatgtaagaaatgataatcatccaaggttatgttggatttatagcaggccaaaaggccagttacatactcgagcatttttgagagaagatcaaacgcaggactcttctgaggcaagtgaacaatattatgaagtcctgtgttctcactgcaagggagaaactatttcctcaaggaaagataaatgctattttcacaggtttttaaaagcagcttaacaatgcatgacatactacttatgcccttgaatgtgttgttgatcgttttgccagcatggaagattagcgagggtaggccatttctcaacggtaggatgacctggagaataattatattattatcctagagcatatattatctcaggaagagtacacaatcaaatagtcagaatgagaaatgagtcatccatacctaagaccttaaaaatcttgtctagttgatcaagctacaagacatgggcaaatcaactgtgagataaaaataaatggcaaatgaatggcatacatagcatggatattctacaaaatgtaatacagcaggatatataaaatgcaacaacatacaattatcaactgcctatttacttttaggaaggttccaggcaagagtgataatatctttacttgaaattaagcatcacatagaaaacgtaaaatgtcgcagtcttagtctagtatctagtaattgattctgaatacaaggtaacgatagcaattacttgagtgtgaatgcccatacttgaaacgggtttggagtagctttggcttcaacaccttggaacagtggtttgagtgtaagcaattcagcaaaaatgcaaccaactgcccacatatctagagttgattaaggaaatagctgaagtgaataaagcgaaaaaagatggtcgaaagatatcatttcaatctccagcaaggataccaacagcacttgtgtagtgctttgccccaagtaacaactctggagcccgataccagatggtaacaacaacctggaaattattggttagccatatacttgtgggtattgataacacattaaatgcttccacaaaaaaggaaaggaacagatgagcatatgaaggttcatcacaaaaaagaggaaacaagcagtagttttacaaataactaccattttttgcccttatatgccttgaaataaacacaagacagcagcaaacatgctaatgggcacacagatggatgtactaaccccgttatcacttaatggctttaatggagcttgatatatcctagcgagtccaaaatcagcaatctttataattccatgttcttctccttctcccatgacctattggggcacatcatcctaatccggtgagccaggaaaagcaagattgacagagttgtacatcaaaaggtagcatatgacaacataccagtatattagaaggcttgagatctcgatggataatccagttactgaggaagggaaatcaatttttagatttctttttggagacaaaatcagaataagctaggatcccagcaaaaaaagttccatgtgctaggttaggctccagtttttacatatcactcatcatgataacttaagaagtaaacgatacctatggagatagttgagaccattgagcagttgccagagcaaagatttgactgtgtagggatttatggggaggttaagcttctctctgtgatgcctgataatctcctgtgatatgtttcataggttcattagctgttaactggagtaaacaaatgattactactgtccaatagataagagagaagattggagatgggcgttgctgcttacatagagatcgtgctcggcgtaatcgaaggcgaggtagagggacatgtcggcgtggttgatgtgaacattgacgagcttgacaacattctcgtggttgatctcacgcagaagctgcaagaggagaagactagtgattagttagggtttggtatggcagggaggagtagggaaagcggatctccctgaggaaggtaccatgatctctctgatggcggtgggcgagacaccgtcgccctccttggactgcttgaacttcttgatggcgatgggagagccacggcggccaacgccagcggcagcgtggggatgcgattgtttgaggcgagcgaggaagacgaggccgtaggtcccctcgccaatcttgcccactagttcgtattgctgcagccatgccggccgattcgttccacctccgacgcggccgtcccccatcgccgccgccgctgccggagaagaaaggaaaagggggaacaaaagatccagccgaacccgcccaacagaaagggcgtttactccacacgaaggcgtaaagccaaaatacgctcacacttgaaaggtccaaactagtatcgtcttaaatttggtgtaaattttcattcgaaaatcatatgaaaattgcaaaattgggaaaaattaataaactacaaaataggaaagctactatttgttgcatccaaaatgaatttatactgatcgaagcagaatctaatgaatgagacacacctcaacattttggtgctagaaattaaggcaaatttggccctatacaaagagagagaagaagctactgttcattgcatgtaaaaaactagtgtgtgcatatcaggttgaatttttaaaggtcacaaggatgatgattagaagcagtgggaggtcgggcaacagaaaaaaaaagtgtggcgaaagagtagagagtggtggctggtgtgacttttaaaaatataaaactaaaaacaaaaaatgatgataggatcgatcttttgaaagactaaggcaactaaatggctatttaacatttttttaataaaaccatgtgtaaaaagttagatcattttgtataggtgctagcgcacaattgtgcgggccacctaactaattccaattaaataagctcattaccttttgctaccattttcttctttccatctaggcctgtgttgcaccaattagaggacatacctttatccttggttctatctataggagccggtgacgctaccactactaaattgtcatcgttgcagccttggtcgtgccttgtgagtgctagggatgttgcgccacctgcccgtcccctcgtctctcatgttatccctcctcctcctcctcctcctcctaatcctccatggaacgcatggggggtcggctgccgaggccacatgcaagaaggcaacgaaatggacagtggttaatgggctcaaggagtggcgcggcggtgggcgatgatgctaaggttgacttcgtgcatggctttggtctcagaggctgcattcatgagagggcaaaggagacaaggttaagcaaataggctgctgagaggcaagggatccaaccttttggggtgttgtgtcaagccttgacgccgtcagcaacaaaggcctaccaggacaagcaagaagggaagcctagtagctaggccaccctaccatatctgccacatggggaccttcacctctgcatcatatggtaccctaaccagagtctccaccaatcaagatttatgtgcacctccttctatacatatcacttgtacaagtcaccaacatgaatgtccacatttcctataatgcctatttattcctctttggtagtttttccttgcttaccctaccacacaggtagccataccacctcctaacatgttgcttttttgttgtcccttgtgcttgccccatccataaaactgcccataagacaccgccatagtcttgtaatcttgttaccatgtcatcttagcctccgtcaaattccatacgaccatctacagtgaacattatgaaatgtaatcaagaacattagttgtttactgtggttggcgatgatggagacaccattgatcaaaatctccaacttccattttcaagattttaggcctcacttcaacggctttttggagtatgccaagtcaggatgggaatggttaggatatgaatcgtgcctaaaccatttccactgagtttatggatccatggtctaacaaggtcaatccactacgagttcattatatcgatagattatccatgaacacccaaatggatcatctgcattactaatagaccaaaaaattcgtattacatgtaggtaaaactcggacatacaatttttttaaaactcgtgctcacactataaaaacttattggattttataggaacgatttattatacaaagcatgtggggcccataatgggttacctgtatccattggataatacactccctccgtccaatacatgtgaggcccacagtgtagcagtgcgcagcttggagctagggaggtcatgtgcgcaaccatcgccatggctgcggcactccggaattactaattggacgcctgttgctaggattgtgcaagttctaatggtttgatccgtttacattttggagtgattctaaagattcattagagtaaatttaaggatcgattcaatttataagtggattgaccctagccattcccatcctgattctcaaggtactacaaacatctccttaagaaactacaaaggaaaccctagatcaatgagcagcataaagtgtctgaaatcccattaaacctcatcgaacgattatttggcagtctcatataccctttttttaaaggcaatactcaatgcccgtacacaatagactatacgggttgcctaccaaagtttgaatttcaatgttcaactaattccactatgagtcacatattcccctaggattagatcgatcctaggtagactataggtacgggcatgttcgctttccgcaggactccgcatacacacaaaaggctttcaggtctatccaatctctttttagttgtccacggtataggattaaagcaatgaataagcaataaaagctcacatcctgttttgcaatatccattgtgagggaaggtaacaataactatcaactatttgtgctacttcctttaggaagccaaaaaatatattatttatatagtgtttacaggcagatgcgttaaaaaataatgtagcagttaaccgttgcaattcctgttgcggcaacgttgtcgctttatccttaaagaacagagacacaagtaaggaaattttcatgcgtttcatcaaacttcactagagagaatggatccatccatccaatagaggtgcggaccagaagcgaaggccacgcctcccgccgtcccgcggcctaggcagcctccacgatgatgcagatgtggagaggccgcggctgcgtctttagaggggattaaaaagattttctgccatacttaatgtaagccgttgacattgcatattcgatgacttgtgagaacgctttttttttaaaaaaaacagagtttgctccacaaatagaatgggtgcaagcggtgtgcgttgacaaacagaaacatggacatggcattcatgcgcaactggagcaactaattatgtagcgagttgtgtgcgggcgattttgaccttggattgttatcgttacaactggatcctagtggcttgttaattagtgccatttcccttaaacctggcctatcggaggaggaagcagagagaatcgacggaagtgtagctatcgattctgatagcgtgcagtacgtgttgttgacaagtgaagcgcccttgtttggtgttatatataagtgagtaaactaagttggactttgcgaaaacgaaataaatggagttttgtataatctggtcgccatcagagaaaacgacgagtgtgtataatatactgtactactctatgatgtacgcatgcagctggaatatagctagctagtggatgactgggtcaaaagaagagaagattccgtgctcaactacccaatcactccaaattaagctcgcatcgcatcgcatctatgactggagagtgtatctttgcttgcatcgcatatatggtcattatacgtgtataaatacgcgcctaataggctaggcacacatctctgatctgctagctagtacagtacatatccatctatccgtctgttagagtaaaaattccccatttaattaggatcgatcgattggattgaagctggcgatggcgagcggcgtgtgccctcctgcggagctggggttcggggcggagtactactcggtggtgaacggggtgtgcagccgcgccggcagctacttcggcggaaggccggtgctcacgcaggccgtcgggtacgccgtcgtgctcggcttcggcgccttcttcgcgctcttcacctccttcctggttagcctccgatccttcggcctctcctctcttgagatcgatcgatcgatcgatcgcagagatatgattaattaatttgtggctactacctacgtacgtatgcatatatatataggtgtggcttgagaagcgttacgtcgggtcgcagcacacgtcggagtggttcaacacggcggggcgcagcgtgaagacgggtctgatcgccagcgtgatcgtgtcgcagtggacctgggccgccaccatcctgcagagctcgaacgtggcatggcagtacggggtgagcgggccattctggtacgccagcggcgccaccatccaggtgctcctcttcggcgtgatggccatcgagatcaagcgcaaggcccccaacgcccacaccgtctgcgagatcgtccgcgcccgatggggcacccccgcccacctcgtcttcctcaccttctgcctcctcaccaacgtcatcgtcaccgccatgctcctccttggcggctccgccgtcgtcaacgccctcaccggagtcaacgtctacgccgccagcttcctcatcccgctcggcgtcgtcgtctacacactcgccggcggcctcaaggccaccttcctcgccagctacatccactccgtcgtcgtgcacgcggtgctcgtcgtcttcgtcttcctcgtctacacctccagctccaaactcgggagcccgcgtgtggtgtatgatcgcctcatggccgtcgccagcgccgcgcgcgactgctccgccgacctctcgcgcaacggccaggcgtgcggccccgtcgccggcaacttcaagggctcctacctcaccatgctcagctcgggggggctcgtcttcggcatcatcaacatcgtcggcaactttggaacggtgttcgtagacaacgtacgtacccaaacgtacgtagtactaataattatcttggatcgtcaattaattacaagtaatttaatttgctgcagggctactggatgagcgccatcgccgcccggccatcctccacccacaagggctacctgctgggcggcctcgtgtggttcgccgttcccttctcgctggccacctcgctcggcctcggcgcgctcgccctggacctcccgctcaccgccgccgaggcagccaagggcctggtgcccccggccaccgcaacagcgctcatgggcaagtccggctccgtcctgctactcaccatgctcttcatggccgtcacatccgccggctccgccgagctggtggccgtctcctccctctgcacctacgacatctaccggacgtacctcaacccgggcgcctccggcaagcagatactccgcgtgtcgagggccgtcgtgctcggcttcggctgcttcatgggggtcctcgccgtggtgctcaacgtggcgggggtgtccctggggtggatgtacctggccatgggagtcattgtgggatccgcagtcatccccatcgccctgctgctgctgtggagcaaggccaacgcggtgggcgccatgggcggcgcggtgtccggctgcgcgctgggcgtggccgtgtggctcacggtggccaaggtgcagtacgggcgcgtgaacctggacaccacaggtcggaacgcgccgatgctggcgggcaacctggtgtccatcctggtgggcggggcggtgcacgcggcgtgcagcctgctgcgcccgcagcactacgactgggggaccagccgggagatgatcaccacggtggagagcgtgcatgccgcgctggacgacgagctcaaggaggagcgcctggtgcacgccaagcgttggatcgtcaggtggggcctcgtcttcaccgccgtcatcgtcgtggcgtggcctgcgctgtctctgccggcgaggaggtacagccttggctacttcacgctgtgggccgcggtggcgatcgcgtgggggactgtgggctcggtcgtcatcatccttctgccggtggccgagagctggaccaccatcaccaaggtctgcgccggcatgttcaccaacgacgctgtgtacgaccgcctcgacgacgtcaacctccgcctccgcgccatcatgggcgccatgcccgaggctgagaagcgctaccgccagctacacgagacggagatgcaccctgccggaacccatccggccaacgacgacgacgacgacaataataataatcagatgatgcactcctgattccatccaatcatccatccatccatccatagactaattaagatttctacgtactacatactactcgtacgtacactttttatatacacacatatatgtatggagagcccatataattaaaaaagagtgtgcatcagcagcgtgtgcatgatagtgaacacgttttgtgtatactacaaaataaccgatgtttctcgttagctgatatgttggttgataataaacaggcagcctacgtcatcttcatcttcttatcgttacaagcaaaaaaaaaatatggccatgacatcgaggatggattctaatctcttaaatggattctaatctcttaagtagacgtacaccaatttcttgtatatcaactaaataattatgattttttaataaaaatataagatagattaatgtgtaagtgtacgagacttgcgaagtggcaagagtgttgggatgtattccttgggcaaagatcaataaaactcttattgacagcatttgttctccctacaatagcatgtcttgattatctatgggtacagaactattattatccattcaatctctcctatatctcctgtaatcactaacagaagatgcatatctttcgccatcttaataagttctgagctgtgatctaacttgactgataagtgatggcaagtttaagtagcttttcagaataccgctaggagagtgatgggcctgaacttgctgggaaccagaaatcagaattggatatgtgacagcagtctgccagtctctgtgcaagcgtgttgacaataagacggtgccaaacttgctgggaacaagaaatcagaattgatatgcgagcatgtaacctgaatacatgtcatgtaacaagaaatagggaaggaaaaactctgttgctataggttctgatgtagatttaacgacaggattgggtaaaaaaagaacctccaatccaataaactgaatctattcagaataacatgtaccgtcagaagtgccaatcaaccgattgggatgtcaggagtatttcattcaattcaggagtcaggagcaaccaagccaagagaccagatcaatcatagttcagattcaagataactgtactgtataaaatatcaatgaacgctccaaccagatcaatcatgaatattcatgaatgaatgacattaatattgaaaaccaacactcacaacatgcaacggatagaagtgttgatgttctcaccaacctggtacatgtcgaaaagaggtgctgagcttgatgcaccaatcgcaccaaccacatgtaatagaagcgggccacttactgacatgagctgtcaaactgaaattaccaagggccattcatcatatcaacattcaacattacataagtagggcagtagcaaacattcaggagtggctcgaaccttctcaattgataaaaaagtgagtacacttcctggaaccagaagatgcaaagttacaatgcaactgtcatacaccagactttctgcagaagatattcaggaagttatcatcttagcagctgccaaagttctaatgaaatgcgtgtgtgtgtgtgtgtgcatgctgcgagttacagatacgaaaccggttatatctagcaggaaaaggaaaggcttatatgatcagtgaaatcttagttacaagatttacaattacattcttattaatttcttggtctttgaggcttaagccttttgagttcgaaacagcaaatcatggttgtgagatcaaggaattgaatcgcttccatctccaacaacacccctgaatcaccatcttcctcgatgttcagcaaactgaaattcgacgcaagtagcaactaggccagacatagggttggtagtgctcacaattccgccaacttgtttatgaacctcctctcagttcttcgctaactttcacatctgagcattcatgcaacaaaatcacaagatcctttgagaggctttgcaacctactggaatctgtagctctctataatgttgcatctggttcctctgatgaatggctactctgaagaatgctctcatgaaacatctgaagtgcgtcttctgctgaaatttcttgcacagaattattcagttcttggagttgtcctctgcactggacattgggcaacaatttttctttcaagctgtcagggagactagctaatgcactgttttaaggacaataaacagaaaacagaatcaataaggatgctacaagcggctgcgtacaagaactatacttggaatggcaaatatccattttaacctggtaatcccacgaacaagaccccacttatagccaacatgcacagattgcccaaacccaacattgaacccctcttgggcgatgtccttctgtccttctgctataccatccctgtatcccatctaaaggaaaaatggaaagattactttacacattctggtccaaacacaagtttcacaaatcataactaaagaaatatattgcagtaaagatgatttaaatggaacataacaatttcacagattcctttaggaatagggcaaagttcccataatcaaattgctgccttaggtttataccttatgaaactggttctgcctgtgaacccactctctgtctaatgtggatccatgaccaggagaatccgaaacatcatcccatacatcatcatcagcaatagcatcatcatcaaccgaattgcctgaacaaaacacacgcaaatcaacttattgtagtacctttgctttgtattatcaacaagcacaaccatcatttgatcacaggttgctttgtaagcagttcaaatatataaacagagctacatgatagcaggatgcaattctagtgtgtacatcccaagcaatgacaactaacaagtaggctaagataacatgtgcagtgacacgaatcaggctgagagatttcactgtccttcgaagctgatgatgatagggttgtctattggatcacctaggtttatatctagtcgggtggttctatttgcaatggatgaacaacaatagatgaatgaacaaagagggagtgagaggatttagggttgtgaccagtttttgttgaggaagaggaagtccggccggccatcgtcgttgtcgtcgcgggcttgacgtggacggcggcgacgatgtgctcggttccgatggcggtgatgcggttgcagcagcgacggtgtcgacgacgaggcgtggcgcggcggtggacttcccgtcactggctgcgccccctcgatcggttagggtttatggggtggagtggcggcggcgacgaacctcgttccttgtgtcgttatgccgtcccgtcctccacccctctttatatggcacagtgtgacgggggcccaccagccattgggctgggcgcccccgatcagggcgcgggtcaaggcccccttgagccgttgggctcaaggggagggagatccatctaacattctcccccttgatctcactatttcctttagctttttctattccatcacagatttacatatagagcatgtttcatcgtcacggttaattaccgatggattcgacagccactatacacatctctattcagaaacagatactttaacttttgggccctatagtccaggattcataaggcttcccttaaaacccatgcatgctacatgttccttgaacatgttgggaggtaggcctttcatgagcggatccgcgagcatcctttctgttcttatgtgctcgagactgattgtttgatcccggactttgtctttcacaacatagtactttatgtcaatgtgtttggcagcaccacttgactaattgttgtgagagtacattactgtgggttctttatcgcagtataactttagtggtttctcaatactatcaaccacctttaaaaccgggtatgaacttcattagccagttcacctgccccgtagcctcatggcatgctataaactcggcatacatggtagaccctgcagtggtagtatgttttgagcttttccatgaaatagctcctactgccagggtaaacatgtatcccccgatgttaactttgtattatcttttgcaaagtcagaattcgaataccccactatgtggagcgattctgattttctgtaagacagcatgaggcttttgttctttgcaaataatctttactaattccagtgctctaggcctggattactttgcaatctgccaaataacccggtaacaaatgccaagtcaggtcgtgtgcacacttgagcgtactgtaggcttcctacagttgacgcatatggctttattttcatttcattgagctcatactgatttctaggacattgtgatgccccatacttttcgcctttgactataggagcaggtgtagcactgcatatgtacatattgaatttcttcaacaccttttctatatatatgccttttgagaaaatcccaatgcatactttgttctatttcggtgaatctctatgcccaaaacatatgaagcctcaccgaggtctttcatgtcaaagtttgaggacaagaatttctttatttcctgcagtagattgacatcactactagccagtagaacgtcatctacatacagaattaggaaaatgagtctcccattcttaactttgaatcaatacagttgtcctctacattctcttgaaaacccaaatttctttattgttccatcaaacttcaagtagcattgtctcgaagctttgctttaacccataaatggatctctttatacggcatcccatattttcgtttcatttcatgacgaaacctttcggttgtgccatgtatactttttttcttcaaatcaccatttagaaattccatttttacatccatctgatgtaattccaaatcataatgtgccactagtgccattataatcataaaggaatctttacaagagactggagaaaagtctcattgtaatcaatgccttctctttgcgtgaaaacttttgccacaagtcgcactttaaacttttctatattccctctggagtcatatttggttttgtagacccatttacagcctactgttttggctcctttaggaatttcttctaaatcccagacatcatttaatttcattgatttcatttcatctttcatggcttctcatggcctcttcatatgagatgggatcatcctccatatgcgactctttcaggccttctaggggcctcctattctggcacattatctgtttgaggctgttgcagctcctcctctgatgtggcaataatttctgttgaatcctgtagaacagattcctcactttcattcattgttgccacaggagagataacaacaggtgttggtaccgcaacggcatgcattgctggcacaacattagcaggtagagagaagaaaggttcctgagtcgacggagcgggtacagacacccgcctctcctcaagatcaatttctcaaattaccgagctccccctaatcatttcgtcttccaagaagacggcgtgtctcgtttctacaaactttgtataactgtttagacagtagaaacgatgaccctttgatctttcagaataaccaataaaatggcagcttactgttttgggttaaatactttatcctttgcaggacttccccacacacggaggattcatagctcatacggtgttttgggcaccgatgcattctatacattgtatgcatcgttctaaaactgagaactccaatggaggaagaactacattcttaaccagtctctcaattctccccctcgaaatatggcataaacaacagtgccataatttcgatgagacatcagaagttcgcttttcttttcttttgtcaacgaggacacaacattcacattctcagaaagagataacaaataaagctgatcttgcaacacaagaccaatacattcattattataccatagttcacatttgccatttcatatctatcagaatccaatttggatacacttattatcaagtttctttgcaaagaatggacataaaaacatctggaagtaaaagtgtgaagccattcgcgagttctaggcgaaaatctccaacagcttcaacttttgcttcaactccattagcaactctaatggatctttcacttctttgcgtagtcctcattgaacggaatccctttaaacaattacacacatgaatagttgctccagaataaatccaccatgtggatctagaataaccaatcataatgagattctttacaaatgtaataatgttctcacctttctttgccatgatcactgtcaggaagtcaggatgatctttcttggaatgtcttgtcttcttgcagtgtagacactgatcttgtctcaactgtaaactgttgtttctgaggcagatgctgaggctgtttttcttttgaggagggtgacctgtggctcttttccttgttatctttgacaaggttaatggagtcaccattggtctctttgtgtctttcctcctcttgcacacaattagagatgagctcttcaatattccaattctctgtacttattttgtagttgacaacaaggttgtcaaagttctttggcaatgaggacaaaaccagatggaccagaaagtcatctgagatgcccaaatctttttgcttcaatttggaagccatgttgctcatcctaagaatgtggtcttttacaccacctccatggtacctctctgtaaaaagctgctttatcagctgtgtcgcataaaactttgaagaaccagtaaactggctctttatactttcgaggtatttagagacagtgtcatactctgggattgagcccaatatggttggctcaatcgtgttctttaccgcagccaaacaattcttgttggctgaagaccatttcgcatgctcaatgtcatacgacatgatgagggaagcattgtccctctctctcttttgccattcagcatctgactctttttcacctctgaaaatttcagcaggttctataggacatggggtagtcaacacccagtccacctctcccaagataaaggcaaggtcgagttctcttttccattcttcgtagttatctcctttcagggtcggaatatctttaatgtaacccatcaaggagtagccacctgagataatcatgtattgtgagaacaaaattaacattaaaattattatgtattaagtctacatcaccgttgggcagaaaatagacataacacataaagccataactataacattgcaattatcaacgttggtcagaaaaattacaacatcatagcacataattaatgttcctaaaattaaaatctcccgttggttcgaaatttaattttagaaacactaattttcatcaatttcatctatttgcagcggaagatctatatacaattcgtataaacaataacaaaactctgttatttactctctgtaaaattctcccgttggttcaaatttaaacagaggtaaaacatgcaaaaacaattcaaaattctattgtaatttgcatgaaaatatacaaaatacatgttcagaagcatttctcacatttatctattctctaaacaattttcacgttggttcaaattgcttagaaataatcacaataattatacataattgaaaaagcttctgagaggacctattattaaactcttcttttctttttctttcggccccgagggacctaaattgaacttttccggcctttgccggtcggtccatggccaccttgcgcacgggcgagcgccccctcccctcccccaggccgcaacctgggcctgggccgggaaagccgccgccgcgcgctccccacttgggccgctttcggcccggccgccgtcggccgtccgatcgctagggtttcgatcggacggccgggcgctaagatcggagggacaaaaacccgaccccagccgccggccggccgaaaccctagcctcttctctcttgcgggcgggtgcggccgcgccgagtggcgtcatctacgccggcgacccttgcgccgccgcgccatggccggcgacctcgcgctgccgctcgcccactttttctctagcgcgccgccgggcggagcggccgagcggagcggcgtcgccgctgccagcggcccttgcgccctcttccttttctcttctccgctccctccaccgtctctagcccccaccgtgtgagagagagcggcggccgaaaaacggagatggcggcgccgccgcgggccccctcgccggcgcgcgcgtgcacccgcgggtgcgcgcgcggccgtcgagtggctcctcggcggtgcctctttgcccctccccccctccgtggccggcgtcatcgacggccggcgacgaggtaagattagggttagggtttcgatctttttgatccgttggatcgtttgcttttctctttggatttctttcttctctgtggatgtctatccccgaaccaaactaaacgctaggatggctctgataccattgatagggttgtctattggatcacctaggtttagatctagtcgggtggttctatttgcaatggatgaacaacaatagatgaatgaacaaagagggagtgagaggatttagggttgtgaccagtcgttgttgaggaagaggaagtccggccggccatcgtcgttgtcgtcgcgggcttgacgtggacggcggcgacgatgtgctcggttccgatggcggtgatgcggttgcagcagcgacggtgtcgacgacgaggcgtggcgcggcggtggacttcccgtcactggctgcgccccctcgatcggttagggtttatggggtggag

SEQ ID NO: 31528 - DNA, 17299 bp, Oryza sativa
  unsure (1)..(17299): unsure at all n locations
gtcctccacccctctttatatggcacagtgtgacgggggcccaccagccattgggctgggcgcccccgatcagggcgcgggtcaaggcccccttgagccgttgggctcaaggggagggagatccatctaacagatgattccacgtgtaactctccaagtgaagctgccaaaccgctcaaatcctccgaacctgccattgaagaagcaacttgcaactgtaagaaagatgacaaaggagaagatcgatcagacgagatgcagaacgaagtatgcaaaggataagagcgagagggaggtgtaggtgaccggctccggccctatcgctgggagcggagtgggctagacggctggttgcgtggctgcccagctggggcagcgtttggcgggctgccggcctaggggcgctatagcaggcagcagcacggcggatggatggggaggatggccagagacggggacggagaaggggagggcaacccgccgccggcgacgtgcggtgcgatgcgtgggtggggaatttcagtgacgcagcagcctgcagcgtgccagctagtggtatgggccatggctgatagcataagtgactttcagctcccacacatccaagcccaaatttcgtatcggcccatttcgtcttcctcctgctagaatccggttcgaatcacaccatggccgcctcccgtccgtgcacggcggcggcgcagccatctctccctcgcgcccatcgtttactctattcagcatcaaccgatgccaaaatttaaattttaaaacttggttctgaagttttttttcgtcgaagattgtcgtttaagtcgctaagaacacatatatataagttttactgtggagattatggttaccccatatctacatggcggttatattccagctggatatatggtaccaaatatagatagaatatctttatgaggactcgggttagattctaaacttgtatgtcaagaaaatacccgggatcctagtcggttacgattgtattttatctgtaatcccatattccgttaggatatagactgtactctgtaatacggaccccttcccctatataaggaggggtccgggttcctctcgggacgattctttttctcccaatcatacaatcaataacacactcggcggaatcatccccggacaggagtagggtattacttcttgaataagaaggcctgaacctgtataaaattccttgtctccaaacccatccactttcctagcttgatagccacccccttttattattgtcgaaatcttgtttcgatagttggcgcgccaggtaggggtagcgtcaagttctcgccgactaagtgcgatgggtttcgtttctggcatcgacgacttcgccttccctcccgggcaggcgttccggttcggcagcctcaacttcatcaccaacgacttcggcaagatctctctccttgactcggacccgaaccagtcggggagagaccaggtccccgtgccattcggtattccgaactcggccgaggcctactccaagagcatctctcccgagtcggcttcaaaccactcggacgagatccaatctactcttccgcgaccagatcaagacgacgggtcctatccctcaatcctgatgaaacttcctgatgatttggccgctgtcttcactgccaagacatctcccactcgaagatctaggcgagctccggcttcggccccgatccaatctagatctagagaggttggcgttatactccaacctcttgggacagtctcgacggaagagttggatggttaccttagctcccccggcgtcagttctcgaccaaccgagatcctcgactacgacgatttcggctaccactatgaccacggcgacctcgacaacttcgacgacagctatgaggataattacacgctcctcttcttcggcgtattcatggctgacaacgaaacggaggaacagcgccaagcccgagaagcggaccaagatcgcgcacggcaagaagctgaacgtcgccgactggaggaagagcgacagcgacaggagcgagaacgactacagcgcgagcaacaagatcacgaacggattgcaaaggaggctgaagatcgacggcaacgcgccttggaatctgggcgccgagcgagagagctcattgggcaacaagacgtcgatggaacagcggtctttcgcacccccagcagaacgcggttgcagcaatcactctcctcgacaccctcctcaaggaagacgcactcaaccaagttgatcatgttgtcaacatcttgaaccagacgaagaccatgatcgctgcctcggttccagccaactccgcaagcacccgcaccccgactgatagccgagtccctcacctccgatctcatgattatcatcagccaagcctcagcatcatcggcacaggatctagtcgcaggagcaggggtcatgacgaacgatctattcactcgcctcccgaacgtcacagggagcgccgagtcgaacggcctcgctctccacctcaccagcgtcccgtcgaccttcgcgacacgatcaaccagcgccgtgcagcacgaggtcaccgccattcaccaaatcgctacgacgacgacgtggatggagtagctgccttcactaatgacctgcgtcgagtggattggccagccggctttaagccgactggaatcgagaagtatgacggcaccactaatccggagtcttggctcaccgtctacggactcgcaatccgcgcagcaggaggagacagcaaggccatggcaaactatctacctgtggccctagcgaactccgcccgatcctggctccacggactaccccgtggcacaatcggatcatgggcggaacttcgtgatcacttcatcgccaacttccagggcacctttgaacgccctggcacacagtttgatctctacaatgtcgttcagaagtctggagaatcccttcgagattacatccgacgcttctccgaacaacgcaacaagatctccgacatcaccgacgacatcatcatcgccgccttcactaaaggcattcgccacgaggacctagtcggcaagttcgggcgtaaacctcccaggacggttaagcagatgtttgaaaaagcccacgagtatgccaaagccgaatatgctattaccgcgtccaaacagtcgggcaccacttggaagccaaagaaggacacgccgaccgcaggagggagtggaagtaacaaccacaaggatcgcaagcgtaagcccgaagaacttgtggcgaccacctctccatcttccccgacaacgttcccgcgtcaacaccttcgacaagataatgaactcccaatgcccgcatcatcccaactccaacctcgtggccaaagattgcttcgtctacaaacagttcgcggagcaatacgtcaagaacgcacgtaaaccttcagacggagatcaaggcacatcaaagaagaaagatgatgaagacgatgccccgactggttttcaagatcatcgcaaagaacttaatcacatcttcggcggacccctggcttatgagtctaagagaaaacagaagctaacagaacgggagatcaatgcggttcagcctaacacgccccaatatcttcggtggtcagagatagcaattaagttcgacctctcggatcatgttgaggataataaagatatttttgtgtggaaaccatccgatatgcctggtatccccagagaggtgattgagcactctttacatgttaaggaagacgccaaacccatcaagcaacgactccgccgttttgcacaggacagaaaggatgcgatcaaggaggaattaaccaagctgttagcagcaggctttattaaggaagtccttcatcccgactggctggctaacccagttctggttcggaaaaagacggggcaatggcgcatgtgtgtcgattataccgacctcaacaaatcttgtcccaaagacccttttgggttacctcgcattgaccaggtggttgactcaacggccggctgcgagttactcagcttcttggactgttactcgggatatcatcagatccgactaaaagaatccgactgcttgaagacctcgtttattacgccctttggggcctactgctacatcacaatgccctttggattgaagaacgcaggagcaacctatcagcgcatgattcaaagatgtttttcaattcagatcggtcgcaatgtcgaagcttatgttgatgatatagtcgtcaagaccaagcagaaggatgacctgattgcggatttagaagaaacttttacaagcattcgtgctttcaagatgaaactaaacccggaaaagtgcatcttcggagtaccgtcagggaagttgctcggatttatggtatctcaaagaggcatacagcccaacccgaagaaaatcaacgccatcctcaacatgaaaccgccaagctcccaaaaagacgtccaaaagctgactggttgcatggcggcactcagccggttcgtctcacgactcggcgagcgggggatgcccttcttcaagttgctgaagaagactgacaatttctagtggggacccgaagcacagaaagcctttgaagacttcaagaaacttctcaccactccaccagttttggcctcgccacatccacaagagccgctactgttaaatgtgtcggcaacctcccaagttgtgagtacggtcctggttgtcgagcatgaagaggaaggccatattaaaaaagtccaacgtccaatttatttcgttagcgaagttttagccgactccaagacaagatatcctcaggttcaaaagttattatatggtgtcttaattaccgtcaggaaattatctcactactttcaaagtaactcggtcacggtggacacatcgtttccactcggagatatacttcacaatcgcgaagcaaatggacggattgcgaattgggccttagagttgatgtctttggatatatcgttcaagccacgaacttcgatcaaatcacaagctttagctgatttccttgccgagtggaccgagtgccaagaagacatgccagaggaaaagatggagtattggactatgcattttgatgggtcgaagaggctcacaggcactggagctggggtcgtcttgatttccccgactggagaaagattgagctatgtattgtggaaacatttttctgcgtcccataacgtggcggaatacgaggcgctactccatggattaaggattgcaatctctttaggcattcgccgattaatcgtccgtggagattctcagttggttgttaatcaagtcatgaaagagtggtcatgtctagatgataatatgaccgcttaccgacaagaggtacgcaagctggaagataaattcgatggactcgagctcacccatgtccttcgacataacaatgaggcagccgatagactggccaattttggttcaaaacgggaagcagctccttcagttgtgttcgtcgaacatctttatgaaccgaccgtgcctagaaaagagacagtcgaagccatggatgctcaaggcgtaagcatgattgaagctgactggagagaaccgtttataaaatttttgagcaaacaagaactccctcaagacaaaaatgaagccgagcggatttccagacgcagcagactttacattattcatgaagctgaactgtataagaaaagtccgtcaggaatactgcagcgctgtgtatctttggaggaagggagacaattgctgaaggatatacattctggtatttgtggtaatcatgctgctgcacggactattgtcggcaaagcttactggcaaggttttttctggcctacaactgtgtccgaagcggacaagattgagcggacatgcgaaggttgtcaattttttgccagacaaactcatttgccagcccaagagttgcaaaccatcccgttgtcctggccatttgcggtctgggggcttgacatggtcggcccgtttaaaagggcagtcggcggttacacgcatctctttgtggctatcgacaaattctccaagtggattgaggctaaaccggtcatcacgatcacagcagataaagctagagattttttcatcaacattgtgcatcggtttggggtacctaatcggatcatcactgataatggcactcaattcactggcggagcatttaaagacttttgtgaagacttcggcatttgttacgcctccgtggcacaccctatgagtaacggacaagtcgagcgcgctaacggcatgatacttcaagggatcaaagcacgcgtttttgaccgactacgtccctatgctggtaagtgggtagatcagctgccgtccgtactttgactttacgcactactcctagtcgggctaccggccagtcgccgttctttttggtttacggcgcagaagcaatgttgccgagtgaagtggaatttgaatcactactatttcggaacttcaacgaggagggctatgaagagggccgagtagacgacatcaaccgactagaagaatcccgagaagcagctctaattcagtcgactcgatatttgcaagggttgtgccgttatcataatcggaatgttcgatcacaagcctttttagtcggtgacctggttctgaggaaaattcaaacaacacaggatcggcataaattatctcccttatgggaaggaccgttcataattgctgaagtcactcggccgggttcttaccgactcaagcgcgaagacggtactctcatcaacaattcttggaatattgaacaccttcgccgattttacgcttaggcatttcgtttgtatctttcctctttgactgctaactttaagtttttctttgaagttttcagtcagggggctactataataataatggagtgtgatttttatcaattcaatttgtttacttgatgtatcattgccttgtttgatttcttggcttagtcaatgaggactgaaagttttttaacaacttttgcaggttttaggctcaacaaggtttgacaaaaacttttaagaaatcaggaactaagttaagatatcaagcaccgcataaattcatcagtattgtacaaattgtgcctccatcatcattaatcatcaaaatcattggtacattagtcagtcagtcttttcatcatcagaattatcaggaccagtcggtcgaagatcggtgtcctggaatctctcaactacatcagcagcaatcttgtcagcggctttttgcgcatcgctgatgaggtcaagagcagcttcttcgctcgtcccgtctgcaaagccatcaatggcatctatatcaacccttggataaagagatttggtcatcgccaacgccagacttgctcccatacttccagcttatttgatgttcttgaaatatgtatccggagcaactctcagcttatcgaaaatttcagaagcatcaagtgcactcgggccgttgttattaaagaacattgcttgaacaattggggcagcagcgttagcaacctcatcccgggctccttcaagttttttgatcttgccaacaaggacgtcgaattgagcttgagatttgatcttgcggtctgcatcaacagattcacattaataagtcaacatatggaggataatggcttttgaggtattgattgttgataccttcaacttcctttaaagccaggtctctttgtcttgccagttctgccttgtcattttccagaatttgaatctgcttctccaactgagatatcttggcagcttgcacttcattgattacggttaatcaagattgcaaagataacagtatgagtcagttgagcagagtttgtgcgtaccttttgatgagccactcagttcaaaatttgattccttgagctcagcgatccgatccctcagatcatgttcattcttcctggcaagttctttcgcttcgtgcagttgattcctggtggtttcgagggttccgagatgagggactaacctctctaaggttgtcgttttggcttcgttcctaagatgaatcctgtggacccccgtttttataacaggaatcattcgtgtaaacagtaccatttccctggatcaagtagtctggtacacacgagttcatagctgaaataccaaaagcacatacacgagagtctagtgctaattattacatcataagcccgcaggcattgtcttaaataatcggaccgagcggtccggaatacatccaaaaacagaaatagataaggcagcggcatgccattgccacaggcaacgaccgtactaagacctactgagcgtcatcgtcttcatctccctcctggtagtaggcatagggatcctccgaagcttcatctcccgcttctgattaattttatatttgcaagggtgagtaccaaccgtactcagcaagccaccacagcaacaatgcagatgaaaaggggtatttcaaaggatggctatggctcttttgcgctaagccagttttgtaattcttttcacaaacctaagacctagcatagactgatcaagttttaataccagtgttcacattaaacaacgacggttctgtccaccatccattgtgatcccaaggatagcttcccgccattgagtcgtcatggttttctgaggacgtccaccttccctcctctcaggaagtggctccatcagcataaaaatcatcatgcaatatcccatcccacacaggttaagaatttagagtctagccaagtgtaatacatgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggaaagagaagtctcacacacatattaaattatggttcaagttaagttctctctctcacatactcatggcagtcctaccaatggcgacaccgatgtagggcacgcttctcggccctacctcaacggctgtcccatcgtagcgcacctgcctcactcaggggtgaaccatctatgcagggatactgcctccgctcggctatctaatccgctaggtctatacccatttgagaagtacggttgtacgggggtcgtttcaagcttaacttcatggctcggtccttaattgactggggacgctactagccttttccagataccacccaaatcatccgtccgccccagtcgaaaacagttgttttcgctttattttcctttcacaaatcatgttatcaatttcatggcaatgtggcgctcatgtctccacatgccgcatctcaattaccttcccaaaggtaattgcccaagcatttagcatttgataaatatgagtatgcatgatcctagaatagcatttctaagcaattgtcataattgactagggactcatacgtaaacatggttacgaaggaataagggataaacaataatcaaggcatggcataatcacaagtaggatattcatcattgcatgcaattttatttataaacaaaataatttctcaattgggatcaacatgttcaaggaatagtgatgacttgccttgctcaaggtcttgggggtcttggccttcacttggatccgcaactccctcgggctctatagttacgtgcgaaaattgatttggattcgattagaattcaaaataaaaatccaaataaatccaaatggaagtcaaacacgaaagtcgattcttttatattaactttactattcgcgtactagggcaaacccaatttcgatttatatatcctaaactattttgtgggtataaatattttgttatcataagtttttaatttaatctacccgagcgttatatccatataataggttggaaatttctattgcaagctaaatatcggacggaatccaaaaattatcttataatattatacgatttaattttagtctaggactaaacgactaaatataatatacgtctaaaattcctagtgattaagtccgaatttctaccatgaatcaattacttatagagattacccaaaataatctataatagtctataagaattcatctaatcgtttagttcttaattacatttaaactagtaccgcgaattgatttcttgtagaaattaccaagaataatctataatttatattaaattttgcaattctatgaccataattaatctataattaaattctaattattttagattttcttaaactattaacctccttaatttcttcctaattttctatttatttttccttttctttttctccattctctcttctctttttctttctttttccttcttttctctctctctctttttctttcttttctctctttctctctttctctctgccggcctctgttttcctctccctctctctctcggctctcacccacccgagcggcggcggcggtggacacgagggggaaggagggcggctcaccggcggcagcggcggcgacgacggcggcagcgacggtggcgcacggcggcacgggaacggcgcgcggcggcacgggagcggcggcgcagcggcacgggagcggcggcgcggcggcacgagagcggcggcgcagtggagagggaagaggggaggaagggtgagatggggtgggggaaaatggagagagggggggtttttgtagagaggggagaaggagaaggggaagggcgggcggcggtaaatgcgaccgcgacggcggcgctcagggcgggacgacggcgacgcgagggcggcgacgcgatggcggcgcggggctcggagcagcgatgcgacgggcgacggtgcggggctcgagaagggcgacgcgacgggtggcgtggggctcgacgcggcgatggtgacggcgcgcggcgatgggtcggcgacgcggcaggtggcgagcgagcggcgtgacaggcggggcgacgcgacgcgcgcggcggcatagggctcggcgcgatggaatgggcggcgcggcagcggcgcagggtgaccggcgaggggacgccgcgcggcggggcgcaggcgcgaggggacgggcgcgcggcggcacaaggcgcgaggccgacggcgacgcgacggtgacggcgcggcagcggcggcggcgcgcgcgacgggcgggcgacgcggcgcacgcggcagggaagggggcggggccagggggaccacgatcgaacacctatgacgcaatgaacagtaacttttcctatttatcccgattttagcccattttctatttaaatatagtcctataaattctaacttttgcataaatgaagtttactccatatttgttttatactaactaaaaattcaccctaatttaatatcactcatattttgtttatataatttatttgaatttttaattagggttaattctcattccatcgtactaaaatttaattattgctaatatggtcgcgataatattttatttatttccaatcccacctaatctttattttaatttatattttaattatttatttagccagcttgatttttaaggtttattcctagttagttattcattattcgcgattaataaattccgagatcaaaatccaatgaaataggcgaataaaatcggcatgatgcaatttattacttaaaaagtttttgaaaatctgtatttttggtgttttgatttcgttgggagaattttcagggtgttacaaatcctctacaaaacagtttaattagcgcatgaattaaatggcaaacaagatggttgagatcaggtaccagagggcttacatttacaatgcgggttgcctgacctagtgccttcttcagtagacatagctcctcgtcctctttttgcttatttatcacgatcccttgaggctgcatgttgtcatcccaccacttgaccagaatcggagggagtgaatcctcagctgcttgtatccggaggatttcttcttcatcaccaattattggccctagtgtatccatgaatgaagatgaagcagccaaataaagtctgttggatcaaaacgatttcagatagcgtgtctacctgtgatgattcccggtcggggacgagtagactttggtgtcttcacaggagacctggtttctgattcattgtcagcatccttcccgagaggactgttcgtttgagcttcaacctcgggaatcttttggcttggccctgcatccgactggtttccagtcgggggctcctggttagcaccgacttcagcttcagtcgactggttcccagtcgggggctcgttgctgggttctacattatcggttgccggttgtttgtcactcggacgattctctgctgttggcccggtttctttggaaaaacttgtgtccatgttagttgggtcagagtctttcccagacgggtctatatcagatggtttcctgcaaatttgattatcagtattattgccgcaatgggtgcgcatcaatacaagagagatcgttatatgagttgcacctagaagacttcctgatctttggcacaggacgactggatgttttcttccttggagtagcctgttttggtagtttcttggtcgtctctcggtctacaggcctcctggtggtatcatcggcttcgtcgtcacttagaaccagcttcctctttcgagaatctgactggccgactggatcagaagcacttggttgagtttcataccgaattcttggtcttccgctcccttgcccagtttggtggcggggagatcggcgttgagcgattgggggatccgacttcatcaaagcaaattcctgggtgtaatatccttcattgttaaatgattcaacaagaaaacaagatcatattttgagaaaggttgaagtatatgaatacgcaccggtggaggaggattgaatgcattgaacggtacgactggcagcaagtgtgagtagctgacaacgatggcgtttgagaagatcttatacatcctttccttcatgaccttgaagtcaagagaatccggatcttcacggtttgggtcatgcttgccgtcaaattcgaaggctgtgcgagatctttctttgattggagctaaccgacacttggtaaagtgccgggtgatctgttctccttgaaggccctattctttcagctttatcatcctctccatcagttctactgcttgagcagcttcatctcccataggcaatgagttccatgtatcctggtaaaccggaggaagacagcagtactcggggactgcgggctcaggattctgaacatagaaccagtttgcatgccagcctttgtttgaggttttgaagggcatggagaaatatttttggctcaaggttcctctgagttggaaaccagctcccgcaacgacgcatggtttgcttttgtttggctggggcttgaggaagaagatgcggcggaacaaggcgaaatgaggcctaatgcccagaaaagcttcgcaggcatggatgaaattggcaatatgcactatggagtttggattcaagtgatgcaagctaatcctgtagaagttcagaatcccccggaagaatcttaaggttggaagagaaaatccgccatagaagaaatgagcaaataccatgatttcgtgtgtgtccggggtcgggaatgcttcgccggacgccggtcgccacccgataatctccttcgctgggagaacgccgtgcgccaccatctccttcagattatcttctgtcacatcggagggcgcccactgactctcgaagctttctctttcttccgccatgaatgtgaactggatggttaaatttggtccgagatatggctggagaggaatggggaatcggagcggtggacgcggggagaaattttgtgaagtttttgagggtgggttggagcagattgatgaaccctagcttcgtcggcgcggttctgtactgtagcatggagtggggaatggcgagagtctcggcggggaagacgaaacgacgtttggacttcggtatttttagggtatcgggagtactaatgggcctgggcctgtacagtacttcagcccaattatgttttcagcgtggcccgttgtgatccctagggacttaggcgctttttgctttggcaatatgtgctcacaatgatgcggcccgatgctgttaaaattctttttaacgcgatttaataattctttggaattattatgatgcacatgaaaaggtgcccgacagagaggtgttataccatttttgtaagcttttttaggctgcaaaagctgttgggttaatttgagatgactggtttattagtagtcattctcctagcatgttatatgcttattttgattatggtaagggttatggcctaggatcattttaagagtttcttactcggattcctaccaaatatatctatttttagaccttttgagtgtttatcattcggcccttttcatattttttatccttgatatattcaagtgagaagcagtcggctgggtattttattgagtaccatgcatgcttcgatataaaatcactcggttcttgactatatgtttagtttttcaactaatcacatagtcgagggctacacctaattaggtgcatctactcgatgcaccatgttttattttcgcccttcacagtcttttagcactcggcaagccggagcaagttgaattgaagcacttggattattgttttttggagattattttggtcaactgcgaaggtctcgggggccactgtggagattatggttaccccatatctacatggaggttatattccagttggatatatggtaccaaatatagatagaatatctttatgaggacttgggttagattctaaacttgtatgtcaagaaaatacccgggatcctagtcggttacgattgtattttatctgtaatcccatattccgttaggatatggactgtactttgtaatacggaccccttcccctatataaggaggggtccgggttcctctcgggacgattctttttctcccaatcatacaatcaataacacactcggcggaatcatccccggacaggagtagggtattacttcttgaataagaaggcatgaacctgtataaaattccttgtctccaaacccatccactttcctagcttgatagccacccccttttattattgccgaaatttcgtatcggcccatttcgtcttcctcctgctagaatccggttcgaatcacaccatggccgcctcccatccgtgcacggcggcggcgcagccatctctccctcgcgcccatcgtttactctattcagcatcaaccgatgccaaaatttaaattttaaaacttggttttgaagttttttttcgtcgaagattgtcgtttaagtcgctaagaacatatatatatatatatatatatgttttacctacaaattattattattttgctaatacgccatatgacgtattttccatatttggcaaaaagatgggagcctaacacacatagaaggtagtgccaccgcatcgatctacgtgctgtggttggagtaggataagtggaagaatctgaagaagagagctaaaattccatgaccattgttggtttatcatcagctcttggagtaaatagctaaaagttttgctgccagtatacacctatcaagtatgtgatgcgtatattgaatcaaggagactcaccgcatgacagtaaggcacttttgcattgttaaaacttaaaaatgggaaactgatgaggaagtccaagaatttagtaattttattgtatgtgacatagtatgctatgaagatctgtagtaaaatggctatgtaagttaaactggccttgtttattgggtagtgaaaacttggcctgtaactgatctgagccatgttctgttgatttaacttagactatctgggcctaaatggccaaatgaatgcatcttgaaaagcaggggtgaatccaggaatgaaaaattgagggaaacgtcggcataaacacatcatgtctcatacaatattataataccatagtattatgttgtattctaaagaagtttcatatagaaatagagaaataatgagaaatacatcacaacttcacaagatgaaactgtgctaaattgctaatggattgagccattccaaatttccacttaggtaatcacaattgcatatttgcataaactgataagtgataagcataccttgtttagttgttttgcagattggcaggttgcagccgccggcctgctgctggtctgctgcagactgcaggcagtatgcacgcacccgacctcccgtggcgtcgctggcgccggcggccggccgcgggccgcctgtctgcaacctgctcagctccctcctgctcgcgctggcctctgctgactgctggcctgctgctgctgctgctcgcgctcgcgaagtcgcgcggacacgccgtcccgtactccgctgcttgcctgctcaccgccgccagcgccgcgcgcttccacctgcggcctgctacctgccggagacaggagcgccggcggccgccggggtcgggagctaccgagctagggattagttagttgggctgggggctatatgtggctcttttctaagtagaataagtccatactgcttccctcaactcttgctctagttaaataacttccctcaatcataaaaccgggtatagcgactcccccatctttaaaaaccagtgcaaatcgcctctttcagcggttagaaaggtggtttcgtcgacgtggcagttttgaccccgttgactgaatcagcttgtgtgccccacctcccacctgtcagcaacctcctccatctatattcttccttacctctccacctctctctttcctctacctcttctctcaccttacagcagcacgtgggggcggagtggccaaccgacgcgcctaggaggggtcgcaggtcgtgacgcgtgcgggggaaagggtcaccggccggccgcgcactcttttctcccatcagtcttagtcgcgcactcttctatcggtgtagagcgacccgcggatgccaaggtcgaagctcgccgatgcgtagccgcgctccagcccacgtagctcccacttcgtctacgtgcccaaatagacaaacaaacaaacacatgcagcgacagcatctagactctccactcctcctgcacgcatacacaggatcagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 31529 - DNA, 39557 bp, Oryza sativa
  unsure (1)..(39557): unsure at all n locations
ctgatttgcgtcgggcgttctgcagttgcatatgtaactgatcttttcaagcgttggaagtatttttttttagataatggaataaataaatattccggcctttactcaaaagagctacagccaattattacatagaagcgtttgacaaacatagtgtagatctaattgaatagaacacaccgcaaggaacaataaagaatccagtctaacaaaggagattacaattattgaaatctatttgtaaatttccacccataattggcaaaaggttgcataaccatagtctccaacttccgacatgcaacttttagaaactcttcatcatctttacacctttgtagttgtgctcaaaactgaagccaatgggttgctctgaaaatgacctgcatataggaaaatgatggtgatttgtcaaaaactatattgttcctactcagccatattgcccaacaaatggcagaagctccaacaagtatcagtttactcattttcttatcaacttccaaaaaccacccatcaaaaatatgagatacgctaactggaagattaaatccaaaagaaaactgaactgctctccacaaaaacttcgcaacatgacaatcgaaaaagagatgttgaatagacttattcttcaaacaaaacgaacacctcaagctgctattccaattacgtcttgccaagttatccttagttagcacaacccctttaagtaagtaccacataaaaattttaatcttaagtggcatcttaagcttccaaatgcacttattcctgtctatataaccattattaattaaagctaggtacatagacctcaccgagaacaacccattctgatgaaaattccatctaaaagtatcaaacgaatcattcaattgaatatgtactatagaggaacataattcatgccaacaatcaagattctgaccaactaaaactcttctaaaaaaacattaagcgaaacagaacccattacagtagcaatagaagatgttttcctacgagcaattgcgtacaaagatggatacttgtccttaaaagcccagttacgtagccacttatcctcccaaaatctaatttgtttcctattattgacaatccaagaacccatatttaagaaagtacttttaacattcataagaccagaccaaaaataggaatcatcttgtttcttgtcaacttgggttatagacttattataaagatatttcctcttcaataagtcatgccaaaccccttcctcattaattaacttaaacaaccatttacttaaaagacatttattttgtaccttcagattatgaatcccaagacccccctggtccttgggttgacaaacaacatcccacctagtgagcctgtatttttattatgatcatctccttgccaaaagaatcgcgatctataaaaatcaattttatgaagaacccttttcggcacctcaaaaaaagatatcataaacatggctaaacttgaaagaactgaattaatcaacaccaatctacccccaaccgataaatgcttgcctttccaactaagcgttggaagtatatagtactaaaaggcgtgtttcaaccatgagatttattcacaaataatccatcaactgtcataaacggaagtatataatgctttaagtacattgtagtactcatcgttgctgctgctggtgttgcaaaataacgtccacgtcacggtgatggtctttatttgccggtgttcccagctgaatgtccgcggtgaaggtgatgatccttgctggtgtcgtcatcgtcatcatcgtgtcgtcgcaggatccacgacgaggattgtgtgttgcgtgccatcggtgccaccactatcttggcaactcccattcttgcggctgcgggagccggacgtacgacgtccccgcccttcagcgtgacggaaccgaaaatccaacgccagcggcggcggctcccaccgagccgcgttcacgaatcacgccgacgcgggcgaccagccgcccagtttcgcgtacgtgtgagctaacgagcnccgtacgtcccaccacgttattcgatcggggcctcggcctaatgcgtaccagggcggcccaatttgttatggctcataggctcgaagccaccgtttcgccttcctcgtgaaatgtaagcgcaacagggaaagcatgtaagagcatcagggaaatcacgtaagagcatctccgagagattctccgttccaactcttcaagttaaattttggccatccaagagaaaaattgctcaataaaaaactagccatccagtttgctaagccatcctactagctaaaagtgccctcggcctggccaaacttggccatcctatctcgcttgccattcatgagtcccactacttttttttctctatcttctctcattcccaccgaagtgcaatagggaggcggggggcacaggcgttgttggcagcggcatggtagagggggagactccggtggccggcgacagaagcttagggatagtgtcatctctggtgagcagacgaaagcacgtgacacggtgctgtcggcactgctccaggaggatttgggtcccgcaggcgtagtctccgtggcatcggctacggcaacggtggcggccgagcggtgggacttcagctccggccagatcgatggtgcgctcgtcacccctgtcggtgtgagcaagaggtcccacgccacctggccaaggtccaccattctgttcgcctcctgccgatgtcgatgccgttcgcctcccgcatcgctgtcgtccacccaaatttatgccgccatcgtcttcctggatctgtgtcaccgctgtcatctccccgaatccgcgctgctgtcgttgcccccacatcatctatgctatctacgggttgtttctaggggtagacaaaaaactcgaaactcatgagtagctgcctagctcaactcgtgtaaaactcggcttgactcgagtcgagtcgttaatgagtcgagttgagtttgaactttcactcgcttgcttaacgagacaactcgagctagctcgtgagttactcggttagctcattgagctcatgatgcattaagatggaagttaattgttcatgtaggtataaaagtcgtaaactcataattatacattgtagcacaatcttgtgagtcatgatatacatagcatgtcaattataatctttggtcatagaatcacaaattataccgcatgtgaattttaaaccatgtatttcggtgtaacgagtttaatgagtcaactcggactttttaacgagtcaaattgagttccatttttaactcgttatgttaatgagtcgagccaagctagctcgtctacttaacgagtttttacaagtcgagttggcttgttagccacccctagttgtctccacctccaaacccacacttccagctctgctaccctcgcctttgctagctgctgctgctgctcccggccaaggaagtggtggtggtggcggcacggagaaaggggggagcggtggctgtgtggaggggtgaagaagggtaaggaggctgacatatgggacccactatcatagactcatatttgagagtgtagatggagagactgttgaagtgaataatgagtttgacttgccaaatcagatggagagttggctatataaatgtttggagagtcataatttaagtagagcgttgaagatgctctaacggcaagtcgacaaatacaacagccaacgtttcctctattttgattatgttctcctcaataattaacagaagaatttttgttcttaaaaaacaaacacgtacaattaatcctagcccctgcggtatacgaattaaccctatacgggtggcataaatcatggcaaattggcaacccctcacctggtagccaactctaggggattgacccattttcttctcccagtttcactgacatatggacccaccttgacttgtccggtgctgtacctcaacacgtgggcaggtgtcggagatggcctcacatggcgctcgtgggaaggatcgcttcgcatccaaccgttgcttccaaacgagcgacggggataaatccaacacacacgcttcccgttcccttcgtcttcaacattcgttctcctcgctgtcttctcccccctctctccaaaacccaaatcccccaaaccacccgcctcgcctcccccctcgcccaagcaaatcaaacccgaagacgccgagtcgccgacggccatggcgccggcggtgctcgtccccatcgacgaaggcagcgacggggagggcggtagcgccacggacgtcgcagccccctcccccgctcccatggacatcgacggcgacgacgacgggcgcgaccgcggaggagaaggcgatggcgctgcggcgagcgtcccggccgccgacggaagtagcgccgcgctctccctgacgctgggtctccacgtccacggcgacggaggcggcgcggaccgcctcagcgatctccacgaagacatcctcgccaaaattctgggccatctcagggacatccgcaacgtcgccaccaccgccgtcctctccaggcgctggctcgacctctggaccctggtcgacatcatcgtcttgcagtatgacgagccccccgactccagaatcgtgcaggaagttctcgccgcccgcgcgaggaatggttccacggccacggacatccgcctgctcgaggtcacctccctcaacagcgccacgccggacgccacggcctcctggctccgcgtcgccgcgccccgcctcaccggcgagctcttcttccgcaacaggtcctcggttccgtccgaaattctcaacgaggagatggacgtcgtggagcagctggtcgaggagcttggggacttggtggtggacgaatcgggcgccttcgagctgccctgcttcatgagggtcaccaagataacgctgagcctggggtttctcggcctatcgctaccaccatcgggtgtcttcgccaagctcagggagctgcacctggtgcacgtccagttcaatggcgaactcaccatggaagatgccatgctcccgtccttggaatggctagagattcgccattccagtggcttggcctccctgacgctcaggctggcgcctctgacccagatgactctgtacaatgtgcggcggttgcgtcggctcaacgccgtgcttccagggctcgaggtgttgtctgtaacggaatgcttcctcgaggatctggagggtgtgagcattgtggcagaggagctggaggacctgcggtggctagatatgtaacagcctggattggtctacttcaagaggatgccgcgcctgcagatgttgttgccccccgctgtttatccttatggattgcagaacgttttcttcaatcggagctgtcagatgcttctcaatctctgtccaagcattgacggtctcctgctgttcgttgaaatttgtggagattatgggtaccccatacccacacggcatggttatccgactagttataggggataacttatatttttgtaatatgtaacagatcatgacttgggtgttacgtttccttgtatattacggaacggcctaaagtcctggtttgataatattgtaaagtagatttaggaaaccgataccgtattggttaaggtttctatcttgtaatcctgccccccatcctatataaggtgggtaggaggccctctagggggcatatgagacaacctgatcgtcagatcaatacacactcggcggattcaaatccccaaacaggagtagggtattacctctcattgagagggcctgaacctgtctaaatcctttgtctccgcatccatccacttttaggtctcgtacgctacccccttttattattgccgaaatcatgtttcgacagttggcgcgccaggtaggggttgcgtcgagtttcctatcaacgagcgcgatggaatcaatttcatgagtcgccgacttcgttttcgctttgggagttttcacttcctttccgtcgaccacttcttcaagctcctcttctctgacttgatccaaatcagtcagggggaaactcaatctgatttttatcattatttatcatattgatttttaatctcagattaattttttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgccggcctgcctccgtcgccgccgactggtgtcatcgcctatacggttggtcggtcacaccaccgttcatgggcgtccatgtcttcaccgaccggctggccttcgccgccgccgactggtgtttccgcctgcacggctggcctattatgccgccgctgttgggcgtctacgacttcaccaccggcctgcctccgtcgccgccgagtggtgcctccgcctacacggctggcctattatgccgccgctgttgggcgtctacgacttcaccaccggcctgcctccgtcgccgccgactggtgtccccgcctatacggtcggttggtcacaccaccgttgatgggcgtcgtcatcttcaccgccggcctgcctccgtcgccgccgactggtgcctccgcctacacggctggcctattatgccgccgctgttgggcgtcttcgctttcaccaccggcctgcctccgtcgccgccgactggtgtccccgcctatacggtcggttggtcacaccaccgttgatgggcatcgtcatcttcaccgccggcctgcctccgtcgccgccgactggtgcctccgcctacacggctggcctattatgccgccgctgttgggcgtcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttcctttcctctgcctcactacaccaattggtcttccattgagtagtgagtcgggggctacagatgttatatcatatttttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaactccgatccgtgaaactttgttccattaatgacgaactcatgtcactcatatgcatgtttgggaagtgcttaggtcgactcccagtgcttgggggctatgactagttgggcagagcgtttaaacgtaatgagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaggcttatctcttacgctccaggaatggatcagtcagaacatcaccgactggcttgccttcgccgctgccgactggtgtttccgcctgcacggctggcctttatgccgccattgttgggcgtctacgtcttcaccgactggcttgccatcgccgctaccgattggtgcttccgcctgcacggcagacttattatgctgccgttgttgggcgtctacgtcttcaccgaccggccgccgcatccgccgctgactggtgtcaccgcctgcacggctggcctgttataacgccaactgatgctaccttcttcacggctggctacatcgctgtcactactaataggcatcagtatcttcaacacaagctgcctacgtttgccatggctgccgactggtttcttcacttccatggctgcatgattctgccagtgttgattggccttatcttcttcaccgccggtcgtctcgtctgctgttgactagtgccctcacctctacgtctggtttatacagctaccactactgatggacatcatcgtcttccgttgccgactggttatgccgccgccgactagtgcttttatcttcacaactgcgcgtcttcgctaccagtttgcttctgttgccgccgactcgtgttcacttcatcacggcgatgcaactttgtcatcatggtggagcgacttcatctttattatcttcggcactggcaaactctattgctgctacttcacaagttttactacttcaccaaccacgacgtctttgtgaacctcgacatctcggcatgcaatgccatgatattttactacaacaaatgactctccaatattcaggatttctacttggacaccttcaacacatatcttcaatcaagcaatgactactcgacgacaagaagctataattctcgactctatgttcagttgtttcccaactaaccaaagagtcgggggctacacaaatataaggctcaaaatttgacaaattttatgtcaagctgaagaaatcaattaatcagccaatgagtcaactccaggagtcattatcttcatctttgcttcggaacagacattctacttcaacaacttcaaatatttcggtttagacgagttgggcaacaacatcaactctcctccaattatttgtcttcacggttggcctactacgcaactgccgatagaggatctcatcgttatcatcggctgctacatcgctattgactggatcaccgacatcgtcatcttcatcaacatcttgtcaagcctcatcaacatagccaactctgctgccgttgatgggaaacttcgtcatcatagtcggctatctttgttgccgttaatcatcattaccgttggatgcgtttgtcgccgccgattattttcttcatcttcatgattggtggatttcgccatcactgttgatgcgcgtctacgtcttcatcgtcggtttgcttttgtcatcaccgactgttctttcgttgttgttgggcgcctacatcttcactgctagctgacctgactgttgccgactggtttctttgcctccatggttatgcaacttcattacctttgattggtgtcactgtttttactaccactgacatcttccgttacttctgatgagcaatttcgtcttcatgttggtcatttcatctccatgccgactgcgtcagctattgccaatagacaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccggaagatttattactcgggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatagtcaaggtgctgtttgggtttatcaagcaattgattggatacaatatcattgctttttgccacgtaagtgtgcatttttattgaccaatattatggcttaggctgattatatattatggtcatttttcaggcggttggtaaatcctttatgagtttacttactcggatgttataccacatatgccatatatttccaggtgtggtgaaaccatgtgtcttttagggacttaagcacatctgttaaagcagtgtgcgcatggcgtatgcccaatactttggaaatttctttattcacagcattcaagcttctttatagctattttgctatatcactcatcatattttacaaagcagttggtatatcacccggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactatatttttcagccctccacagtcttcagatttggtaaaagtactcgggagaccatggcgaagatgattgaagcactcggctttggagtaatctagttcgagagaaggttatcttttcgactgtgaaggtctcaggggctactgtggagattatgggtaccccatacccacacggcatggttatccgactagttataggggataacttatatttttgtaatatgtaacagatcatgacttgggtgttacgtttccttgtatattacggaacggcctaaagtcctggtttgataatattgtaaagtagatttaggaaaccgataccgtattggttaaggtttctatcttgtaatcctgccccccatcctatataaggtgggtaggaggccctctagggggcatatgagacaacctgatcgtcagatcaatacacactcggcggattcaaatccccaaacaggagtagggtattgcctctcattgagagggcctgaacctgtctaaatcctttgtctccgcatccatccacttttaggtctcgtacgctacccccttttattattgccgaaatcatgtttcgacaaaattgaactagtgagtgcctcttcttcctctgtttcagtcaagtaatcaattgtgtattgctcgaactgcaatgtggattatcagatgattatccttcagaatatgcaattttctattgcaaacttgcaattgttaagtttagatcatctaagctcatgagtgtttaggctcaacactcaatgctcgattcagctgcagttttttgttggcctatcttttgcattgttgagagttgaatatcttgaatactagttagaaagttgcagaataggagaacaatcttgaactgaacttcaaatgtatacttgaccttaggaaaataattttatcagcacattttcaagtgatacttgtttctgtacaaaggatcaattgctgcattcatgtttactgagctagcataattgcgagtcatccatgcttgcatttctcgatatgctgcagtttctgagttgtcgttaccaaagagatcgtcattgattatcagttgtttcaccattatgtggttgttgaacatgattacataagcctgcagatacatctaattcacttgcactacaattgaattcagattatattaatttctattacatctggccgaaaagcagcatccaaagttccaaactgaaaatgttgactctgcagcaaattactagatcgttacttgtctgcaagcaaattactgattcttcaactgtatggccttctgtcaaacatttctttgctctttcccagttagttttgcattttgtctgagattacctctgttaacttcctacaaattcataggagcaaggcgacaagcatggcgttaggcctttaatggaaggcattacccaactccctcacattaagatcttgtgcttgaatttactaacacgagggcatgcttatggagctagtgtgttgcatattctgacaatgtgtactggtatagcagtgctgggcctgagaatagaagaagatttccaggtaatcatgtttcctatgaattccgaacaactgcgttttttaattctaatttctatacctgcagtaaattcttaagtgtaattacaaacgctctgttggtttaggcaggaagttactccctcagtcccatatttgactcatcccatttgtgtcccaaaataagttcatttttaagcaaacattgcatcagagtttgcgaaagtgaaaaataattgtataggaagtagataaagcgagaaataattgcattgggattgaataaagtagggatatactagttcttagtgtttgtattggtatgtgtgggatgatagaaaaatgagcttattttgggacataggtagtactactccgtcctataatagatgtcgctttgactttctgcttgcaacttttgaccattcgtcttatttgaaaaattagtgtaaatataaaaaaagataagtcatacttaaatacttttgataataaacaagttaaaaaaataaataataattccataattttttgaataagacgaatgatcaaacgttacaaataaaaactcaaagcgacaagtattttgggacggatgtagtatcaattatgcctatttatgacatagcaaaagctaactcttgatatgaattaatttaatctgggccttttgtttccctattcacatattacttgtcttatcatcatagccctcttggacaatataatttcctactgtccttttaaatgatccagtctgtcagagatgtaatagatccatgaaagttttggtagcactgaaagtcatgcttcattgtgtgaacatattatccagcctatgtgacatgcattaaacctgattagaaaaacaaaatcatgacaggaaaaactgctgtttcaattttcatcattccttttagggtgtgtttagttcctgaaaaaagttgaaagtttgaagaaagttgggagtttagaaaaaaagttggaagtttacgtgtgtaagaaagtttttgatgtgatatgatgtgatggaaagttgggaataggggggaaactaaacacggccttactaggctgtgtttagtttctgaaattggggagaagtttggggaaagttggtagtttggaaaaaaagttgggagtttatgtgtgtaggaaagttttggatgtgatgtgatgtgatggaaagttgggagttggggggaagtttggtgtgaactaaacacaccctaggtgccgaacaatatgaaccttccgcagttactcaacgtgtcagacgatgaatctcattaacaccttgtactttgttctgatcttgtaatttcaggttgaaaatgcttgtccagtgaactgcctctgtgaccggccacgaaactggagagataaggacatttcgatgagatctctcacagaaatagtgatcctcaacttcagagggaagcaacatgagcttgaccttgtgagggtcttagtccaggtagcaccagcccttgaccttgtaagaatgacatgtcaccgttcgttagctgcttttggggtagagttgctacgtgcctatgtacgaagttttgcaagctttaggacttctgtggaagtgagtcaaagtaactgaagcaagaatagctatgcgaccgtagcgaactgaagtataggctactgatctttgaaatacctgacaaattttgatcctgctatgctgtagagaaacagagaaactggctggctgcaacgaacttagttgccacgcgttgttcatttgtcttcataagcaaatttatcatttgttagcaatttggaatgcctttttcgtatgtttgtcagagctgaagtaatgtgtttggcgcacccgctcactgtagcttttacggctttaccggtaatccaccacggatgcactgggtgtacatggcatttctgatttgcgacgggcgttctgcagttgcatatgtaattgatcttctcaagtgttggaagtatatagcgctgaaaggcgtgtttcaaccacgagatttattcacggataatccatcaactgtcatatcggaagtatataatgcttgaagtacattgttgtactcatcgttgctgctgctggtgttgcaataacatccacgccacggtgatggtctttgccggtgttcccagctgaacgtccgcggcggtgatgatccttgctggtgtcgtcgtcgtcatcgtcgcaggatccacgacgaggattattgtgtgttgcgtgccatcggtgccaccactatcttggcaactcccgttcttgcggctgcgggagcgggacgtacgacgtccccgccctccagcgtgacgcagccgaaaatccaacgccagcggcggcggcgtctcccaccgagccgcgttcacgccgacgccgcgccgccgcgggcgaccagccgaccggttttcgcgtccgtaggtgtgggcgtgcgtgatcgatcaagaggcctcgactctatggaaaatgctatatgtactactaccttctcttattgtacgccgttgactttttatccaacgtttgatcattcgtcttattcaaaaaatttatgtaattatcatttattttattgtgacttgattcatcatcaaatgttctttaagcctaacataaatatttttatatttgcataaaaattttgaataaaacgaatggtcaaacgttgataaaaaaatcaacggtgtcatacattaaaatacggagggaataactttttcttactaggtggttatcttttctcttgaagatgaagattaatttttttacgcagaacgaggtggtattaacgtttgatggattgagtttaattattaaaaatttaaaaaataaattaatatgatattttagagcaactttcgtctagaaatttttttgcatgagacacaccctttagtagtttgaaaaacgtgtcaccaaaatcttaatcttcatccaactcttgttgaagaaaagaacgggacctaaatttatacgatagatgaagcatgaaaattctgtgataattctacaattctgcagtaaaaattatcctgtgacatgttgttgatgcaagtttatttgttgcatggttagttactgttttttaaagtacaaattaacatggcttaattctagcccttgaggtatacgaaatggcatagatcatgccaactcctcacctggtagccaactgggatctggaccctttttcttctcccagtttcactgacatatggacctaccttgacttgtccggtgctgtacctgaacacgctggcaaaaggtgtcggagatggcctcacacgatgatcgtgggaaggatcgcttcgcatcccaccgttgctttccaaacgagcgacggggataaagccaacacacacgcttccccttcacttcgtcttcaacattagttctcctcgccgtcttctctccctctctccaaaacccaaatcccccaaaccccgcctcgcctcccccctcgcccaagcaaatcaaacccaaggacgccgagtcgccgacggccatggcgccggcggtgctcgtccccatcgacgaaggcagcgacggggagggcggtagcgccacggacgtcgcagccccctcccccgctcccatggacatcgacggcgacgacgacgggcgcgaccgcagaggagaaggcgacggaggcggcgtggaccgcctcagcgacctctccaacgacaccctcgccaaaattctgggccatctcagggacatccgcaacgtcgccaccaccgccgtcctctccaggcgctggctcgatctctggacccatgtcgacatcatcgtcttgcagtatgacgagccccccgactccagaatcgtgcaggaagtcctcgccgcccacgcgaggaagggttccacggccactcacatccgcctgctcgaggtcacctccctcaacagcgccacggcgggcgccacggcctcctggctccgcgtcgccgagccccgcctcaccggcgagctcttattccgcaacgcgtcctcggttccgttcgaacttctcaacgacgagatggtcgtcgtggagcagctggtcgaggagcttggggtggtggtggacgaaatgggcgccggcttcgagctgccctgctttatgagggtcaccaagataacgctgagcctggggtttctcggcctatcgctgccaccatcgggtgtcttcgccaagctcaaggagctgcacctggtgtacgtccggttcaatggcgagctcaccctggacgatgccatgctcccttcttggaatggctagacattggcaagtcccgtggcttggcctccctgacgctcaggctggcgcctctgacactgatggctctgcacgatatgcggtggttgcgtcggctcaacgccgtgttgccggggctcaaggagttgtctgtgtccgaatgcttccttgagcatcttgatggcgtgagcattgtggcagatgagatggagcagctcaggtggccaggtttctactggcctggattggtctacttcagcaggatgccgcgcctgcggacgttatgcgtctctgtctctgattttgctcatggatcgcgcgaggctttcaatcagggctctcagatgcttctcaatcgctatccaagcattcaccatctcgagctgcgcgttgtgatcaaaacagtgagtgcttctccttcctctgtatattgttcaaattgcaagatgggatatcaatttagctgttgccatggttatgttcaaatcgtctttaatatgtgcacatgtcatttgggttgtaagctcagtactgaatgcgtgatttggctgcagttttttattggaaaatctttttctattgcttagtgttcgccaactgttttgttagttgcagactagcagagcgatcttgaacttgatgtgataatttgttgatgtgctaaagattcagtttagtgttttctgtcttccactccgcatatgctgatgcggtttctgcgttgcctttaccaaagagataagcaattattaccaattagttatcgttaccattatctggttgctgaacatgagcctgcagatatatctaaatttacttgggactgtcattgaattcagacaatattgatttctcttcctgctggctgaaatggaacagacatatggaggatatacaaactaaaattgttgacccaagctagctcttgtacaagcaaattactaaatcattactagtcggaaggcaaactactaattcttcaactgtatggccatttgacaaacattttttgttctttcctattagttttgcattttgtctgagattgcttctgttaacttcctccaaattcgcagggtgttacgcctttgatggtaggcataaccggactcccttacactaagatcttgaccctacatttagttacagagggccattcttatggagctagtgtattgcatattctgacaatgtgtactcgtatagccaagctgaccctgatgatcccaaaatatttcgaggtaattatgttccctatgaattttgaacaactgcatttttcattctaatttctatgcctgtagtgaattcttgagtaagtggaagtgcacatgatttatgaagttatcaattatgccctatttatgacacaacaaaattaaatttaactcttggtataagttaaatgataaataggcccatttgttgtaaaattcacatacttgtcttatcagcatgtccctctttgaccatttctttcctgttgtccttttaaatgatccagtttgtcagcgatgtaaaagacccaagaaagctttggtagaagtggagtaatttctagcactgaatcatgcttaacggtgtgaacatattttccatcctatatggcatggattaaacttgaatagaaaaaatataatcatcattagattaagaacagctgttttcagttttcaccattccttttacttactgaagtgtcgtattcacagttagtcgacgtattagacgattaatacattgtactctgttcttatccttgtaatttcaggtcgaagatgcttgtgcagagatttgcatctgtgattggctaccaaactggagaaacgagaacattttgttggagtgtctcgaagaagtaacgatcctctactacagaggggaggacgatgagcttgaccttctgaagctcttagtcaggggagcaacaggccttaggaggataagaatagcccgctactgttcggttgctgattgggagatagagatgctacgtgctgatctacgtgcgtatgcagaagaggttggaagaagtcagatttccttggaagtgaggcaatgtaacgagtaactgaagagtgaagaccgtagtgagctgatgtgtgcggcgccttcttgctcagacctgaagtaaaagaagagctctgttggctattactgatccttgatgtacctgacaagttttgatcctgctatgctgtactgtaacagataaactggctggctgcgacgaacctagctgccttgcgtggacatttgtcttcataagcaaaagggttatcatctactactaggattttggaatggctttttcagcatgtttgtcagagctgaagtggtgtgttttgcgtaacagctcactttagttttcactggcaatccagcagggatgctctgtgtgtacatagcatttctgatttgctacggcgttctgcagttgcatagtaagtaatccatcttgtccaagtgttggaagtagtatatatataatgctaaaaaggcttattttaaccatgagatttattttccaaataatccatcaactgtcataatggaaatatataatgctttaagtattgtagtcttggtcattataagtaacctagtaattgtcatagcgtccaatgtccatactactcatctttgctgctggtgttgtcatatgatccatggtgatggtctttgccggtgttcccagctgaagatccgtggtgatggtcctttgcttgcgtcgtcatcatcatcgtcatcgtcgtcgcaggatccatgacgaggattgtgtttgcgtgccatcccatcagtgccgccactatcttggcagcgcgcccgtcttgcggcgccgcgggtgaccagggacgacggcttccgcctccgatacgccgcgggaaaatccgtcgccttgaccagcttcttctgcctcggattcggcacgtttcgtggcaatggctttggttttgggggctattgccgcgccggcgcccgggcggccgtgcgcgtgatcgatcgagagatgtcgatccactccacgcgcgtgccgcggtgcacggcgtgaggttggtttccggagcgagacatcgatccgaccgcgttattccatcgggggcctcggcccgatgcgaaccaggccggcccagtttgtcacggctcatctcatcggctcggcgccaccatgtcgccttctcttgtgaagttgtgaggaggagcagcagagcacgcaacggcaactcggcattcggcatttcggaaagcagcgatgttctgttcgaacgtttgctgagagaggcttctacgtagcggggaacgtgtgaggctgctctaaattgcaacatgatcccattcgaaaaattgctccgttttgaaaaagtcgcgtcattacaattgtttagtgatggttatcaataggtatccaatacctactctctcaccagtctaaaaaaaaccctactctctacatcttaaaaaaccaacctaaaaataatgtgatacaatctagtacaacaaatatagatagatacctatccagatctatctagatttattgtatctagattgattttcataggacagggagtatactcaaaccattagtttaaacttatttaagacttatgtgccacattatctcgcctggacggaatgatgtcgaatatatcatatatggtacactataggtacaacctcatacctgtcaggtaataggcttggtacccgtcggtattatctgattattggatctgatgtcgggacggagtgaggagggatgggagaataaggaatagatatggtttaccggtgcaagttctcccatgtggaaacaatgatgcaaagttcaggtggcgccaaatccatcgctagggatcttggggtttcaaatccgccacgaccgagcaacaaggacgactacggtgctactctccatctttcctcggtgcaacaatggtgctgctccgatcctcactcaacacaacagtggcgctctccatcctccctcgtcgtgaccccaagcaagaggaggtgcagcaggacgctccctaatctcctaggtgagaggaagagcaataggcgataggaacagcatgagacgacaaagaaattaaagggaaggaacataaggccgtggagaaaaaagaagagccacaacaggatgcgatgatgtcgaatgatacaaggcatcgtgtgaagcggaggtagacagagtaggcgccatgagaagcggacgacgggttcccgcctagatggtaagaacgggatcccggtagatatcattttatttatttaggttgcgttcgttgtaatgagttctgggggattgggtgagaaaaggatatcgtattccgcgcgcacgcttcccaaactactaaacggcgtattttttacaaaaattttctataggaaagttgctttaaaaatcatattaatctattttttaaatttaaaatagttaatactaaattaatcatgcgctaatagctcacctcattttacgcatcttcccaatcttgtcaatcccctctcctcaaactcacccttaatatctgagctacaatcagtaacattattttttgtcaacatgatcatttgctctcccgagctatatctctcttcccttctcgtagtacgcttcctgtaatctctcgctggcatgtggacccaccctgacttgtccatgctggacctgaacacgtggcagtatcggcgattggccgcccgattgcctcagacacatcgcgatcccgccgttgcttccacacgagccggtggaataaaaagcgaaggccacggctctctcccccctcccttctccttagctcgtcttcaaatttatcctcctctgcagctctgctctcgccgtcttcttcttcgtcttcgtcttcctcctctctccaaaccccccaacccaaacccacctccccaagcaaagaaaaaaaccgcctcgaaggccatggtggtgatcgtccccatcaatggcgacggcgacggggagggcggtagcggcacgttcgtcgccgacaaccccccggaccctgcccccgctcccatggacatcgacgacgacggcgacgggcgcgaccgcggcggacaaggcgatagccccgcgacgcaggatctcctcagcaagttgaacggcagcggcggagaaggcgacagccccgcgacgcaggatctcctcagcaagttgaacggcagcggcggagaaggcgatagcgctgcggctgcgcgcgtccccggcggcgaaggcgatagcgccccgctctccctggcgctgggtctccacctccacgtccacggcgacggaggcggccgagacggagtggaccgcatcagcaatctccccaacgacaccctcgccttcatcctgggccaactcggggacacccgcaacgccgccgtgaccagcgtcctctccaggcgctggatcaacctctggacccaggtcgacatcctcatcttgcgctacgacaagccccccgactccagattcgtgcaggaagctctcgccgcccacgcccacgcgacggagggttccgagaccacggccatccgcctgctcgaggtcatctccctcaacagagccacgccggaggccacggccgcctggctccgcgtcgccgcgccccgcctcaccggcgagctctacttccgcaacaggtcctcggctccgttcgaagctctcgaccttgaggtgttctcgatactgtatgaggctgtcgtggagcaggagatgatctggtcgagtagctggttccagctgccctgcctcacggaggtcaccaagatcacgctgagcctggggttcctcggcctctcgctgccacagtcgggctccttcggcaagctcagggagctgcacctggagcacgtccggttcaatggcgactacaccctcgacgatgccatgctccccctcttggaatatttaggcattcgcaggtccaatggcttggcctccctgacgctcaggctggaatctctgggctggatgggactgtacgatgtggtggggattcgtcggctcgacgccgtggtgcctggactcaaggccttgtgttcggtcggatgcttctgctatcatgatgtggacagcgtcagcattgtcgcggaggagctggaggagatcgagtgggaggatttttactctccacaatcgttcaacttcaacgacttgccgctgctgacgatgatacacacccactgtgttttttgttctgaatcgaacgaggctttcatcgaaggatactatcagcttcttctcaatcgctatccaagaattagccatcttgacctgcgttttgtgattgaactagtgagtgcttcttcttcttcttcttcctctgtttcaatcaagtaatcaactgtgtgttgctcgaactgcaaggtggaacatcatctcattatcaatttagtgttgcaatagttatgtttagatcgtcttttaatccgttgtaagctcaacactgaatgcttgattcggctgccgtttttattgggaaaactagctagaaagttgcagaccagtagaataatcttgatctgaatttttttttttgtttgtttctttgacctttggaaaatattgttatcagcacattctcaactgatactttgtttctctacaaaagatcaattgttgcattcaatttagtttactgagctagcataattgcaaatcatgcttgcattctggatatagtaatgcagtttctgagttgtcgttatcaaagagatcagcattgattaccattcgtttcgccaacatctggttgttggacatggttacatgatcctgcacataaattgagttcagactatattaatttctatttcttctgggcgaaaatgttgactcaagctagctattccgcaagcaaattactaaaacattactagcctgcaagcaaattactgattcttcaactgtatggccttttgtcaaacaatcgttgttctttccttgttagtttttcattttgtccgagattgcctctcttaacttcctacaatttcacagattcgagatgaaaaaagcgttacggattcgatgatagacaatatccaactcccttacattaggatgttgaacctagctttgaaaacagaaggccatgtttatggagctagtgtgttgcatattctcacaaagcgtactactatagcagagctgaggctggtgaaccaagaaaaattcaaggtaattatatttcctatgaattttgaacaacggcattttgattctaatttctttacctgcagtaaattcagttaactcttgaaaatttcttgtcttatcgtcaaatccctctttgaccatttctttcctgttgtcctttaaatgatccactctgtcagcaatgtaatagatccatgaaagttttcgtacaagtgtaatatctaccactgacaatcatgcttcacgatgtgaacatgttttccatcctccaagtctatgaaatgcattaagcttgaatatataggaaaaatataatcataagatagagaactgttcttttcagttttcatcattccttttacttagtagtgtggcacaaagtgaagctttgacagttactgaatgtgttagacgatgaatctcattaatgctttgtactttgttttgatcttgtgatgacagtctgatgatgcatgtaagctggagtgcatctgtgatgggccaccagattggagagaaacggacatttcgatgaggtatctgaggaaagtagagatcctcaacttcagaggggaggaacatgagcttgacctcctgagggtcttagtcagggtagcaccagcactgaggatgatcagaataatctgccaccgttcgtgcgctgcttgggagacactatctgcacatatacgaggttttgcaagagaagcgacttctgtggaagtgagtctgtcagagtaagggaagcaagaatagctctgcaaaccgtagggaactgaagtaagaagagagctctgttggctactgatctagtctgatgtacctgacaaagttttgatcctgctccgctatgctgtaaagaaacaggagaagttttagctgccattgttctttgtcttcgtgaagcaattttagcattctgcattctggaatgcccttttctgtttgtttgtcagagctgaagtgatgtgtttggagcaccgaaaatggagcacacggatgagttgagccgctgaacgtttgtgattttctacggcgttcggtagcagcatgaaattgcttgtgttagtcgctgagaagaaaatcgttgttgtatagagcgtgaaattgcatcagaacatgagcagtcctgctgtatgttgatcatgcataatcctgtgggttttttttgccgtgccaactgccgagttggcctagagcaccacagcccacagcgtggcgggccgcgcggcacaacctcatgttccgtcacggtcgcgacagtatgtggtcgatggcctcgcacggcgcgcgcgtgggattcctcagtttaacatcctgccgttgattccaaaccagcggcttggacaaaagccaacacacaagcttcccgttctcctcgtcttcaacaatcaacactagtcctcctccaccgtcttctccggttctcccctctccccaaaccccgcctcctcacaagaagagaaccaagaaatccaaagaccccccctcacccacggccatggcggttctcgtcccgatcgacggcggcggcgacggagagggagagggaggtagagccacggccgtcgccgaccccgcccccgcccctgctcccatggatatcgacggcgatcgcggcgcgctcgacgtcctcgcccccgcccccatggacctcgacctcgaccgcgaccgcgacgggggcggcgacagagccgcgctcgtcgcctccaccagcaacgggggcgggcggggcggcctcctcagggatctccccgaggacatcctcgccggcactttgggctgcctcagggacaccagcgccgccgccaggaccagcttgctgtcccgccgctggcgccacgtctggaaatgggtgtccggcctcttcttgcatcattacccagccccacgactccagccccgtgcgcgccgccctcgccgccctcgccgtgcacgcggccaccagcatcaaccagctctacgtcacctccctccatccacagcgccacgccggacgccaccgcctcctggctccgcgtcgccgcgcccctcatctccggagagcttctcttctgcaacaggagctcgattccgttccacatgcttttcgacgaggtattcagcgataccatcgaagaaagaggcgcgctcgagctcccctgcttcacgagagccaccaagattcggctgcgcctggggtttctttgcctatcgctcgctgccgccgtcgggcgtcttcgccgcgctcagggagctgcacctggtgttcgtccggttcaatggcggcgaactaaccctggacgataccatgatgccgttcttggaaggggtagagatctggtgttcccgtggcttggcctccctgacgatcaggctgaagcatctcatctcgatgaatctgtacgccgtgcggggggttgtttgggctcaatgccgtggtgccgagactcactcaagtttgatcaatccatcttggagcatatttgatcttctgtacacgcaattaatttaactctgccaaatttcattgctatttagctctgcccaatttcattgtgacataatcatcggtgccacaaattctgtttcaccaatctagcaaatatattatgaaaatcataacgagttgcctagctaatctaaaagatcgaggatacatagtccacattcaagatttattgctgtcatataaattacaatcaaaatatatatgaagctattcgagattcccagaaattataattaagtcactcgaattatgtttggattgtttggttcagctctcttattaaatgttcccatatataagctttgccagcagaatgatcttgggaaaacaactaactgtaaagaacaagtatatttgccctctccgattagttacaagaagaatgtttacatttcagcaaatgactagtcaaatccatgtctatttgtatgcttgatgcaattttttcattacatcattattcttccttacagagctaaatttgtactgagaagcatcctaaaggtgacaagctcatgatcttgtcataggtctcttcatccttggcttaatagatttagcaacaatatattatgattttctcaaggcacattatggttgcatactgaagaaacattagagaaaatccagctcattattatagtgctccttgagatttatctgtatctctgatcttccagcaaaaccaagttaaatttctgatctattctatccaacttgtagctcaaagaaaacgattggaattaatttcatgtaatagagaaaggaattagcaatgcatttaacttgacctcgggggcatatataaaaagaagggatcattttaatttcaatagtatgtgataaaaaatattttgaattgcatatgtattacattccagtgtcttaagaaaaatgcagttttcgagcatcttttctcctaaagataaagataaagttgaaaaattaagtgtgttacgttagtcgagatagtattaacgtatgattaattgagttttaattattacaaacttgaaaaaatagattaatctgatattttagagcaaccttcatatagaaagttttcgcatgaaacacaccgtttagcagtttgaaaaagcgtgccacgaatatgcaaaattttatccattttttgtagtgaaaacgaacggaacctaagtgatgaagtattctgtggtagttacctttcttagggcacatgcgcatatcttaagagataggagtacatagcgcatacttaatacttccttcagcaccatgtgtgggtgtcatgccctactgtagtaattgttgttgtccctaattaaccagatccaatcaactgattatcatacgaaagtatccgaggaatttagttaaaacaaaggtatatatactaattaacctttgctcacaatttatttcagtatcatctgtttttattagctattcaattcttaattagtacggacctaattaatggggggagggaattgaacaaatatttcatataaagcatccaatctgaagaaaatgatggaatttttttttaaaaaaggtctgttcatggactgctatttatgcatttaaaccggttactaggaacttggtgtgccatccaagtgtatatgagcaaaacagcagcagagcttatatactgacttgtaactgttgtaagctaaatcatcaagaaatgataactatatatatatataatatccttcccagaattcttcaagacaatgttagatatcttttacaaaagggtaaattggaaccatgccattgtaattttacaaagagcattggaatttggacagacccatgggttagcaaattaaatatgagaatatatccctttttgtcttcctttcaggacatatgatcaattgcacacataaggtattatatctaacaacggtcaacgagctctagctttgaaaaatacatcagtttcacatttttgacaaatctactatatatgctctcctgattcctaccaaagtgtcaccaaatgaataatcagtgttaacacaagttgcactaccaaattttatttaaaaactctgatcgatctgcttgtggggtatgttgtaatgtagtacgtaaagatatttatactatgtaaattgtgttagtcacatattttaagactagctagcaaagttgtgctattgacacaattaaatgaaaaatatatttaagtcacccatctgattgattaattgaacataattgacacactagtggatggacttatgtgtgacttacacaaatgtggaaagcaaatatgtaatcaactcctagctgagatcaacacaacacaataactgtatgtcatacacacacaactagtatcatcaatttattaatatcacacacacaacaactaatacaaattaatacacagtcaattaactactcaatcgattatatccatatattaattcgcatctcgcttttaattagccggcagctacaagctagtaataatctaactaagttgatataattaaaatcatcggcatataatataaaaagatgagagacacatactggtttaataggaaatttgatctgtggaacatcagtgcaggtactcgagaaaagctccaagatcctactaaaatgcttcgaagaagtgtcgattgatgacgaatatgcacttctggaggcatccggtttccccgatcagcttgacctcctcagggcagcagccttcctagcagaactcctccatcgccggcatcgagagtgacatggccgagtccttcaattcaatgacgaagcaatccttcacttgcatctttgtgagattggctgcatccacttccagccattgcagatcagatcattgacagacacgaggaataaggtcaggagtgagctggtgtggatggtgagctctctcacgcaggagtagatgctgacaagctcgaggatctgcaggcgaggacagccctacgacatgacctcgctgagatacgtacccgccctcgtcatcggtgatgacagtctccgataagtgaagcttcgtcagcagtgcaaacgttggcttgtcgtcgtcggccagcaccagctggatcaccatgttgacggagatggtacgtgatctccgttgccctcttgaagcatgggagctcaaggagatcagtgtcctcatcatagttgtcgaacatgtcaatcccatgcgacacgaagaggtgaaatcggctagtgactagccggacgacagtgtcgatcgacgcacgagatgatgtcattattctcgaagccgaattcatccccgaggaccgatatagcgaggtagcgtaagaaacaaagggatatcctctcgagagatgaaaacactttcccgacaggagagcacacgggtgcggatggcctcgaccaagggcaagaagacaaggatgtggcggagaagctcgtcggcaagggagctgatttggtcgggaccctcgtaagcactaccctttctgccagatccgccggtgctagaagcctaagctcttgcacttcgcccatgggctgctgctggcgccccgagctatgggagagaattcaggatggggagggagatcgaagcaacgaaaggaatataggtcgggttatgtggctgtggcactgcctcgagagagcaagagtagagtagggaattggaggtggctagggttccgtgaaatgtgccaagctctgctgctaattaattttctgaatttattacacacaagcatttgtcgagtgtctgcttgtgaggaatggtgacgttagctacacctaatattagattcatctaggccgtccatgtcgagatcgacggtatagtcatgtttgtactggccggcggtagtgggagctgtttgtgcactagttagcaaaaccactgaaatatgtagggaacagctaccagtatgcccctactttggaaaataatgtactatgcacaacttaacatgactacttacattcttctcaataaaatgtgtgcacagttgcacatataacttgagaaaaaaatgtttcttacacattctagagtagatatgtgagttttttatatggtacattaacccaaaaaaatgaagtgtggcttgtaaatgaattcgagcctagggagggtccatgttgttgaaagtgccttaggggtgtggctggtgacatggggcggccaaatatgccccccatgaacccaccttggcgaggagcgtgtggaagcggtggcctatgttttgaggtggaagaggaagtcggctagagttgttgtggttggtttgcgtgcaagaaggaagaccatcatagcactctgtgtttgctggctgcagtgggcagtggctacaaggatgcatggagcacacgcgccggcaactgtgtggctatcgccgcgagccatggggagaactcttgctagggagggagatctaatcaaagagaggcatctagctagggtttgtgtcggcggcgctacctcgagagaacgagagtgaactggggaattggtggtggctagggttccgtgaaatgggtcggactctgctaataattgtcttaatttattagtttattacataaaagcgtccaccaactgtctggttgtcaggaatggtgacgtcgactacaactaatgtggccgttaataagattcatctgggccatccatggaaagatcgatggtgtagtcatgttcgtactagccagcagcagtgtgagcttttgtttgtgtggttggtctgttagtgtcctgggcactagttagcagaaccaaggaaatatgttggggggggggggtacatgtattctttggaaaaggatatgctctatacacaacttaacttttttttaatgaccttgatttttctcaaaaatatgtgttgtgcacaattgcatgtatagtttgaaaattaataaaatgtttcttccacattctcaggtagatatttgagggtttttttatatagtacattgagcgtaaaaattaaggaggagtttcaaatgttgacctagcactaggacatcattaaggtgaacataacctcaattggaggcgacctaggttggtcccaagacccaggccagctataaaaatatctccaaagtgcctctagagtaaaagtattttctacgattttgaaagtgctaactcctgaatttacagccaatctgaaaaatcactctagaaaagtgtctctacttaagctttttgttgtagtgggagcattgtagtatcatcaaaaaaacataaatcccccttccttctgcaccaagccaaattcccagacagtaccccgctgatgaagtgcgatactatagatccccgatgcaaggaaaatcaatagctttctaatgatatgctcttccatgtcctcttggttatgcccttgtgtcgaggtcaggggtggacctaggcctcagcctgaccatgcatttttttcaccatgtaacagacttggttagcaaaagttcaatgggcgcagtcccacttgtcatattccttctcccctttgcaagatcgtggtgttcgtggtgtgtggcaagctcatgccctagtgttctttggaaagagtgagggctttcacgtagagcacgttgtgaagaagaggcagcagggaggaggaatctaatgagtgggaccaagagcatttttgacctgccacactatttatccctgccatgagtaaaaccacgatgtttttgttgtagtggccctatgtgaccatttgtttcatctgagccgtccattatattattgtaagatatatattgtgaagtcacattataattatttctatttgctagctgtgggagcttgcctatttaattatgactacggattagcagtttgccgcacagccaatgtaaggatcataatattcactagctagctagctagttaggtttgaaatttccatttaattagttgatcaaggagaatgatctttaatggatactcaacagttttgtggaaatttgaatatgtgcatacattttgatattgtgtaatatgcagtctactactttaccattttgtggaaagggcatacactactcttttttatgtgtgtgtgtgtgttggggggcagggggggctcaagtaatctaaaaatgtgttgtatacacttgtatatatagtttcagagggattgaacaattaaatcattagtaattatgtgtagtttagacaattactccctccgtttcataatgtaagactttctagcattgtccatattcatatatatgctaataaatctaggcacacatatatgcctagattcattagcatctatataaatatgggcaatgctagaaagtcttccattacgaaacgaaggaagtaattattatgtatattgttcaccgctcaacatttactattatttaacttacctccgagtccaaacaaagttgtgattttcccttacgtgacacatgaatagacccaacaacaaataaaaaattaaaaattggtagactccaccaatcttgttggcctctctccatgtgtgtgtctctctccctctggcgtctctctagttaccaatccatgccctatgcgcaaactgttgtccaagaagaaatgttgcggattgcttccctgtgtagattccttgctccgttcttatactctatatgtcggtgagccaaaaaaacaaagtctcctcttttcctctaccggatcccctttcccctccatctctggtggccgttggtcgcctgccaggggaggggggtttggggagccatcggttttatcccttagtcgggttcattctattgtaaatcgagtttatctagtactaggttctctgctccttccctttcctgtatagctcgatggagatgccataatacccatcttcttcgtcctggctacctcctttcatggccggtttgagttccaaatccaaagcttgatctgccttgcgccatttgaaaagttgttacgggattttataccaatgttttagtcaacaagtgcagcatatttgccccatggtgggaggtctccttcctccacaacgatgagttgtggtcggccgtttaaatcatctccgacgagtttgctgctagcaatttggtgcccttgtctttgatggagctttttcaatgttagattgaatctttttgtgttcatcgggttcacttcaacctccaattatgagatgccatcgtcggtttcattgtcttggtgattagattggaagacaaagtgaagcagggactcgattgcctttttgttttctgttggagtcatttgcttattttcaggacccctgcgtaacttgtttatctttgaggagtctttttgcaaatcatgttgtatgtttatctacatgtccttctataggcaacctaatctctctttctttgagagatgtgacgtccactcatgcaagttgtgtataaacatcctatattaaataaatgcgtgagttctaaaaaaaagagaagtgttacagaagttggacagcaggttataccatcgtggttcacgtttaatccttagggaggaccaaagggggcagcaggtacaccatgtcgtactcacagatccggatggggcagaccttcagggaggcggatactccctccgttccataatataagggattttaactttttgcttacactgtttgaccattcgtcttattcaaaaaaaattgaaattattatttattttatttgtgacttactttattatccaaagtactttaagcacaaccttttgttttttatatttacacaatttttttgaataagaccagtggtcaaacagtgcaagtaaaaagttaaaatcccttatattatggaacggagggagcagattgtttgcagggctgtcaacgagccaatgtcgactagttcagaaaccaacgaaaattttcagtggagcatatagaggtatatacagtgaaaatgcaagttctgagttctgacgctatttcatatcaccctccacagtattgtcagcgcctcaaacaactaattacaatgcagcaaatcagaaatgctatacatactcagtgcagcactgcatgatcatcaggaaaagcaaatcaggactgctctttgcaccaatgctcacacttaacttcagttctgagttctgaccaagcaacaagggcacactgctccgtactaacaaaaatggcattccagaatgtcaaatgctaagaatcgttcatgaggacaaactaaaatggcagctaaattctccgcagctagatcagttgctctgttcctttctttacagcacagccggatcaaaacatgccaggtacatcaagggtaagtagccaacaaatattttcttacttcagctcactgtggctgcatagagggagtgtcctgactcacttccactgaaatctctggtcttgcaaaactttgtatgactgcagatagtctctcccaagcagacaacgaacggtggcaggttattctgatcctcctaaggactgttgctaccctgactaagaccctcagaaggtcaagctcatgttcctttcctccgaagttgaggatctctacttctccgagagacctcatcgaaatgtccttattatctctccagtttggtggccaatcacaactgcagttcggtgaacatgcatgttgaacctgaaattacaagatcagaacaaaatatgagctagtaatgagattcattacctaacacattgagctagaccagtctaaaaaaaacacattgagcaactgagaaaactttattttgtattacaaagcatgatttcagtgctataaataactcttatacttaaagtttcatggatctatttcatggccaactgattgtacgatttgaaggacaatgagaaagaataaaaagtgggacataatgataagacaattatgtgaatttggtcacaaaaggccctgtttatcagttaactcgatcatatcaagagttacttttgctatgtcatcaataaggcattattggtaccttcctgcctaaatgtaactgacggagcatatacaagagagtaaggattctttagacataattgtgtgtgtgcacctacacgtgctatcgtggctgtcatggctagctcactccaaaattctcgctacgtttgggtacagggtttcaaagaaaataatacgaagcatttaattataaatcaagacagcttgcaggccatgttagaggtgaagcgcaaaccaagcagaaatttcagcaaaatagacatgaaggggaatatccctattggaaacaatatactcgtttttgtgaagcatgatattcctatgttggacatggaaaaaaaatgtgttgataggcacaagccaataaaacaaacaagtgcactaactatcagcactaaaaacatccatgtttttttaataataaaaacggtttacatcttcggcctttgctgttagacacacaaccaatgatttctatctctaaaataaacgatattagattatgggaaaaatcctgtttctctccaaatgataaccaattgaactaatgaaataaaactcacatagactataacatggttgctagaatcacgttaccagcttgcaacttatatatggagttcaatatatgattgtgtttcaattaatgaagcaaattcatttcagttgaaggatatattatctcggtcaggtgcttcttatttatattgacaacaaatgaaagatttgataaatcgaacaccgtcgctaaacttgccaagctgatatgggacatcttgtttcctttgctctatatatgaacgtacggccgtacgcctcaagatatatagtacttatcctgtacctattgccacacatcagtggagaggtgctttattttcagcatgcaatgcaaatagtaaagatattggcacatatatcatattggcgatcaatttatgaatgattgtgtattacaattgtatgctttgcagagcaagagctttctatagctaactacaattctagctaattgatgaacttatcatcgttccttattttccaaaaaaataaaatatcataaagggaaactatatatatatatatgagaggtaacaactgctataaagagaattaatttattttgttgcacgtactgtgttttcgacagatatattcatattatattatatatatgttactagtttattacaagccacctatgagtattaagaataatgagttcataataaaccccgtgtcacaaaaggcgaaaggacctgtagcctagtggttacaagagcctcagtagcacctgaggtcctgggttcgactccccgtgggagcgaattttccaggatttaacggcgttgtgctttcagtggtaggcgacgtacccgtcgacagcgaggcgcctgtggtgacttcatcaatctctccaggatttgcccgtacccgtcgacagcgaggcgcctgtggtgacttcatcaatctctccaggatttgccggcccagtcttcgaagatgctcataggggtaggccggtttgcgtgcatgcgttcataggggtgactgcgtgtgcgttgtgagtgtctgcgttgtactgtgtaattctcaaaaaaaaaaaaaaaaccccgtgtcttttttgcctatctccacccctagacggactcggcggtggcaaatgagcatatcggcacactgcaggttttgaaattttgtaacccgcctcccccgggcaagcacatatctcacccgaaatgttcagatttttccaaatatttatgaatttggtcaaagtttgttcaaattcaatcaaatatattaacatttcaaatagtttcattaaaaaaacaccataattctcgaaattttggtggtaaacataactatactaaccctggcatcctagcgcctattgttcaggtagatttttctttttttaaatccattctagcacaaatagttcggaattcaagtcatgtgttgtaccacacattagaataattaatgttggcaaacttctcgaaattttggtggtaaacataactatacaaaccctggcatcctagcgcctattgttcaggtagatttttctttttttaaatccattctagaacaattagttcggaattcaagtcatgtgttgtaccacacattagaataattaatgttggcaaactttgataacaacagtgaaaaatggaccagaatcaaacacatgcattcagcattgttggaatccatccaaacagatcgaccaatcatcatgttttgctcagaagattaatagtgtgaaagacacaatcaagccacacaacatttaatatcccaaagttgtacgaatcttacaatttaaatatctaggatatgttccacatggcaatatataagacaaaacatagccaacaccaaaatagtacaccaaagtcgctattccggtcaatctattacagccattatagcaccatgtatttatgtgtatctttttgtctacactaaattattattgttcaactcgatggtgcaatctgatgtgcatagctggcgtagattgtctaaaaacgatttgtatgagtggagattgacagaggaaaccaatgacaccttcctaagtaattttgagttttctacaataaatagtaccaactgcttctcatcatacgtgcccccaaagccattgatacttagttcttcaagtgaacccaatgagatctcttgatccctccaatttggcggttggcgacaagtgcagttgggctcgcattggatatgatttttctgagatacacaaagaattgaaatgatataaaaaatataagcccattttgatatatgaagtaaatcgataaaatgtattcaagcaatatatatatttaattgctagaaacactcaacacagtaatacaataacagacatacctttggacatatttcgagagaaaaccttttgatccacctgcttttcttgaggaggtgtacaatggttggggcgagagtatgttctttcttttccacaatgagttctagctccaagcaatagggtagatccactgtgtgtagaaatttcttttgctcctccgattcctggcaaagtgtcacgaaataaataattagagtataacacaagttgtattaccaaaaacactggtctatcgatctatttatggtggttaatgtaactgtgtgatgatatttatatataatagctaattaaattgtgttaatcacatatttagttagctaggaacaagtaaggttgtgctagggacataaaagcatgaaaatatatttagatctcatccgatactgctaggggatggactttcatgtgacagaaatatagaaatctagaattaactcctctagcctagataattaagctacagtgacaatgtacttgtttagttataataatcattctctgtgcacgatctttataataatctaatgcattaatgctcccatactgaacgtaatcaattttttaatatcatatagtaatgcacaacctaattaactagaccctccccgcaaaaaaaaactaattgactagaccagaaaaaaaaaacatagtaacaagtcaatttcaatttagtactcacacatactaattaacatgtgcctatatatatataaccggccgagctgactaatttgtatgtatatatactctcttgagcagctgcacttaatactactcccctgctcgttgcggttaggataagatttgatcaatttttaagattcgtaccatcaattattaattaggataagtttctaaaatctaatgagttcatgataataattttcaggataaagtatactatttgttttcaagataagcattaatttgagaaatatatattcgtaatggttgagttttagaagcatacttggctactaaatcctgttctaaaaacatcaaatatttttttactgtaaatccgtaatataattaagtccatatactaaggctctaataatgcaaaatcatgacggcataataatatataagagatgagatctagatcatatgtaccggtttaataggaaattcgatctgaagaacttcagtgcaagtgctcgagaacagctgcaagatcctagtataaaacgattggcttccgctgatgaacgacaaatttgtcgaagcagagtcgacgcatgcgatcttgtggatgaatcctgcaggttccctgacgagcttaacctcctcggggcagcagtccttccagtagaactcctccatcgccggcgtcaacagcgacatcgccgacccctccgtctccgccgcatcgatgtcgaagcaatccttcaccttcatccatcggagattggctgcgtctacatcaagcagttgcaagtcgttgattgagacgacgcacagggtcaggagcgaggtggtgtggatggtgagctccctggcgccggcgtggatgtcgatgagctcgagggttttcaggcacgggcagccatgggagacgacctcgctgaggagctcgccctcgtcggcgacgaaggtgttcgacaggtgcagcttcgtcaggtgggcgaacgtgcggccgcggtggtcgtcgggcgccagctgcaccgccatgtcggcgatggagatggcgatctccgtcgccctctcgaagcacgggagcgcgaggaggttggcctcctcgtcgtagtcctcggagatgttgatcccgcgcgacacgtcgaggcggaagcggccggtg

SEQ ID NO: 31530 - DNA, 6911 bp, Oryza sativa
cgacgggagccctctcgtcgcgctcgagcttggccggtgagctgcttccgtcgcgagccatggggagagagatcgatctagggtttgcgcaagacggctgagcggcggaagcgcgcgctgctgcttcgaattcgagacgagaacgatggagttggggaatttttggcggcggctagggttttgggaaatgggccggactctggtctctatttatattacacacaggcgtccgctcgagtggttgagtgggaggaatggccgttagattcatctgggccgtccattgagacatccaacggtgtaatcacgttgcacgcacggtcgagccttggtcgtgggaatttctgtactgaggcctcggtgtgtcgttgtctgatgctggttcgcttcttcgttacggagtacataacaaaaaagcgactcctgtctgctcctctgtccctaaaagaattaaactctacggataaatatgaacacatcacacacacacatatatccatattcatctatagagtttaattttttttgggacgaagaaagtatatattatttgaaataaaattctcacaaatcgtaaattctacttccttcgtttcacaatgtgagactttcttgcattacctacatttatatagatgttaataaatctagacatacattcgtatagatgcctagatttattaacgtatatatgaatatgaacaatgctagaaagtcttacaatataaaatggaggaagtactatagactattggaccactttaaaatttgtacattatacctctaaacctaacccctcatctctcctcttgtcactcccagcgttatcaccaccgcgagttgcgaacttgcgctcgatgccccaattgtagcctagcctcgcaagctgaacgaaagggatcaacggcgtcggcaagccctcttccctgtatacggtggctctcagccactagatccatcaccaccagttgccacatccaaaccacaagattcagtttgcccctgccgccaatgccgcccaccaccctcctccacccccgtggctctagtgcatttctgttcgcccgtgtccaccacccaccactgggtggccacctcctacgaccatccctctaagctcaatgatctctcctcccctaactcaccctaaacccgagactgtaaacccaaactcgtcggaccactgccagtcgctgaaattggaggagacagagttggatagccagaacacgaattgcgaatattagaaatttgcaagattttaaccccaattttctgtcaataaccatgtagtgatttcgaaaaaaacggttagtagatagccgtacttagaaaaaaaacatacaagtcacttttatacattatataaattaaaattacttacaatgtaatcacttttggggaacttttatgtgaactacatgaacagatcagacagttccgtgtgaaaatttggggattttcttgaatgtgaatgttaattagggaaaaaaattgggttgaaaatgtactctctccgtcccaaaaatacccaaccttgtactaggatgtgacacatcctacgttggagtatgccacaaacctaataagcccatatatatatatatatatgtgtgtgtgtgtgtgtgtaaatgcatctcgtggtaggcgtcttaatatacatgtggaattttgtttttacagtcggctacttatcccctcctataaaaatgggcatttgaatactcgttgtacattactggagagatgcacatctctcctagttcgcaaccctctttattccgggtatgcaaccgggagcgcgaatccgggactaaagattcatctttagtcccggctagtaacaccaaccgggagtaaagttttttttttcattgtttcttctgtatccatattgatttctaaccaaactctcaaccataaaatcatcaacattcacaaaagcatcacaaaatcatcaacatccgcattaagaattcacatcacaaatatacaaatccaaaggcatcacaaattaaaaaattcacgttcacagataataaatcaacaaaatcctcacgttcacagataagaaatcaacaaaatccaccgccgcgctgtcacagttgcctcgcgccgaccaagccgcttccgctgcccgctccagccggcgatgctcgctccccgtaggccgcgcggggacgtcgccgcctcccgcgccagccgtcggcgtttgctcccgcgcgggccactgcacgtaggccgccgccgccgttcgctgcgagaaaaaaaaagagaggataagagagcagcgagaaaaaaagaggagaggataagagagaggaggaaaggggatgaggaggagttttcgttccagagggtaagtgttagggaccggacgcttttttcaactgggagtaaaaatgatctgtagtcccggttgataacactaaccgggactaaagattataaaagtgcgttgagctttttaaccgggacaaaaaatggtttttaatcctagttccaataggaaccacgactaatatggttttatgctgaaccaacaaagatcagttctccagtactccagtctccagtagtgctagtagaaacgactaccaacccgcatttgaaaatgcattatacttgcttgtatcgtattagtggaatttcagagattaatctagaatttcaaacaaaagtttcaaataaaatttaaattttgaataacctttttttgttgttgcatttgagcttacctttatacgttgcctcgtcctcgcctcttgcatcccggccaccaggcctggcacatcaggtgttttccctctggacctccgcaaacctatagtactcgcgccggcaccaactatattcctgtcaaccgaccgaggcctcacaccgctaggtagcgatcccaattttttcttcaaactttcaactttttccatcatatcaaacttttctactcacataaacttccaactttttcgtcacatcgtttcaatttcaaccaaacttttaattttagcgtgaactaaacacagcctaggtcaggagcaacggcaaggaagtcaccatgcctctagagaggaccagaggctgttgcatcgccttgcagagtccccgatattctagtgaggagagcaagctgctgggcaaaatgcagggctgtcggtgagggtgtgcaaggtgcaggcgactgaacatgcctccaaaattagaggccctaaaattttcatatgttaatccacttcagatttggaccgctgtgaggatgggggtggtgattcctctggtttgaaaagttgaaggatgtacaatattttgtattgaagttgagtggtgtaaatcgaacttctgcgatttatagttgagggggtcaaatttgattgaacccctatagctagtatgccaagagtttatacaaaccaacaatttacaagtgacttttcgatcaccaatgcagtttgcaataggctgtaatgaatcaaattataagcgcaaaccaacaaagcggggcatgcacttcgatcatttagttagttgtctcgcaatgatttcaaatgcatgaccactagactagttataacacaaaaaaataactctctctttcattacaatattattctagcaaacatacataagctagtaataccagaatagtgcacaaggacagtagttctccacaaccaaatttggtacacatactcaacaaaagttcaataaatcactgcatgcttcttgaatattgccccatcaaacctttgtcactataattttttccagtccactatagcagtatttctctctacacggaaagttcaactcgatggtacatccagtcattgatagttttcgtacatggcacagaaaccgtctatatgaacaatgaccattcgagaaaacgagagttatctttttaagtacttttgaatttcgtataataaaatataccaacttctttgcttcacgatggcccgagatgtgtttgatggctagttgttcaagggagtctagtgggatatcttgatcccaccatttaagtggttcgtggcaagtgcaattagacatgcagcatggagcaaatttgttttcctgaaacagagagatatagtgatataactaaactgattgataaagcaaatgatccataactaacagtgccaaaaaaagtagatattttttgggcaagagagatgaaattaaggtaaaacataccttaggatgatatggatttagtgtaagagttaagtttctgatggagctatttctcttgaggaagtgtacaacagttgagccaaacgagctatgcccatttgttatcacgccgaggtctagcgctgaatagtatggaagttgcacgctgtgtataaggctctcttgctcttccgaatcctgcaaaattaacaacatcaccaatggaataattaaacaaggtatatatatatatatatatatatactttcacacgaaatattaaaaaaaatgctgtatcctggaagaagtgacacaaacgaaaagttcactacggaatattgtaaatacacactgtcattagtactcatgtaaggtcagtgcacaggccaaattattcggtcccaacttactaattaacttcatatttccctaacgtatgtatatgtatgtacgtagcttacattgtgattgcctacttcttgatctgcagagggcacgcataagaagatatatagcatcataaaggcatgcaagaatttcagcgagatccattagttgctaaactagttgacaaacctaactaagtatgagtatgtgacttacacaaaaagatgtgtacactgataaaaaaaaaaaccaacctagctgtgatattgacaaacttattaaactctatgcttttctttaaaaaatctaaattctatgtacctaaacaatctcaaggacgcaatttacgcacgccaaaatactaattaaacatcaacaagataaataaatataattaaataagtaaacaaataaagaaagaaagaaataccagtgtagctgtagcagtcataggagaagtgagccttaaaacatgagcacgagagaaaagcttcaagatcttggtgaaatccgattgcccaatctcgtgaataatatgagaaggaagctcgacgacggcgagctccatgaggcagctaggtaaactaatcagctcgaccttgtcggggtacgcgtcctcccagccgagctcctccagcgccggcgcggcgagccgcatcgccgcgccgccggtccacggacagcggctcgtcccgtcgaagcagtacttgacccgcatcttgcgcatgttgccggccgccacgtcgagccgccgcagcgggacatacgcgaggcgcaggctcagcagcgagtcgctgcggagggtgagcgcctccatgccgtcgatgtgctcgagctcgaggcactccaggcttgggcaccggcgcgagacgacgccgctgatgccctcgccggcgtcgctgaagcggagctcggacatccgcagcctcgtcaggcgggtgaagcctccggcggcggcggcgtcgtcgagcgccgggaggcggacggccatcccggaggagtagagggagatctccgtcgcccgctcgaagcacgggagatcgaggacggcgtcgtcgtcgtggcctacctgggtggtcacggcgaggtagaagcggccggtgacgctgcgggcggcgaaggccgcccacgcggaggcccggtcgccgtcgacctcgggccagtcccagtggtacgagatggcgaggtcggcgatgtccacgtcggcggcgtagcggcggaggatgccgtcgaagtggtccgggatgtgcccggcgctcgtcgcctcctcctccaggaggtgcagccgcgggacgcgcttccagacgccgacccaccggcgggacagcgcgctggtgcggacggcctccggcgtggtcacgaagctcaggacatggtggagcagctcgtcggggaggctgctgatacggtccggaccaccgtagtagccacggccaccgccggcgccggcgccgacggatccgccggacagagaagccttcttgtgcgcggcgcacctgtaagccattggggaaatggggatttgagctagctctgaaggagaagaaatggaggagaaatctagggtttcgtgtttcgtctcgtggcggcgttgctgcgtcgatcgagcgagaggaggagtacgggaggctgcctctgctccgaggctttacatagcggctgtgtgggagagagacaactgatgcatgtgaccgttggtttcatccgagccgtccatcgcacgagtaccgtatgtgtgagtgtgaaaccgtccgaaacctagcttatttcctataatactggtcgatccttttattttctttttttgaaaatggattcaaaccagacatctacatccaaaaaataataatgtgtgaaaccgtccgaaacctaagtgcctgttctaaaaaataataattacctattctgctgatcatatatccctgtctggagctgaagtctaatggaaatatggaatgatacattcccatgtaaaaaaaatatatgcctgcgtttgtatgatgaaagtacagtaattaaattaattacttgaacatgaaaaattagcatcacaaagtgctgcttatatttcattggtttcgatcagattctctgatgagagaagaatatgaaacaaaatcgtctctaaccaaaaactatctaaagtcaacaaggggctgctcacttccatcaaatgttcttcaattcttctactgcgcatgcacttccaatcaagcagatgttgcagacgtaggagtacgtcggtcaagaaaccgcgcagtatatactatactcccgtcccaaaaaaaaaaaaaaagacaaacattgggtttccgtgtccaacgtttgactgtccgtcttatatg

SEQ ID NO: 31531 - DNA, 57943 bp, Oryza sativa
ttatatgaaatttttttataattagtattttcattattgttagatattgataaaacatgattaatattttctgcgtgacttgtctttttaatttttttttataatttttttaaataagacggacagtcaaacgttggacacggaaatccatggtttgtctgtttttaggatggagggagtagagtatagatatgcagacgagatttcttggtatgcaagtatataccgtgttcttggcttgcaagatcacccacgcaagttcagagcgaacgacggcagttaatgcaatctactccatctttctaagttttctggtgctgccttgattaattagttccgcacaatcaacctcatgctaatttcagctgaagttttttcccggcgaaaaatttcagctgaagttttttcccggcgaaaaatttcagctgaagttttgcaaagattattacttcttcaagaaatggcatgcgcgctaatgcaatataattcagtggtcacatgatattctttcccctgaaatgagaaaataatgtaactatgatattatattattacacgggcatatattaagagataccctcccggtaaaaaatatttatcatttaattaggacaagattgtgtggcatatattaagagatacccaccccggtaaaaaatatttatcatttaggacaagattgtgtggaacctttcacaaagtacatatatttagttcgatcactagataatattaatgactagaaaccaacatagtgccggatgtgacacattgtagtactacatatgaatctggacatatacgtagtatatataacacatttcagtatatatatgccggtggtgtgtatatatatatatatatatatatatatgtatatatatatatatgtatatgtatatatatatagtgcacacaggccctcacgtgtacacacgtgcacaccaactaaaaaatatcaccaaaaaatctagaaaaaatcatacacatactttcaattgtattacacctagggttcaaatcttaacgtcaaattcattatattttagccgtaacaaaaaaaacaaaaaatctgacagttttaaggttgcaattttgtcagaattttatcttttttgttattctctatgtagaatgaatttgaagatgcgactttgcacgtagatgtaatactattgaaagtacatgtatgaattttcctagaacttttttgtgataatttttagttggtgtacacggtgtgtacacgcgaggtcctgtgtgcataggatacgctcccatatatgtatatatatgtatatatatatatacggtggcgctacacagcgccacccacaggtgctacgcgccacgaaacaaaatggcgccagacacaaacgaggagaggtcagcccaccaccgacaaaatcccaccaacgaggcatccaacccacccgcggagttaaaatttaacttagatacagttggtggtggtggtgcggtgatatcgttgaggagttaatattatgcgatgattcagttggtctgagttaaagtttaacttagatacagttgggtggtggggtaaaaccagcggagttaaattttaacttagatacagttaggtggtgggtgcgatgacgtcgttgaggagttaatattatacatggtttcagttgatatgagttaaagtttaacttacgtacaattgggtggtgggatgcgatgacatggttttggagttaaaaaattacttgttgttgttcaattctggatgatatgtgattgagtctggttgctgctgagttaaaaattaactcgcgatacaaaactgcaggacatcgttgtagagttaactcagtttgtatgagttaaattttaacttgtgtacaacaagattttaactcaacatatacgtcttcacaatctataagcataagttaattttttgtcggcacttgctccggacatcaacggcggagcgtcatggaggtgttcgtcgctgctcctccatgtccttcggtgttcgaacacgccgccgcggaggtcgccgccgtgtgcgtggggcgcggaacggcggcccgatccgccgccgcctcggctgtcgcccgcagtcccgcagtcgccccgtcacgggatccgccgtcgagccacctgcatccacgcctgacacgcaccaccgcaaccggatccgtgtacgtggggcgtggagcggcggccgaatgcgccgccccctcgcctcgccatgccatgttggatccgccgacgcctcgccttcccgggcaggattatccccggatccatcatcacgccggatacgccctaccatggccggatccgcgcgcgtggggcgtagatcggcggctgggtgcgccgcctcgtcgcctcctacacgccgtcaaccgtcgcctccacgcctgccgccgtgtcgtaccggatccgtcgacgtcgcgcccgccgccgctcggcagtggaggtggcgctcgacgtcgcgccgccagccgtgtcgtgccggatccgcccaatgccgccaccactcgccgccacgcccgctcgccgctctcatctccgaaaaaataggatctacatatgtggttggttacggggtggatgtacaacactggtatatatatacactaaaagttgagtaacatcaagttaaattttaactcaaatacgtggtggtgggtggggggaaggtgggacagggtggtggtgcggctgtgtcaggcgccatctaatacgtggcgcctgtagcgccatatagtagttctatatgtatgtatatgtatatatatgtatgtatatgtatgtatatatatgtgtatatatgtatatatatatgtatatatatatgtatatatatatatgtatgtatgtatgtatgtatgtacgtgattgaaaatgtgtcatttcatatatatcaacaatatactgaaataatggagaattattttatttgatgataagctgctttagcagattatgtatgcctcactgacatgtagtagatgctaccataacatattaaatcaacgtaaagagtggatttgaatctttttagacctacatgacacccaagacaaattcgagaatttagaaatacattttgagagtgatatctagatgacacactcgcataagtttaggatagtccttatacttatcagcctcatcttttcgcttatgcttattcttatcagccaaaattcgaattttcaactttaaatttggagttgattttgaggtttttgttactgggattttgaggttttttcatcggagtttatttttcagcttttgcttttagatcactaagaacacgtatatatatataaaagttttattcacagattaattttcgtttgcatatatgccgtttcccttattcccggaataagcgaaatgatggagcacttcactcttgttttttattttggccggtttcaattctggaacgggcagaacatctttcagagaaatcatcatcgatcagcctaaaatcaaccagggactgttcaccgactttacaatatatttcttctgaggaataggtacaatcggggactgttcatcgcctttacaatcggtacatactatgctgcaggcaacagctcaggctgcatttagttcgacgtaaagtttagattttggttgaaattggagatgatgtgactgaaaagttgtgtgtgcatgacagggtgatgtgatggaaaaggactgaagtttggatctaaactttggatctaaacacagcctcagagcagctagctagccacagataccgaggaacgaaatttccttggcttggaaggcactgtattttctttgctagcaagagatcaccctgttttaatttgtaaaatattacaggctgcacgttcagaacaacggatggcgacgcaatctctcataaatttatgattctatttcttctatgagacgtgctcgtccaaaaatcaccttctaaatactctatgtctcaaaataaacaaacttaatacgagatgtggcatatattactaatagtatatatgaatctgaacatgagatgaggaatgtgtccagattctgaaaccaaagaattaataaaaacagcactatgtgatatatggatgctaacttcctccgtttcataatgtaaaactttataggattgtccacattcatatagatgttaatgaatctagccacaacatctatatgaatgtgggcaatgctataaagtcttatattatgaaacagagggagtacatgttatgttatcatattacttgttaagtatatatgagatggaacaaaaatgaatcaagcgacggtaattgcagtggtatttgtgatatttatgttttgagaaatctaggaatgcttatttcctgataaacatattacactaagattaacataattttgataatgattttaatgtttatctataatcattaaggcaataaaacttagttgtacagatcaagcgtacatcaggctagcaattggagctgcatcttatatagctgatctattattatattctgattgataacacaattaaagttaaaagataaacaatagaataaaaaacaaaagaaatagaaaatatgcgcgcagttggcatgccatccatatggcttgcataaaccatatttatacagtaaatgcatgtaatatttattatttatttgtaaaggagttatattttgaatagatctttaagcagttttaaaattgtatatctatcaagcctaacaaaaacattatgctggtaaatgtttaaattacatataaaagaaataaaaataaatgtttgaaacgtggtacgtggaacacaagtcttgaaaaatatggtacgaaggggtatacctcttcaaaacatttgttcgaagggtgaaacacgttccatggattttttaggatgatagtccggaatgatatggaaaatcaggatgcctttgttatgcaaagaataatttgaactaaatatatgtaaactttagggcttatatggatgaaaccatttgaataaaagacttttcataatattaataaactcaaagggctaaattgaaaaaaaagatgaatctcttttcctttcaccacatcaggccatcaccccacgatggtatccacaatgggcatgcacggcaagatcaacgtcaacaatggcaaaggcatggaggaccaagaacttgtcctgtgtcgttgcagtgcatcacccacatatctgacattggatttctcacattctgatcttcatttttttatcagttttgatcgattgaagaatgaagaatacaacattcttttatcagttttgatcgattgaagaagacaaatggagacctcttctttcttactttgatgtctatttttatttcgatttgaagagattgcaagtgatagtttggaatactctagagtttagatgaatgttcgcgcgggagactgcacagggttctccaccttctctccatatggacacatggcagattttaggagaggttcaaatcgaaatattaggacgccatatggcccaatgagaggctagggattggaccttgaaatcggtattaaagattactgtacttccatcatacaacgcgggcatttcttttttttttcatatatatgggaatgcatcgatcattccatgcattagacttcagctccagtatgcagggattggtccgtaggtaattaggtttcgaacggtttcacacatacaagcgctagacagggattaatcagttttgaaaaaggaaaaaagattgatcagtatagaataagaaattagctagatttcggacggtttcatacatactcgcgtgatggacggctcagatgaacccaacggtcacatgcatcacttctcgctctcccagacagccgctgcgtccgctatgtaaagcctcctcctctcgctcgatcgacgcagcaacgccgccacgagacaaaaccctagatttctcctccatttcttctccttcagagctcgctcaaatctccatttcccccatggcttacaggtgcatcgcgcacaagagggccaggttgtccggcggatccgtcggctccagcgccggcggtggccgtggttacggtggtccggaccgtatcagccgcctccccgacgagctgctccaccatgtcctgagcttcgtgaccacgccggaggccgtccgcaccagcgcgctgtcccgccggtgggtcggcgtctggaagcgcgtcccgcggctgcaccttctggaggaggaggcgacgaaggccgagcacatcccggaccactatgacggcatcctccgccgctacgccgccgacgtggacatcgccgacctcgccatcacctaccactgggactggcccgaggtcgacggggaccgggcctccgcgtgggcgggcttcgccgcgcggcgcgtcaccggccgcttcgacctcgccgtgacgagccaggtgggccgcggcggcgacgacgacgagcgcgccgtcctcgacctcccgtgcttcgagcgggcgacggagatctccctctactcctccgggctggcggtccgtctcccggcggagctcgacgccgccggcgacggagacttcacccgcctgacgaagctgcagatgtccgagctccggttcagcgatgccggcgagggcatcagcggcgtcgtctcgcggcggtgcccgagcctggattgcctcgatcgagctcgagcacatcgccggcgtggaggcgctcaccctccgcaccgactcgctcctgagcctccgcctcgtctcggtctctcgtctccaacggctcgacgtggaggccggaaacctccgcaggatgcgggtggagtactgcttcgacgaaacgagatcgtgtcgtccttggaacggcggcggcgcggcggcggtgatgcggctctccgcgccggcgttggaggagctcggttgggaggacgcgtgccccgacgaggttgagcggattaggttaccgacgtgcctcagggagctcgtcgtcagcgagcttccttctcatattatccgcagcatggggcaatctgatttcaccaagatcttggagcttttctctggggctgatgttctaaagcttacttctcctatgactgctacactggtattatttattcattaatttacttatttatttttatttatttctcttattgacttttaattacgttctaaacttttttctaatttagctttttttaagaaaagcatagaatttagtttgtcaatatatatcacagctaatttggtttataactttcatgtaagtcacacttttaggtctatccactacaatattcggtagtggactttttcggttgtgtttattaattgttgaagagctactcctctcaggctacaataaatcaatatttcgtcaagtattgactatgtttaaattaaattacttgacgtagtatggttcaataaatagatcttcaaatcattttgtgtgactaagataggtcaaatagcaagctagtaaaatgtgagtaacacacaacttttcaaatgtatacaagtttaaaaaaaaaacaaattacagtaccctgctgtaaacatagtgttgtttttatgaagattaatttattacagttagttttaatcacatgaaagtgtataactcccttgtttaattattcaattggtgacgatgttaattttgtaggattcagaagagcaagagagccttatatacagtgtccaacttccttactattcaaagctagacctcggcgtgataacaaaagggcataagtcgtacggctcaagtgttgtacacttcctcaagagaaatagctccatcagaaacctaactcttacactacatccatatcatcctgaggtatgtttcttaatatctacgtttcatctctctttgcccaaaacatatctactttttttttggcaccgttagttatcgagatcatttactttctcagtcattttatatatatagttatatcactatatctctccttttgtgttttaggataaaagatgtgctccatgttgcatgtctaattgcaattgccacgaaccattaaaatggtgggatgaagatatctcgctagactcccttgaacaactatgtgtcaaacacatctggggtgaatgtgaagggaagaagctgatatactttattatgcggaattcaaaagtgcttaaaaagatcactgttgttttctcaagttggctttgttcatagagacgctttctacgcaatctccgcaaactatccacgtctggatgcatcatcgagttgaactttccgtgtagggagaattcctgctatagcggaatggaaacaattacagtgacaaagggttgaggggtaccggtatattaaactttttgagtatgtacctgtaccaaaatttggttgtggaaaactacaatccttgtgcactattctggtattactagcttatatatatatttgctggaataccttatatgtggattcattcctttggaatgtgctctcttaatattgtaatgaaagaaccctagctagttttttgtgctaactagctagttgggtggccattcatttgcaatctttttttttttatcaaacattcatttgcaatctttatgagacagctaactaaaggataaaagtgcatgccccctcattgttggttgcacttataatttgatggatgaacctattgcaaactatacgtgtgaaattaaagtcacttgtacagttgtatgtctttgggttgtatgaactctatgatatatatactataggggtttagtctgatttactatatattgcaaaagtttgatttaccatactaaatccaataccggatattttacacacttcaacttttcaaaacaaacaaatcaccatcccgcccttgtcaacgcagtttaaatccaaagtagttttagtcctgtgacatacatgagtccacctcaaatcctctgactttctatggcaaaatcacaagcgtgcggttccatctatcccaccatcgattctcatccaacgatgcacgctcattcccccaatatgtttcttcttcatctttctccctttgctcagcatcacggccaaccgccagctttgatatcctccttgagtacaaacgtgattacaccattggatgtttcaatggatggtccagatgaatctgatggccacattgggtttagctaccattacaccattcctcccactcagccactcgagaggacgcctgtgtgtaatataactagagaccgttagtagcagagtctggcccatttctctgaaccctagctagctgccaccacaattccccaactccacttgctctagtgtcgaggcagtagcgctcctgtcggtcagccgccacaaaccctagatccatctccccatgtcttccgacggcacagcagctcacctaccaagctggagtgcgagagagcttccgtctccggcggatccgactgcgacggtgacgccgcctacgagtgtcccgattgcatcagctcgctcgccgccgtgctactccaccacatcctcgtcttcctccccgtggtcgaggctatccgcaactgcgtgctctcccactgttgggtctgtgtctggaccggcatcccacagctgcagctcgacgatgatgcgtggagggtcgatctagttaattaggttgtgcattatatgatgttaaaaaattgattatgttcagtatgggagcattaatgtgttagattattatgacaattgtgcacaaataatgagtattataactaaacaagtacattgttactgtagcttaattatctaggctagaggagttaattctagaattctgtatttctgtatttctgtcacatgaaagtatcgaatgagaggtctaagtatattttcatgcctttatgtctctagcacaacctttacttgtccctacctaactaaatatgtgactaacacaatttattagttattatatttaaatatcctcacatggttatattacccaccataaatagatcgatagaccagtgttttggtagtacaacttgtgttatactctgattatttttatttggtgacacttcaccaggaatagtaagagcaaaataaatttctacacagtgtggatctaccatattgtttagagctagaactcattgtggaaaagaaacatcacacgctcgacccaaccattgtacaccttctcaagaaaagcaagtggaccaaaaggttttctctcaaaatatgtccaaaggtatgtctattattgtattattgaatgtatgtttctagcaattaaatcgatctatagcttgaatacattttatcgatttacttcgtatatcaaaattggcttttttttttgttatatcactttaattctttatgtatctcagaaaattcatattcatgcgagcccaactgcgattgtcgccaactgccaaactgtagggatcaagagatctcgttgggctcgcttgaagaactagctatcgatggctttgggggcacctatgatgagaagcggttgatatattttatcgtaataaactcaaaagtactgaggaatgtgtcattggttttctccgtcaatcttcactcatacaaatcatttttgcacaatcaacaccagctatgcacatcagagtgcaccatcgagttgaacaataataatttagtgtagacaaaaaggtacacataaatacatggtgccataatggatgtaatagattaccggaatagtgactctggtgaacactcgtgtgtgtactattttggtgttggttatgtctgaattagtcttatatattgccttgtggaacatactctagctatttaaaatgtaagatatgcgcaactttgggatattaaatgttgtgtggcttgattgtgtcttccacactattaatcttatgagcaaaacatgatgattggttgatctgtttggatggattccaacaatgctgaatgcatgtgtttgatcctgatccatttttttcattgttgagctcaaactttactaacattaattattctaataaaaaattgatggtagcaatcttagaaattaaattgaccaaatcttgtcaccgtaaagagcagaggggagtacgtagtacatattgtagctgatcaagagactatatatagatataataaatagagacaggttattagtatgtatctgagtactaaattgacttgttactgtgttttttttatatagttaggcttattttttggcaaggaaggtctggttaatttggttgcgattatatgatattaaaatattcatgtatgggaacattaatgtattacattactataaataccgtgcataaaaattgattattataactaaacaattagtgcattgttattatctgtagcttaattatctaagctagaggaatcaattctagatttccatatttctgtcacatgaaagtcccctagaagtatcggatgagaggtctaaatatatttttatacatgtatatatgtctgtagcacaactttactagtcttaaaatatgtgactaacacaatttagttagctattatatgtaaatatcctcacactgttaaattacccaccaaaaacatatcgataaaccggtgtattggtaggacaactatattaattatactctgattattcatttggtaacactttgccaggaatcgaaagaacagaaaaaatttatacacggtgtgaatctaccatgcatattttttagagctagacctcattgtggaaaacaatcaacacacggtcgccccaaccattgtacacattctcaagaaaagcaggtggatcaaaaggttttctctcaaaatgtgtccaaaggtatgtctattattgtattattgatcgatggctctatgtttctagcagtaaaatctataacttgaaccttttattgatttacttaatttcgtatatcgaaatcagcttatatttttttgttatatcacttcaaatctttttctatctcagaaaattcatattcaaggcgagccctcctacacttgttgccaaccgccaaactagaaggatcaagagatctcattgggcacgctcgaagaactagctatcgatggctttgggggcatctatgatgagaagcagttgatatattttattataaaaaactcaaaagtacttaggaaggtgtcattggttttctctgccgatctccactcatgcaaattgtttttgcacaatgtacagcagctatgcgcatcagattacaccatcgagttgaataataataattattattgtacattaatgcatggtgctataatggttgtaacaaattgactgtaatagcaatggtgaacactcgtatgtgtactattttggtgttggttatgtttgatttaatcttacattttaccttgtggaacatactctagctatttaaattgtaagattctttggatattaaaatgttgtgtgtcttgattgtgtcttccacactttaatcttctgagcaaaacatgatgagtggtcgatctgtttggatggattccaacaatgttgaatattgtgtggccctgaatagattaagttcgttatggaacctgctggatgccctccataagatcgcctgcgtcgacttcgcttcgacatatttgtcattgatcaaggaagccaatcatattatactaggatcttggagttattctcaagcacttgcactgatattctacggatcaaattttgtattaaaccggtacatatctagatctcatcttctaatatattattatgccttcatgattttacattgttagagccaatatatggacttaattatattatggatttacagtcataaatattcgatgtttgtagaacaggattttgtggtcaataaagcttataaaactccaaccattactagcatatatatttctcaaatgcttaacagtatactttttattgaaaagtattatcataatatcgtataaacttattagattttataaacatcctaatatagaattgattgtacgagacttaaaaaaatgataaaatcttgtcctaaccacaaagagcagagggtagtattgtagctgtcgagagagtatatatacataaaaataagtcagcttggctgcttatatatagagagacacgttaattagtatgtgtgtgagtactaaattgacttgttattgtgtttttttgtgtctagttaggtttagctttttgcaggagggtctaattaattaggttgcgtattatatgacattaaaaatgattatatatgtttagtatgtgagcattaatgtattacacattactataaagactgtgcatacaaattgattattataactaaacaagtacattgttattatatgtagcttaattatctagctagctaggctagaggagtcaattcaagattttcatatttctgtcacatgaaagtccatcccctagcagtattagatgggagatatattttcatgcctgtatgtccctagcacaactttacttgttttaaaatatgttactaacacaagttagttactattatatataaatataatcacactgttacattacccaccataaacagatcaatagaccagtgttttggtagtacaatttgtattaattatactctgattattcatttggtgacactttgtcaggaatcgaaagagcagaaaaaatttatacgcaatgtgaatttaccatatatttcagagctagggcatattgtagaaaagaatcagcgcatgcttgccctaatcattgtacaccttcacaagaaaagcaggtggatcaaaagttctctctcaaaatatgtccaaaagtatgtctattattgtattatagattgctgtgagtttctagcaataaaatctatagcttgagtatctttgatcgatttacttcgtatatcaaaatcagctcttttttatatcacttcaattctttttctatctcagaaattcatattcactgtgagcccaactacacttgtcgccaaccaccaaacttgagggatcaagagatctcattggaccgcttgaagaattagctatcaatagctttgggacatctatgatgagaagcagctgatatattttattataaagaactcaaaagttcttaggaagttgtcatttattttttcttccggtctccactcatgcaaaaaaaatttcaaaatctatgccagctacacattagattgcgacattgagtagaacaatattaatttagtgtagaggaaaatgtacacataaatacatggtggtgtagtagattgaacgaatagcaactttggtgaacactcctgtgtgtgcttttggtgttgcttatgtttgattgtccttaaaattgtaagattaattcgtgcaacttttggatgttaaaagttgtgtggcttgattgtgtcttccacacttttcttcttctgagcaaattaaacaatgataaattaatgcatgtgctttattttggtctattttttattgttgggctgaaactttgccgatattagttgttctataatgtcatacatctcacgacttagaattttgatccattcgttctagcatagattaaaacaaaagaagagtgtaatatgcctaaacgacaggcgccagtgtgctgagacgctcgctaacacgccgtacgtctaggtgcggagacatgcaaaaaggacaccggagtcaccatgaacttgttagtcttaacgctcacaggtaacttgtaaatgaactgtgtatgtgccgtcaagtttctcccatatataaaaaaacaaatcaacagaactgcttgttatgtgtggacacattttctgaactgctaaacggtgttttgggagacgaaggagaactatatttcaggggacgaagggagtaacgttgaagagaaccagaattggaaaaagttaacttgagtttcctcatcttatcgttgagtttcaaaaaaattcttaaaccaaaataccaggtatatataacgcatcatattcttacagaactaggtcacattgagttccaaggcatcattgctcccggttttggccgacgtggcagctaagttagcgtgggactcacatgggccccatatgtcagcaacctgttaggtttaattgggtaattgatccatttaaatcaattaaatcaaataaattccaaggctcattatgctaggaattcatgtgaattcattcttttatgggatatcaatgggatgaagagttttgagaattaatccatttgattaaggaattggtaacttatatcaattagtcctaattgatggatggttgatggttgtgtagtggaggatggttcatggctagttgatgagaattagttgctctattcctcttcctattccattggtaacttacatcaattactcttaattgattgttggttgatggttgtgtagtggaggatggttcatggctagttgatgacaattagttgctccattcctcttcctattccatgactcttactcttcatcttccattcctcttataaaatgggaatggatttgatctcccgcgagataaagaagacacactttcatccattttcaaaagctgttgctgctacggtaatcccatcccgacgagtgtgtgcacacgcgttgggagagtaggcctccgaaaccacgcgttgctgcgacgtttgcacagacgggcgggcgatcaggtttttggggagcgcaaggcgcgactactcactgttcgtcaacatctacttcatcttcaccaacatgtcgaacactggagacaaggagaaggagactcccgtcaacaccaacggaggcaatactgcctcaaactccagcggaggaccattcttggggtataaccttattacattatttcaattagaagttttactgttaatgttcatcgcaatgtcaacattgtgtcattatgtgattgttgatgcttattcaacgttaagcatgctcatgttgattacattcaccactatcactggatcaaatcctattgtaaatatcatgtttattatcttgttattttggattaaaatatgccgaattatgaccaaatttccaacaatccaaaaacctgataggtcattttcggtagttggctttgctgctgcactgaaaccacatgcttttgatggttcaaactataagagatggaaagcacgtgcactattgtggttgacagcgatgcagtgcttctatgtttcacggggcaaacgaagtgaaccacctctttctcctgaggaagaggctaagttcgaggcttcggattgcctgttccgtggagcattgatcagtgtactcgctgacaacatagtggacgtgtacatgcacatgccttctggaaaggacatgtgggatgcacttgaggccaagttcggagtttctgacgccggcagtgagctgtatgttatggagcagttctatgactacaagatggtcgatgaccgttctgtagttgaacaagctcatgagattcagatgttggcaaaggaacttgagaacaacaactgtgagttgcctgacaagtttgtggcaggtggcattattgccaaactaccaccttcttggtcggactttgccacttctctaaagcacaagagacaagagttcagtgttcctgatctcattggctctttgggtgttgaggagaaggcgagggcaaaggacgtccggggcaaaaaggttgagggaggttctagtgccaatatggtacagaagaagaaccctcatgcatcccacaacaacaagaaagtcaagcctgatgtcaaacccaaggctgcaaccaattttaagaagaaaagtaagggaaaggcaaagggagactgctttgtgtgtggcaagtctgggcattgggccaaggactgtcctgagcgcaaagacaggaagtctgccaacatgatcattagcgagggcggaggaacatcggggtacggtaaaatattacctacagttctctctgtttttcattcacctgattggtgggtggacactggtgctaatattcatgtatgtgctgacatttctctattttcttcttatcaggtcgggagaggttcctccttgttgatgggaaacgggtcgcttgcggctgttcatggtgttggtacggtcgatctgaagtttacttcgggaaagaccgtgcagctgaagaacgtgcagcatgtcccttcaataaagaagaatctagttagcggctctctattgtgtagagaaggttttagacttgtgtttgagtccaataaatgtgtcgtatctaaatatgggacttttgttggaaaaggttatgacagcggaggcttgttccgcttttctttgaatgacatgtgtaataatcataatgctgtgaaccatattagcgagaatgatgagtctaatgtgtggcattcgcgactctgtcatgtaaatttcggttgtatgacgcgcttagctaacatgagtttaattccaaaattcactttggtaaaaggttccaagtgccatacttgtgttcaatcgaaacaacctcgcaagcctcacaaggcatctgaggcgaggaatttggcacctctagaacttgttcattccgatttgtgcgaaatgaacggcgtgttgactaaaggggtaaagaaatatttcatgacactgatagatgattgcactagattttgctatgtgtatctattgaaaacaaaggatgaggcattgcattgctttaaaatctataaagctgaggtagaaaaccaacttgaaaggaaaatcaaacggttgaggtctgatagaggtggggagtatttttccaatgagtttgcatccttttgcgaagagtttggaattattcatgagatgacgcctccctattcaccccaatcaaatggggtggccgaaagaaagaaccgtactctaactgagatggtgaatgccatgttagacactgcggggctttccaaggaatggtggggtgaggcagttttgactgcgtgtcatgtcctgaataaaattccaatgaagcataaggaagtaacaccattcgaggaatgggaaaggaagaaattaaatctctcatacctacgaacatggggctgtttggccaaggtaaatgtacctatagccaaaaagcggaaacttggacaaaaactgttgattgtgtgtttcttggttatgctatccacagtgtgggttatagattcttaatagtaaactctggagtacccgacatacatgttggtacaattcttgagtccagagatgctacattctttgagaatgaatttcctatgaaatatacacctagcacttctagtaaagaaactgtcatgccccatgagcactttgcaccgatagaacacaatgatcaaacgcctgaggaaaatcctgaggaggacaacattgtagatactcgcaagagtaagagacaaagggttgaaaaatcctttggagatgactacattgtatacctcgtggatgacaccccaagaaccatagaagaggcatattcatctcctgacgctgactactggaaggaagcagtatgcagtgaaatggactcgattatgtctaatggtacttgggaagtcgttgagcgtccatatgggtgcaagcccgtaggatgcaaatgggttttcaagaaaaagcttaggcctgatagtacaatcgaaaagtacaaggcaaggcttgtggccaagggttatacccaaaaggaaggcgaggacttcttcgacacatactcaccagttgctcgcttgaccacgattcgagtactacttgctctggcagtctctcatggtcttctcgtccatcagatggacgttaagacagctttcctaaacggagagctggaggaggagatctatatggatcaaccagacgggtatgtactagaaggtcaggagggaatggtgtgtaaactattgaaatccttgtatggcctcaagcaagcacctaagcaatggcatgagaagtttgacaccacgcttacatctgcaggctttgttgtgaacgaagctgacaaatgtgtatactatcgctatggtgggggagaaggggtgatcttgtgcttatatgtcgatgacatactgatctttgggaccagccttaatgtgattgaggaggtcaaagactatctgtccaagaattttgaaatgaaggatttgggagaggctgatgttattcttaacatcaaactacaaagaggagatgagggtgggattacacttgtgcaatcccactatgtggacaaggttttgagtcgctttggatataatgactgcaagccagctcctactccttatgatcccagcgtgctattaaggaaaaaccgaagaatagtaagggatcagctgagatactctcaaatcattggttcattgatgtacttggctagcgcaacgaggcctgacatctcatttgctgtaagcaagctgagccggtttgtctcaaatccgggagatgatcattggcaggctctggaaagagtaatgcgctatctaaagggcactatgagctatggaattcactataccgggtatccaaaagtactagaagggtatagtgactcaaactggatatctgatgctgatgagataaaagccacaagtggatatgtgttcacacttggaggtggcgctgtttcctggaagtcttgcaagcagaccatcttaacgaggtcaacaatggaagcagaacttacagcactagatactgcgacagttgaggccgagtggcttcgtgaactcctgatggatttgccggtggttgaaaaaccagtgccagctatcctaatgaactgcgataatcaaacagtgattattaaagtgaacagttcaaaggacaacatgaagtcatctagacacatcaagagaagactgaaatctgtcagaaagcagaaaaactccggagtgatagcattggactatgtccaaacggctagaaatatggcagatcagtttaccaaggggctaccacgtaatgtgatagacagtgcatcgagggaaatgggcttgatacccacctaaggttgcataatagtggaaacctgtccattatgatcggagatcccgtgaatttggatggtgaaacaaactattgtgtgactgagagaagagacccttgaaaagggctcattttcatgatgtgcttctcttctttcctgcatggtaggatggcttatgtcttaatgtgatccgagtggcttttccaagcagagatgttgacctgcagaacatcttagaaggaacacacctatatgagttcgactgctagtcacagtctatgagatttgggtgatctctagatactcatgaaaggcctggagtatgacttataagctccaacccgagggaatactaatggttgcctagtatcagttatggaattgagtgaaacctaactgcacaagactgacaattcaaagcatagtccattgttcagttgtggtcaggtgtagctccttttctaggtgaaagttcaacttaacagtcttcaccgaaacactagtatataaaagctgctatggaatagagagcattctcatgagccttaaaatttggtggggattgttaggtttaattgggtaattgatccatttaaatcaattaaatcaaataaattccaaggctcattatgctaggaattcatgtgaattcattcttttatgggatatcaatgggatgaagagttttgagaattaatccatttgattaaggaattggtaacttatatcaattagtcctaattgatggatggttgatggttgtgtagtggaggatggttcatggctagttgatgacaattagttgctctattcctcttcctattccattggtaacttacatcaattactcttaattgattgttggttgatggttgtgtagtggaggatggttcatggctagttgatgacaattagttgctccattcctcttcctattccatgactcttactcttcatcttccattcctcttataaaatgggaatggatttgatctcccgcgagataaagaagacacactttcatccattttcaaaagctgttgctgctacggtaatcccatcccgacgagtgtgtgcacacgcgttgggagagtaggcctccgaaaccacgcgttgctgcgacgtttgcacagacgggcgggcgatcaggtttttggggagcgcaaggcgcgactactcactgttcgtcaacatctacttcatcttcaccaacatgtcgaacactggagacaaggagaaggagactcccgtcaacaccaacggaggcaatactgcctcaaactccagcggaggaccattcttggggtataaccttattacattatttcaattagaagttttactgttaatgttcatcgcaatgtcaacattgtgtcattatgtgattgttgatgcttattcaacgttaagcatgctcatgttgattacattcaccactatcactggatcaaatcctattgtaaatatcatgtttattatcttgttattttggattaaaatatgccgaattatgaccaaatttccaacacaaccaatcctttcccctctcttcccatctcaatccacctccagctcggccaccaacgagatttccgatacatagtggcgttgaggcaactgggactctgggagctgcctcaccgtcaccccctcgtcaacgccaccgagtccgacgagattaccgacaacatagcggtgcggcgtccgtcgtgcaagcgtgtctagcccttgtgcccattgccggctgagctgtaggtggattgagatgggaagagagaggacagaagattgggctactgatatatgggtcccacatcaactcagctgtcacgccagcaaaagccagtagcaatactgccttgggatctaatgtgatctgattttgtaagattagtgatgcgttatatcagctattccggtgcagtgacgattttaaaactcgacgacgagatgagagaccccaactgaacttttcccaccagaattacgggctcatttggtttgataccaatttactaccctaccaaaattttggcaacttcaatagtagcaagtgaatatttggtttgctaccaaatttaacccaccatagttcaaattgaatactactaaatttggtagtgcaaaaatttgccaatgttttgcagccccatcgtttggcctaaacagctaaagaataagtcaaaatttgaatttttgaacttgattttgaagttgattttgaaatgcttttaacgtaatttttgttaatgttggcttttaagtcgctacgaacaaatctacaaaagttttacttataaattaattttaattttctaataagccaaataagccattttaggcaaaatggcaaccgatgggagccttggtactaccaagttttggtaggacaaaaattggctctaaaccaaacaaggcctacatgtgaaactcaccaaggatcccggtccgggctagcccaaaacatgcggcccagtagctttagttacctggtgggctaaggcgacttcgcgaaaaaaaatactgggctttactcattagaggctcggcccatgcttagagtaaggcctactcccactggcccacgacaaacactcatctctcccctcgcgactcatcgcgttggcggccgccggacctagctcgccgccggccgatttcgcagcggccaccgtcgccgccgccgcccatttcctcctcctccttccttccgccctgtgtacggttcctctggtattagcgttgcgccgccgtcgccgcctcctgcaccgacaacaacgccaaaccctatgtccctatctcctccgtcagtcgtcgagcgcgcgtcctccgccgattgccctcctcgccgtgaacagacgccgagacctcctgtgtgactgtgccctcaaacctacggtttccccccacagtggccttcaccgatcaattgatccctctccctcccgcacggtcgcacggaggaggtaattttttttttcctttaataggagtatctcgtgagactaatctcttggtggaactattaaattaggttgttttaattggcaagtgagcgtccaattatttttttgtcagcataaattgggggactgctagttgttcatacttcataccaagcaaatcctagagattagaatgtagactcatgattaacaatgccattcatttagatttcattaactacaatcaaatataatggatcccaaagtggctaccattagtatgtaagtaagagtctagtttagaacagacattgagctcctcctgtttcaccctacatatttagctatcaagtttattttataagtgaggtatatgaaattttttgtctaagctcaattctgttgtttaattttatttggacttgaggtcactagaatattttacttgttcgtgtaccatttgatatgagtcacccttcttacgtccgaaaaaatgagacgcctttctctttttcaggtatgtcccagcaatcagacacaccttcatgttcagatgattctgaagataacatcatcgacccagccagcatatacactatagaagaattcatttctgagcaaagcatcatggacaatttgcttgaacggatcactgtgaaaattcagtccaagattgaagctcagaaggctggtacatctcaccatccaaggggtgaacggaaatctttaaacaggaatcatgaagggggccatcaacgacttgtgaaagattacttctctcaagatccaatctatagtgataaacagtttcgtgcaaggtaccggatgagaaaacccatttttctgcgtatcgtccatgccttaggtgaatggtctccctatttcaccaacaggagagatgcctccagtcgtcaaggactctcacctttgcaaaaatgcacagcagccattcgtatattagcatgtggttcccttggtgatgccaatgaaaaatacgtagaaattggtaagagcacagagctagagtgtttggagcggtttgtggaaggggtgatcgacaattttggtgaagaatatttgcgaagccccactagtgaggatatgcaacatatactacaagtgaatgaggcacgggggttccctggcatgttaggaagtactggttgtatgcgttgggagtggaaaaattgcccagttaaatggaaacgtcaccttactcataccgatcatggtgctgctacgatgattcttgaagcggttgcttcacatgaccactggatatggcatgctttctttgctgtcattgggtccaacaatgagatgaaaattatcagtcaacaacagttgtttaccgaggtgttgaaaggccaagttactcaggtgcaattctctgtcaatgggaagcaatacaatacgggttactatcttgctgatggaacatacccagaaggcaatgtcttcattaaaacagtatccctccctcagagcgaaaaggatcgaatatttgcacggcatcaagaaggagcaaggaaggacgtccaagaagcatttcgacttctacagtctcgttttgccattgtgcgtggtccaactcgtttctttcaacaagagattcttgcaaaaatcatgcaagcctgcattatacttcacaacatgacaattgaggatgagaaagatatggccagcgcttgttttgacccagatgaaatttcagggacattggctgttattttatcagacatcaacactgtgcctgctgattcttttactgaagtgctacatagaaatgcttctgtttgtgctccaccgaaacatacacgacttagaagggacttaatggagcatatttggcagcgatttggtccatttggcaaccagtaaaacaattaatcctagtgtggtaatattagacttataactttgtttaattttttgttataactttgtttaattttttgttataacttataatcctgcaatattagacttataactttgtttaattttttggtacatttggctttgtttctaattatctgtaataaatatttgagtattgccgtccagtgacatttaaattatactccattattaaatgtattatgaaatctttcgagattgttcatcctcaaccatggatgttcaggtttgattagtttgtttacacaaaatgtatttcaggtttggatttttttttttttttgaagaaaactaaaatgaattatttacctcatttatttctgtttacacaattttgacctagatgtaagccaaataattagagaaaaattccaggaaaagtcagtgaaggtcaaggctatctggctttaactaccaccaaacagctgtcagcataaattgctacattttcagaaagacattttaaagttgctcccaacaaatcctaggttttcaacagaaggtgagctaacactgtgcatagtatgctctactatttcatatgaagttatggtgttctgcggaagttgtagtttcttataagttctaacggctatttcttttgttgatttattcagtcctcaatctagactggaagttgctaatttgttaaagttagctcttcgatacagctccctgcagtgagttgatcatggtcatcttttttctgtaagtggaaaaaataacgacattacaatttcagcatttatgagtgttgagtttttctaaaggtcctcacatgttctttcagaatttcaacatttagacatatctcatagctagagcaattgaacaatctcatagtctgttatactgactactgaggttgtgttttattcattttcagatatattaccagggagtgcttaggcaggcttttcgtatgcaccttttgaagtactgtaggccaacaagttggaatttttcagcagaattttattgtgcataacagcaatctcaagcaggagttccattggattacctggggactggggtagtagatttccaacataataactagtgatgtgcttctactgtttcttttgtctaagataccaactatggatacgttggttattttgtaaaaatagcatttggacttcaggagcatattactcggtactatgaattatgatgacacttgcagagtttcagtccatatcgcgaccatgattgacgccttcaagggtgcgaaaccgtcctgttttgtgtgaacttctccaagtttaatatggctttgtgcccacatacctgatttgattggtcctaaaagaggatgctagatcagatttaacatttttaatcgcattcctatactcataattctgtagtctggaagcgggaggaccgcacatgccagcctcagagtctactaaatgaattgatcttttttttttcaatagcaatgtaaaccaactaagactatccatgggtctgccaagtcccatggttgaaactacggtatatctcgcgataaccgcacggttagcagtaaccgccaaaccgtcgggtggcggtaaccccagccccgccacctcaaacagtttggtaaaccctagccatggtaggggtaacttccagtatggtttgaggaaatttgtttgaattgaaatttataaaaaaataatgaaaaaattaaaacggggacactattttccctcatgggccggcggcctaggtcatactgggccgtctggattaatgggcccgagggtagtatgtttgcttgctcccccacccctcccatataaagcaagtagggttcccgtctcgctcgcctcctcgatcgtcttctccacctgcgccgccgcagcctcctcaactcaactctcttcggcagcgagcagcagcgccttccaccatggtgagttcttctcctctcctctcttccccgcggcgatggctacgcctgggctagcggcggatgcgcggtgcggtgcgattgaccccgttgttgttttggtttgtgttgttgctaccttggcaacgcagccgaagcagatccacgagatcaaggacttcctcctgacggcgaggaggaaggacgcgaggtcggtgcggatcaagaggaccaaggacgccgtcaagttcaaggtgcgctgctccaagtacctctacaccctctgcgtcttcgacgccgacaaggccaacaagctcaagcagtcgcttcccccgggtccgtattccgttatccactgcctgtgtattctcttcctttcatttttattgatgctgttcttaagtaaggaaacgtccgctgctgtgtgcgaaatcacgtgttttgttggaacgaatcgttaaatcctttcatgctttaggatttaaaaagaatgtggtatggaatggttatgcatgttctttgtgaatttagtttggtctagcatgctaatcaggtggagctgttgataaattggccttccatttagtctggaaattgcattgtgtgcaatgatacccaattagtgcctcccaagatagtcatggaaatcttactgtaggatatgtgcaagtctggaacttctcctgggatgagattgcgcagttgcaatcatcttcctctttgtatagcttttaattgtcatttccatgtattgatgtcagtataaatgtcaaggcgcataagtaacttgcctatctcagagccatagatatgacaattttttggcagagcagaaaatatcatttacctcgtctttggaaaaccagcaaaagtaattacagcactgggcatacctgttctatttcagatcaaatatgctacaaaacaacctactaatcaagtacatcatacttgtctatctggtccagcagacaaagccagcaccaactaaggttttgtatatttttcaaaaaaatgatgcagcctacaagaccagctaatttcatgccttccagatatccttggaccataagctgttcatccagaaattatacacgttttgcactatgtatctatgcattactgttctgctgttcattcagtacaaaatttctttttgttcaattgatcatcattgctaactcaatgattgtgaatttctttcttcaggtttgactgtccaggaggtttaagcatcaaagccagaccatgctgtttgtagcagcaggattgcttgctcccgttcgcattagtagctattagatgctgaaattttatctgtcttgagttttgaatgtaacacccaaagtttatgtgctgaaccttcttcgagtcagattgcgctgttactcctttctggagatagctaccagtcgtactgtccctaaacacactgaattttgctccatttctctctaattgctggagtgtttcatatttgttctggagtgtttcgtatttgttttgaaccctggattgttgcctctgagattgtgttgacacatccacacgtgagagcatgaacacagtgacacgtgagagaggaagaacgatttttgtggtattgctggaatcttttcggcttgcaggttcttaatatctcgattcttcagttggaatatctgctgcttggtaggtcagttacagaaatcgtggtgtgacgatgaggaaagccatctgtgggctatcctatgtgtgcagtacttaacaaccgtgcagaacttgcgttcagattgtatttgcggcaagattgtcacttcgacaaaattttgtagaaccaatttgtccttcagttttggttcatgtgctattcatttcaacttctatgaaatatgagcaaccaagaccttgaccagcatacccataattcatctatttcaaccattggttacattgctttataattttagtcggtagcgctttattgacgaagttgagtcttgaagaacctatcaaactaccaaactgagtttaaaatggtctttaagattaaaatttatcatggactgttgattttttaaaagtaaatttaaggttgtactgtccctaaatatttttctcttacattttttttggcaattatattgttattactgattaatctccaccgtccgatccttatcatccccttcccggctacctccatcatccccttcgccagtcgctcgcttctactcccgcctcgccttctctccgccccgctccgctcgccggcgagccgccgccgccgccccagccccacaccctcgtcggcgcgtcgcctaccggtggccatcttcgcccactcccgctccatgtcctgtagccgaagtgcggcaatgattgactgcccgcggctgctcctggcggccgcgcgcgcctctccgtaccccagctccgccgctcaccggagggtctgcaccgccggagtccctcccgtacccgtatattgccgtgtcagccaccgccgcaggtcctccgttcctggtgagcttcggttcttactttccttgtactcgtgcaagtattgcaggttttttttcctttttttttttttgcgattaaactactcgtaccatacttgatgttagctatggagtactatgcataatgcaagaatttcttgttttgcattgtgtgcgaactcgacaattggaagagatgctagcttgaatagggaaaaaatggtttcattttatgctttagttatcttatcctctggatgaaacattgacagacttgggtcaacacagtgcaatctgcatcctctgggtcaggaagccaatcaagcgttgcagaaagttcggaggctaccgaatgggccatgcagggtaaccaatttccccaccacattctcaaatcaggatagcagattgtgtttctttcagcccatgagaccatgaatgccagggttttgatccttatgcttagaagttggtgacagatttctacgctttgcggaaggatgtcgagctggctgtagcgcgcgtcagtgaagtcaggcagtctgctggtttggatcagcttgaggaggaaatcgcttcgctcgagaagaaatctgcagatagttccttgtgggatgatccttccaaggcacaggagatacttgttgctctgacagaggtcaaagacagagtcaagcttctcaacgatttgaagttgcaggtttaaccaacttgatattcttcttcatcccatactagagatgatacagaatgatgtagaattctaattgttattatactatagctatatatattgaaatgattgtttaacacctcctgtagtaaattagtaattctcattattataatgtggatttgccgcgttcataaatacaagtaatgataactaataaaaatatgtaccccctccgtcccaaaaagaaaccaatctaggtggggatttaataccactgtccatatttgttgtcctaggtggtgtgtaatcctcacctaggttttttttttttttttggggacggagggagtacagatttgctgcatatatccatactacagctgagaattgacagaggctatccattttggttgaagaacatgacttctggaattaattggttaccaacactagttcttaattgtgtcctttccattgttatttacaggttgaagaagctgagaccattgtaaagcttactgaggagttagattccatagatactggccttcttgaagaagcctcaaagatcataaaggcattaaacaaagcactagataactttgagatgacacagcttctttctggaccttatgacaaggaaggtgctgtgattaatattactgcaggtgctggtggcaccgatgcccaggtatgctttcactaattctcatgcttccttcttagctcacaatgtaggaaagatgatttttgtcttagttttctaggatcttatgacttgttcatttagtcttgttgtgcttgtagaaaatttagcttttattattgtcgatattatacttctagtaccaaatatgtaccactgtcataactttttcatacatgtcctatttctatctgttactgtaaaagacgacctaacatcagctagaaaactagtgcaaatgtgaatgtatgatatgataatgaccttcttgatgattattaatccatagtgtacataactggatttccaggtgtcaggatttaacgcaaactttatatatgtagtagtatatgtaattctaaagatgtgcagttcaacttacatgagtttatctcatataagaatggcgatagatgatgtttcgtgtttttctggagaaaaaacatattgtagaagagcaagttgtgattataatttttttaatggcttatatttgtaggattgggctgacatgttactgaggatgtatgttaggtggggagagaagcagcggtacaagacaagagtggttgagaaatcccctggtgaagaagctggaataaaatcagctaccattgaattagaaggaagatatgcctatgggtatctctctggggagaaagggacacacagaattgttcgtcagtccccattcaatgctaaagggcttaggcaggtatgtgtagtttttcagttcctcttttgcgattcatatacatattctcgcaactttgaaaggaaaagacatctactcatgctcagttttctgttcaatgtgctaatttctttagacaagctttgctggtgttgaagtaatgcctctactgccagaagagtccatggatgtagaaatacccgaagaggatctggagataagcttcactagagcaggcggcaaaggaggccagaatgtgaacaaggtggagacggctgttcgcatggtccatatacccacgggcatcgctgttcgttgcacaggtttgtactcaaagacagtcagtgcagcttgcatgatgtgtcatatcttcgttagggctgtggatctgaatatctgctaattcttggctctatgccttcacatatgttgcataaataggtagttttgtcatgtttgggtaagacccccaatcttagtttgatatgatgtggtcatcaaaagacccaaaaaagaaaaagtgaaattggtaatcgttgaagtaaagtaaagaactgagcaagacatcctccaaatgattgaagcctcataatccctcgttgtgaccatagttaaatgtgcagctaaattcagttttatcacataaacaccatgacttaactgtgtacctgagaatttgccattgaaatgtatttgcaattttgcatcaagaactgtagctacatgagtaattttccacatcttttccttgcgaaacctcgcagaggagaggagccagttggccaacaagataaaggccctgagccggctgaaggcgaagctgctggtgatcgccgaggagcagcgggcgtcggagatcaagcagatccgcggcgacgcggtgaaggcggagtgggggcagcagatccgcaactacgtcttccacccctacaagctcgtcaaggacgtccgcaccgcctgcgagacgtcggacatcaccggcgtcatggacggcgagctggacaccttcatcagagcctacctcaagtacaagctctctgccgctgctgaggagcaaagcgtcaagtgacagatttgcatccagtgtccgatgcaacaaccgtgcttgtgctataggcgcagaattttgatgcagagcaagaaccccatcacgtagtaagcttgtaagaatagcctgaaattaaccgtgcagaattcggtttgcttggctctactaagcacccaaattttattttggggcttcatgtattagtggatatattaatttcatttctacccaatatatataagcctctcacctgcctgacgctctcatgccatttctcattgcaaacctagagtcaggctagcggtccatgctcaaaaaggttactctacagattgaatgctttggaaccatttgaacttctctctctctctctctttctctctctctctctctctcatgcataaatctctctctctctctcttatgcataaaggccgagcttagttccaaactttttcttcaaacttctaacttttccatcacatcaaaacttttctacatacacaattacacaaacttccaacttttctatcacatcgtttcaatttcaaccaaacttctaattttggcgtgaactaaacacacccaagctacaatcagttcaatttgctcaaaacatgtgcgaacagatcatacgttgttcaaaaacgctctctcaattccctaagagcaagtttaatagcatagcctactacttgctccaattcatctatagccaattttatagccaattcatacaatagttgcttactatattattaatacatggtcccacttgtcatacacacattgcgtcttggagtccgtgctgtagctggctacatatttgtagcccactgctcttctctctcatcttttatctcattaaaatatgtttatagctggctaatagtctgctattgtacttgctctaacacgcatccaatccgcattcccaatccgtttggtggacggaggacggcggtggcggcctccgcagatgggactacctatacatttgtcaacaaattttttcccaaaaatttaacagatgtaattatagtacaatcatggtgtaattacactgtaacttatatgtaattacactgtaaattgcatgtaactacagtgtaacttatatgtaagtttcacataattttgaatcattagatctattacaagatttgttttggtgaggaagaaaacacatcatagcacacacatatgtgaaagaattttttcccacgacctccattttaccgaaataacatgttacggagagatttttgaaagttacatacaagttacactatagttacagtgtaattacactacgattgtagtgtaattacatctgtcaaatttctggggaaaaatttgtcgacaaatatatagcaaaatcgccgcagattaatgttaatgggccgggaccttttgggctcatcaggcttcattggacaaatctggcccatttaggtaatcgtgttatagcccacgttttcatgactgggctggaatctcgaggcatgggccacggcccgctttgttgaacagacaaattcaggacagggcttcgttttgacttttgagtgtgtgtaaaatagggatggaaatggtggaaagaaaattctcgactgatcgagtatcgatttttaaatacttttctctaaattatgtcaacatcatattagagtcgtcactaaatagttaaattcatagatatgaaaacttctcgaatcctgaccaaccaataaccgtttccgtaggaatatatcatttccactctttggaaaaattgtagacactagttgtttaagtgaaaaaaaaagatccttccgagataccgtacatcccaaggtgttttttcttccttttttaaaaaaaattcccaaggtgtattgttatagtagcagtgcatccagctaaagaaaaacaaaacattgaatcaaccttattatttacatagtgcatctctgattgtgcagtgaagattctgcagacatgctgcccatgtagcaagacaaacaggagtagtagtgtttttgcccataacgcacacagcaacggctggttaataattttaaaaaaaactgcgagattccattccaaaacctgaccagtttactcccctcttaaacaaatcatggtggtggtgcatgctttgagctgctgcaaccgtttgacttgatgagcagccaggacaagtgtggtgtttgctccagatcagacacatccatcagacagcaaggacagcaagtaccactattacttcttaactcgtctgctcctgcaagattagtactcctattagatctaaccctctggattagtttaggctttaacccgaccaatgtacttaactacacggtgcagccacactgtagcttagctaccatccagtgatggagagatcaggaatcccactgacagtccatgcctccccgagcacgaattccgaggcgtctctagacacggatgggccagcgtttacgtcacctgcaatttgtgagaatctcaaagccaccactactccttctgtggaccaatgcttcagcaattcagcactgtattggtttactgctactactacctgtctggtgtgtgtgcccatgcctattgccctcttgcctttctgctgctcctgcttcagaagagttcagaacccaaggcaagcaatgcaaggcaaaggtaccaatgttttgttactaattactgtagtattactccttgttattaaccagggtagctgcagtagttagttaattgtagttgatgacttcccaagcaatattggtctctctttgggtctctcaaaaacatgtagtaaaccctagctagcccctaggatgctctccttgactagtgtggatgcttcctataagcatggccttggtttaggagtagaacagcactactgtcagtggagtagtagtcacttgcaagttaggttatgtgaccaaaccgttgttttcttgctgtgttttccttgggagtaatgcagctgaaagcctgaaagcctgtgaaacctattggcatttcaaaatgggaaccttccatactctcacactggttctacttgtagcttagcactaatcaaatactgacatgatgcttaattatctagtgtgtaattgcctgttcaatatatatacacaagttggcacatcagaaaattcagaagttgcttcttcgcatgttgcctactgctaccagcagcagcaggcgtatgggttaactgtcaacatgatgcatgcatcttcaatagactattaatacttgagttgcctgaaaaaacagattagttaattaagtaacagcgatatacagcgagaacaatcagcaggcaccaacatctgaactctgaagaaattaattggagaacatgcttgtaaccaaaagaaaaaatacagcatgtagacatgtagtagtgacctcttcatcttgatctgtacagtactgacgacttctgattaacttaatcgaagaacccaatacgccactgaagtcgtgcaagctttagctttgggccgacttatgaaaaactaattaactaacaaacaagaaacctttgcgtggtgcttatccccacacatgacaaacatgagtgtgttcgaaggaatcataatcttaattgcatcactcgagctacttgcttaacatctctgatccttatctccatctggacaaatattaattatttccagctaattaattgatctgctattttttttctaattaagcacagagatgaagcctccacgatatctgcgttttgctcttggattttgcagcgtggttaagccgacgagaggagtacaatctaagcgattactccctccatcctataatataaaggattttgagtttttacttgtattgtttgaccattcgtcttattaaaaaaatttaaaaatattatttattttttttacttactttattatccaaaatactctaaatacaacttttcgttttttatatttgcacaaatcttttgaataaaacgagtagtcaaatagtgtaagaaaaaaactcaaaatcccttatattataagatggagggagtatttccttagaatcttagcctcctgcatgccttttgcacgtgcttccgtagtcccgtgtgcttgcattgccaaggcttaaactaatgcggtcaaagctcacaaatgactcaaccgagcttagtttgcttaggtgacaacacaacaaatgaacaaaatgtctttgaaacttaagtgcattgacttaaaaaaaaacacggtaattatgtccttgctccatggatttaaaaaaagaggaagagctgagaacgaacaaaactaaaggacatgttgctttgaactgcgtgctgatgaattagatttcaggcagggtacggtgcatggctagcaatatggaaatgatcatgagtgtgttttcttttttgcttagtaagatctggcccatgcaattaaaggaccattcacaaaccaaagatatataggtaggagtacatatagtagaatatatgggtccttagtggaaaaagcatgatgttgtcatcctcataatcccctttagcaatcatagagttttgatggtctcccatgtatggccagatggaagagaagctagctagctaaacctggtagccaaaggcaacatgcatttcgcccccaccaaaacgcaccttttattaaaaaaagggttttgatttggatgtgtgtatatgagtatatcatgttcctttttttttcccattgagctagctttatcctcctctgtaaagatccaaaatgagaaactaccgttaatatgttaccaaatgcaattgcatatatagttttggatgcgtctaccaatgcaatcacgtacaagagcaatgagcaataaagggcatcggcatcttttcaccatgatgctaattaatatgtgagaatttctacaaattacactatttagttgaatgcaccaactagttcatgtttaaaaaattaagctgatgaaaaaaaaaacaattgcattgacactacatcaggcctgtttagttcccaaacaaaaatttttcaccctgtcacatcgaatgtttggacacatgcataaagtattaaatatgaaaaaaaaaactaattacacagattgcgtataaattacgagacgaatcttttaagcctaattacaccatcatttgataatgttgtgctacagtaaacatttgctaatgacggattaattatgcttaataaattcgcagtttttaggtagaatctgtaatttgttttgttattaaacaacatttaatactttaaatgtgtgtccgtatatttaatgtggcaagttaaaaaatttcgttcacgaactaaaccgggcctaaatgtcaccttttttttttgtcgacgtcgcatgttgatttttgaagcatgggtgatcttgagatcagatattctgctcagtcgctccatcaatcaatctatcaatcaatgtaaaacactaaccatgaataggcataatcagtcttgcacccccccccccccccctattgtcgttgatatccttggctcagatagacttcatgatcagagcagctagctagtaagagcagctacgatagcaggctataagccagctataaatatattttaaagagataaaagaagagagaagagtagcgggttacagatctatagtcagctatagcaagggctccaagacataatatgtgtatgacaggtgggaccaggtattgatagtatagaaagtatctattgtatgaattagctattacattggctatagatgatttggagctagtagtggctatattattaaacttgctctaaaccaccgtatccttacttaatttaacactcgtagacctcccggttatattagcttcgttgtcactcacaacccccctatacctctacaactccgtatcatctatctgtctgattaatatgagcgcgctataattaaagctgtgtttaaatctaaagtttggattcaaacttcaattcttttccatcacatgaatatatcatacacacacaattttttagtcacatcatctctaattttaactaaaatttaaactttacgctgaactaaacacagccttgtactgtcaatcagcgtttgtcttcagcagatggacacttcttcagaatgcttgactcctctggcgccagccttgctcccgggtcacacgaatgcttgacattattggcgagaaaaaaagggaaaaaaaccggatgccgaccgctctacagagtattttaacagggcgtaggctgacatctcatctcatcgtaactgacgaggatcgtgagcatgaacaggtcgacacacagtacatccgtcggctgaagtacctgcatggcctttgccgtgcattaatggcagaaattctcatgcgtctgcaccgctacatgctgcacgtacatgcacggcaacttccttctgctgctgcggtgctgctaaacgatgcacgaacagtgccgcttagctaagctggattttcaaaatatattttagctctttttcaaaaacttattccatacataaatctttagaaaaacttatcgaaggaatccactctttttctcggtgccaaggttcaatatctcggtgccaatgacacggacaccaacaccctcgtatcccgtgatagttaagtcgctgacatcaagaaaatcggcgtaaaaaaactaaacgctaaagatttgtaaaatatcttttttagaaaaagaattaaaattataactattgtactttttttttcttataaatcggtgccatcctgatttgaaccactatgcgacgagaatgtgtggtggagttaatgcgcgcctcatcgtcatcgtccggcgcagcatccgctgggcgcccggcggccgccgacttcttgcattcagtcggtcaccggctgaggccacgcacgtcgcactactgtttccacgcctgcctgaatacctgatgatgatgcgcacgccgatggggaggcagaatcggaggagaagtacaaccagatcacctgggcatcgcggtaccgtacgtatatgtacgttccccggccaccggccagaacaccggcgactgcagggtgcactcatcagtcatcaaaaatcaaaatggatcgacgcaccaattaaacacgtaccgatcgagcagagatcccacatgaagttgtcctgtacgtataattgtgtctgtttatttactagtgtcgaaaaaatagagtcaatataaaaatagctgaaatttaaaattttaaaaaaaatattgaaagaagaggcaatagtccatataaaaatttagtaaaagttagaatatttttttaaaaaagctaaaagtagagcttagagtacaaatagaaatacaattaagaaagaactaaaatttaaaaaaaaagattgacacgagagtctagagtacctattggaatataatttagaaataattggaattcaaaattaaacgataagaaatattgaaagaagagggtagagttcatatagaaatacaatttgcaaataacagaaattcgaaattaaaaaacaaaaaatattagaagagtagtctagagtccgtacagatacgatttagaaataactaaaattcagagtttaaaaataaacaatattaaaataaaggtttagagtctatataggaataaaatctattatattattaaaagaatagaaaaaggagcctccacgttttcgctctcatggcctagaaattctcacattactcggagaaaaagaaaaagcagagtccatatagaaatacaatttagaaatagctgaaattcggaattaaaaaataaggaatattagaagaggagactagagtccatatagaaatacaattaggaaataactgaaattcggaattaaaaaataaggagtattagaagaggagactagagtccatatagaaatacaattaggaaataactgaaattcggaattaaaaataagaatattagaagtagagtatggagtccaggttagaaatacaattaggaagtaatagaaatttggaattaaaaataagtaatattagaagtagaatatagagtccatatagaaatacaattaagaaaaaaaattagaaattcagaattaaaaaacaaggaatattagaagtagagtataaagtccatataggaatttaaaactaattaaaatttggaataaacataataaaattaaaagtagagtttagagtccatataaaaatacaatttacaaataaataaaattcgaaattaagaaaaacatgggaggaagagtttaaagtcaatataggaatacaatttagaagtaactgaaattcgaaattaaaaattaaagaatattgaaagatgagtttagagtccacatagaaatacaattagaaataataaaaattcagaaataaaaataaataatattggaagaagagtatagagtctatatagaaatataatttacaaaaaaactcggaattaaaaaaaaagaaatattaaaagacgagtctagagtccatataggaatatttataatttacaaagaactaaaatttggtattaaaaataattaataactaacacgtatataaaatacaatatgaatattacacattagtagttttataaagttattgcaaaatttaaaattatgttgtcattttaatatatttgaataatataatgagaaaacaaatatgctattatatgagagaaaatataatgatgctagccgcacaatttgcgtgggacaccatgctagtttataaataaaggaactttgaaatttaaaaataaggaatattagagaactttaaaatttaaaaaaaatattggaagagaagtctagagtccatatagaaatacaatttagaaataactaaaattcagaattaaaaataattataaccatcacgtatatacaatacaatatgaatattacttattggttagtttggtcaagttcatgtagaatttaaattatgtttccattttaatatatttttataataaaatgtgaaaaatatatatgttattatataagaaaaaaagatactagccgcgtaatctacgccggccaccataaagttaaagtaatatatatggggctgaggggagggagaaatcttaaaaatcagtattaattccatactgtttcgttataaaaacggacgaatcatatatacatgtctagggtggatggagaggccgatagtcatttggttccactgaagaaaatgaagctattgtgttaggagcggattatacatcacgccttgattaagcatagtagtagtaataattaagtagcggcaagtacggccaactgctgtcggcgccggcgcgtgatgagggatcgatggatgacccgtccgtgtacaagccgttcgacgtacacatccggcgtaattaccttagctaaacatcttgaccaaccacgtaatcactagcttttccctaccacagaaaaaaaaactcataatcctgattgtacgatctaccgatttaattacatctgcaatcaaacagaacatggataaatgaccaaataatgagtacatttatatatgatctctattggtgttagtaggagtattttactactcgtattattatcaatcaaagatatctaggcggtttatttatgagttatattgatatgatccactagactagctagaaaagatgaacaatttgaatcgatttctactatccataaactccattgaatatctagaaaaataaatcatttggggagataaagattcgccatgtctgttgctgaagagcaagaaaaaggtccactcatgaacatgaagaaaccattggccgtagaccacaccgagctggccatggacccatggtggtaatgtgccggtgtacgtggccgtagtccacagtgaacttggtccatggcaccatgcagttttttttttttggcagggacggtgtgtgctgtaaagatcacccagccttttttgaccatttgagtatggtgatgacctgtgtaagatttgtatgggaaaaggtggtttgtcatggctaggtgatgagcatctttggcccctctcctctcctctgccaccctgccaaatcctactgcatctttgattcatccatctgtgactgtgtgtgactctctctctctctgtgtacagcaccaggagatgtttcttcttagataatgataaaaactggggacaatccactcataaattaaccaacagggacagtactgctatacagttcgggcaaggacatgctttgtgttttatttccatggaaggacacgtaaaaccatgtgcaattaactcgtgttaattactaacccatatgggttaaggacgcttctttggtgtgaagatcataaatggccaggtcatgtcatgtgccgttgtgtttcttttttttttttcagaagttggatttggattttaaacctgtggtgagcaaaaaggaaatggaaagtttttgtcaggcgcaccgaagcacaaaggttggcatagaatctctctgagctttggactggctatctctctggtgtagtaagatcaacagcatcatgtagtaattggaagcatggcacgatcaggacaagcatgtgggaggaagtaataaattactaatgctagtaatatattccctaatttatttggggttagacactgtatactcctcctttaacccttgttttattgtctcaaagagcatccaaaaagctcatcaagggggaaaaagttcctaagcctagaaagtgactcaaatgcccatgttcttttaccactaagctagtagccatatcagcgctgtcagagctgtccttgctttctaaacactgtaacagcatatttaccgagttgattaatctgcagattacaagtcaactgttcccctgaaccttggctgccatgatgtcattgtgcctttactgatcatgctttacactgcacgtctggtggctaaacaagcatcttaagcaaggacacaaacagaggactttgtttattgctatggcttaatctttctaggtcttgtgtgacctctgagaatctatcttgcacgataaggtcatagcataataataataattagtccaccataaacaattttaagcatctggaatagtacttgccaaattgtgttatgaagaagaagttgtggtattatagacttttagttaatctatattcacaatctatatgcattgccatgttcttcagagttcagacactcccaattttcacagctactagctcttctctccagtgaccaagaactgatgcatcatcataatacacatatggaaaaaaattgagaaaaaaaatgaagagaaaaaaaaggggcaagaatgcagggatgaaagaaccacatctctgcatttgctgctactcctatgtacaatcagtatgaaacgagcttcaagaacacatccggggaagtgatcttgaagcagcgcggcggccggcggcggcgccgccgccgcctccggtggctctcctcgccgccttcatcttgctcatctgcgtcttcatccggctgcacaccttctcgagctccatcacccgccagtgcatcccgtcgaggagcgacctgagattctggctctccagcgacaggtcgagcctcccggcgtacaggacgacctggccgccggcggcgacgaggtcgtcgtggtcctcgccgccggcgcggtgcttcgccgcggacaccggcctcaggtgttcgtccgggccgccgccgcggaggaggctcttgagcaccgtgtgctgcgacgccagcgcctgcaccgccgccctcgtcgggaatccggcgttccgggcgaggtgcttgcagcactccggcgagagcttctcgtagtttatccccttgcagatcctcatcttctcctcctccgtcagccgcgtgtgaacctgccatgatcgaccaaaacaaaacccattagctttcagctagtagagcaattaattaggaaaaaaactcaagctaatttagcatcttaatcagcaggattaacagcactgacagtgacaaaagtgccaaaatcttaagcgtccaggacaatgaccaactttttttttttcttgagacaactcgatcgtttcaggcttcagagaacattcagaagccgatgatgcataggattcagaggaggtaggagtagcaataaaacgcactagtagcaattaatgcgagggtgagtctgtgaaatgctgacaaaatcaagaacagtgctcgctgtcgaggctaggcggcaccaaagatctgagtaatttacctggaagtagacgtcgatggcgcggtaaagcgcgtcgtggcagtccctcgccgcggcgggcagcgccgtggcgagctcgacgaacatggccgggcgcagcgacgggtccggggcgacctcggcgaggtacaggtcgacgagcttgcccaccttcttcagcctcggcgtctcgccgcgcgcgccggtggcggcggcgtggtggaggaaggcgtccaggaagcggaggacgagggtgacgtcgtacaggctgctcgtcgtcccgggcggcgccgggacgagcaggttgtcgagcgtcgcgtggtcgagcttggcgccgatcatggcgacgaggctgtcgtggcaggaggtggggagcttgagcggtgaggagatgcggaggatgccgaagaggcccctgcaggagaccgagctccggtcgaggccggacatggcggcgatcgccgcctcgagcatcgccctcttgtcgtcggcggtggcggcgccggcgacgcggcacttgaggtagtagaagaggaaccgggagacgacgccgtggtcggtgcccctggcgaggagcgccccggggacgcgctccaccatgccggggccgaggacgacggcgaggtcctcgaaccaccaggtgcggctggtgcaccgcgcgctgaggcagctgctcttggtgtcgcacgagaaccggaacgccgagctctccggcgaggagctcgtcggggtggcgtccccgggggagacggccacgtgggacaccagcgcgccgacgacccggtcgaacacccccgtggcgtccgccgtcggcagcagccgctggcactgcctcacggcgtccaccacgctctgccacgaccactgcggcatctcgtcgagagccttctccgtcatcttcaccaggctcggcggtgtcgacacctccgccgccgccgccgccatgtccatgaactcagccgcgcaccgcagcgcgcacgcgttcgacgcggtcaccgcgacgccgccgccgccgccgccggtgtaacagaacctcgcgacgagctcgaatgcctcagcaccgccagggaacccacgcaacacgaccctcgccgccgccgcagctccgaccaccccctcgccgccggcgccgccgccacccaaattcttgatcctaccacagaacggtgcaagaacctcctgccaaaattcaccaaaaccacgaaaacaaaacacaattcaggacaaagaaaccaaacaatttactcgtacaagaatcaaagaacacaccagcctaatctaacccatccaattgactcccaaaatcaatgcgaaacgtcagaaggaacatgcggtttatgctcttaaatgaggaggtaagctggtggccattgccatgcagcccaccaaacgccattaaaggcctcgcactcactgacagaggcgaagcagatgagctgtagctattaggccattaactccggggaagaagaggaagaggaagaagaagaggaaattggaatggaacattattttactcgcctaattgctgcgagctctcgccattggaggaaggagatgaaccaaaacgaacaagaaaccgtagcagcagcagcagcaacactcacactagtactcctgcgccattaaggaggaagaagaagaagagatcaagaatggctaggcttggcgagctggctgctcattgatggcgatggcgaaatggaacccacaccgcacttaaatggaagatcgcgacgtcttcctcctcatctaatctctgaactcgcagtaaaaaatgtagaaaaaaaatattcagaagcagctgggggtattaacagcagaattacagggagaaattcagattaaccgatgcaattaaggcgatgatgatgaggattcaattccaacagcgtgtgtacaacctgacaggcttgcattcgcacgaacctgtcccactcccacaggagagacaggctacagctcaagaacaaaattacagcaagaacaagcgatgaggcgacagacaatgcgagcattttatagaccaagaagaagcaaatcgtaactacgaattcgaggttggtacatgaaacaagcaggatgtgacaagccgcacgaaatccaaaatccgacgactagggatcaaggagagaacagcacaaggggataaaagcaaagaatggaagagaccaaaattgggaaggagatcgcgaggtaatgccaaaaaaatttggggactacctgaaacagttttggacagaggaaacaacaaatgctaggaattgaaacaggctcaattccagcaggatgtgacacacttcctcactcatccccaagaacttggtggtgaaacactagagaccagaagctagagtacagaacaataatccccagacgacagaggcaagctgtcaacctaagaaaggaaaaaccaacaacaagaacatcaccatcgtcaccaattcatcatcttaggatgagaagcagcagaacagagcaagaaaagaagagaccttaggaagaactgcaagaagaagatttgttgctaccaagaaggaagaagaactgcaagaagggaaaggaaaggaggaagaaccttatcaacgaggaagacctcttcaccatccacatcaacctcaagaacacagcccatcgtcctctttttgttgccacacaccacagcagcacaccacaaaacaaccagctttaaagcaacatggcaaagaagaaggaaaaggctgcaatgatggggatggaagcagtaacacacacaaagggatagatggatggcaccacccccaaccccaaacctcctcactcacagagagaaaagcccaagcttccaaatggctaaatgctcaacaatggcagctgctctggctctgatgagtggtcaatggcttgcaatgtgagagagagagagatggaggagaggggccagccaaagaagttggtggatcctgagctctactgacagcctctgccaccctgcaagtggagagtttgcagggagagagctttggggaatatgtaaggctgggttcttgatttctccctgccctttacccaccttgcacattgcatatttgtgcaatgtgcctgggtactattcacagtcaagaaatgggcaacagaagaggggaattttcttttcttataggggaggtgtaggttttgtgtagagacagaaaaaaaaaatgcttcgcttgtgctgagcatctgagttggtcatttccatgtgacactcggatacctgattctctgatgtgagataatctttgcatcaactggggcaaatctatatgtttcgcgtgaagaaacagtgcactcattctgttgccctggatgaatttgcaccgagtattcataaaattattatttttagactggtcaccggaggagctttccaacctgaatttcggccctgtttagatccgccagttttgccattttgaagcactttttaccattttgaatctaaacactaataacaaaacttgacaatttgacatttgctagtccatagtggtaaattgtgccaaaaagtgctttgggaccactccctctctctttctctctctcactttagtgctagaatggcaaaagtttaggaaacatctaaacaccaactagtaattttgtaataccaaaacttttaccatttaccatttgtcattccaaatggatctaaataggcccttcattaaaaggagaaacagtacaatggtttagttcgttacattggaatgcaaaaggaggaaagaatttctttccaggattctactactatcatgatgtttttccagtatttataaaattataaacacaatatatggtctcctgatgttttttttagaaaaaaaaacacaaaaagactagatcaacatatcttaaaatttataaaatcatcacagatgtctcgttattgataagtatgatacgtaccaaaaaaaaaataattaatatcatcataagaatcctatatccgtttaaccgttaagttacgcttatttcacggtctcttgatgttttgacatttctttaggagcaaataattgtttacaaacggataataaatgtttgttttcagctttacaagactgacggaatgacacgccttaagacggcattttgatatgtaaatgaaaagaactactactccagtatcatatagtcggccggtttggtgtgcaaactactactactactcgtcaagatgccctttgtaggatcaaatcattatgtcatgtggttgttaagctaggcttcatgcaccgatttgcatgaatggataagagagatttttgttggatcaaatcctcgtataaattaagctagctttcttgccaagattcgcatgaaaggagcaggggagatcttttataggatcaaatcctcgtataaattaagcaaggtttcttgccaagattcgtaaagtatgaaatgaggaagaatggaactttatgcccggaattttgggaccatttatttagcgcttcatttgaatattcaattatttattagtcacttttttttaactcatccattcaccgcactttaatttcggtaggggggaacaaataatgttttaacttcgagtacacaatgtacactttgcttaatccgcaccacatggaatacaatttctaatttgggaaaacactacagtataatacaccattttttcaacaggatgtctataatatatattgcatacactttatcctcggttccaatttttctccactctctgactttccttgactctctgaggctactattcctcatgaaagatagtgcaatgttcaagtgcacacagagagcaaaaattagggcctgtttagttggcaaattttgccctggcatatcacatcgtatatacgggcacacatttgaaatattaaacgtagtctaataacaaaacaaattacagattttgtcagaaaattgcgagaagaatttattaagcctagttaatctatcattagcaaatatttactgtagcacaacattgtcaaatcatggcgcaattagacttaaaagattcatctcgcaatttcctggtgaactctgtaattgtttttttttctaaatttaatactccatgtatttatccaaacattcgatgtgacagtgtgaaaaattttgtttggaactaaacaagtcctaagtaagtacacaagatgatatgttgacgaaataactagtgcgtgaacgtttacgcgtctgggccgtgcgcgaatacccgtgtttttcttttttatcatccatgtgacttctttttttttttggaaattttaaaaatgatatgaactgtaaatttatttcatgtttatgttagagtaatttattagaaagaatgggttttgtttgcagtaagtaacaatgataatgacgagaaattgagaactattgaattgccatccaaggtacgaaaaaagtggctttttttttttgaaaatttcagccgcctttgatttctagacatcccaatttcttatcccagacacttaaaaatcgatacacgatgatcctgaaacgcctgtaaacactgacaaaagcccacgaaagcttcacaaaacaccgaggacacacacgtgctacattattaacaatttgaaacaacaaccgttattatccatggtgttagctccaaaaagatcattgaccataccctggcctcaacaaaggaagcccatactctgccttgaaatagtgtcgaggcagatggtctgccggtctgctctctctgctttacattttgacagcgtctcgtctacctccagaggatccgaacccccgaagaaaaaaaaaaggaaaaagaagagtatctagctactatttgccctgtcaaccatcctgccagatggccacagagaagaaaagaactggcgatccttgctggatcgctcctgccactgtaccacagtcggtaggaataagtttactttaggtccttcaatttgttctcgagtctaaaatttatcgtagaatcataatactgtacactctctccgtttcagattacaagatgttttgactttggtcaaagtcaatctgcttaaagtttgactaagtttatagacaaatatagtaatatttacattaccaaattagttttattaaattaataattaaatatatttttataataagtttatcttgggtaaaaaaatattattatttttttctataaacttggtcaaacattaaacagtttgactttgaccaaaatcaaaatatcttataacctgaaacggagggagtatgatgcattccttaactctcaaaaccaatgcaaataaagtcctaagacagtttggacagttggttcggcttacgtgatgcctacgtggcacttaagtcgaaaaaaccgtgagaccaacatatcaacagccaacccatcttcctcctcctctctctcctccctatctctctccaggccaggaacaggttgcgggcgacaagcgacggcggacggaaggcggacggtgggcaacaggaagaggtgtggtggctatggtgggttggaagggtcgtagccatcacagggttggaaattctggaacgaaatttcagaaatttcggaccacttcgatacgatattatttcagtcgaaattttttaattttttaattttccgtgtgttttggtaatatttgttcaaattcaactaaaatttgttcaaaatttcggaaatttcgttgaggtccgatcaaatcggctaaacggaaatgtttaaccctgggccatcatcctctttccttctcttgttcatctctttataggccgggaggcgcgtggcagaggcttggagagagatagggaagatagaagagagaggggggagagagagagagaggaggaagatgtgttgactgctgacatatgggtcccatggttttttttttgtgacttaggttccacatcaacgttacataggcgccatgtcagtcaaaactgatgtctaaatcaccttaggaccttatttgcactgatttggaaagttgatggatgcatcatatatggtattgcggttcaccaatgaatttcaggctcagtgagggacctaaagtgaacttattcccgaccaggccatagcaatgcggcgtgaccgacgcagttctattactactactcgttgtcacctcccctcccctcttctcgcaccatggcggtggtcgaggaggccactggtgacgagctccatgaccgatgaatgaatcctggtggtgtagccgacgagcttctggtagacttgtagctggtggagtctctcctcgcggctcgctcgactggtgggggtggcggcaagtagaaggggttggtgggggcaatgacgagggaatagcagccctcttcctcctcggtctttgttgttgcttccgaagctcatcgaacaatgccattgcctccctttctccagcctccgtgtgccgcttccgtccatcttacttgataccgttgagtccagcaccatcgtcattgaggtgaatggctacgggggaagatagaagagagaagagggggaggggggagtcaccaacatgtgagccccacatgttgactcaatcaattgaactaagtcaacgagtcacatcagcgaaaacatactcagaacctgagtaagtcatttcgcaccggtttctactgctgatggttcaggatatatgttattgcggttgagcgatatgtataagattggacttatattagagggagccaaagtgaacttgttccaaaaaagggcccatgaacaatattggcctctcctagtgacaggccacaggcgagtcgctcgctgcgtgggccgccggtgaaatccacccgcaatccggtcgcctccgatgggccggactacgcccgcgtgctttcacctcacgccggaagttttgtcccgtgcgatttcgattgccgctacacgatcgctagtacgctcccataccatccaccatagccaaaagagtacgagttcttcagagaagataaccactttttctcatcaaccccaagctaggtcgctctcgctcgatcaacgtcctccgaattcgcgtatcatcccgtgctcaattcggccgcaaaaccgtatcgatcacggctggtgcatccatccatccgcccaattaatcactcacgcacgaatatcagcatatatatgccaccaatggccgggccggccacggctcgaaggagctaggccgttagcacggtccatagctacgattcttcatacataatcctctcttcttcatcgtcttcttcttgcagttgcagcatgtccggttcatcctgttgctctcgtgtgtgcgccaggggcgtgctatccatggcaacagagatgagagatcgatctcgctcagtgctatatactagaacctacagccacctatcgctgtagcacaacatccaaaatttagaaatttcccgtatactccctccgtcccaaaaagaccaagatgtgacacattttgtttatattccttgtatgaatgtgtcatattttctattagattggtttttttttgacaaaagaagtaggcagcactgagacctcattctttttaattaagacagttttttttcttgattttcgttagtatgtttttcatattgctaaatggtgcgttttgtgtgaaaactttatatatgaaaattgttttaaattatcagataaattcatttttcaagttcataataattataggaacaattaatcatgtgctaatggctttattgttttgcatactccaagttcatcttcatctttgttagaaaagaatcaccacctgaatgtctgaatccccaagacactgacatgttccaatgactctagggcctagactgtcactatgtagggatgcacaagccgagtagagtagccttgagcagagctactatacaaagacgacaacatcgcgatcctcttctactgtgcatatatcgtcttctttggagaggagaaacgatttttttttcttatctgaaaagggtgcttgacaaggattgggccgcggaaagagggcgcattgcatatacctgcatcgcgtgccttcactttcacatggattttcgtttcttgaatctgctgtggagtgcctggcactgcagctggatcagtcaaccaaccaaaatgggattagtttgaacctgaatctgaactagtggttatactctagctaatcacctgttcatgagtcagggcatgatgattgatgaggcagaataagaaaaaggaggaccttgatagagttggaaggcacttgctcattttctgtccttagcttcttcagtttctctttcagaaaaagaaaaggagggcttctttgttcagtcccttagctttggaaaattaggcgcacttgggcaaatttcagtggtgttctgttctcatcttgtttgcgcgttggatggctatggattggaacgtgtttttatttattttgcttttctattgtgtccttgagaaaaaaaaagctgagatattggtcgcctgaaagagatttatctgttttttagcacagccctgccttttctaggagcctctttttatggttagtgtaatggagcatgaaataggccacaagaaatggctgttctgtggctcagcttacacagtgatccagctaatcaacttactcctgcaattatgtgcatgatggtaagctaaaatcgcaagaacagtaaattggctgaaaaatgagaagtacatatatatatatgagaatttgaactctagaaaataaaacacaagtgttcatttggtgcggccaccaagatcaaacaagcaaacaactaggtcaaaatgataacatcgagtcatcatggcaaattttcttccaatgggtggttttgcttaatcttccttgtctacacatgggaacaatccggagatggatccaatgtatattgctgtcttttcatcctcgacttgggttgattgaattccatttgtccactggacaactaaagcactctttattcctgatgaaacaagaatttctccatcattctagtcatatgacggcccaaaaggtcctttaatctcaccaattcagatatagccacatggaatggttttagagttgtactgcaaggatgaaaagggttctcatcactttcacgattacaattgatgcatgccaagacaaccttgaggtctattttcttgttgatatcctctagctgcctctaaaatttagttagtgcacaaacaatttaagagctctacatcttgagtgattttccgcttcttcagacgctgcaattttgaaactacttccgtcccataatataagcatctttagagtttgacacggatattaagaaaatatgtataaattaaataggggaaggttgtgattggttggaaatagaatgttggagaaaaagttattatattttagaacaaatcttaaatgctggaaattgttatattttggaatggagagagtagtttatactagacggtataatttatactgccagtataaattaatgatttaagggtttagattaaattatccttcccacttaaatagattggagtatagaatcaaatgggcgtaaaatcatctttctatacttagttcatggaggcaattatgaaaaattgcattgtatatatagtgaaacaatgctgggcatttcccctgctcgttctcattccctattatccaccgtcctcattactatggtgaggtgccaccagccacatccagtccacatgcgtcgtccgtcagctaacataggatggcgatgagatgactgatgggatgttagggactaaaacatgaaattactggaatgctcttttcaaattttgccgtaaatttctaaagtgtccttgtatgacaatatatactactcccttcgttctattttaagtgagtcataagtttccgtatacaacatttgaccattcgtcttatttgaaaaatttatgaacaaattttaaaaattaagccacacataaagtaatatttatattttatcatctaataacaataaaaatagtaatcataagaaaatttcaaataagacgggcagtcaaacattagcactgaaactcataactgcgcttattatggaacagagggagtaacaaaaaattgtaccgtaaaagttctttaatttttacagttaatttgtggtgcctcctaacatgtaaatactatgtaaacattagggatgtactaaaagtttacgctaataagaaatatagtacctgtttttcctcaaagatacatctttacttcacgtacattatctttttctgtagctggtggaatctggtttcataccttgcaacattttattacctatgcatctttagttggaacttttctgcacattactatacacatctagcagtcccttggagattaatcatataatattgtgtccttcccaattatgttaacaatcatttgtctctttttgttctcttttgttgctttgtaagccttgactacttctctttagcctctttttctccttctgtttggtgctgtcggctagctaacatacacatcaacgctttgcagtgtagcagccctagctaagatgcaatggttcgttattaattaagtagtgatgcagacccaaaaaggtgtatatatatgttattactaatatagatctcactcaggttacccaagaaaccaagagatatgtcttgtttaattgaataatagaaaatctgaatcgcgtgtcaatttagttacaggggaaagtcttgcttctcttcaagttgacatgacaacacaccaaagaaatctacacagttttgtttacctaaataaagaggttttggccaaaagagtaaacaaaacaagtataactttacaagcattatttgccaacttgaagtccaaaaatactatattataattccattccagtgccactctgtccttaagtattaattcgtcgcaaagaaataaaatagatctttgagacaaagcaatggacagtggacacttcctatagtcttgtcttgtatgcatacggtttccaaattatagtccaaaagataaaggcaggggagatatccttgactattttatggcctatcccagatttactgattttatagtccaaaagtagtatttaactattaaggttgagtgctatgtcactttatatatccttcatttttagatcaagttaaagctagctaaccagcactgactctggtcttccattgtttaactagatcgtatcctgcctgaaggttactctgtgacccaaaagagacaaataatacgataaataatcatttactccctccatttttaaatatcaatttaaaatatatgatgttgttggcttggatataatgtttaatcattcatcttatcttttaaataaaaaattatatcaatattatttattttattgtgacttgtttttcattaaaggcagtatggcttatattttgatgtttgcactattttttttcaataggatcgaccaatgattcaatgtcatgtttaggtatgacgtatagtctcttgttctccaccccttctcctttgtgcacccattctcccattctcctattgtcggctcacatcctttccccgccatgtttgtaacgattttctagcaaatatatataggcacatttctttgagtctaccgtgcccatattgcaccatgccttgaaagcttcaagcacatataagaatctctcttgtggtattggtatcctatatatttaaatgaaaaatattataaaattaaacatagccaagagcactccgacccattgtttttcgtcccaacaaaccggcaacaggccataaaagtcattagcagagcacgaaacagctcaacttagatgataattaagaaatatcccggaaaaaacctctcgcgtcatcctcccctggggcggcacgggaggcggtgaccctgccgcccctctcctccccccctctgcctcgccgccgcctgagcggccgtcggcaaagccggccggccgcaaggacggcggcggtggggcctctcgccgaccatgcttcgggcgggcaggggagtcgtcctcgaccggcgacggtggccgccagatccgggccgctccggccggatttggcggggtggcgactggcggcgggaagggcgacgacgaaggaaggggcgcacggtgttgggcggcggtggtggaaggcggcagggatggcgtttgctgagggtgcgaaggcggcggcggcggcttgtgtgcggcgacggcgcggtgctaggcggcgacggcggcggtgtcccccagatccgcgcctctcggccggatttggcggggtggcgactggcggcggggagggcgacgacgaaggaaggggcgcacggtgttggccggcggtggtggaaggcggcagggatggcgtttgctgagggtgcgaaggcggcggcggcggcttgtgtgcggcgacggcgcg

SEQ ID NO: 31532 - DNA, 11261 bp, Oryza sativa
gggcgttcagcaatagtggttcggtgccagtgactgcggtcaccgaaggcatgccggacttggacagcttgccgagggtgtggcagacggctgcatctggccagcgcggcatcgtttggtggaggggtcggagtccggcttggcgcagagaggcgcagccgatggagggaggccggctcggcgcgagaggcacaggcggcgaagatggaggccggattggcgcgagaggcgcatccggtggaggaggctggcttggcacgagaggcgcggctagcggtggagggggcgacctaggtgtgaggaggagctgtcggtgggtgtggcgtggtcttcggcgctcgaaggctagccaacgggggatgccggtgcaggggtcctacatgtcggcagagcttgtatggtggtggagcttcggtgcgttagccgtggattcgcaggtggtgagcggtaggtgaaaacccagtctggcctctgccggaccgacaacgatggttcattccccctcctgagggcgttgttgtgttgtctcacccctcaaagggtggttgccgggtgaaagcctagtcttggctcctttgagtcccgacggacggcggcggcggtttctccgtcgcttctcttcttgaagacgtcgttttggcatcccttggggggcgatcccgtctgtgtccccttgttggtctaatgacggtcagtcacgcttagcggtggccggtccggtactagtcttctcctgggctggtgtgttggcgatgtcggtgtgtgggtggtggtccttttttcctggttacgaccctccagggttgtagtcttgtaatgtttttcctgctctatcaatagaacttcgcaccgtttcgtgcgagtcgttcaaaaaaaataattaagaaataagaaatgcagtgtattgtttgatgatggcacacacacgtacaacatcacacaaacaggagaaggaaaacacaatttgtatcaatttcactcctattagtggcactcatcaccaacatatgctagcttgatagctaataagttgaggaaactattagtaccactgtatatcatcagcatttgcatataactggatagtgttgtctgacgaagagtcagtgcaggctgtcaagccaatgagaaatcggctaaacactctctgaaatgacctgacaaatcggtcaaaaaagtacggccccgatacttccaatgtacaaatagaacatgtcacattttttttccactagcaatagatatgatactgtatgttcgatcaaaagaagaggcagtagaccagtagttgccacaattttatctgataagatctgaccggatattctgaatgtgaccctgctacacggtacatattgatatgctgcgcaagtgaaagccagtcactcaatcatatactcctctaagatgtaatccaagaaataccattaacaactatctaaatccaaaagaaaatgacatcgacaaatattagttccaagaaatgccatcatacaaacgattttgtcccaaaaataccatccgccattaggattccacccattccgcattgttaagtgctataggatgaacaatatatttaacgcttgtcaatggcattacttggattatctcataatttaattgattacatttcttagataatggtatagtgtttatgttttgtagataatgatataaagagattacatgagagaaagctatagacacatataacgcctttaatttacacccccacgcttttgttgcttcagatcgttgaaatgaatagtcaactaaaaaatactcctcgtttttttaaatatacggtgtcgttaacttttcaaagtatgttttatgtttaaccatttatattattttaataaatatatgattaattttattttgttatattttatcactaaaatattttaagtatgacttatatttttacatatttgctcaaaagattttaatgatacaaatggtaaaaatatgcttaaaggtaaatagggtcataaaataaaaactgagggtgtatagttttataaacttggaaagtataaaacttctcgtttctacaccaaataagaacgcatacacgactatatttgttgatactagaattcgaactaactggagcaaagtgaaacttttaatgagaaaatatcatgtgaaaacaagttaaatgttaaaaactcatgaaaattatatctaaaagttttataaattcataaaacaattactagagaaaggtatagatgtgaaatacattctcaccaaatctcaagtccaaactcaactttatttgagagaaataaaaatgacaaatttcaggtgaatagtagcatattactattcacccaaaatttgtcttatttgttacccaaaataaagttgagtttaaacttgatatttggcaataatgtatttcataaccacacctatctttaatgtttttttcataaatttataaaaacttttaagtataattttcatgagttctcgttttcactgaatatgccctcatttttaatttgttcaaaagcaaatgcacactatgtaaaagcaccatagtcatttctctcaaaaatttcctgtgtacctctcttgacattctatccacgaataagagcaggggcgacgctacagcctaccatcggggtcagtagaccccgacgatttcatgcatacatctagtacccctcgcttttttaccagctagaccccagtcaagcaaactactagaccccggtgacaccgtttcgttaaagcccaatagcaattaggaacgagactagtaagtagaaaatagaaaattaatcagctcttaaacgcctgagacttgagcccacatggccggcagcccagaaagtccattcccctgttgcatcatattcttctggtagtttgaccgagcacttcgcattgcatcgccgcacatctcgatttctcgactttccgtgtcttctcgtcctcgagtagtacacgcgtgcatcgccggcttggcgtcacaaggacgagaagaatggcaagggtgaagggttatggttgagcgctcgagcgctcgagctgttgagggcggtaacctactaacattatcacaatttcttgattattaccatcacaatttagccctagggtggtttctcaagtccgaaagtttattaggaagttagggttctataattcagaagttctgaaatatgaacatttgatttgtctttgttttcaaacttcagttatatgatcatgagtaaggaggaggattaatgtataattttgttccatcttacgcatagttttagtcacactacaaaaaaatggtttttttttctgacagccacccctttcattttttgcaaatggctagcttaaacttaaaggctatatctgtgaagattcatttcaccatgtgattatcgtagcaccggtcacaagcgaaaagatctttagtcataagcgacacgattggccacctgtaaaaatgtgttttggccatttacgataaacctgttcatagtagtgcaagttcattagttagtagtgaccccggcgatgatttattctggcttcgcccctgaataagaggacaattacaacataaacagttctctttcttaaaaaaacactaaacatgatatagtcaatgtctagtgtggatataataaaaaaaaatcgtgcagcataagaattggagctacccttagccgcccatgttgtgatagttcaatatttttaacatattatccattatacatctcaatcgtactacgtacgcacacttaatatgtccttcatcacaaaatataaaaatatttagaaagtgctaagtcaaacatttttaattttgattattaataacgaaaaaaatagaataactcgtttatcattagaaaaactatcataatttataacttttttaatttcaaataacttattgttataaatattattggttgaaataacatctcgaacacctctctagagttaaaaaatacttatattttggaactgatgagggagtaatacatagacagtaaataaaaccaaagaaaaattaaattgcctactcaagtcaagatgtggtgacatgcagggtgtgacctccacgccataatccacacaagctggactaatcgaagactagcataataaaactactagtacgtaatagatatcgctgagctagcacatctcgaaccacttgccccattaacttgcattagcaaaacctgtcataaattaatcaaatctgcagataggacgatgatatatttgatactatatccttgggtgtactggagaaatggtctacggattttcggctgtcggatcgagatctaacggtcacacactgatcaaaagtcaagaggcagggtggcatggtggttagtgtctcgccatccagtgatcagccatgttacctggaaactttttaaaattttaattttaagtaagacttggcaaaaaacagagggcacccattggatctaattagggctcatttggattgagggaatttcaaaggaaacttattggattttaatccttggaatttatttcctatgaggttctttaaaacaaaggaacggagtttgcatgcaaattatatgaattgtttcctatgccttcattccataagaaactaaacgtgtgctcatgttttcatttcctttgaaaagtccaatgctcttattctatttctatctctacactcatttcgattcctccaaaattccttgtcatatttcctgtaaactatctaaaagcattgcttctaatgttcttatgttctgaaatactgtaggaggttctattgtgtatgccattttattcatatatgatttccgtgttgctatatttatagaatcctagttccagaatccagaggatattacttaaatagtttgatcctcttgtctatttcttgcgttttgtgcaaatcaccagcagattatatgaacgtaatatcatgagaggcggagatagagtacggcagctagggttgcaaccctactccttagcctaaatatacattgaaattacactttaaaattttaaaaattagaagataaaggtaaaattatgtaaagtatactatttgagccctatgcttagaaagattctggttccgccacccattatccatgctaattaatttgcatttagagatcatgcactttatagacaagcatgcatggaaccatcaccatatccttagcgagattggagaaacgtgtaatattgtagataaaggcggagaagattgaggctagagatgtaatgcatcttccattatctttataaaaatccagatgagattattttatttactcttttcagaaataaaaagaaggccaatgttttaggtagataagctctctctttaaactctttttacgtggattcatgccacagctcacaaacaacgtacgtatagcccaattgtccaaaacaatgcaatttgcagtgactgcatgcgtgttccacaccaaaactaataaactctacttactaatttgtgaaaagaaaatcccaattttacccatgcaacgattaattaatcaccaaatactaatgtcaactctgcaaggacaaaaggggcagtttagtcatttgggtcgcggccacagcaagtggccgcctagtacaaacagcgggcgcgatataatacgcatcacccgtggccatttgatgcggatttgctagggctttgaattttttttttccgctcgatcgagttcgcttcgaattcgtataattaagctaatataagctaattaagctcggggatgaagctgttcgccttcgtgaggcgctgccggcggctgtcgtcggcgccggtggatcaggcggcggaggaggagccggcggcggtggcgccgcccgcggagaagcggcggaggaggccgtcggggccggcgtggaagccgacgctcggggcgatctccgaggacgccgcggtggcgtcgtccgccgccgcgaaggcgaagccggcggcgaggacgaaggcgaaggcgaaggggaaggcggcggcgccgccgccgccgcggcgcgtggtccggtcggagtacgacgacttccggtgagttttttttttctctttctccccgcgcgcgcgaacgttagcttgggcagttttttttggccgttggatttcggtggttcgagggatcgggacggataggatctcgacacgtgtccttcggcgcgcttctcccgcgtcgccggacgccgtggcgcgtacgtgtcgcttccaggtgggccacgggtgacgtggctccgagtcaaggtcgtccgtgcgtgcatatgctacgcagttttgacttttttgacatttttacctcatcaacttaatcctctcctgcagcttctttcttttggatttttttcctttttttgggggtaatactccgtagatgatactacgtataaagacaaaattgctgaaacttggttggtttgatcaacttgcgagttgcgttgagtacctaattagcaattggatctcgcagagagtttgactccagataagagtgagtagaaaatttaaagaatcctaaattaaatgggttcacagggatcaagcttgccaggtcaatgcactttttttttttggcaactagcagcttatacagttgaactgttcatcgcagctcatgattatccgtataacctagccatgttgcaaagcgtaacgctccatcatactttgacgacgtctagggttagttgaaaccgtacatattattccaaagacacataagcaatacctattgtggaaaaaaaaataagtgagtgaaaattcataagtcttgttttgtatgcatgaattttaagatgctcatgtcacgtcgagatactgcagaaaaaagactgcagactcatccggtttttcaatttccattatcacaacaaaagaaaattgacatactcatacggcttaaattaaggaattcatctctatagttgaatatcttagcactttcaatttgtgtacagatgttaatgatgttacagattcttagcattattaggtgatgtctaatcgagtactaatttattatatgttatgtaagatggaaggagtagatggacacttcgaaactcatcgcggttgccccttttttttctaataagttattttggcttattagaaaataaaaactaatttatagataaaacttttatatatatttctaacgatttaaaagtcgatgttgaaaaataaactacgttaaaaatatcttaaattaactttaaaattaagtttaaaaatttaaattttagcttttgtttgatttattagggcaactctctttaattccctgcaactagttggaccaccgtgtcctaacaatggaatctactatgtatatagacaatctcaattctcaccgtccttgtcagaatcaagaacgagggggtcctccacacgtactaatttcctcccttttatcgctagtgcatgttagtcaaactcaagctatagtacactggcccagatgacaagtgaaggccgtgaaactcttcccctgatcacttcgtgcctgctaccgctactacttcttgtccctcacatgccattatggcaaaaatttcaacagacacccatatgttcaaagttcaaacatagctgaaacttgcgaaatatatccagattcatatgcatttcgtcccaaaatacataaactttaaaagttacgaatctggatatgcatttatccatatttatagctaaaggttgttatattctgagattgatggtagttacttttgtggcctagttatttttagcttgttcactaaattattgctgcagattatttgctttgcgtttctttttctattttattgttcaccgttatttgcttcacatggacaaaataatccgcggcaataatgccttagtcactctctctttttttttttccttagggggagggggtttggggtttctattaactggtactccctccgtttcacaaggtaagtcattctaacatttttcatattcatattaatgttatgaatgaatctagatatatctatctatctatctagattcattaactttaatatgaatttaagaaatgctagaatgacttacatatgaaacggaggaagtaactcacaatttagccttcattactggtaccgtggtactaaccaaggtgcatctctgtgtctctacctgcaggcactacggggcacccacggtgttgccggcgttcgcgccgacggcgttcttgttctgagctcaactccggtggacacaagtcctgtagctgatggggcgctgtgtgctcgtagtgtgtgtgtgtgtggtttcactggcttgaccatgacgcctctctagtgtgtgtggtgctcgctggcttgaccatgacggctcagcttttgtgcgcaaagatctgaacgaactcgcaaagctgattctgtaaattttccggatgcttctgatgatgtgcatataaatctgctgctgctgctgctgctgctgcccgatcccccccactcgcgtttgtggctttcggtttccatcgcctttttacgattcctgatgttctcctgcatgatgcgtggatatgtgatggaacgagcagcaaattcctcttggttcaacgatgccgagacaagttcatctttttgatagttcgattgctacaacgacaaataatcaaccagaaatctcgacggttttatgcattacagtgatctcgatggaccaacagatacgacaagcaagcaagcaagaatgaacaactattatgtcctttactatagtgaaaagaagaaagtataacgtgctaatgaagtaccgggaaaccaatatgctgcatacataggcatagcactgatctggcaacatcttaaaacaagcacaccagaaacatatgtggcacatccaagtagcagcacagaggttgcaaattattccccagcttaaatcacgggtagcaggctgaagaatagaagcacaaatagttcataaattctcatctctttgttatcaagagtggaaatgagccaccagttacgagatcagcacccctcgtgtgtcgccatccagagagcaacaattgatttttttttcccatgatggaagaatcaaacatgaagataaaaccagtgcgcttcggcgaggccatggtatttgagtcgtgccatcatgggagcacagcgtgcatgtgcaatgaggttagtaaccgttaatctttcgctgcgaggggctagagtgtaatgcccggttgtcagtgagccttgagaagccaacctgatccctggtccctggactctggggcactttagggctaggaacacttgtcaagcgactctgaggcacagtatcagacatggacttcgagaaggcttgtgcaagctccaatgcagatgctcctttcccaaaacgaggtgcaacaacctcaggctttggtggctcaactggcttacgccaggtttcaggctctggacgctgttgctcgggcttctccacatctctagcaactctcctgttgtcctcccgtcgtgtaggcctatacacatcactccggtctgtatcccgcctgtagtctttcttatcagcattccttgggcctctagaaccagctggaaaactctcagccttttcacctgaagggttaatggacatagcttcgaccttctgctcaccctttgcaaattcacttttagacctggaagatgccacaaaggttattagcgaatgcggtacacatccaacgtatgcatgctatagtaatatctgcagaaaaggaacaaagcttcaagaaaatgaatctcgtaaaataaggtaaaaactacatgttttctgtcaccatcctttcttggcactccaaaagccaacttcgaactttcaaacatcagaattagataaaaaaaactctatgcaaaggaaaataatacacattcagcttaggaatgttgcacaaacaagcatgttgtttcacaccatcatgttagttgctttccgaaaacacaacagtgcaacttttactatcttaagaacgaaagcccaactggaagaccaatcactggtcctgcaattgtaggtggccagtaaaatcatgtcacaatgaatggaacattaactatggtccagacctggagataccaggatttcaatattaataacaagcatgaatcaggaagcattagatataaaaatgtaattcaagccaagtaaaacgttgattttatctgaagggctgtatgctaactacctgccaactggagatgtcttatcaaggtcacttgctaaagcatctattccacgctctctgagaacctgagtttatgaacaacattaagtttttggtaaagctaggaaaaaaaaaagaaaattacatatatgcaagtgcaacatgaggagagagagagagagagagagagagagagagagagagaggatcgcatacttgttccctgggccgagctccaccaaagagggattgcctaccacaatatttacaaaaaatgagagagaagatattgagaattactacaggaatgaaatagagaccagaaggacaattcttactgaacagattgaatgcaagattgatagctattaacttgtgaacaaatttagcaacggtataaatcttgaaaacaaaaaatccaagattcagagattgggaaaaaaagaatggggattcaggagccaaattaatgacagtagaatctagacgcccttgtacattttcactcactcattattcacatggatttaaaacatttttcacatccactattcgtgcagacaaaaagaagcacagtttatttctattggagcaactaaatgtctataaacatgttacataattcgttccacatgtagtgtgcactatggaactaaagggaagtggtttgccacaagtaaataataaatcaaacctaaagggatccctattgatataaactcaccatgataggttaaacatgtgttatgcccttttgttaaatatgagctgcatgcaattgtcaacaaagaaaaaagaaagatgacctccaataatacaatactgcaaattgctttagtcctccaacaaggtagaatccaaaacaaaataacaagccattcttaatagcgcacagcacaaacatgcatgtggaaatgtacatactgaatgcaaacaacgaagattaatattccaatctaaatgcacctatttcatattaacaaagatcaatcaaccagatggatacttgtaacctcaacatttaacaaaacataaaaaggtgcttgaacaggccaagtg

SEQ ID NO: 31533 - DNA, 8022 bp, Oryza sativa
cctatttcatattaacaaagatcaatcaaccagatggatacttgtaacctcaacatttaacaaaacataaaaaggtgcttgaacaggccaagtgtaccacacatatggcaagcaaccaacagcataatccaaatgataaaaatagacgtaacattcaagaattagttgaaaagaagggaggcgagggtggaggagggggctaaacaccacctacctttcctttggagcactttcatcagactgtcctactgcattggagcggggtttcagattcaatcgtggtcgctccactgcccggccctcagcatctgcccctgctactcctgctttaggtgctacaacattctggtgcacatcatgaataacgtcaacctgcacagtattcgcgaccactggaacctgatgcacctatacaatagttgtccaaaagggagaagattaaggtttcaccatgccattgcatacataccatatatcaaatcaagcaaactaagagcaacttaataagcacaaagcaacacaacacaatcatgtatcactttgcatggagatttgcaaacatcatttgatgttaccgctggaaaacaagacaattcaattttcaatccgatcaacacacatgggagcaagagtaataacctgcttctcttcaacatagacaggagatggttctgaagcctcgattggcttggagcgaggaagcagcttcaacttaggtctctctggcagcacatcaccaaccctaggtctctctggcacatcacccaccctaggtctctcttgcacctccaagcctctagcctccccaaccctgccttcatgcgacgcaggcctcactggcgccacgctcctctctatgccaccatccagctctctcaccccgactgactttggcctctccatctccggcggtgcaacatgagtctccaccaccactgggaccgacacaggcgccgccggtggagaggagggtttcgacgagttccacctcccggagatcaccttctccacggcgctcgcctgcgcaatgcgcgtcgccgaccagatctgaccaccgccgccgccgctggcggcaggactcaccggcgccgcggtcggagccgcctccctcctcggcccccaggcgttcccgggcccggatctggtgggccccgcagccggggatggggcgaacgacgggggcgacggggccgggcggcgcggcgtggaggcggcctctaagggcgtgcgctcgtcctcgtcgaagtggcggccgatgcgggaagggttggtgaggaacgacgggaccgcggccgccgccgccgcggcagcggcggcggaggtcgccggggcgcgggggcgagcggacgccgcgggagcggccgcctgggaggccacggggcggtccgccgggcgcgcggagctgcgacaaacgagagttaacatcactccatcacctacacgggtacaccgaacgacgaatcgcgagatggggctagggtttgggggtggaaacttacacgccgggggcggaggggagggggagctcggaggggatggagccgccgtggaagtccttgagcgtcatcgtcgtcaccgccttcttcttcgacatggcggcggtggccggcgcgttcgccgtcgttgcccgaggaggacctcgtcggcgtcggcggcccgccgatgcttcgcccctctcgacgacgcgacgcacggggttaggttaggccgcgccgcttgatcgggggggttccaggtgtctcgtccgcgcggcgctctctgctctctcgccttcgcaaatcgcaagggggagggggaagaggagggggaggagggtttgtgccgcgttggatggggaggaattttttacgagttagcccctgtggaattttgtggcgttgcacacgaggcggcggtttagattcggcgagagtttagggggatttttcgctaatccagtttctttagttgggctgggccgagtttgggtgtgttgggctgttgcctgttggaaatggaacgaggtagtgataatttataatattaattattattattattattacaaaataaagtgcttgatacaaaattattttataaagctgcaatcatgcggtatgccttgtctaatagacggaggaataatgttaggttaaaggttgccgagaaaaataagtgataaattctggtgaaatctgtcaaaaagaaacggcaaatcaagatggttgatttgagtatctcctgagatccatcttgggtagatgttactcttactcttatcttcttatgtaccagatttctatatttggtttcggtatggggaaaacttggtaaataagtaaatcaatcaaagcttacgagggaatggcatcatcatcatcatatatgtagcaaataaacatggaacatgctattgttctttattcagacaccgaacaattaactaatcatgtataatatagaagtttgctaaattaacatagacactctataagggaatctctcagtcagcagagcccaacacttccaagctccaaacccagaaacatacaaaagcttcttctgacttctgcaacttccctggtaagagtaatatgcagcagcacaagaacagagtcttcaggatcattctttccagccacaacatcgcagtccttacttcagcttgtggatggtctccatgtccacggcctcgttgagggtgcctttctcgacgtgatcccaccagcccatgaggaagttgtcaacaaccagccggaaccagggagacagcttcaggccttcctctccggcgtccgctttgcggatgagctccttcagctgctcacggctcacgtatttcacatcggccacttcgtccgggttcgggactaccttcacgtcgcggacgatgaacagcaggtagtcaactgcagatgagaggtaagaaacaggtttcagtgcagggcggcataatgttcgttcttacacttctggtgaagtatcccgaacagtcgtatctatttgtgtaataatcgtaatgatcatataattggcttatagaaatgagaataacactaaaggttgagcttcaatgaataaaaataagtgtgcaggtaattaagtaaggtattaaaactaaaacttacgctcgtgttcaccccattttccatcagatggggccttgtaaagcatccgaccaagaggggtgaattggtcaactggcacatcttcagctgggatgcccagctcatccaagagcttcctctgagcagcatttctaacacctggagaatgataatatgttactaacatcattgaaacagagcagaaacggaagaatagttggcctcaactagccttttttttggcacataccaaggtagttttcctgtataagctcagactcacggtacagaggatggctgcagcaagtgttggtccaaactagaggaaatgtaacctttgttgcagatcgttgctggaaaagtagaacagataatcagcagatgttttgaagaataagatggcagtgctagaaatgagatatgaaaaataacttccagttgagcatttgaagaatatgaatatgcgggtaatttgtaaacagaagacattttgaaaactagttacgcaaagagctatgtcgtaaatgtcatcacagacacaacatctacaagtctcagaaaattgcgcgcgtctgaatcatgagcgcaaaacctaaataccatttgtttttctcaagagtgatttaaggcacaaacctaacttccaactggagatcctgtgttactaactgctatggtaacttgacatgggagcacagtgaatagttgtatagaatatgtgccaggtgcaatgtaatacaagattaaaaaaaatggaagtgcagaattagtaaattctccaaacctggagtaggagttcatattttgagttgaacaggaatacactgaaagccctatgaagtagattttcagattcgattttttccatcagatggcctgtgtcaaatgaatcaagtcaagtatcgttccaataactaattcaaaagaatgttgggcacaggatttgaatagagatgcagataacaacacttacagttatattttgattcatggccaacaacattgtcttgttcatccaccaaaatgcatctgtgaaataacaagaatgttacttacttgaatatcttgaaactaatacttataaaaaaaacatagtcgtatttactgaattctaaatcattaaaaatgtttacatggtttacaaaaaaaaaatagaccaattaagcaactagacatatatcgtacatcgcttatggaacttgcattatacggccatcacactcaagctaacattggcaaagacaggatagcaaacctgaaattatttgttgacataatttgggaaaagaatattgaatagaactaaagcaaaaggtgccatcagagattattgaatacagtaggtacatgtgtttaccataatatttacatataaaagggcattcttttgaaccacaggaggaatctcttttcaaataaatctttcattataagaaagggaaaagaaaagcatcgcattcgctccttccatatgatctttaatagctgttgctaagtcaaattaaaagcgatagggaacatcatgcatagtcattcaaacagtacttttgctgatccagtacacctttcgctgatccagtacaccgtaaattgaatgaggcggctaaaccattagcttttcctacaaccatctgaagctctgaactcatagaacaataattgcacaagtgacaaacaaagccaagagagaccgttgagttgaacacatcaaaccaaaccaagtcatgactaggttgccatataatgagaaattacaaatccacacacaagcaaagccttatctttgacctgcagtatccagtcacatcttgcacagtattttttttaacaaaaagagtatttagcgcgtatagcatttgctaaaacaacaaaaggaacagtgttctagccaaacattgcccacaagtgccctcccatcccatggccaacccagaaactcccacggcataggccccgagatctaataacactgcgaacaagtgagactaagcaagtgaagttcaaacccaaccaaaaatataacccgcaagtgaattttggccaccgtgaattttggcgttcgtttatgcgaaacaactaaatttcaaatcccaaatcccccccccccccaatcaccacgagatccgatggggggtggggggcgcaccgaccaccagaaacccagactcgcgcatctcatcaatcaaaatttctaaagccaataacggcgcaggagggaggggggaggggggggggttcggggcgcgcttactcgtcgtcgaacatgagccgcttctggacctcgtccatcccggcgtcctccacggcggcggcggcgccggccatgcctcgcggcggagaaggcgcggccgcctctgcgcgaggcaaagggagagtgtgtgcgcgacgcgaactgcgaagaagtgtctctgcagccagcggcggaggcggaggcggggtgataaataacgggtgggccggccgggccgggcctcgcggacggcgtggtggtggtgggcccacctgtcagcgagcattgtacatttgtacaagtagatctctgtccgggtcagccacgtgcgtgccactaccatacgtggtgtttttttttttttggctcgcctcctctcacggtcgctgaaaggtggggccaggagtgtgatctgggccatctggctgagctcgtattcctcgcgcctcttatattattttcgggaataataactttttttaaataaaatgtgttctcttgtctctttatgtcagaagaatcacatggttacgatgactcgtgttggatccgatctgtgaaaaaaaaaatccaaaaaacaataactactagcgtggagcttaaaacattgccaatttttgtatttccgggcaaacaatttgccataattttgataacagaccacataatcgcaaaaccggcaggcgctgccaattatttcgcgtcgggccacagattagtaaggagtaaaggaccacaaaaatgcttactgaaattgtcacaacagactaaacggctgcaagaactggctagcgctgctaattttggtgtaggataagcccatctaattaacagctaccaaaagttccctcgttaaaaagcatacataatcgaagatgcttctagagttgagtatttttcttcctcatttatgtcgggaacgttaatttgtggtgctagttttttctctcttttttttttcatataattgtggtgctgatcctgatggaacacgagaggctgcgaggagactagaagcagctgggctagcaaccggggtgcattagcaaaccatcgccgccatgaaattggtgagtatattatctaaaaataaaatattgaaattggtgagtgactggagcttcagctaggaaatcttcagaattttcatttttgtcgtgtccgtcgcgtcgtcgctttctcccaagtttatggatggcattctacactggactactgagtactccacagatgcagctactcgacccttgcggtaaaagattgacgctacttgacgctgtgcccgaataactaaaaaaactttattagaaaaaagagaaagaaaaaccaactgtcaggttgtagatttgcacacttctcaacagaattgaggaacacaacacagaaacaaggggaaatggtcattacactggtgttccaaatacccattggagaatcacatcttacttgtttggagcatcacaatgctttccattaactaaaccagtatctagttagtaactgtattgagtccactgttcatttgcctacaaagcagtacaatctaaccatgctttcacataagaggaacgacagaaatctttgtacagcctcaggaaagacagtaatcacaaaggaccagggtcagtaactgctaaatacattgaaggtgtgtccttctaggtcgtctcatcattacatggttcaaggcttcaagcgttgacattgggagaatgcttactatgtcaaaggtcctccccttcgcacccgaacgcgctcaccattgaaatgcatgtacttgtacttcttcaagtatttctcgaggacaatcttttctttatcttcctggcctaaagtcacaaatgctcttccgatccttcttgttgtatcctcgtctggatgcacccctagctcctccatgtcagcatatatctaaaattggaagtagttattagggaaaacaacccccaagcaaccctttagggaaaaaagaagaacctacatttcagcactaaagcatagattgactcacaatgatatgatcctttaaaaaatgtacatatgcaaatgaatataacaaactcaattagtagaaatgaaaacacaaattaaaacatcaagaaaaggttaaaaaggtaaatgtcacctaaatctacaggaaaaatataaaaaagtcagataccacctccaaaaccttgtctggacaatggcgggtgtcatatatcaggatcatccgggaaaacaacctcttgggtactgaacgtgtatgagtttgtatgatattattccaaatcgactcagcctcatctatccttccatccataaaaagagccaacagtagtgtatcatacgttgtccatgtcagcacctggcctttgctcatcaaccacttggctacctgataacagcaacaaaattgaaaggtaagtgagaaaatgagcttgacatcaaaagctgcgattactgtactctcaacagactaacaaggagatataatctataataaccttacctggatgattctcagccattgtctccgccttttcaacatttccaaagcttttgctgctgcaatagtagggaattcgggctcaaaggcagtccacttatccaatgcaccataaccagcttctttctcatttggtaactttgaaacctaacagatagtattccagactgatttgagacaatttcagtttcttaagcttgagtattctatagtgtcac

SEQ ID NO: 31534 - DNA, 508 bp, Oryza sativa
ttcctttttatcttataaacccatttgcaatcaatgacatttctacccttctgaggaggaactaaatgcgatgtattatttttaatcaaagccatatactcagcatccattgcaagtttccaattcttatctttcaaagcatcttgtaaattttcagacacaccagttgaggtcaaaagaccccattttactgtaccatcagtgtagattttctccttgcgaattccactttgcagccatgtgcgaagacgtgctgctgcgtcagactcctgattccgatctgcaattccaagtccgcgcctcgccgtcggatcggcggcagcgataattccaagtccacgccttgccgtcggatggccaccgctgccaccgctcctccaccggctaccgtcgcctcgttttcctctctcccgtttgtgcgcgtgcctgtcggtcccttgccgcgtgcctgctggcccttcccgtgcaccgctaccatgcaagtcttgccgcatattgccgcgccgtg

SEQ ID NO: 31535 - DNA, 22864 bp, Oryza sativa
tacggcacaaaaacggttctcccatctaagctcacctgaggttctcctcgggccacccatgtactgcaaggctgatcaagatcagcttagtagagatgacctcgactacttgaaagagcaaagacggcgcgcggccctccaagccgcgcgctaccagcagagcgtgcggcgctaccatcagcgccacgtccgggcccgatcactctgcgtcgacgacctcgtcttacgcagcgtccaaacgcgtgatgaattgagcaagctctcaccaatgtgggagggtccgtatcgagtgatcggtgtcccccggccgggctcggtacggctggccacgggcgacggcacggagctgccaaacccgtggaacatcgaacaccttcgtcgcttctacccctaaaggggggggggtcgggtgtcagattttggctcgggccaaccccacacccccctcgggtgtgcaggattggccgggggctaccacacatgcacatatattccctttttccttatttcagcatttcaatagaagcagtttcaattttctaaaggttgtgtctgtgccgtttttccttctgaagaatcttaacttgaaataaggtcactcgtgctcaaccttgccctagggggctcagttcggtcagctaaaatcgccaaacggggcccagaaccgagccgtgccccggggcgtggtgaactccgggggggaaccggcaaaaacccacaatcgggtcacccatacccctcggtcaccacgttcccggcctggccagtctcgacatgtggatctccccgggcactggccccgaccccgagccattcaggactgggacttgggcacgagcccttatttcaagctaaggcgcaaaaggaccatggcacagatcatcctcatcgcatatgtatagcaaaataaaactaacacaaaaatttttcatcatttcatttctgattgcagattaagttaatttgtacaaaaaagaggtatgaaggccttagaagaaagaaaaagaaaaaaagattggcgggggcctgggggctcattccaatgcgcccgggtcgccggcctcgtcgccgccgtcatcctcatcgctggcgtcgctctcctcgtcggagctgggggcgaacgcgagcagaggggccgacccctcgaagccgtcgacgatatggtcggcagcatcccggacgcgcgcgcgcgcgtcgtcctcggttccgggagggaactcctccagcgccatccagggagagaagtcggggtcccgggcctggtagctcgccagcacgagttcgaccgccccctgggcgaggtccctcgaggatgacttgatggtcttctcgagctcctcggggagtcgttcgaggacccaggccatcctgttgaggtgcggagcgaggccttccaggttgctagggcgcgtcctcgtctggcctttccagaggcccgcttgccgaccggcgcgatccatgcgggagaccgagtcccaaagcatgtcgggccccatctcgcccgccaagcggagggcctcggcctccccgatggaagaatccagcgcgcgctgcatgtcagcgacggtgtgttcggcagccgcgaggcgagcggctaagtcgctttcgcccgcagccgccccaccgatgcgcgccctcgcggccagctctttctcccgtgcctcgaggttggcagcccgctgctccagcgcggctctctcggcacggacgcattcaaggttgcggcgcgcctgctcctcttgcgccgcctcgtgatgaaccctgagttcctctcgacactcaaggttgttgttggcccgatctttcggtgagttgatgaaaactacgatttggaagaaacgttgacgacccgactacaaccgtacaagacgttgcgttgcgccttagcgatcgatacacctctccgtgggttgttgatcttgccggtgcaaatcaaccttattcctgcaagcaaatcgaagaaacaagcaagaacaagataaaagcaatctgaattgcaaataggagttaaatacgaatgataagttggggttccgaagaacaagcagacggacggtctagccgacacgcgcgctgcaagcaagtagcaatggctaaactttaatctaacaaaacccaagaaaccctgaaggggtacctaactatttatagaggtgggaggacgaccaagagggtccaagggtcgtgctccaccagattggggcgcaccccacatgggcctcacatgggccagggtcccaaacaaagttacaagcccattggcccaatacaggagacgcagcaccttggttttgtgattgcggccaaacgagatagatttccgagatgaggctggatccgttggaaggaggacttcgagagctttccatcaagtactcacgggcccaaaacggagcacgtatgtagatttggcggccgtttgaagtcagcaatgtaacacgtggccgaatcagattgcagcacatggaggacttgatcttgatgtcttcttgttgtttcatgatgtgagcaatggtcgtatccatagtagccatggtcacatcatcctccccttcttcacagaaaaccgtcctcggtttttccatatggtgctcttcgcgcagtccactgaaaacaacctgtttcttgcaatcaaaacaagacaaactcgagacaatatgattagcagtaacatgtctctctagcttgcatattttatccggaactacaagatgttctaaatctgaacaaatgtaaactctatgcaccaaaaatattcctctatcattatattcgccaaagatatgaaaaatagcattagttggacatggcaaatcagatttagcaaataatttctccttcaaattatcgagctcacaaaaatcatcaaactgaacatagcccaaagtatttaaagaagatagcaattcgcgttcctctacttcattagcaatgtgaacaacatgcttagaatcagcacacaaagaaatagtagaactaacatgttcattcactagttgtggcatggatataagtgaaacattatcacacaactcttctttatcacaagaaacagcaagtaaatcaacttgtgacaaaggcaactcagtaattgattccactaatggttgctctactatagcatgaaaagtggacaagtgtagctcaccttgagaatactcaccttcatttctctcagcaccatttaatttaccttgcgaactttcttcagataatgtagctgcatcagccttctcctcattcgcgagtgatggaagtgacatctcaaacatatcgttcttctcattttggagacttttctgaacttcctgcaaaacatcagtgataggaggcacaagcatatcttgttgctccgttggattctccaaaattttgcgctcaacaatgcaagcaagcatgaacaattggcctatatgattatatgtcacattaacaagcccagcctgaatattgaaattaagccctctgaaaaatctagtcattgtgttctcattagattcttgtaaaccactataagtgatacaaattttaaaatcatgaaagtactccctaacagttttgtcaccttgttttagatgttcccatttctcaaggagagcacgtctatagtatgaaaacacaaatctttttctcatcagtattttgcattcatcccaagtttcaagcttattccccacagtatgccaccaaaaagatgcagaaccggtacacttattactagcagccttaatcatttgagcattagaaaaatcatactcatcaaattgtttttctactgctagctcccaattaatgtatgcagcggaatcatactttccatcatagactggtaacttacatgcaacttgtgcaaaattatagtcatgtacctcatatgcatcacgtgaagaagttgtcatatctcgtcgaaggtgtagatgttgacgttgagcatgaccatcttgtttccccttgcgcaatcctgccatggttagcagcaaacaagaaacatacacaagaatatacacgctcctatcaactattaggtactggcagctcaaatgtcacacacactcaagcttttaaccaagctcttacaagatcttaccaatgcaagtggaatggtgatgtacaccgactcaaccaagcagcccaatagaggttggatatatcgatgcctcggcaaacacttgctgtacggctgcaatcaaatctgtggagctctgggtaggcttaaatatgtagcaaaggaatagcaaatgctcaaatcagagaacgcaaagttgaataattgttcaaagtcaagtaccgtgctggtcctaggctagaacgtactagagacgcgagcctagacacaaacgataccacaagatagcactaggaacaactcatgcacaactctgatatatgaagttcagctcaaacataacagtattttctcttttctttctttcttctttcttcttttctttttttttttctttccttttcttttctgttttttttttggtgcggctttttttttctttttttttgcacctttctgcctttttttcacttttttcttgattttttttaacaaaaactgactcaaggaccttaatgtaagattacagggactcaaacataaatataaaatttatagggactcaaatgtaaaagtctaaacccaaaattaaaattatacaaaaaatggaatgctgaatttatgccggttccgtttttccaaacagatctcgaaaccgacaccaaacaaaaattcgccaaggtgtttgacacaactcggaacggtggaagagagggagggagtcggactcggccaaaggggcgagtgggactcggccaggaggtggagtggatggcagccgaatttggtgtatgggataaaaaggaaactgatttttaaccaatccaatctactatatctttccaaaacaaacttgactacttccaaaatcagatatggtaattcaccttcctcctctcgtgcacgacacaggcacggccaaaacaaacacacacaaggatcggcaaactctagatgcaactcaagaactccaaaactaaccgatagaaacgtctgaaaactacaaaaatagaaccgtggcagcgagccgattccgttttcgtaggtcccgacaacaacagagacacggtggcagcgacgactgtggtacaaaacgtgaccagaactcgaaactctaaacgaactagacgctaagaccagcaacacgacgtgacgatgcaacacaaaattcaacaaagcaaaaactgaaaagaacaatgcaatggcacaatatggctaggtaaatgatacgaatttttttgtatggctattttctggttataggaagataaaaactcaccgagcaacgaaagctctgataccacctgatgaaccctgagttcctctcgacactcaaggttgttgttggcccgatctttcggtgagttgatgaaaactacgatttggaagaaacgttgacgacccgactacaaccgtacaagacgttgcgttgcgccttagcgatcgatacacctctccgtgggttgttgatcttgccggtgcaaatcaaccttattcctgcaagcaaatcgaagaaacaagcaagaacaagataaaagcaatctgaattgcaaataggagttaaatacgaatgataagttggggttccgaagaacaagcagacggacggtctagccgacacgcgcgctgcaagcaagtagcaatggctaaactttaatctaacaaaacccaagaaaccctgaaggggtacctaactatttatagaagtgggaggacgaccaagagggtccaagggtcgtgctccccagattggggcgcaccccacatgggcctcacatgggccagggtcccaaacaaagttacaagcccattggcccaatacaggagacgcagcaccttggttttgtgattgcggccaaacgagatagatttccgagatgaggctggatccgttggaaggaggacttcgagagctttccatcaagtactcacgggcccaaaacggagcacgtatgtagatttggcggccgtttgaagtcagcaatgtaacacgtggccgaatcagattgcagcacatggaggacttgatcttgatgtcttcttgttgtttcatgatgtgagcaatggtcgtatccatagtagccatggtcacatcacctcgcggagggagaggctgttcgccagccgttgcgtcgtggcctcggcctcctcgagagctcgctcccgctcagcgagtgcatcctcgcgaaggcggagcgcggactcctcctcggcgcaggcggcctcgtgcgccgccagcgtcgtctcccggagagcagtggcggcctcgcggtccgtgaagcccttctccacggtgccggcgtgttcttccagcgccatggcacgggcctcaagggcctcctcgcgccgccgggacgccgcttcggcttccgttgcccgccgctctcgggcagcagcggagtcaagaaccccttgggcggcgtcgagcttgttcttcagctccgcctcccagctcccgtgttgaaggcggagggagtcctgcgcctcaatcatcgcggtggtggcgacaagggcggcctctcgctcctcctccacctctcgggcgatctccgccagcgccgccttgcgggcttcaagctccgagatgtggcggcggtgggccttacggcccacctccaccatggcgtccaccgagcgccgcccctcctcaacacgcgcccatgcggcctcgagctccgctcgttctgcacgcagggcctccacttgggtgttgaacccatccagcactgcggtgtttgcggcggccagggcctgcagaaggggctcggcgctcagcggggcgacagaagatgaggagaagagccgccttggagaaaaggcgacgcggcttggccccccggaagatgcgctgggctcggggatgtcccccgggcccgtttgatcatgggcgtcgcccggtgaggtaggcccaggcgatgcgcccgcggcctcgtcgcgagccgcctcggaggatgtcgcctgagggccgcccgagggagtaggcccaagtgacgcgccagcagcagctgtcgcctcagcctggcgagcccgggtggcctcctcccgggcagcttcttcggcttggcgagcccgggcggcctcctcccgagcagcttcctccgcttggcgaacccgggcggcctcccgggcggcctcttcagcttcccgaaggcgggctgcggcttcacgccggtcagactctcgcctccgctcctctgcggctgctggatcttcggcctcggactggccggacttggggtggcgggaggaatgcgacgggacatcgctgaagcagaagaaaaagccagaagacgaacaaagtgagcaagaaaaaacttctttttggagaaagatggttgcaatgagagtgagacgaacctgcgagggggtcggttgaatgaccaccttggaggggaaatcaggtttccccggcatggttccgtctcccccgtcttacggagccgcttcttcttgcgcaccccctcgggctgcgatgtcggcgcggccccctccgggcgccgactgctggcacgcaccgccccgccccctcggggaggagatggcggaggtgttcctcccagcttcctcttcccctgggcgacggcagggcggctgctccccgagcccccgacgcggggcccagaagcacgaccccctcctggggcaggttgttccccccggcggcgctcgcccgcgccgtcgtggcccttaggggctctctcctctgaggccccgacccccatcataatggttagaatggagacgcggtcgggatcgctgcagagggggaggatctcttgaggaaggcgagacgcctccgcggagctaagattcagcaccctttggactacgatcttgaagtcctcgggagcccaatcccatctggctccctggtgggtccgcatgtagtcttcaggcccagtgtactcccaggcgctccgggcgcgccgttggagcggcgcaatccggcgacggagataatcgccgtacaccatggccccggtgagcccctgggatcgcaggcccgccaggcggtcgaggacggcgtcgtagtcctcccccagatctaccggcgcccgccagctggagacctgcgccgggggctggcttggaagtcggaggcgcgcttcgtcggcaaggggggtgtagaaccggtcgctcttccagtcgtcccacttcttgcggaggacgcaggggatgtagcggttcaacactggcccccgcggctggaagtagcagccgccaaccgctgacggcggtgacaccgactgcacggtgaagaaccaccggaacagctgaagagaggggcgcaccccaatgaacatctcgcacaggtgtgcgaagatggccaatgtcatcaccgcattgggggtgaggtgcgccatctggagatcgtagaactccaggacatccatgaagaaatgagaaaatggcgggaccagcccagccatcgcgaaggggaggaagaagatggaccgccccgggtagtctggtgccgggcgcccctcgcccagcatcactatctcccgaccggtggcggactccggcatgaagcggcgcggcagtccggcgtgcctctcgttcacgatgcgggaaggcggtagtacactgccatcgagcagagcagagccccgtgccatggcggtggaggaagagatgattgggaacgagcgcgtgtggcgaaagtagggcgtagcagagaaagagttagagctcaggcggcaaaggcaagaggaacaatggcgaaaggaagggagcaaatccttttctcgatgcttttatacccttgccatcgctgggcctggctcctcgtttctcgcgcccactacctcgctccctcgtatctcgctatcccgctccctcgtttcctgtgcccacgcttccactaatcccattcgcccgcttacggcgcatgaagtggatatgcggttgtggcaatcgaaacggattgtatcgtgcgcgcgttaattacgctcgccaaccgaagcggcgttaccgtatctccgagcgagacaaatctgctcacccagattcgcgcgctgctcaagtgatgtggcagtcttgaatagaccgcccattatggacaaccaaagttaccaataccaatgtgcatggattgagaccgttgggtattttgcccaactacggagaccggtcccacctgtcaccaggctttaggggtggcgtcacacctgaccgcttcccttgggaagggaaattgctctggcataacgccgggggctactgtcggtgatatgggaccgggagtatcatggccagaggcttgaggcagacacaatcgcccacgtggcctggcaccttcggggacgtcgggcccgagggtgaggtgtccgccctcctcctgattccccccgagggggggtcgggttgcgcttgccccgaccccgagggccgaggcaccccgaccccttaaggaagtctgcgccacatatatgggataagtgagcacagctgtgctcacctaacagcatttattgcggtctggtcaagcgtgtcacgctgcatgcagcgcaatacagcgcgctcttttatccggtctgtgaccagtcacagaccggtcagatcaacggttaggtggcgactggcggtctgacgcacgcctcgccccgtcccgtcaagacgagtgcctctaggcacacgtctccagccggagctagcgtgttacctcttagagatggcacgttagccctggttagatgaataccaggcttcatcctaaccattacaggcaaggtgttacacgaagaagggcaaacatgcacgttgttaatctgacgcgtggtggacaagaatgaccggtctgacactggtcgcgtcagcaacgagcagccacgatcccacgttgcgcccgtctccgccgggagtggaggtaggtgtgggctgtcccatcgaagtgtgattcggacggcaaccatatcaatctccgttcgtaaagagaaggaaagtccagtttggaaagggaagggtgcgtgtggtatccccttgaagtataaaaggaggaccttgcccacagagtagagggttgattctggcgagattgagagcctagaacaagggagagtttggctcacactttgtagctcattcatacacaaatccacaaaaacacaggagtagggtattacgcttggcagcggcccgaacctgtatacatcgccgtgtctcgcgttcccttgctagcagacaatctttccacatacagagagagcttgagatctcaccctaagcccccggccgaaccggcaaaggggggcctgcgcggtctcccggtgaggagccacgagctccgtcagatagtgatattcaaagtatggccgttggtttatttgcataaagctagtttcacaattcttttcacaagcttattatctagcatagactagtccagttttaattccagtatttattacacagcaacggttcttttcaccatccattgtcttcccaaagatggcttcccgttactggctgtaatggttttctggggtttactccttctcgtctctcgagaagatgatccaccagtataaaatcatcatgcatatcccatctcattcaatttaagaatttagagtctagccaagtgtaatacatgtcctgatgctcaatatccgcgagcacggctattcgaatagattggttttactcacactgcagtggatgtacactttacccgtactccgcgacttgcccaacacatgagcctacgtcccaacgaatgagacttgccaaggcaaaacctttcaataacctcacgttggcagtacccgctccatgaacttgcatcctcatgcactccatgaacttgcatcctcatgcactctaggtgtcatgagtttctagcagtgagaggagttctggcgctcccgggaagggaagactcacacatgcattaagttttagttaaattaaatttacacatggcagtcctaccgatggcggcaccactataggcactcgcccctcgcggccccaccaatggctgtcccatcgtaggccctgactcccacacaccaagaataaccactatgcagggatactgccttcgctcggctacgtactccgctaggtctatacccatacgagaagtacggttgtacgagggtcgtttcatgcttaactttacggctcggtccttaactgaccagggacggcactagccttttctggacaccacccaagtaccccagccgccccggtcgaaaacagtgtttagttttgtttctcttttcacaattcatgttatccttgtcatggcaatgtggtgcccatgcctccacatgccgcatctcaactaccttccttaaggtagttgcccaagcatatagcacttgataaatatgagaatgcatgattctaattagcatgactaagcatttgttcaatatcgactaagtacacacgttagcagggtttacaatggtcatacagataatcaatatcaaggcatggcatatttaacaagtagggcattcatattcacatatgtatagcatgtaattttatttaaatcaacataattttcgcaataggttcaacatgctcaaagattagtgatgacttgccttgatcgcagtcttgctatccctgctcctcaatcgactcaacaattccctcggaatctaaatttacgtgcgaaagatcggatttgaactcaattagaattcaaataaattcaccaaaattcaaacagtacaaagcatattgagaaaatgttatcaccagatagatcttgattttagatgaatttaggttcaagtttcattcaattccgagttaagatgagtgagttatgcttgtttaaagattcaattttgaattaattcaaacaattgtgaaatggcactgtgcagccgagaggggcattattacagtggctgacatgtgggccatccccctattttatttctggtttttatttttttaaaggaaatcctattgtgtcattgacaggtgggtccggccccctgttgaatctcctgtgggacccgcatgtcattgagacattcacttaaaacctaatttaattagatttctaagcatccgggcctacatgtcataggttcataataatatcattagttttagggattactgtacactaatgaagtggggtccacatgtcataatctctccctctctcgtgccttctctctctcccgtcgtcttcttcctcgtgctcgcgacgaagcagaggagcggcgcgcgacggtacgacggcccgagccggaacggctcggcgcacggtggggctagcggcggcgcatcaccggatgcccgccggcggcggcggcgaagcgcggcgaccgtccggcgcacggcgcgacggcgcgcgacggcgccgagatcccaaaatcggcggcggcacgatgaggaccaatgtgagcgcaaccaacaacgattcaaccatctagggtccacatggagtatatagaagcaaaaatctagcctaggttgtattggaacgaagtccccccacggtgagctcggccatggcgcggcggcggccggagtcggcacggttacggcggcgcacaccccaaatcgagggggccgttggtttctaggtgaccaggcgggactacaggcgcgagggcttaccacgaagtggcggaacggcgaagttcgacggcgagtggcgcggtgcggtcgaaacaggggcagacggcggtcggcgacggtcgcaagtgttcgatgctcgtactccctcgcgtagcggctcccggctccctccaacagcagcaacggcaacgggcacacctcctaacacaccccgccacccacaccggccgagaggccctgcggcggcggcgcaacccccgcccaccaggtgttcgacacccggcggcggcgcgattttgttttctctgggatggagcaagaactccgggaaaggggagacgaatgagggttcgattttggataaggtcgagctaaaggcgagcttataacagcgagagggagggcgattcctattggataagatcactcgatgactcagccatgtttcgatctctcctaggttcgattcaatgccttgggccggcatgattgcctagacgatagggtcccaggagagggatcattagctgtgggaggaaccccccctattatccagcggtctcggtggggtgcgacaggatggcgacgcgacggtgacaagagcgacggcgacggacagagataacgacttggatagggggcgccgggctatgccctagggtgacgcggggttgtcgtggcggccgttatcactccatcccgagggcgacgtgtgaggggacgggatgacgcgggcacccgtggcggcgcagcctttggcgcgggcttttggcggcttggtcggcggcgggcccacgcggcgtggcatgacgcggtgcggcgcacgggcacgactagtgcggcgcacgagtcggaaagcaggcgcgcggcacggcagcggttggagagggcggcgtcgggtgttcggtcgggttaggcacagatcgaacacctggcgcgcaatgaacagtagcgccaggaaaagaaaaaggaagagaagagaaaggataaggaaaaaggaagggctaatctgcaaaatggcttggaattgagttgtaactctatctattttggattcaagaattcaaacatttgatttgaatatttatttggttattcattagtccccaaatgaatttgcttcccatcatcccaaatacaaatattttaatttgcatttttatttatttattcatatctctaccaaatgatattactctatattggattattccaaaattaacttaaataattggggggttttgatagtcctaaaattaattaaaatattcaatgggtccattattaatacaatagcacattggttgaacttatttgcataacaaggtattcatgtaaattgtaattattatttagatgcgcgtctttactttgatttttccattgagatgatttatagtttggcaagcaatatcaaccataacatccatcatgatgcaaagttttaaaaagtttaaaattttagtgatttttattatcgaggatttttaggatgttacacttaatctcgcgaggactcagtctcctgccacgcgttgcatccgcatctgaagtctacgccgcgtcaccgccgcaatcctttcgccctactccgacgcggtgtccaagtgccgtcctcttccggcctccgatgcggtgtggcggctcctcctttggccgcagcttttcccctcccctcggtcccctcctcccctacgcctctcggctgcccctgtgcggtgcgcagctcgtcctttgtccatggccacaacttgtcccctcccctccgtcccctatgcatctcggctgctggcacctacgcagtctccggcacaggatcacgataccctgagtttctttatggaagatgtatgagagagatgaagtatttctttcctgctggacattgctttgctgctatattcattggaagaatctgctatgttgatgggagaggctgagtttgatttatgttgtgtgccaagttctggacctagttccttgtcttttgatatatgtaatgaacctacttgattttgctgaaagtatgaatgtaataatagtaaaaaagaagtagatgttctgaaagtttgtagtttcttgctctgatgtgtaaactgttctttcgttgtagaccttaaacttactgtttcatcttaaacaaaattaacatcagcggtcattgaacaaattgtcaactatcttgaataaaatggacactattacaactagtgatcccacaaacaaacttctgaaattcttcgatctcttttctttgcttgcccaatttcttcttgcttgtgcgatccatggccaaaagcctttcagccatctcaatatctagcttcgttttttcttctttctgtcccctccttctagggttgctagtgctcgcgatccaatgcataccacagcgatggcgattccacgaacaaaggcttgcgatggcgtcggcggacgagctgccgaggccatattcgccacgctgagctcgtcgccatggtcacctcttcttgttggcgcattgaggttgtcgtcatccagggatagaacgactcccagaagtcggcggcggccagacctggaccggctataggaagggcaagttgggaatgggcaggttggcgacggctggttgcagtgagggaggaagcgaagtccggcgagattggctgcgccgctgctagggatgacggaaggggatcgggaagagacagattaccgggttggggacttgtaccgtctctacaaaaattgactaaccacgcgaaaatccaattctgcccttccaccagttccatacacgtgaacaaagggggaggtaccccgcaccggattcccgtaactcgcggtaccgacaattgtgggtcgtttgatctggctgaatggacggttacgattgcagtaccacgcggtaccaaaaattctgctggacagtaaaaattctcttaatttttataattgtagataagtagagatagagatagagattgaccggtctaacaaaaggtgtagacgtggtacacttgagcgcgtgaaactccatgatgataaggttcgattgttaaaatcctaaggcaaccaagattactatttaatatctattaaaagaaaattacatataaaaattttttgaaaattttatatagatgtagctgtgcaatttctcaattggttagtttctttacagctaatccaggccacccatgttcaagtcctaaacttattagcatttacggctaattattttttcagtcgtagtcctaaacttattagcatttacgggtaattattttttcagtcgtagtggtaggtgatctaccgtcgatagcaagatatccgtggtgacgtcatcaattttaaaatatgttggtccggtatttcggaggtgctcataggggtagggtatatacctgtgtatgtttatagggatgagtatatgtgcctgcatttgtattttgtttcttaaaaacatcatcaatttcgagatatgctggcccgatattttgtagatgctcatgtattcatgcgggtagggtgtatctgtgtatgttcgtatggacgagtatacatatctacgtttttactataccaatcagggttttgccttcaaacctataccaataccaatcagcattggattcgtcagcagatgtgttgatttgcataggtgaccgtctacacggaggagttagcactagtccaataacgaatttcccgtgcggtcgaaagtgattttcgcgtgcggatcttccacccgtctgtaacgaagtgcctgcaaaaattgctatttttgcgtgcgggtggcgcacccgcacacggtggttatgttgcccgcacgtaaaaatgaaaaaccgaaaaaaaatccaaaaaaaaaccctaaccctaaagttgctgccgccaccctcctcgtggtcgtcctcgtcgttgtcgtcatcgctgttgccggatccgccgcctccccaccgtccgagcccgcccacccgccgttaccgccgtgccggccaccactgccgccgcatcctggcaggggacggctaccgccgccagatccgggttgggggcaggtgcctccgccggatccgggcaggggccggtcgctcgccaccgtgcgcacgccatcgagcccgccgctcccggttgcctaccgccaagcccgccgctgccggagccgaaggaggcaaagaggtcggagccagaggagaaggagaaagtggcgctggcgccggtggtgtggcctgcaggatgcgaggtccacgcagccgcgtggtgctagcttagcggaagtgaggagaatattgagcggaggagaggaaagtgtggagaagatggagggggggggagaggagaaaggaaatttgattttttttttgaacaggttcatagggaatgagtatttttccgtgcgggtctattaggaggcccacctgcgaaaattgatttttgcatgtggttttcacacagaaccgcacacaaaaatggaggatgattttcgcagacgcgactagttatctgcaatctaaatgggtccctgtacaagaacattgttttttaagtagtgtagcgaacgtccttctatcaagaggaagtgggaagactataagttacccatctatgctctaaaaatactataagtactccttaatttattacccatcagctaaagatttacgatgttaatagagtcaccaaccatctcgatctagagaactctaaatcaatatggggtttgggataggacaaaggctgtgttcagatgacccttttcccaacccctctccctcattttccacgcgcacgcttttcaaactgctaaccggtgttttttttttacaaaaagtttctatacgaaagttgcttaaaaaatcaaattaatccatttttgtaaaaaaagcaaatacttaattaatcatgcgctaatggattgctctattttccatgatcactgttccggatgggaacttgttctagcgaacacacccaaaatccactaacggagccaatttagagatcagaccaacctctaggtcaatttggattgatttgaagttaaccatctgtctcgtgggcgaatcagaagctttttgagacaaacctatagagcgtatatcacttgtcgacgagctatatctatctatggtatttgtagagtatgaggattgttagtgctagggtatgcacaagattgaggaataagagacagaatatatcgatttttatataggttcggaccccttaactgacaggtaatagctcttctcctgttgaccggagtcattgttgcctttatatattagtctcacacgagtacaacatttgagttgacctaatctagtccctatcgatctagcagcatggagctctcacatgtgatcgacgacttgtgcagtcttattcctcaaacatgaactcgacgaaattgaatatatctctagatccctcatgtccacattgggtttgtctaaatttgtcctcgtgtctctttccttctagggagtcttgtatttatatcattgagtatcctcttatccaagtagaactaggtaactgatacaaacacacccgcaaggggaggctcgatcttcacggtagtaggttttgaaccaaagagcaccggtgtaaaccgtgcacaagaggataactagctttatacctgcaagggttggatgcgaccaagtggtgagggtgagaacgatccgaatcctcttggattccgacccatcaaaccaagcaatcacagaaccataatccaggactaatccacacaagagggggtaagacacttatgcaatcttcaacaatcgtctctcatctatgctttttataaagttaaagcccactaagtataaagctcaacatgcaaacatgctaccttatcattcactagcaacaactaattatcaaatagttcatacaaacatgcaatatcatccatactttatttaattctacaaatcagaatgcaaatagatccaatcatcacctctctcatcatttgcataatatttcaacaaatatatccatcattttttataatacttaacatacatacatccatatattctgtatcaaagcgaagatattatttagtttgtttcatgtttactactaataaatcctaacttttcatttctttttcccctgtcttccgcttcttgcgatacaaattttggccaacaacataaatttcatctataatcctctacaaagtctattaaatttatttctcttcaaatatggcttgaaaaaaaatcagttttatttgttgttaataattaacatcatacttacttcttgctcgattgttgaaagatatatatgttagaaattacttagtaattcttgcagtaaagcgcagggaatcacctagtatatctataaagttcatccccactaagtgtagttaatgttatttctctcttctctcttgaagccgcatcatctcaattatttttagccattgtgtcggtgacatgggaccgggagtatcatgactagaggcttgaggcagacacaatcgcccacgtggcctggcaccctcgggggacgtcgggcccgagggtgatgtgtgcgcccacctcttggtctccccgaggggggggggtcggaccactcctgcctcgcccccgagggccgaggcgccccgacccctcgcgggttctactccgcgtgcatgggttaggtgagcacagcagggctcacctaaccgcatttattgcggctcggctaaacgtgtcacgccgcacgaaatacagtgcactccactcgtttatccggtctgtgaccagtcacagaccggtcaaatcgcgggttaggtggcgacaggcggtctgacgcacgcttcgccccatcccgtcaagacgagagcttctaggcactcgtccccagctggagttagcgtgttacatcccagagatggcacgttagccccggtcgatatatgccaggcttcatcctaaccattacaggcaagatgttgtgtgaagaagggcaaacatgcacgttgctaagctgacgcgtggtggacaagaatgaccgatttgtgatcggtctgacactgctcatgtcgtcagcacacagccacgttcccacgacgcgcctgcctccggcagaagtggaggtaggtgtgtgccgtcccgtcagaaggatgttcggaggacaaccgtgcaaatctccgtccatttatgaagagaagaaaagtccagtttagaaagagaggggtgcatgtggtatccccttgaagtataaaaggaggaccttgcccatagggaagggggatgactttttccagattcagtagctagaagaaaagggagaggttggctcacactttgtagctccttgatacacagatccaccaaaacataggagtagggtgttacgcttctcagcggcccgaacctgtatacatcgcttgtgcttcatgctctttcgataggtcgcgatctttccacatacacagagagcttgggatctcaccctgagcccccggccgaaccggcaaaggggggcccgtgcggtctcccggtgaggagccccgcgctccgtcatctggcgcgccaggtagggggctcagcgtgtgtcttctgagctcttgcgctctttcgtgtgcaccaagcctttcctgttcagcctcatggctgagcaagcaaaggtgcccgacctctctcccagtgtgagtggcgacgacggggagccgaacccacgccgtcgagctcgtactccaccgcctcctccacgccaaagtcctgggcgggagaaggcacccaagagggctgaagggtccgcgacttcggcatccacaggagctgggaaagggcggcgagatggggagcgtcgcctcctcgtctatggtgacggcagcacgccccagggcgcgctccaagctgcgggcgcgctcctacgtcacccgcctgtcgcccatgacccggagtctccagcccaacgatggctggacgacgtggccaaattggtcatgacggcgcggcagcgcctagacgctggtgggcgatcctccgccaccaagacctctggtgctgctaccaccggctccgcgtcgtcaagacggagggcacgacgagcggcagccgctgttcgccgttcggctgccactccttcatcgactccttcgacccgggaagatctgcgtggggagcaggacgcccgcgccagcatcgagcgccggcgtaatgaccgaagtgctgcccacgcaacggaaggcgcttcctcgtccagagtgtcacctcgacacggacgtgggaatcagccctccgtgcccccggttggtggtgtcggctgtagagcctttgtggcgagtcttcggaatgtccgttggcccccaaggttccggcccaccatcgccgaaaaatatgatggcagcgtcaaccccgccgagtttctccaggtctacacgaccgggattgaggccgccgggggtgacgacagggtcatggcgaatttctttcccatggccctgaagggacaggcgcggggttggctaatgaacctgccccccgcgtcggtccactcctgggaggatttgtgccaacagttcaccatgaacttccagggcacatatccgcgccccggtgaggaagcggacttgcacgctgtacagcgaagggacgacgagtcacttcgatcgtacattcagcggttctgtcaagtccgtaataccataccatgcatccctgcacacgcggtaatctacgcgttcagggggggcgtgcggcacaaccgcatgctcgaaaagatcgcctccaaagagccccagactaccgcagagctttttcagctcgcggaccgagtggctcgcaaggaggaggcctggacttggaacccctccggttccggtgtggctgcttcggccgcccccggatccgccgctcagacagggcggcgtgacaggaggaggaagaagaggacagtccgttccgacgacgagggtcatgtcctcgctgtcgagggcgcttcgcgggccacccgaaaggggaggcctgtgagcgacaaaaagaaggaggccagtgctcccagcagggagcgccccaccggcaagtggtgcaccgtccacaatacctccctccatgaccttgcggactgtcgcgcagtcaaaaatttggctgagcggacaagaaagtgggaggaggagaggaggcaggagcgccgggaaggcaagtccccggcggttccttccggccatcggcgaagtgaggctaagcagaaggcccccgccgaggacatcgatgatggcgatgatgacctaggtttccaagagcctggggccaccattgccactgtcaatggaggagcgtgtgctcatgtttctcgccggagcctcaaggctatgaagcgagagcttctggccgcggcccctactcataaggcgacgcgccgggcgcggtggtcggaggttgctctcactttcgaccagaccgaccacccaccgtgcgttgcccgaggagggcagattgcgatggtggtttctcccaccgtttgcaacgtgaagttggggcgtgtcctcattgatggaggagcagccctcaacatcctttcccccgcagcctttgatgccatcaaggccccggggatgatgctccggccgtcccagccaatcatcggtgtgacgccggggcacacttggccgctaggtcatatcgacctcccggtcaccttcggtggacctgccaatttccgcacggagcgggtaaacttcgatgtggcggacctcagtctgccctacaacgtggtcctggggaggcccgcgttggtgaagtttatggcggcggtccactacgcctacctccagatgaagatgccgggccccgatggccccatctctgtccatggcgacctcaaagtcgcgctcgcttgtatggagcagcgcgcggaccgcctcgccgtcgtgtccaagcccgagggtggcgacgagaggcttggctcatctgcccccgccgccccgaggcagcggatagtcacgtgcgatgaggtcccggtcaaggaggttgccctgggcgacggcccgtccaagaccacacggatcggtggtcttctggacggcaaataggaagacgcgctcgtctccttcctgcgggcaaacgctgacgtcttcgcatatagaccggcggatatgctcggggtccccagggaggtgattgagcaccgtctcgccgtgcggccgggcgcaaggccggtccggcagaaagtgcggggggaggccccgaaacgtcaagctttattcgcgaggaggtggcgcgactt

SEQ ID NO: 31536 - DNA, 15797 bp, Oryza sativa
ggtgaggagccacgagctccgtcatctggcgcgccaggtagggggctcagcgtgtgttttctgagctctcagactcttccgtgggcgccaagtttcccttgttcagcctaatggccgagcgagcaaaggcgcacgacctctctccgagtgtgagcggcgacgacggggagctgaatccacgccgtcgagctcgtactcccccatctcctccgcgcccaagccctaagcagggggaggcgcttgagaaggtcgacaagtccatggcatcaccagtcgcaggtggtgcaggaggacggcaagatggggagcgccgcctcctcgtctacggcgacggcagcacgcctcagggtgcgcttcaggctgctggcgcgctcctacgacatccgcctgtcgtccatgacccggagtctccagcccaacgatggctggaagatgtggccaacttggtcatgacggcacagcagcgcctgggtgctggtggacggtccgccaccaccaagacctccggtgccgctaccaccggctccgtgtcgtcaaggcggagggcgcggcgagcggcggcggctgcacgtcattcggctgctactccctcgtcgacaccttcgactcgggaggatcagcatggggagccggatgcccgcctcaacatcgagcgccggcgtaatagccggcgtaccccccgtgcaacggagggtgcctcctcgtccagagtgtcacctcgacatggacgtgaggaccagccctccgtgcctccggctggtggtgttggctgtagagcctttgtggcgagtcttcggaatgtccgttggcccccaaggttccggcccaccatcaccgagaagtacgatgggagcgtcaaccccaccgagtttctccaggtctatacgaccgggatcgaggccgctgggggtgacgacagggtcatggcgaacttctttcccatggccctaaaaggacaggcgcggggttggctgatgaacctgccacccgcgtcggtccactcctgggaagatttgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaatactataccttgcatccctgcacacgcggtgatctacgcgttcagggggggcgtgcggcacaaccgcatgctcgaaaagatcgcttccaaagagccccagactaccgcggagctttttcagctcgcggaccgagtggctcgtaaagaggaagcgtggacatggaactcctccagttccggagtggcagcttcggccgcccccggatccgccgctcagacagggcggcgtgacaggaggaggaagaagaggtcggaccgttccggcgatgagggtcatgtcctcgccgtcgagggcgctccgcgggccacccgaaaggggaggcctgcgagcgacaaaaagaaagaggctggtactcccagcaaggagcgccccgccggcaggtggtgctccgtccacaacacctccctccacgatctcgcggactgtcgcgcagtcaaaaatttggctgagcgaacgaggaagtgggaggaggacaggaggcaggaacgccgtgagggcaagtccccggcggttccttccggcaaacggcgaagtgaggccaagcagaaggcccccgctgttgacatcgatgatggtgatgatgacctaggtttccaagaacctggggccaccattgccaccgtcgatggaggagcgtgtgctcacgtctctcgccggagcttcaaggctatgaagcgagagcttctggccatggcccctactcatgaggcgacgcgtcgggcgcggtggtcggaggttgctctcactttcgaccagaccgaccacccaccgtgcattgcccggggagggcaggttgcgatggtggtttcccccaccatctgcaacgtgaagttgggacgtgtcctcatcgatggaggagcggccctcaacatcctttcccccgcggcttttgatgccatcaaggccccggggatggtgctccgaccgtcccagccgattatcggtgtgacgccggggcacacgtggccattaggtcacatcgacctaccggtcaccttcggtggacccgccaacttccgcacggagcgggtgagcttcgatgtggcggacctcagtctgccctacaacgcggtcctagggaggcccgcgttggtgaagttcatggcggcggtccactacgcctacctccagatgaagatgccgggccccggtggccccatctctgtccatggcgatcttaaggtcgcgctcgcttgcatggagcagcgtgccgaccgcctcgctgctgcatccaagcccgagggtggtgacgagaggcctggcccatctgcccccaccgccccgaggcagcggatcgctacatgcgacgaggtcccggtcaaggaggttgccttgggcgacggcccatccaagaccacacggatcggtggtctcctggatggcaaataggaagacgcgctcgtctccttcctgcgggcaaacgctgacgtcttcgcatatagaccggcggatatgctcggggtccccagggaggtgattgagcaccgtctcgccgtgcggccgggcgcaaggccggtccggcagaaagtgcggcggcaggccccggaacgtcaagtcttcatccgcgaggaggtggcgcgacttctggaggccggattcatccgtgaggtcatccacccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccacagcggggtgcgaccttttgtgttttctagatgcatactctggttaccatcagattcgcatggctagggaggatgaggaaaaaactgcgttcattacccccgtaggaacttattgttatacgacaatgcctttcgggttaaagaatgcaggtcctacttttcaacgtactactcgaatttctttgggtagccaattaggacgtaatgttgaggcttatgtcgatgacttggttgtaaagacgcgcaaccaggaaacgttactttcagatttagcggaaacttttgagagcctccgctccgcccgcataaaattgaaccccgataagtgcgtgtttggtgtacctgcgggcaagcttctcgggttcttggtctctgcccgaggcatcgaggccaaccccaagaagatacgagctatagagcggatgcgcccccccagcaagcttagggatgtgcaatgcgttaccggttgcatggccgccctaagtcgtttcatatcgaggctgggagagaaggcgctacccttatttaaactcctcaaacgctccgggccgtttacttggacggaggaggctgaacgtgctctcactcagttgaaagtgtatctcagctctcccccagttctggtcgccccggagccaaacgagcccctgctgctctacttagcggcgaccccccaagtagttagtgcatcgttggttgtggagcgcgatgaggacaatcctcattccgcgcactctcaccctgtgctgactaggcccgggagtgagcagggaggagaggcccccgagtcgaatagtggcctaaggcccctaacgaccggagtcggcgctctgcccgctcgtcagacggtgctgggtgcccccgaccctcaggaaggccccgaggccactgcgggaaggccgcacctatcgccctttgaccccgaggctaaccctgtgctgactcgacccgggaaagagcagggagaagaggcccccgagccgaacggaggccagaggcccctgacgaccggagttggccctttgcccgcttgtccgacgatgccaggagcccccgacccccaggacggccccgaggccactgagggaaggccgcccctttcatcctccgaccccaaggtcatcggtacagaagacaagtgcgccccgaaaggccacttgaacgaagaacgccccggggatacggcccctagcagagaggatcggccccaccgaagggtgcagcggcctgtctactttgttagtgaggccctccgggacgccaggacccgatacccacaggcccagaagatgctttacgctattctgatggcctcgaggaaactgcgccattatttccaggcgcatcgggtcactgtggttacgtcttaccccctcggtcaaatcttgcataatcgagagggtacaggacgagtggtaaaatgggcaatagagctttctgagttcgatctgcactttgaaccacgccacgctatcaagagccaggccctcgccgattttgtggcagagtggaccccggctccagagaccgtctcaatgcccgaggccagcacgaacccctcacagctgcctcacgccgcccactgggtgatgcaattcgacggttctctgtctcttcagggcgccggtgcaggggtcacgttgacctctccaaacggagacgtcctcagatacttggtccgtctcgactttcgagcgactaacaatatggcagagtacgagggactccttgccggactcagagtggcagctggactggggatccgccgcttcttggtgttaggcgactcccagctagtcgttaaccaggtctgtaaggagtaccggtgctctgacccgcagatggatgcctacgtgcgccaagtacggcgtatggagcgccattttgacgggatagagcttcggcatgtgcccagacgggataatgtgattgccgacgaactctcacggctcgcgtcctcgcgagcccagaccccaccgggcgcctttgaagaaaggcttacccagccgtcggcgcgacccgatcccttaggggagacggatgtgcctgaccggcccccgaggcccgtcggagtccaggcctcgggacccgaagggagcgcttcaagctcccttagattgattgcttggatcgctgagatccaagcatacctcacagataagactctacccgaggaccgcgaagggagtgaacgcgtccatcgcatatccaaacgctacgtgctggtagaagggaccctctatcggcgcgcggctaatggaatcctcctgaagtgcattccacgggaacaaggcgttgagcttcttgctgatatccatgaaggcgagtgcggagcccattccgcctcgcgcaccttggttggcaaggcctttcgtcaaggattctattggccgacagctctcaatgacgcggtcgacctggtccggcgatgcagagcgtgtcagttccacgccaagcaaatccatcagccggcccaggccctgcagatcataccactttcatggccatttgctgtctgggggctcgatatcctgggaccgtttaggcgggccccgggcgggtttgagtacctgtatgtcgcgatcgacaagttcactaagtggcccgaggcttatccggtcatcaagatcgataagcactccgcacttaaattcattaagggcatcacggcccggtttggagtgcctaaccgtattattacggataacggcacccaattcactagtgaactcttcggcgactactgcgaagacatgggcatcaagctctgcttcgcctcacctgcccaccccagaagcaatggtcaagtggagcgcgccaatgcagaaatcctcaaaggccttaaaaccaagaccttcaatattctcaagaagcacggcgattcatggatcgaggagttgccagcggtgctctgggcgaaccgaaccacaccaagccgagcaaccggagagacgccttttttcctcgtctacggcgcagaagcggttctcccatccgagctcaccctgaggtctcctcgggccaccatgtactgcgaggctgatcaagatcagcttcgcagagatgacctcggctacttggaagaacgaaggcggcgtgcggccctccgagccgcacgctaccagcagagcctgcggcgctaccatcagcgccacgttcgggcccgatcactctgcgtcgacgacctcgtcttacgccgcgtccaaaggcgtgctggattgagcaagctctcaccaatgtgggagggtccgtatcgagtgatcggcgtcccccggccgggctccatacggctggccacgggcgacggcactgagttgcctaacccatggaacatcgaacaccttcgtcgcttctacccctgaggggggggtcgggcgtcaggtttcgggctcgggccaaccccgcacccccccctcgggagtgcagggttggccgggggctgccacacatgcacattctcttttctcttatttcagtatttcaataaaagcagtttcaatttcctaagggctgtatctgtgccgttttttcctttttgaagaattttgacttgaaataaaatcactcgtgctcaaccttgccctcgggggctcggttcggtcagctaaaatcgccaaacggggcccagaaccgagccgtgccctggggcgtggtgaactccgggggggaatcggcaaaaacccacaatcgggtcacccataaccctcggtcaccacgttcccggcctggccagcctcgacatgtggatctccccaggcactagccccgacccgcgcctttcgagggctgggacttgggcacgagtccttaaatcaagctaagacacaaaagaggaccacggcacagatcatcctcatctcatttgcatagcaaaataaaattaacacaaagaaaattttcatcatttttgattgcagattaagttgatctatacaaaaaagaggcctgaaggccttagaagaaagaaaaggaaaaaaactggagattagcgggggcctgggggctcaatccgatgcgcccgggtcgccggcctcgtcgtcacggtcgtcagcaccgctggcgtcgccctcctcgtcggagttgggggcgaacgcgagctgaggggccgacccctcgaaactgtggacgatgtggtcggcggcatccctgacccgcacgcgcgcgtcgtcctcggtcccgggagggaactcatccagcgccatccacggagagaagttggggtccctggcctggtagctggccaggacaagctccaccgctccttgagcgaggtccctcgaggatgacttgatgatcttctcgagctcctcggggagctgctggagagctccggccatctttgagaggtgctgagcgaggcctcccaagttggtggagtacttcatcgtttggcccttccagaggcccgcctgccgaccggcgcgatccagacgggagactgcatcccaaagcatgccgggccctatctcgcccgccaagcggagggcctcggcttccccggcggatgaatctagcgcgcgctgcatgtcggtgacgatgtgttcggcatctgcgaggcgggcggctaagtcgctttcgcccgcagccgccccgccgatgcgtgccctcgcgtccagctccttttcccgcgcctcgaggtcggcagcccgctgctccagcgtggctctctcggcgcggacggattccaagttgcggcgcgcctgctccgtcagcgctgcctcacggagggacaggctgtccgccaaccgttgcgcctcggcctcggcctcttcgagagctcgctctcgctcggtaagcgcgtcctcgcggaggcggagtgcggactcctcttcggcgcaggcagactcgtgcgccgccagcgttgcctcccgggaggtgacggcggcctcgcggtccgccaggtccttctccgcgacgcaggcgcgctcctccagcgccatggcgcgtgcctcgagggcctcttcacgccgccggagcgccgcttcggtctccgttgctcgctgctctcgggcagcggcggcatcaaggacctcctgggcggcgtcgagctttttctttagctccgcctcccagctcccgtgttgaaggcggagggagtcctgcgcctcgttcatcacagtggtggcgatgagggcagccccccgctcctcctccacctctcgggcgatctccgccagcgccgtcttacgggcttcaagatctgagacgtgccggcggtgtgctttgcggcctgcttccaccatggcctccaccgagcgccgcccctcctcgacacgcgcccatgcggcgtcgagctccgcacgctccgcctgcagggcctccacctgggcgcttaatccatccaacaccgcggtgttggcggcggctaaggcctgcagaaggggctctgcgctcagcggggcgacggaaggcgtggggaagagctgccttggagaagatgccgcgcggctcggcccgccaatggacgtgccggcctcggggatgtcccccggacctgtttggtcctgggcgtcgcccgaaggagtgggcccaagcgatgcgcccgcggcctcgtcgcgagccatcctagaagctgtcgcctgggcatcgcccgaggaggtgggcccaagcgacgcgcccgcggcctcatcgcgagctgcctcggaagtcgccatcgcctcagcctggcgagcccgggcggcctcctcccgagcggcttcttcggcttggcgagcccgggcggcctcctcccgagcggcttgcggttgtggcagccgagatagatcgtatcgtgcgcgcgttaattacgctcgccgaccgaagcgacgttaccatatctccaggcgaagcaaatcggctcgcccagatttgggcgctgctcaggtgaggtgacagtcttgaagagaccgcccattattgacagccaagttaccattaccgatgcgcatggtttgagaccgttgggtttctgcccaaccatggagaccggtcccacctgtcaccaggctttaggagtggcgtcacgcccgaccgcttcccttgagaagggcgatcgccctggcataacgccgggggctactgtcggtgacatgggaccgggagtatcatgactagaggcttgaggcagacacaatcgcccacgtggcctggcaccctcgggggacgtcgggcccgagggtgatgtgtgcgcccacctcttggtctccccgaggggggggtcggaccactcctgcctcgcccccgagggccgaggcgccccgacccctcgcgggttctactccgcgtgcatgggttaggtgagcacagcagggctcacctaaccgcatttattgcggctcggctaaacgtgtcacgccgcacgaaatacagtgcactccactcgtttatccggtctgtgaccagtcacagaccggtcaaatcgcgggttaggtggcgacaggcggtctgacgcacgcttcgccccatcccgtcaagacgagagcttctaggcactcgtccccagctggagttagcgtgttacatcccaaagatggcacgttagccccggtcgatatatgccaggctttatcctaaccattacaggcaagatgttgtgtgaagaagggcaaacatgcccgttgctaagctgacgcgtggtggacaagaatgaccgatttgtgatcggtctgacactgctcatgtcgtcagcacacagccacgttcccacgacgcgcctgcctccggcagaagtggaggtaggtgtgtcccgtcccgtcagaaggatgttcggaggacacccgtgcaaatctccgtccatttataaagagaagaaaagtccagtttgaaaagagaggggtgcatgtggtatccccttgaagtataaaaggaggaccttgcccatagggaagggggatgactttttccagattcagtagctagaagaaaagggagaggttggctcacactttgtagctccttgatacacagatccaccaaaacacaggagtagggtgttacgcttctcagcggcccgaacctgtatacatcgcttgtgcttcatgctctttcaataggtcgcgatctttccacatacacagagagcttgggatctcaccctgagcccccggccgaaccggcaaaggggggcccgtgcggtctcccggtgaggagccccacgctccgtcacattggatgattcatcaagggtgtaaattgcacctcttcgcattatctaaattgtttttaggctttggatgatttatcaagggtataaattacatctctccccccccaaaaggcataccatacaacccaattatttataacctatggataactgataaaggtaaaaaaataaacacatgaaaaaatcatatagtagggaaaaaagaaaattttagaactcatatatactatattatcacacaattctcctgcagcaacacgtggggtacccatctagtacatgaggttttaattgaacaaaagttgtctaatggataaagtagagtggtatttatactaggaacatccctcctagcttagtgtgaacataagaaaccacatccaagtaatcaaggctaacataaatgagaatgcaaaaagttttctcgggttcgcgcacagcccttcagttcttgcacagccttaagtaaaattactctaacttcttattggaaaatgatattgtaacccttgagaacgttctcaaggtaacctatccttcttggcgtagtgatgatgccttcagatataaaccatagcaatataaaggtagagcatttaggtagtataaactctcactaaaatttgggttaagttgagcaaagagtgagttcacctcttgttgtattttcctagcattgaggtagtataatttaaaaacataaaaagataaaaaacataaattacatttatcattaaaaaatacatccgcttcggtctccttccctcttttctccctgatagatgagatcacaattattattagtgaaaataattttaagttgactttataaacatagattgtatatattatcatatatacgtaactaaattagctccacaatgtttaaaaaagaaaatttataaaatcatattattttacccattatattaacaattataattcttagttaggtgcaccttttattttgtaccattaaattagcaatttatgatctatataaactaatttataacccactattttgaactatttttaataaaaaatattttgctatgataatagaccatcaggtctatcttttgttctaaaaaagcctctaaagatctctttccagtctttgcacgttgcacattgtgtccttgcctagtgggcatatgacctagtgctctacctgaagtagctaagttgatcacaatcgcccataaactttattaaaaacatttcaaaatttataggcacactacacatactaatatatttttactcttatttcaaataaatattgttttgaacaaaaacaaacaaacatacaaaaaagaaagaaattagctgcaaactattgttgatattttggactacaagccaactaattgtgtaggtgaattgtttcctaacataaaacgccttaaaaattcattagaattatggagaaaaaatatgaaaattttaaacttgtacgaacggaaaaaaaatccaaccataattttcatattatattaatctggcttatagattatactaatctattatattatactaatttggcttatagattagtatattagattatactaatctggcttatagattataataatctatcataataatctacttatttgttttagcttatatactcctaataatttagattataataatcctaagctaaatcaaacatggcctaaatcataccttgagttccttaccgtcctaatttttccttttgacaatattgaatggtatgcatgataattgcattctcgatccaaaggttggttcaaaagtcatatgagcttgatctatcttgtaagtcgatgaattgtttttagattcacccgacctatagtttgccctatgagatatgatttttgaacaaactataatatcttgttttaataatatgaatgcccacgtgttgcgtgagtcattcctagtttttctaacaaacgctgtatataagagaattagtattaaaataagagggataccaatcacacagtgaaaaaagtgaatgggatcaagtaaaactatttaattatatgtgatgcgactgcataataaacagttcatttgaatgttttgatcttcttgttggcttatcctagaaattctcatattaataggagagaaagaaaaacagagcccatatagaaatacaatttagaaagagttgaaattcggaattaaaaaataagaaatattggaagaggataatagagtccatatagaaatacaattaagaaataatagaaattcgaaattaaaaataaggaatattataagtagagtacagagttcatatagaaatacaattaaggaataatagaaattcggaattaaaaataaggaataacagaagcagagcatagagtccatataggaatttaaaagtaactaaaattcggaataaacataataaaattaaaagtagagtttagagttcgtataaaaatacaatttacaaataaataaaattcaaaattgaaaagaaacatgggaagaagagtataaagtaatatagcaatacaatttagaagtaaaattcgaaattaaaaattaatgaatattgaaagatgagtttaagtccacatagaaatataattagaaataataaaaattcagaattaaaaaaatattattggaagaagagcctagagtcaactccctacgtcccaaaataaatcaacttctacaattcaaactttgtccgaaaataaatctacctctaccttcttatctactctcggttcacaaatcaaaaaattttattcctttaataccccttacctacctacccaccaatactaatttactaatattaaggggtagtttggacatttatcctctcctttagtgatgcattgggatgctagaatttgtctctttgtggaaaagagggagtatatagaaatacaatttacagataacaaaaattcagaattaaaacaaagaaatattgaaagacgaatctagagtccatataggaatataatttacaaataactaaaatttaatattaaaaataattaataactaacatgtatgtaaaatacaatataaatattacacattagtagtttcgtaaagttagtacaaaatttaaaattatgttgtcattttaatatatttgaataatacattgagaaaacatgtatgttattctatgagagaaaataccatgcgttagtattaaaataagagggataccaatcacatagtgaaaaaaagtgaatgggatcaactaaaactatttctgtagggtatctaatgaacagagaaggcagtagtcttctttgtaccgccggacgtaacggccatgttgctgttgctcgagagcttcttaagcattgtccagatactccatactgcagcgaaacaggctggacgtgtcttcacgcagctgcatactctgatcgcatagagtttgttcggtttgttctggggtcagaacaactacggcatctcgttaacatccaagataaatacggacgaactgctctgcatctcgcagcagagaagcttaattcgaggataatttctgctttattgcttcaccaaggcatagacgtcacactgcttaacaatgacggtcagacggccacctcggttttaactgaagctttagctagcagaaaggacgatgacatcgaccacatctgggtatgtacttccaccatcctataattgttagtatctttatagtatttaaaagttatagtaaaatagttatcactatgatagtgctacttgtcatatcaaccacttcgaattcaaatttctccacattctgcctataaccaccatcctacatctaactatacattatttattataagcggtattatatactccctctgtctcaaaatataacaacttttggactctgacacgatcttcgatatgctactttgaccaactatatcaataaaaataaaatattttaaataaaaagatttgcatattatgatagcttgtctaatgataaatctagaaacatcaattttatatgattgaccttttttattttttttctattaatagtctgttgatgcgaaaaacatacactggcctggaagatctgtttaactcctgtgcaggttcaaaatctcgcctttagattcgtaagcgtgccagttgatttgatcttgcaatcaataagaaagaaagataagaaaaacacggttaaatctatagacgatagctgatcggctagttgccgatgatatatcatttatctctgagccgatgtcatatctgaatcgatcggcagtcattaatgaatgaaataagactaaatctactcgatcggctatagatattaataacatataatctctacttcgatacatatttaaactaagtgattgggatagatcggtcgctgtgccgagacagtataaatcacttaagtcgaaatatatactaaagtattaattatatagatgtttatagcatagccgatcaaaaagatctagcatgtaccagctaatactccgataccactctatactaagatattagaacaagcagaatatatcaaacaagaagcctaatataccttaatgcaataagatcttaatataaatggcagatttagcatatcaatcgaacatataggatataaagtagctaaatcaggtaagatcggctgaaaccccgatactatctctattaattattataaaacaggctagatatcacaattatagatagaacttaatagatcgaactcaaacttaaccgatgcagcattaagcataaagataactgtaggatctaaacaagatgatgaaaacttctaagagatggtagatacccgatacaatccaagttaacaacaaaacatagccctatcggttacttcttaacagcaagaactagccgatgacaagttatatagcacaactaacaaagattgtaaagtatatatgataactcgacgaattacataaacaagattagagtgtcataaagatggaagcactaatcccgagaacgcaaaccgccttgacaagtttacctctagttgaagatcgaatcaatgcagctcaacccgaaagcaagaactcgtcgaaatagaataaaagggtggcgatgcgccgaaagtgttattgaatgtgtgttatttgattacataggctcgggtcatatttatatccgagattacaagatatgtccttgccggacacgattcttatctctaacaaactctaagataccataagtctttgcggcagacttttgcccaaacatatctctaaagaatttacatgagatatccttattaatagctacaattgactttctaaaagctttttctccatcgtggcaatccttatgaagcacgttaattgattctaggaatagcctcgaagccatctttatcagaatcggctataccaactctatcggctgtatcggttatcctctgtccgatccatctcagccgattcagactccagccgatgccttcacagccgacgcatacgctgttcttcaaatctaactctttgccgaatccgccgaatccgcttcgattccaacgtcgaacctaattcatatcttaccaaatttggtcgttaacatagtcaaagttaaaaatgtttgacttgttactatgctaaaaatgcttatacttacacacacatatatatacatatatatatatatatatatatatatatatatatatatatgtatatatatatatatatatataggacactcctatggggcacaatgg

SEQ ID NO: 31537 - DNA, 17402 bp, Oryza sativa
  unsure (1)..(17402): unsure at all n locations
agctcatcaacttatcaacaaaacaactcaaatttaactttatttcacaatccatgattacatacctaactaattatatgtatggatgctatatacctagaatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatggtgcccgggcaccatggagcaccaaacaaatttaatatatatatatatatatatatacatatatatatatacatacacacacatagacacacatatatatacatatacatatgtgtatatatgtgtatagacactaaaaaaatgttcgtgtgttacaacgggtaaatgtgtttttttccagtgatacaatagttactaagaattagtatcgctatatattataattgaaaccgcgctgcctcctacccctcttcgctctgtctgcctgtcttaacttccggaagaaagtttcgtgcctgtacagtgccgaagccgatcttcctttctcggtctcccaaattgattgagggcttttgatcaacttgatctcttctttcaatttttcctaaaaacgcagcgaatccacaaaactcagaggataaaaacaaccggggaaaaatcaccggccgagcatcattcactaccattaaactgagttgaaatctagtgaattaaagccaaattgaaagggggaaatcatgggggaaaggatgattgaggagtggagaatccatttttttaattaattagaggagaaaatgcatgtggaggtagatcgatgtggcggctgtgttagggttcggctcgggcggcacggcggcggctggaggcacacgacaatggtttagacacgtagagacgacatatgaaatcaaatgcatggaatccttgcttatttttttattaggtattaggtattaagatagattagagataaagataaatattagaaaatcaactaaaatgcggatgacgtactaaaattttagcagaaacatcttcaatttttataatatttttataatagtttatatataccccctctcctcctggtgtgcgcctccctctgctctcccatgcccttcctcctccctctcccttttttctttttttctcttttatagaaaattaaaaaaataaattagtgaattcaagatttgaactatgatctcacagtatataccaagttattcttaccaatacatccaatgatgatatttgttttaaggattattgtttgtttttttatcttactttgtgagaaaggaatatagtgatcgattctaatctctttcactaccaccataaaacaaaacatatatattattaggaaactcataacattttactatattcgtgaagtataattatcgtaaaagtacagtaacacgtcacgctactgtaaaacatataggacattactgcacttctgactgtaacactacggtgaaattatagtaaactaggaatcaaagcaaaaaaaaatattgtttaaaacatcttacttgtaaatattgttagtccaagtagcatctcaaagactgtatcaaaaatataaaaatgcttatatttttagtcggggagagtggtaaccaattaatgacacccaaacaaaagtttagagttttcccagctgacatgtaccgctaatccacatccaacctcctgcacgttcgcatccatcgttcgtgcaatcgtgctcattcattgcgcttgacccgactggctagacaacgaccaaacctctcctgacaaaaaaaaactgctcgcgttgccacttctgatcagctatctcatcatttgtcaccttgccttatactaactccatattttaacgttttgtctaacgtttgaccattcgttttattaaaaaatttacattattataatttattttattgtgacttgatttatcatcaaatattcactaagcatgacataaatattttcagattttcataaaaattttgaataaaacgaatggtcaaacgttggtcaaaaagtcaacggcgtcatatattaaaatatggagggatatattaaaatatggagggagtatcatttatcaccttgccttatacccctccgtccaaaaaaacccaacgtaggtagcgatgggacataatacagtataatgaatctagacatggaaatacccagattcatggtactgtataatgtcccatcactatgttaaaacgttggtttttttaacggaggaagtagctcttaaaaccttctcctacctaccgctccatcccatgaaactgaagtaaaaaaaaaaatacccctccataaaaaaaaaactaatcctaacttcagctggtaaaaaaaaatacccgtccatccttaagattagattttttaactttacaagtgtttaacttgtaattattacaagtgattgagtagtactactttgctaaaaaaatctaatgtgttcagagtttgtctttttagcaaaatagtacgtgtaaaaaagttcaggatacccagactgatacgaattggattggaacggaaaaacgagccatcccagatggtactgttgacacgaaaaaatataggtatggaagatctgcttagctctagtgcaggtctaaatcttggtgagatacgggcgtgatagtcagtttgaccctgcaactgacaaaacatacaaattgaagatcaatgagctgatcggttgacaagccgatggagtgattccagccgatgccgatactagccgatagcgatagagttttgagatgtcggctatatgtccaatgtagataatgatacttgagtaaataatgatataatgcaatcggctgatgataatacagtataacagtcatataatccaatagaaaccaatcggctaataatgatatgataggataagtactgatccaaaggataaagcatacatcggctagaggtccgatgtcataaaatccataagattagattgaacagtgaaatctttattgcaatcggctaaatccaaattgtatgtaatccttgtaagccgatacaacgtccagatacctcatcggctaaagccccgatgaaacccttattggcagtcaacaagcatgctagatattacgattctaagcatgacttaatagatcaaatttagttgatgcaacactaaatatgaaaagaaacataatatctggacaatcaagcctatggctgattttaagggtggtagatgtctaagttaatctaatctagcaacacaatttagccgatgccggcagaaaccctaaaacgagaagcagccaatagagctaaattgatatgctaagactagattaacagagacatctgataaataggtaggcaaatatatcatccaaactagagcaattcaagaggtcgaatgtactgatgcagccttgaacgatgccgacgtagacgagacaattgcctaggccggtggaacgttggacttatcccttcgctagagatcgaactgaactaatgcagccccgtgtcaggtgccaaattccactggaggataagtaaaaacctcggtaaagagggtggcgatgcgcttagagtagtattattgatcgtggagataatttacaatgacctgggtgtacatatttatacccatggggagtgttcgcggtatgtcatgagtcccttcgaccagacctaccgaaaccatgcaaccagcgaggattcaggcccaggacgctaagatcatttgggcgaagtcccatggcgaagactatgaagtagaaatcgcgaaggccgaagaatcgcgctggtatccggcaagaccaaatgcatcattgggcgaagggtgtatgccgaaggatggggtcttcgccataacaagcccaactttgaagaggccaaaggggccatcccagccgctcaggcctgttcgccaattggcccattagaggcccatgtatccaaattacaatgtatacccaatcaaacgtccctttcataagggcagccatgtaaattcccctgtaaagcctaaatcctaatgggggaacctttaataggattataaatagcccctagggacatgtgaagtggggaacccaaagaaagatctcaaaataatacatgtactttttccaacactgttgagtaaccacgtccttcgatgtacgcggttgtcgcttcgacaacagctggcgccgaccatggggacctctgagtgaaaccactaagagcgaatgccaccgaagaatgtcgcaaaggagaaggttgctaggcgaatggagtgtgaagcaagaggcgagatggccgccgaagaggtagtagagccttcggcgcccgacgttgaagctggcgtggcaccatcggcttcggcacctgcgctgcaaccaccaccttcggctcctgccgcttcgacggggcaggcgccgaacacggctgcaacagcaagggtgctccagaccagggcggagatcctttcaacgagccaacaggtggcgccccaagctgcttcgccacagcaggctccgacttcgaccgcgctcgccgctgcacaagtcaaccccaacctcgacgcgcaggccgaagctgacatggaggccatgcgtcagaacatggcacgacttcaggacatgcttcgtcagatggaagggcagcagcaggcgtacgaagcggcccgacaagctaaggctgcatcagcacccattctctagtactcggcaggctataacccacctcaagtctatccgcaagcgccgatccaggtctttccgctgcaagtcatgcaagcgccagcgtgcttcgcctgacagccttcagccgtaaccatacacccatcccctcacgtacaagcacaagttcggccggttgctgcccaagtgcatcctccgctactggcacagacatcacaggcgatggtggaaggggtttcagcctggcaagcgcagtttcaagctttccttcaccagctcaactaaccccacaatatttcaagtacaaccccttcgatctgaccggaagggaatgcaagtcagggtgcacccagttggctaccgtcgaaccagcctggtccaggggcttcgccttggagccaaggaccgcagttcgaccccaacactgccattcaagcaccgaccgtccaaccacaggcgacggcaccaagcttcggaaccaatcaagcgccgaaccaggtcgccatggcttggacacagcgtacgttcgacctatccatggcggttccccaagcgtcgccgttcgggaccgggcaaccgaacacgatggcccaacctcatgcgcaagtcatgacttcacccttcaccacaccatatccgcagctggtgccgaacaagccagggggtgagaaggggctaccgctgagcaggggaatcaagattcatccaatcccaccccagtttaagttcccacctgttccgcggtactcgggcaaaacggacccgaaggaatttctgtccatctatgagtccgcaatcgaagccgctcacggcgacgaaaacaccaaggcaaaggtaatccatctcgctctagatggcatcgcccgttcttggtactttaatttaccagccaatagcatttactcatgggagcaattgcgcgatgtttttgttattaactttcaaggcacctatgaggagccgaagacgcagcaacatctactcggcattcgccagaggccgggggaatcgataagggagtacatgcgttgtttctcgtaagcccgatgctaagttcaggacataaccgaagcgtctgtcatcaacgctgcttcggccgggctgctcgaaggcgaactcaaaagaaaaatcgccaacaaggagccgcagacacttgagcacctgcttcgtatcattgatgggtacgcaaggggcgaagaggattctaagcgatggcaagcaatccaagccgagtacgataaggcctccatcgctgctgctcaagcccaagtacaagcacaggtcgccgaaccggctcctctcaccgttcgccaacctcagctgatgaaccaaggacagccgccgaggccaagtcaagcccccatgacttggaggaaattcagaactgaccgcgcaggcaagaccgtgatggctgtcgaagaagtctaagccctccgcaaggagttcgacgcccaacaagcgggcagccatcaacagcctgttcgcaagaaggtcggaaaagacctctactgcgcttaccatggacgttcttcgtacaccatcgagcaatgctgaaacattcgacagcgtggcaacgctcaagatccaaggcctcaacaaggagcagctgtcgaagcacctcgcgaggctgctcaagaacaagtacccccggccgaatagcgccaagacatgaagcgcagagtaatccaagtgattacaagggctgactcgccagcttagccgtcaaaactgcagaagaagatgtagctgcgaatggtgcacaacattgcttcggccgacgaaggggctccacggtacttgaatcagcaaatctctttcgggccggaagatgccgaaggagtgttgttcccgcatcaagaccccttggtgatcttggccgaagtagcgggcttcgaagtccggcaaattctggttgacggaggaagctcggccgatgttattttcgccgaagcttacgccataatgggcttgcccaccctagccctcactcaagcagcagcctggcttcgtggtttcggtggtgaagcagttcaagtcctgggacaagtacaactggcggtggcgttcggcacgaacgagaacaagcgcgaagagcaaatactcttcgacgtcgtcgacatcccatacaactacaacgccatcttcggccgtgcaaccttgaacaagttcaaagccatctcaaaccacaactatctcaagctcaagatgcctagtccggcaggcgtcatcgtggtcaggggcttcagccttcggctacatcatagggcgatttggccgcaattagcagggcagtgcacaatgtacaggccgaaccgcatgaccgtacaaagcacccgcccctcatggcaaggtgatcaaggtgcagatcgacgatgccaatcacacaagatttgtttcgcttgggggcgatatgggcgaaagggaagttgaaaacatcctggaggtgctcaagaaaaacattgacatctttgccttgggacccgataaggtgggaggtgtttcgacagatctcatcatgcatcatctggcggtcaagccgaacaccaaaccaaggaaacagaagttgcgcaagatgtccgccgatcgccaagaagtagcaaaagccgaagtgcaaaagctgctcaaggccggggtgatccgggagatcgaccaccctgagtagttggcgaacctggtactggtgcggaagtcaaacggcaaatagcgcatgtgcgttgatttcacagacctcaacaaggtgtgcccgaaagacgacttcccccggctcagcaagtgggcggcggagttatctcccttcgatctgcattttgtcgcccgcactgctatcaagtcccaagtcctagctgacttcgtggccgaatggacgccggcattcacccctgaacccaagcctgtcgaacaaccttgggtaatgtactccgacggttcgtggtcacaaaagggggcgggtgccgcggcagtactcattttgccaaggggcgtgccgattcggtatgccataaggctgtagttcaacacgaccaacaacacggcagacgtcgtactgnnnnnnnnnnnnnnnnnnnnnnnnnnnnnggttcggcgcttgctcatccgaatagactccaaactagtggcaagccacgttgacaaatcttttgaggcaaaagaagaaggaatgaagaggtatctggaggcaagtcgatctatggaaaagtgtttcaccggcataacggtcgaacacttacctagaggccagaacgaggaagcagacgccctggcgaagtctgttgcttgtggaggcccacattcaccgggcatcttttttgaggtctttgtacgcaccaagtgtgcctactgagagcctggacatcatggcaatcgaccaggcagaactgggcgaggacccaaaggactggcgaacaccgttcgtgaagtaccttaagaacggttggctccagaggacgaagcagaagcgaagctcctacagctcagagccacaagatacaagctgatctcagggcaattgtatcgctcaggggtgctccaaccctttcttcgctgcatctccttcgttgaaggcgaggaaatggcgaagaaaatacaccaggggctgtgcggtgcgcaccaggccgcaagaacggtcgcctccaaagtgtttcgccagggggtgtattggcccactgtgctgaaagtctgtgttgagcaagccaagaagtgcgaaagctgtcagcggcatagccgaagccaggcagcaccccagtatgagctgcaacctatcgctccggtctagccttccgccatatgggggctaaacataatcggccctttcccggtagcgcgaaatgggtacaagtttgcaattgtagcaatcgaatatttctcccgttggatcgaagccgaaccacttggtgcgatcactttggtagcagtacagaaatttgtatggaagaacattgtttgtcatttcggagtgccgaaggaattcatcactgacaatggcaagcaattcgactctgacaagttcagagagatgtgcgaggggataaacctggaaatcaggttcgcttcggtcgcgcacccacagtcaaatggggcggccgaacgtgcaaatggcgctcaagaaaaggcttgagggggcggcaaagggtaaatggctagacgaaatgctatctgttctctgggcccttcggatgacccccactaggccaaccaagttcagcccgttcatgcttctctatggcgacgaagcaatgaccctaatagaactaggagctaattcgccaagggtgatgttctttggaggcgaagatgcgcacgagttgttgctcgaactccttgaagggataagagtcgaagcaatagaacacatgtgcaagtacgctacaagcaccttggcaacttacaacaagaaagttcgaccgatgcagcttttgcctggccatctcgtcctaaggaagaaggcgaacccagtggtggtcggaaagcttgaatcgaagtgggaggggccatacctcatcaaacacaggtccaggacgggctcctttcgcttggcgatgctggaaggcgaagagttcgaccactcctggaacactgcttctcttaagcgtttctatatctagaaagggtggcaccccattcgccaacttgtaaaaatgtacatactattgtataggcctttcggcaactctcgttatgtaagcccttcggcacaaaaataccaaaaaaagaggaaaatgacaaaaaaaatggatgtagggctattatccaacctggaggcctgaaccagtataaaatccttgtgtctttcgcctttttacttatgtgaatgataaatcgtggaaaaaccctaaggcaaacgcctgatcagcgaaagcaccggggggcgaaagaaatcggccgaagcatcgctcaccgaacgttgaaaccgcgacagcttgtttcgggaaataagtaaccgaacaccgcaatactcgagttatgtgaaaacacaagcgcttcttttagcgcggaataccacagatcgaaagcggaagtcgaaagctaaaaagtcagcagacctatttcgctaatatacgcaagggggccgacatgtttcgacctaacgaaagcacgaaaggtgactatgcgaacaatagcgaaaaggaaatgaaacacatctttattaacttcaaaaaatatcaaagaatacatgccatacaacatgctataggtgaaagaaagtaacgggctttacagcctagcttacaagaaaattatatcttcgcccccaaaacaccctccactcccaaaggtgtgatttggcgaacttggttcgtcatcactactaatattatacactaccctaagaggagaagggggcgaaacacaaactaagccatagtggcgctgggcgatcgcttcctagcgatcagtccttcggtgatttcgccaaaagcgggccatgtcctcctgacgttccacatggacatgatcgtagtcgtccagggttcacccggggtgtgcccgcttttggcgtttattatcatctcgcgacaggaatacttaatcttcggcaggtttttaaccgtgacgaatttctcacattcttgttccgccaatccccaaaaggaggccgaacatacacctttcggcgaaaaccctgctaagaaaacataagaaggccaatggcaaagcacatggttaagacgaggcggagcacataaagtgggcgaaaaacgtcgtctcttttttgtgcgcagaataatgaaagcatacatatcaaagccgaagaaacatgataatttactaagacttggttcatctatctcatatattaaaaagggccattttcggctacaatacgaaaggggtagggccaccggccaaatttacatcattcgcccaccgcggcaagcgccaagagaaatctacaaaaaatctaaagaacgggtggagagcctcacacctcggggtgattttggctgacgtccgccccaccgcccacatccattccgccttcttcggccgctggctcttcgccctgctccgcctcctctgcctttgccaagtgttcgagcaggcgcaccttggcggtggatcggcgttctttttgccagaactatttgcgccagccacgaagtgtgagcgaaatgtcctgagagttgacctcccaatcccccttcacaaacttggggagctcgacgatgtgttcgctaccgttctactgcaacaggcccattgtaaaggccgccgacacacgcgcacaacaatcgccgtacgcagtggcgcaatcggagaccgcaccaccagcctgttgtgtccactccgagaaggtgaaggcagaagcatcttcgccagggactcctcgcaccctcgcccccatgtcagtaagggcaaggcgaagcgtacggcacacggtcttggcagattcagtggctttcgacatatcctgcgtgaaccgctgcgcctccgttgaagcggtttcctctgccttgctgacctcttggcaaagagcctccatcttcggctcggtgagattatagtagtcggtcagggggcggaatgagcttgctccttcttaacctcggccttgagacgctcgatctcggcctttgcctcgctccctttctcaagctcagcttggagccgcttgttttcagccttcgcctccttgagggtgttggcgaggctctccatttcaaggctcttgcgacccagttcgtcgtccttagctcgaaaacggcctttaaaaccgtcaagacgagcccgcacggttcgttcggtcgaacaatgagccgcaagaatctatttcgacaaagagaaagagggcgaagatgaatggcatacccgaaacaacagctaaaaggaaagaaatatgaatagcatacccgaacagctaaactcttgatggcggaacagccctcgtcgaactcgttcagctcgaagaataggctcgggctcccagccagagaaacgagattacttacccccttgacgaaggggataaggtccgcccgagtctcgaagtcaccgggggcgaagtgtggcgccgcaagggaatactctgaagccgatgtttcggcaaccgtctttttccacttctggacggcgagcggcgaggccaccggtttgcgcacagggcttccgaagagcctggccgcaaccttcacgacccggtcagcagatgctgaagtcccaagggcaacactccctcccaccccgccaacaccgaccgcagcaccaggagcggtcgaaaacccaggctctgaccagcaggcgaagtaggggtctcgtccgaagactcgtcgtcgtcgctgaaaacgcgagcgacatcgacgagccccatttttttagaggtctttttaaccaaacccctcttcgccaccttgcccgccacaaacgaaaccagcgccttcgccccctccaaatcctttcggcggaggggggagctgttcgactccacccagttttgacatggtcgaggcttggagttggggtgtacccacgcgtctcggtgcggttgtcggcgggctcgtccgcaacctccgtctcgtcctcttccccttcctcttcgccgtcatggtcatcgacagtgtcctcatcatcggcgtcgaagttggtagtggcaggggcccttcgctccggggagccagtttaacttgcctgcgtgtccgcttcatggaagtcccttcatcaccgttggccttatacggcttcgcccggggaggaagattgccatcgtacactcggttcgcccggtcggccgcctgccgtgtaagtagctggctgtattcggtgaccgacacatcaccgatcatcttccgagcttcggtgtcggcctgagcaagagttaacactgcaaaaacgaaacgtgttatcttattaggcgccgaataggaggaaagagcaaaatacagacacatataggaaagcaaaaactcactgtttgccccctctggcatgacgagcttcggcaagccatcgacctcctcgtctgggctcacctcgacttgccacgtctgggagagagggaagatccgaagcatacagaactcttccaccaggtcacggcagctaaggcgggagcagattttgcgaagcagggcgaaccgggcttccatggcaccatcgacagtgaccttgggcttcctattcggcgcgatcgccctgcgacgccatcggagagctttcgccgactcggacccagcctcgaaggggatggattggtaaaaccacttcgatatccagtggcgatcccacttggacatggtgccgttgatcgggcatagatcagagcgctcggggcgaacattgaagttcatgatctcgaacgccgtctttttcgtccctgggggagtgaccaccgtcttcgagtttatggtggcgtaaaaaatagcaccgaagagcccggcgctcgattcgaaaccagcgggccggcacgcctagtcgaagatggcaatccggacgagagccgatgggctcagttgggggagctccacctgaaaaaagcgaagaatctcaggcaacaacacgttgcacggaaaccgaaggcccgcttcgaagaacacagcgaagaccaccgtccggttgtcgccgggcttcggcaccacagcctttcctaaggcgaaggcctgcttctccgccagcacgccggaggtgaccagcttcatcaactcatcctcgtctacaagcgaaaccccgagataggcggtggcgtcatcatcgatcctgccgagatcagggcccgtcacgtaagatgggttcgggttgcgaggggccatggcgaaaagtgcgagcggtggcgaaatctgccgcttgtggagaaaaaaaaaggaacggtcgaaaggcctagtgactcaagaacgccgtgaagtgagagagcggagaaagagaatgctcgcggtgaaaatgacaggggcgtggcggtgaaaaagggtggggggatatataacccacccaggcgtcggttcgccttcccacccaattgtaagccgccacgtgtcacaagggttcgcgaaagagataatccattatatgccactgactttgtcgcacgtctacgatttgccactgactttgtcacgttctacaatatgccatcgacttttgcttaacttctacgatttaccatcaccgttcggttagccaccgttagtactgtacaaatttgtcgaaatgaccaaaatacccctatgacaaaaacttccaaaatttggataaaattatcaaaatattatattataaacataagattgtaaacatccaaaatttgaccaaaaacttgaaatatgatatttcataatttttatccaaattttgaaaccttttctcccaggggtattttggtcattttgaaaaatttgtacagtactaacggagactaaccggacggcgatggtaaattgtagaagttaagcaaaagtcgatggcatattgtagaacatgataaagtcagtggcaaatcgtagacgtgtgataaagtcagtggtaaataatggattctctctttgcgaaatggtaaattcccattcattgagccgcacagtgctaagcccatgagggaagcccgtcactgttcattgcggcccacaaaaagagaacggcttcgctgtttgcaaaaggcgaaagataggaaaatttactaaccgtaaaagtacatatgcacaaagtatacacatttcttgcaggactccagtataggtttcggcaggagcgtcggtcgaaagggggcgcctcatgccataccacatggtttgcacggtctcggccgaagctcataactcacccttgcccgtgaggggcttgttggtggtatgtcatgagacccttcgaccagacctaccgaaaccatgcaacctgtgaggattcaggcccatgacgataagatcatctgggcgaagtcccatggcgaagactatgaagtagagatggcgaaggctgaagaatcgcgttggtatctggcaagaccaaatgcatcattgggcgaagggtgtatgctgaaggatgggggcttcgccataacaagcccaactttgaagaggcccaaggggccatcccagccgcttaggcctgttcgccaattggcccattagaggcccatgtatccaaattacactgtatacccaatcaaacgtccctttcataagggcagccatgtaaattcccctgtaaagcctaaaccctaatgggggaacctgtaataggattataaatagccccgtagggacatgtgaagtggggatcccaaagaaaaatctcaaaatactacatttactttttccaacactgttgagtaaccacgtccttcgacgtacgcggttgtcgcttcgacaacagggagatactagtcctttgtaggacaagaaaaaaactttcctaaaaaataaaaggaaaatataaaatccttataggacactgaacacacttttctaaagataaaaggtaatgaacaaattattcctaattaatagataatttgtcatgtcgcatcctcttgaactacttctgcataagcttcctttaatagattaatttccttaaccgaatatagcagtaatccgactgttgacgatgtgataattctctcatgggcctaccaaattttgtcgttaacaggaaagcatcatattcatttattacttgcatgcagattccagacagcaaagcaaccgcagattcgccagtgatggacagaggtctgctgaaagcagccacatcgggtgtgaagccggctctgcatgacccaagccttctgcttggaaggacagtgcaggggaacacctgcctccacatagcatcggcccatggccacgaggaattctgcaaggatatcttgatgctgaacccgtccctcctctgcactgtaaacgcggatggcgagacgccgttgctcgccaccgtaaaaagcggcaatgtcgctttagcttcttttcttctcagttactactgccgccgccatgacgatcttgatacgagggaggcgatggtgaggcaagacaagcaaggatgcaacgcgctgcaccacaccatccgcaggggacacaggaagcttgcattcgagctgatagaaaaagagcctgccttgacgaaagctgttaacaaacacgatgaatcgcccatgttcatcgcggtgatgaggaatttcaccgatgtgttcgataaactgttggaggttcctgattctgctcacggtggaacctccggatacaatgctctgcatgctgcctttagaaataacaatactggtgagaccctcatcgatctagctatatgtatcgatctagctatatgtgcttgttaaccattaatattatccatgccttcacatttttttctcagatatcgccaaaaagattattgagactcgtcctaaattggcaagagaagagaacagcgcacgggttaatccaatgcaatttggtgtgcttgagaacaagattgacgtgctaaaagtattgttggaacatgatttctctttaggatatataatcagcacaagtggtatccctcttcttggtagtgccgcataccagggccatgttggtgttgctatggagattcttaaacattgtccagatgctccatttctagttgaaaacgatggcaccacatgtctccacatagctgtacaaaaaggtcacataaagtttgtggaatttgttttgcagtcaaaggagctgcggaaactcattaacatgcgagacagaaacggtgaaactgcccttcattatgcaatccggaagtgccatccgaagatcgtcgctcttttactgcaatgtaaagcccaggatgtcacagtgctcgacagcaacggtaaccccccaatctgggtaccaaatgatgccgccgaccatgctaagacgctcaactgggtacgtacgcatatgctctccacaacatatatagcgtctatatatatgtcatcgatttctattctaatatattaaaaaatagtaaacgatgctataatgttgaaaaatatctcctatttaagcaatttgcaaggtataattttcagtcgttaaagagaaaagagtcccactacattcctacctaccagtactataaagcaatcttaaccgttgatctcatttgatcgaaaggtgcagatctatttatacaaccatcccagttagcagtactataaacatgaatgggtattattgtctaagaaaatagatgcggagaggtataatcatcatttagcagtgactaaacctactttttcttcgatgttcgcatgcggttggccgacccgtatgcgtgaaaaggtttgccaaaatcgttattttcccatgcgggttaggcaaccgcttgccaaaataggatttttgcatgcaggcacctaagccagccgtatgcaaaaatattttcgccaaaaaaatataaattcaaaaaaaggcagaaaccctagccgcacaccgcctgccacgccagatcctgccaccacagccgcccgccactggccatgccagatccatgctgcctaggccgccgtcgttccccgcagccgccgtcgctcacagccgtcgtcgatccgcgacctctggccgtcaagcctgcagccgccatagccatcgccatctccgccgccgctcccaccgtcaccggtgctagatccgccgtcgtgcgtggggggtgggagcggccgccatcgccgatgttggcaccgccggatcagccgccctcaccgcccgcagtcgcgggggtcgtagccgcaacaaggtgtgaca

SEQ ID NO: 31538 - DNA, 2493 bp, Oryza sativa
gcccacgctcatttggaggaggagaggagttagaacacgaggagaggagaggagagaaatatcaggagagggagagaggagaggggtgaaaaattttgaagtggtgaggagggaaagagagagcataagagaacaaaaatagattttggcatggtactccttaagaggacggtataaaaaaaaatcttttttttttttttgctacgggtcccccttaaaggatccgtctggagaaatcgatttttgcataagctggcactacgggccgtttggaacctactggagtttggtccagaaaaacgttctttgtagtacaacatgtcagtaaatcaagccgagcccccccgtagaaaactttattaggttatgtgcaggaagtagagaaataactgacccaatatatatagaagaatattatgagagaaatttattcacaagtggagaaaaatacactcactgttacagaaatgagcctttgtgacaggtcatccatcataggtgacttctctcattgattaagggcctgttcactttaatgacattttcaatcataccattttttttacaaagttacttaaaaaaatagatacgtttaatttgttgccatagtcaaacataagaaatcctgccaaaattttactaatattatcatcttgctaaaattttagcattgctaaaaacttggtaaagtttattttggctacaacctaaacatgtcctgaaaagtaacccgtttgataaaatacttaccagggataagctgtagaagacttaattagtgatcatacgctgatatgagttcatctgacgggagttataacccgtcactgaccaccaataatgataagttttcgatgacgggtatagaatctcttaaaaacaagagattgtatatttcgaaaaaaaaaacagggggttgtgcgcatcggggtttgagttggcctttgctcgtatggatttgttgtgcaccggatttgaatggacaagttgctgcaccgggacaacagatttacaagttattgtccctatttacacaccccacccaccattatgtatgagcacaattcccttttcttaactagcagacattactactcattaactatattgacattaattaccaaaatggtgcgttatcactcaccaaatgagcaggcaactgctgctaacacgtagcacactctcaaaccacaggtagagccatcgacttaggtctgtttaaggagcttaatactagaagcagctggttggttgctagtttctgagaatttggaaaaagatatgttttccagcttctggctttagttcatttctggattctaaaactagttctgttatattcaacatggtataggaattacatcgatcatcagtaattcaaggacacttcaaattgtttagttttattttaaatttgcaaacatttgtggcagacataaattgaaacacaaaggtcaagggaagtgggcaagcaccaaaattgtgtgtatagttccatgactatcaatcatattactaccatggccatacataactttgtaataaattaatgcagagtgaagtctccatgcgtatgttgaaagctgacccggaagacaaaggtgaaatctataatcttataaaaacaatcaaagatcaagtaactgagaaagcaaggaaggatataaggacattgactcaaacatacacaagcaacacttctttagtagcaatcctccttgcaacaatcaccttcgccgctgcttttaccttgcctggaggacacagtaataatgctggaagtgaggggcttcctaacatgggtagaaagcttgcatttcaggcattcttgatatctgacacctaggcaatgtgcacgtcacttactgttgccttcgtatgcatcatagcaaggtgggaggatcttcagttcttgctttactacagatcttttactaagaagctcatgtggtttgcatattttgcaaccactaccgcattcgcaactggtttatatacagttttggcccctcaccttccatggttggccattgcaatttgcgttgtgtcagttttgttgcccattctcactaagcttattggtgaatggccagtcctgaagctcaggattcgattgcttggatctttcgagtccgatctcattgatatggtttgatctaaccatcttgtgttgtctagtactttatggttgatagtgttatgcatttaataaattttggatgccgtgaaaagcaaaacttatgtaacgaactttactaagtcaagcttgtactcattaacagtactgttaaaaactgtcagtgttgtttttctatcatttaagtttgttatgatctgctgtatggaacatttcttgaaatctgaggaaatattttgagtcattactacaagaaaaatactttgtagagacatttttctagtactgtagagaaatttttcaaatgcttttacaatagtgtagaggcattttaaaaaatgtctaataagtgtctt

SEQ ID NO: 31539 - DNA, 4681 bp, Oryza sativa
gtttgttgtatagaatgcggcagttccgacactcatgtctacttcgaattggtcgctgaagcccctccaactcaagagcaaggcaagtcatacacaaaccattgatcatattgaacctatttttacaaatccctcgctttctatttaaattgcattgtttttataatgtcatgtgggatggattcctattgtacttagcctattgttatcctatgtcatttatagcttgggaaataattttactggatgattggtttaggtgatgcttggatcaattagcacactatgggtttcacattaactttagtccttaatttaatgattgattaccaccatggtaataagtaaactaaaatatgctaaaatggtgtattgtgggtgcatggttttgatagtcgcacccatgacaattaaggaccggttcccgggaaacactggaagaattactcgtacttaccacaagacaacatgagcaacggctggatttggagtgtagctttttcctagccgacgtactaaggcaagggtgggtgtgatggagtaggatgggtcctatgacgacctctgttgcttccagattcacctaggcatgagggggctgcccactgccggtaggggtgggggcaaaacctgaggtgggcacgattggttagggagggttatacaaagggtcctatcacagtctctttccgaggtaccttggtggtattgaggcgtatgataacatgtcgtggggctgtgtcttgtgggtaaagttgtacacttctaatcagagtaaaattattcgaatagtcatgcccgcggttatgggcagtcaaccagattcactattattagtctcacctgaatatttggacttgttgaatggtttagttcaggtggtttgcttgggcctgtttcaacgtggtttagcattggatagtgatgtttaatattgattaatttatatctagtgttttactatattcaacttgtgattttaaaatgccagctttatgaaaatatcctataccctcctttggtactatcttgcatcatgccttctattggtatggattgttgagtacggtgggtagtactcagtcttactttatttttcccccaaccctcaaaagcaaagtattattcagatggagattattgggaagagtaggcttgttgcggacgtcaaggatgcctgtggatttgtagacgctatgttttctcaagagatcgatgattagttaactcgattatttatttccgatgcatatataagacttatttatatttttgtaagacgtggacctgtgtatcaatattatcgtcaatgtaccctggttggtcctggacagatattttaatacacattctgcttgaaattcgtgttaacgaatttttaggcgttacagacatcacatttcatttcattatatgcaggcattgacagtcagatattatgatttaagaaccatcaacagtcgccatgatggcagcgcaccggttttgccgtggttggaggggtcgttaacgtgaatgaccttggcggcggcggcaacgaagttggcgaggaagaacggtgccagggaagtcgtggccgagggtggagcgtgaggagtcatatgcctacggacgctggcctgttgacggtgaagttgagagctccgaagcagaattcggcccctacagcgaagcggagtgtctggacagattcgaggacaccggggcccacctggacaagttggccggagttgttggcgaaaaatttgaaggagttgaaggagaaaagtttggcggtggggaaagtggcggtttcgcgaacgtggccccgtgaaatgcatgccatctcctcgaagaaaagacgattgagtgccccctaactagcatgccaattttcgatttctaggatcgagaatatgaggtgcgctagatcaaggagagatggtgacatagacgattatcctggtttaggcccttagcatggggtaataccctacgtctggtgatgtagattggatctatgtcaactaaaaagacaagagtgttaccgcttaaggttagtgccagcgcccttatagagctagggcaaccgacgacatgcttcgtacagtatccctcataatccgggtacctaccatctgcttactagggacgagatagacttccttatctcttatccctttctatatatccaaagtattacatgggcctaggacactcagcccaccctatgtagtatgacccaaatgcctgtccttgggtatccgggtaccgtgtgccccatagcatgcatgacggtggaaggaggtgacgacgcgcctcgccgtgatcagcagtcgacgagcgggatggttgcctggttggcagctgcctccgccggtacaccatgcaatgatagaaactacgtcgctgatggtgtgttgagaaggtccagcgagagcaaccaatgggtttgcattccacacttccccagcggcgcgtcgagaacctccagccgtggttgttcacattcgctagtggcgggcggggcagcaacgacgaccaccaccatgggccacagtggcgggggcggcgttcgcgactacatcatcgccaagtgcacatgctcccactggttcggactcctctggtgtggccggcgcgacgactgctacacgaggactcatacacgcggtcaatgttcgacgccatccttgccggctacgtgacggcttcttccacctggatttgcacccaacaccattggtagtgtggcacctgccgcgcaaccacaccgcatgcatggtgagctcgccatcgctcgatctgcttccatggcggagctcgacaaggcttcaagggcggcactattggtatttcttacgatcacagatagaatccgcaagcgcacggatataccaatgtagcacttcccctacggagtattccaagtgtatcgaatccaagggaacgtgtgtgattatcttctcgtcaggttcatccaaggacacaaagctaatgtgggcatagggcagagaggatttccgaatgagaaacagtgtctagggaaagcttaactttaatcgtaacgcaatacttcaggcactggcaacccgctgttcccagatgtcgctctactatgtaccaggacagggaggacttaagtgctcttgagggctgtcaccacctctacacccacctcaaacatactgtgggatacgctacacccacctcaaacatattgtgggatacgcagcaaccactagagattaattacccagacaccacgtttacgcaattaataactactctagtgccgatcaaacactaaagcaatcactataaataaatggactataatgaaccatgatcccgtatgctaattaggaactaaccaagaagtaattctcactaagcaaaccttaattactcacaatgatattttctattaaagcagagtaattaacaagatacaaaagtaagaggagattgccgacaactccgggattcctccgattacttctaccttaatgtaataccccatatattaaaagatttttaggttttttttgtttgggttgatgtcacgccctgaagttcccctcccttgctctaaattcataaaataaatcgtccgaagaaattgtttaatttaacctagagatgaatccctaattaataaatgcaaataataatcggaattggcatgtggaatttttcttgagttctacatgtcaaaattcactaacaggatttttagtggaattttcagagccttggaaataattttaaccaattaaaatgagcaaagtgcaatattaaatccctggaaaatcttttcttctttttctttttcctccttttttctctcttcttgggccgtcggcccagtccgttcgcctcccgcgcgctcgccctcctctcagctgggccggcccactccctccctcctctctccgggtcaccgacaggtggggcccacctgtcggccccttcttcctcctccagccgacggcaccgccgccgccgaaaccgccaccgacgccgccggtttccccgtttcccgcgcccactccgcccgtaccccacgcccacgtcgccgcccaccttccccgcacctcccgccagctcgcgcgcccgcaaacggcgggggatttgaaatttcccccactctctctctcctcctccatttcccccacgtcgccggccaaatcggccacctttccggcctcgtccgcccctcccgagcccatataaaccatccccgcactcccctccacctttttcctctttccgccgctctctcccgtgccctccatcactcccgcaccgctacacccgccgccgccgccttttccactcctccggtcgccgctcgccgccgctggagccgccgccgagccaatttgccaccgccattagcttcgccgccgccaaagctaccccggccgccgcatccccatccaatcccgccatcggggcccgcttctctccgcgcgccggtgagtaccaccatagccgccgccgtcggccatggctctcgctcgtcgtgggcaccctctctccctctaacccctcacacttcctctcttagggtgtcccggagctcggccgccgttcgccgtcgcccttcggtcgctgaccgacgccgattgccgtcttttcctcccgcgccggccgaaccccggagagaactccctctttcttcttaccacgcgcgccg

SEQ ID NO: 31540 - DNA, 8214 bp, Oryza sativa
cccccccccccccccccgcatgcgcgtcgccgcgatgcaccgtcgcccgcgtcgccggccgccgtcgtcttctcgccggccgccgccgtcggaggccgcttgccgccgccgccctcgccctaaccggccggccggcttgaagccgagccgagccaggccgccttcctcctttccccgtgagccgccgcccggtgggccccgcctgccagtacccctccctctccccttgtgccgctgaccagtggggcccgcatgtcggcgccgccccaccccttgctgacgtcagccctggggcaatattgcgcaataaatcgattaagggtttttcttttatagtaaaaacacagagaatcttctaaaaatcataactaattcatccgagctccgattaagtccattcaagtctcagtaaatcaagaaaaatgcaaagaatccattaaaaatggttttgtttcctgtttcagtagtcttatagcatgttttgcttgtgtgctttgtttgtcgcgtaggtttcggccgttccgtcgatccgcagtttctcgaagacgttgctgaggtctcatcagttcgagagcaaggcaagtcatgcaatacaattgatcatattgtacccaatttacaaatatcccgcatttctattaaatattgcattgttttacaatatcatgtgggatgggtcctattactcagctatatgttgtttcccttatgccattgataacttgggtattaaaatgactagatgttggtttaggagatgcttagccatgcttagttcaactagtgcacaaaaggggaccacattaaagcatagacttgattattggcatagctttggtttagtgccaccgtaatggtgttggttaattaaaatacattacatggtgggctgtgggtgcatggttttgctagacgtgcccatggcgattaaggaccggttcgcgggatgccctggaagaacttatcgtacttaccacaagccagcgtgggcaacggctgggcttgtagtgtagcttttctctagccgacgtacccaggcgagggtgggcgtgatggagttgggtcggccggggtgtccggttgatcggcttccggattcaccgcggcacgaaaggggggctgcccgttgcctgctggggacgggggcgaaccctaaggtgtggtgcgatcggttagagggggttatacgaagggtcctgtcacggcctctttccggtatgtcgtggtggcatgtcggtgcacgggaacgtgtcgtggggctgtgtcttgtgggtacagttgtacacctctgatcagagtaaaactattcgaatagccgtgcccgcggttatgggcggtcgaccagattcaccgtgattagtctcacccctagtttagcttaatgaactgattagttcaggtggtggtttgggcctgttgcaacgtggtgtaacgttggacagtgattggttaatatggattaattactacaactgttttactgctttcaactactgctttgaaatgccggctttatgcaaaagaacctttagcctcccttggatatatcttgcatcatacctcctcttccggtatgacttgctgagtacagtgggtagtactcagtcttgctctcttttcccccacaccagagttgaagtccttctcagttgaagatgtctcgaagaggttggtttcgtcgctgccgtcaaggatgcctgtggaatggagtcgcccgctgcaggagtcaagtcttcaggcttagctcgcttttctctttttccgctgcatttgtaatcttttatatttttgtaagacgtggatctgtatgtcaacaattgtcgtttgtgtaccctggctggtcctggacaggggtttaatgcacattcagcttagaaattctggtccgtgaatttctgggcgtgacagttgacttgttaaaataaagatgttaacagaaaaaaataaaagaaaaatatttttagaagtgggccaacatgagaaggcccataaacccagcccattagttctcccctaaaacctagagagaggggaaccgaatcccacctcccctcatagtgccgccacccctctccctggccggtgcctccttcctcctctcctcctgtgttcgcatctctcccatctacagcaaattgctctccctagatctccaccttcatagcttggatcaagaagcgaagtagaaaaacggaacgatgaggagaggagtagaaggaggggttagaccggagtctcccctattgtctcctcacaagttctctaaagaaaccctaggtgaggcttatccccttgttgtatcagtttttctagcatggctttagtgcattaattcgtggttagggaaggctagagaaggagtttgggtatttgtggttcggtttgttgaagttctgcatgtgggcagatttgcagtgcttcagtgtttcgatgttttggggctctaaatgttgttttcttcaaaagtgtataactaggaagttgtatatatgttcggatatatcttctgaccaaagggcgcgatttttatctcaagtggtttaggagatataatttttttagtatgactgttgtttttgtgtcataatctggatagtagtagattgaactatttttggaggggctaaacagtagaatcagcccggctgcctatagacaaagttgtagaggtttttcttagctttccatattggtaaagtacaacctgattgggcgcgtagaactccagttatggttgttttagtgtggacagtctgaaattctggacagattctaaagcttgctttcaagcgcaaattagaccatttaaatagcacaataaaaatatgctttctacatgaaagttgtaggtattgctctgtagattttcaaaatttatacattttccgtcatagccttttcatatttcgagatataaaggtttgaagcagcagtcttgtgtataatccaagtggtgttccttgttattgagttttgatgggatggggcagtaggttcacctttttattgttttatacgcatgtttgaatgtgtttgctaaggttttgtttgtgattaggtggtggtccatcagctcgtgcatgataccaatccttcgttgaaggcaagtgtatgacgaactaattgtgtgattcatggattgtttactctatctatttatttctgatatatttcaacgtgataagtaactgcttgtattcatattattgttcatgccatttagatttcaagttgatcttatgtgtacgatcttattcttgttttaatattctggattctgattctgcttaaataattcaaattccctgcttgccatggatgtgtttcaatttggttctttgattccggtttcaattattcaagtaccatgtgtagtcatggtactgcaatttggttctttattcaagttcccgtggataagcgctgatcacgcttactcggctttgccggcaaatgttaggatgtattcactattgtccggaatggaaactactatttcaattcatgtctgcagggatgggaactactatctcctttgacttggtgtttggaaatgtgtttcctatcaaagaaagaaaatcttctgttcatgctttattgtcaatgatgtgtatatgtgttttctagttccatattgtacttgctgattatttttatactcttgtgttttatttggttttaggtacgcattgagaccgacatgcatgggcgggaagtagcacccttatattcacatctacttgcacactatcaaactatattgcttaggtccataatgacacttaaattatatcctggtttggtcttataataatcttttagatttctaatagttttttctccatggattataaggatggatcgtattatgggaatgatattgctattagtttaacttataattgcctgttgtcatgtccgtatttgcaggggtgactctgccgaaatttctaataattttggaagttagtggtttgagtgtttttttggtgtggcactctaagtacgtgggtacctggggtgttacacttactctctcccttatcattcccataacaataaagtacactaagtcctcttgtaattcatcttatgctttggtgtgtgtgaatgagggagaggagaggggtatttataggtggagagttgccttgggagagtggagatgctccaagcatcctatgagcatattccttctagcttcatctcctcttgacaagtgtcctctctatgacggtttccaccggtagaaaaggacacaaccgtcattgggatgaggagtacaatcgtcataccgaatatgggctggattgggccagctgcgggttccgccgatccaggggttcggccgaaccctgattggctcccctggcccacatctttcttcaggatgctgacatgtgggccccacttcatgatgctccatgttttggtccaaataattgcacattttatatgttgtagcttaaaaccatgtgagttcatgagagcaaaatatgtttccattctttatgctcattctctcccaactttggtggttgatcacctgcatacaaatatacaccaccactcgtggaaattgttagaaataaatcctaccactatgttggaagtttcacatttgtggttttatacaggtattgacgacgttattttggcacttaacagccgtcaacaggcgccgtggagctccaggcggcgtgtctcccctctttgcgttgtctgccgcgttcatcggcatcagcacttgatgccttgagctgaccaactcagtggctgctggcaggggaagagaggtgaggaagatgatgaatcagtctgacatgtcactggtggagaaatgatttgtgctcccgattggtaaccctctgtaaccccggtttttcaactaggactatgaatccgggactaaagaccactatctttagtcccgattcaaatacccgggactaaagatcgatttttagtcctggtcaaccaggactaaagataaaatcgtctttagcccggattaatgttaccaaccgggagtaagggattttttttcttttttgttttttttgcttccactgctgtttttctatttccatctcgagcacaatcgcacaaaaatcacatgcataaatcatttacaaatcacgcacaacacacctaaatcatccacaaaaatcatttacaaatcatacacaacacatgcccatccacaatccacaaatcatccccaaatcaacaaaaaaatctacacatcaattcacaaaataaaaaaaagctccacaggaccacaaccaccacccgaccacctcccctcccggatccggtggaggagagtccgccgccaccctcgcaccgccctagtgccaccgccgccaccccgccggctagctcgccctgccgcctccccctcccagatctggcggaggggaggccgtcgccccgccgcttccccggccgcctcccctcccagatttggcagaggggaggccgccacccctcgccactttcccggccgctcggctcgccccgccgcctcccctccaggaccggcggaggggaggccgcccccgccgccccgccgcttcccttcccctcccactgccggctgttgctaagagggagggagagggagagggagcggcttgatatcgagagagggagaaaaatctctccgcagagagttgagagaggacaatgcggagagatttttctaagtgttgattatataatctggttggtaacagggcggggagaatgacgcagagagggctgatccggatttttcttttgtcccggttggtattaccaacggggactaaaaatagtataagcatgacaccagcctgacaatttgtcccggttggtaaaaaagtaccccgggctttttgaaccaggactaaagatttagtcccagttcttactcaatccaggagtatagtggattttggctgaccgggcaaagatggtttctccagtagtgagtgggacattaattattttcaaatatattttattgacttagatatgattgacacatcagcgccacattggcgaaaccacaatgtttcaaacttcgaacggttttaaaaattgaggggtgtattatacccggttttgaagtaaggggtgtatttcagacaaatgctatatagttgagggtaaaatggaccgaataaaatatgtttgtccgtcgctaatgacgtgcttaatgaatttacgttgcacaattaacaaaaataatccatataaatcgagggtacatttgcaacatttttttttggttttatttgccttttcagtttttttttttggtgttgccatatttctttgacggttgcactgttctccactttttttttcggtcaaatacgatgcagcgctgcacgcttctctcctgctgggcagacgacgcctgcaggctgacggcttttgtcagcggcccaacggcgtcgtcaccatcaccttgcgtccgtccatccggaacagtgcactagagcagttgaacagtgcggggttcctaaccacacagcctagcgctgcgaaccacaactagcgaactagccttatcatttccgttagatgtttggatcaataatgaccgcaaattcatagctgttactgcagctgaccctggaggcctggacgccccatgtcttggaaaaccgtgcacgctttgtatataatcacatgaagcccccgcgtcctgctagacccttctcacagcgccagattttgaagcttgcagcagatcgagatattccagttgggtcgccagctaggtgcacttcaccacttccccttttctcatccacagatcgagttcgattaatttatctttattaggtttattttggttcaaagctaggaggaggcgctctccagttaaaatggttagtcttttgatttagatagtttctaaccgcaaaacacccaacttatttgtcaaataattttcatttccgctggctatcaaaagagagaaaatacgactatacgagcatttgcgaatttaccacttttttttcaattttgcaagcatgccgctcgaacaacagttcaagttgaattttcgcaatgttctagtgacagtcttgcaataacgattcaaaacagtggcaaatttataattaccccaaaataagatgttgaagattcagcaggtttagtgttggccgaacgacagcgattcctcatagtaagaggaacataggtcatttacatataggccttggtagaatctctattgttagatttttttttctaaaaggtatatggaatttttatattgatagtattgatgtctaattcggaatttttgttgggatgatgattatatcattgttcacgtgaaaaatcatgtacgttgctttcttatggtctagcgagaattgttaagcaattaggagtccgactttcaccccaagttagcatgtgagggttttaaaaggatttcttatatgactccttatgtatttacaaaagtgaacgaacataaaaatagacttaaatacgaacggcatatcaaagtatcacagaaaccatctttaatttttgagcactgctcccgtccagcaaacggtaccccaggtaccggtaaccccaggtacaaaacttaatctgaccattgaattagagcggggcacgatcgggattgaacttaatgtagacccccgtttttataacggaatcactcatattaatagtaccatttccctggatcaagtagtctggtactcacggttacattgttgaattatcaagtgcgcatacaaagattgtttagcgcgaattattacatcataggcccgcgggcagtcttagatcataggactaaacggtccacaatacaaacaataacagaaataggtaaggcagcagattataggcagcggctatgccattgccacaggcaacgaccataactaagacctacagagcgccgtcatcctccgcatcctcctgaagataagcatagggatcctcctcgacttcattgccatccactgattaaattttgtaatagcaagagtgagtaccaaccgtactcagcaagccatcataacaacagtgcatatgatagtgtcggtgatatgggaccgggagtatcatggccagaggcttgaggcagacacaatcgcccacgtggcctggcaccttcggggacgtcgggcccgagggtgaggtgtccgccctcctcctgattccccccgaggggggggt

SEQ ID NO: 31541 - DNA, 5721 bp, Oryza sativa
gggtagtactcagtcttgctctcttttcccccacaccagagttgaagtccttctcagatgaagatgtctcgaagaggttggtttcgtcgctgccgtcaaggatgcctgtggaatggagtcgcccgctgcaggagtcaagtcttcaggcttagctcgcttttctctttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggcgtgacaagttggtatcagagccgaccttgaccgtaggacaagccaaatggaaaccctaagagccctctgaaaccttttcatctgcatatgctttttgcacttggatttgtttcgggaaaaattttggggttttgcctctttggtttgtgggaaaaatcttggtcgttcattcggatcggatccttaaaattagctcggtctagggttttagaaaaattttatttggagtttatttgacagtcagtggggaatttatcgggtgatatgcattaggtcgtgtctatattcgatggggcaatgttacgcgcatcatttttcatgcatctagtttatgcattaagctatagtttagtcagtcgcattagtgtctttatccgggttcatgaaaaatgttctatgcataaaaatcatcatgcttggctagttgtttgggccatttgttgcttggtttaaatttggatttgagcatgcattgattcctatcccttgtctaccttagaagtcagacatgttcttcgatcgcaagcgccgctccaagcttcagagtcgccgcccttagctttatcgtcttcttagttttgtttgcttgctagtttccgtgcttaggtttgttgcttgtgggttagtcggcggtcgatatcatgtgtgagtggtatgacagcctttattaggagttgtgtgcctctttttcagtgttttaatcaagattaagataattgcacttaatcttataagaaagattagtttccgagccgtctgttttcttcctttctcttatttctacctatcctcctccagatggtgaagacaaggaatgatccccgtgactccaacgacgccagtggcagcgaagagcagaccgatggagctcatgtcagtggtgcatctggcagcagatcatctccaccgcccgaaaacccaacagtcactcaaatgatgacaatgatgatgcaacagatgcagcaacattaccatcagatgttgcagcaggcgcaacagaaccagcagtttggtcctccaccatcacacgtgtccaaactgttagactttcttcgtatccagccacccactttctcaagcaccaccaacccaatggaggccaatgactggctccgtgctattgagaagaagctgaacctactgcaatgcaacgaccaagagaaagttgcttttgctacacaccagttgcaaggtcccgcttctgcctggtgggataactacgtggcgacccgtctagatgcaacggaggttacttgggcagagttttgtcaaagcttcaggaaggcacagattcctgaagggattatggcacaatagaagagagagttccgtgcgctccagcaaggaaccatgtcagttacagagtacttgcatgagttcaaccgccttgcgcgctacgctcctgaggacgtgcgcaccgatgctgagaagcaggagaagtttttgtttgggctcgacgatgaattgaccaaccagctaatctccggagtctatgaggactttgagaagcttgtggacaaggctatccgccaggaagagcaacgcaacaaaatggaccgaaaaagaaaggcagctcagatcagctttcctcaggggaacaatcagaagcctcgcttcatgacgggacagctaggtgggccttccaccctgatcgtctgtcagcaccgtccctatcacccgagtaacttcgacaacgactacaacggtggcagtcacaacaacagtaagcagcacaaccacaactcgactccacccccactaatggcaccagctcagtcagatccgccagctgtgtcagctcagtcagaacaacccaagaagagggctgtaggaaagccaggaccctgcttcaactgtggcaagcacggccactttgctagcaagtgtccgaagctgaatcgcactggacccaggttcatccaggcccacgccaatcatgtgtctgcagtggaagcacaggcagcaccagaggtcgtgttgggcacgtttccagtgaactcatatccagcaacagttctctttgattcaggtgcctcgcattctttcatttccaaaagatttgctgggacacatggattatcggtagtggaacttaaaataccgatgcaggttcatacccctggaaatgatatgaggacagcacactactgcccctcggtgactatagagatcagaagatcaccgtttctatccaacctcatccttctcgaatctaaagacctggatgtcattcttggaatggattggttgaccagaaacaagggagtgattgactgcgcaagccgcaccatcaccctaaccaacgacaaaggggagaagatcaccttccgttccccagcgtcgcagaagtccgtagcgagtctgaatcaggctgctattgagggtcagacagaaacagtggagaaaagtcccaggaagttggaggatattcctatagtacaagagtatcctgaggtgttcccagaagacctcactacaatgccaccgaagagagaaatcgagttccggatcgatttggcacccgggactactccaatttacaagaggccgtacagaatggcagctaatgagctagcagaggtcaagaagcaggttgacgaacagctgcagaaagggtacatccgaccgagtacttcaccttggggtgctccggttatctttgtggagaagaaagacaagaccaagaggatgtgcgtggattatcgcgcccttaatgaggtcacaatcaagaacaaatatccgttgccaagaattgatgacctgtttgatcagctaaaaggagctaaggtgttttccaagatagacctacgatcaggctatcatcagttgagaattcgggaagaggatattcccaagacagccttcaccactcggtatgggttgtttgagtgcacggttatgtcctttggactcaccaatgcaccggctttcttcatgaacttgatgaacaaagtgtttatggagtttcttgacaagtttgtcgtggtattcattgacgacatacttatttattcaaaatcagaagaggaacatgagcaacatcttcgtctggtacttgagaaattgaaggagcaccagttatatgccaagtttagcaagtgtgacttctggttatcggaggtcaaatttctgggtcacgtcatttctgctcaaggcgtggcagtggatccatcaaatgtggaatcagttacaaagtggaccccaccaaagacagtttctcagatccggagttttcttggacttgcgggctattaccgtcggttcatcgaaaatttctctaagattgccaggcccatgacacagttgctaaagaaagataaaaaattcaaatggtcagctgagtgcaaccaaagttttgaagaactcaagaagaagttagtctccgcaccagttctaattctgccagatcagacgaaagacttccaggtctactgtgatgcatctcgccaaggattgggatgtgtgttgatgcaagaaggcagagtggtcgcatatgcttcgcgacagttgcgcccacacgagaccaattatcccactcatgaccttgagttggcagcagtggttcatgctctgaaaatctggcggcactatcttattggcaaccgctgtgaagtttacactgatcataagagcctgaagtacatcttcacccagcccgacttaaatctccggcaacgaagatggctggagttgattaaagattatgacatggggatacactatcatccaggcaaagcaaatgtggtagcagatgctctgagcagaaagagctattgcaatgcagtatgtaccgaaggcatgtgtgacaaattgcagcaagatcttgagcacctaaatttgggcatcgtagaacacgggtacgtagctgccctagaggcccggcctacgctcgtggatcaagtcagagcagctcaagtaaatgatcctgaaatagctgagctgaaaaagaatatgagggttggaaaagctcgagatttccatgaggatgagaatggcacaatctggttgggagaaagattgtgtgtgcctgacgacaaagaactgaaggatctcatactcacagaagctcatcaaactcagtattcaattcatcccggcagtactaaaatgtaccaggacctcaaagagaaattctggtgggtcagcatgagaagagagatagccgaattcgtcgcactctgcgatgtttgtcagcgagtcaaagcagaacatcagaggcccgcaggactgctacaaccccttcagatcccggaatggaaatgggaagaaatcggaatggatttcataacaggtttgcccagaacatcgtcggggcacgattcaatctgggtggtcgtggatcgactcaccaaagttgctcattttattccagtacacactacctatactgggaaaaggttggcagagctttatctttcaagaatcatgtgtttgcatggggtacctaagaagattgtatctgatcgaggaagtcaattcacttcaaagttttggcagaaactgcaagaagaattggggactcgtttgaatttcagcacggcttatcatccacaaacagatggtcagaccgagcgagtaaatcaaatcttgtaagatatgttgagagcttgtgcacttgactttggtggagcctgggataaaagtctaccgtatgcggaattctcttacaacaacagctatcagtccagtttgcaaatggtaccgtttgaagcattgtacggacgaaagtgccgcacaccacttttctgggatcaaacaggtgagcgccaactgtttgggacagaagtgttaaccgaagcagaggagaaagtcaggaccgtcagggaaagactgcgaatcgcccagtctcggcaaaagagttatgctgataaccgccgaagagagcttactttcgaagcaggggattatgtgtacccttcgtgtcactccgcttcggggagtacaccgcttccaaaccaaaggcaagttggcaccacgctttgtgagaccatacaggatcttggaacgcagaggtgaagtcgcttaccagctagagcttccacctaatatggttggtatccacgatgtgtttcatgtgtctcaactgaagaagtgtttgagggtacctgaggaacaagctagctcagagcacattgacatccaagaagatttgacctacgtggagaagccagttcgtatccttgagaccagtgagagaaggaccagaagcaaggtgatcaggttttgcaaagttcaatggagccaccactcagaggaagaggccacctgggaaagagaagatgaattgaaggccgcccatccgcacctcttcgccagctcttccgaatctcggggccgagattccgtttaagggggtaggtttgtcacgccctgaagttcccctcccttgctctaaattcataaaataaatcg

SEQ ID NO: 31542 - DNA, 1499 bp, Oryza sativa
aagtagttagtgcatcgttggttgtggagcgcgatgaggacaatcctcattccgcgcactctcaccctgtgctgactaggcccgggagtgagcagggaggagaggcccccgagccgaatagtggcctaaggcccctaacgaccggagtcggcgctctgcccgctcgtcagacggtgctgggtgcccccgaccctcaggaaggccccgaggccactgcgggaaggccgcacctatcgccctttgaccccgaggctaaccctgtgctgactcgacccgggaaagagcagggagaagaggcccccgagccgaacggtggcctaaggcccctgacgaccggagtcggcccttcgcccgcttgtccgacgacgccaggagcccccgacccacaggacggccccgaggccactgtgggaaggccgcccctgtcatcctccgaccccgaggtcatcggcacagaagacgagtgcgccccgagaggccacttggacgaagagcgccccggggatacggcccctagcaaagaggatcggccccaccgaaaggtgcagcggcctgtctactttgttagtgaggccctccgggacgccaagacccgataccctcaggcccagaaaatgctttacgctgttctgatggcctcgaggaaactgcgccattattttcaagcgcatcgagttacggtggttacgtcataccccctcggccaaatcttgcataatcgagagggtacaggacgggtggtaaaatgggcgatcgaactttctgagttcgatttgcattttgaaccacgccacgctatcaagagccaggccctcgccgattttgtggcagagtggaccccggctccagagcctgtctcaatccccgaggtcaactcggacccctcgcagccgccacacaccggccactgggtgatgcagtttgacggctccctgtctcttcagggcgccggtgcgggggtcacgttgacctccccgactggagacgtcctgaaatacctggtccgcctcgactttcgagcgaccaataatatggcagagtacgagggactccttgccggactcagagtggcagctggactggggatccgccgcctcctggtgttaggcgactcccagctagttgttaaccaagtctgtaaggagtaccggtgctctgacccgcagatggacgcttacgtacgccaagtgcggcgtatggagcgccattttgacgggatagagcttcggcatgtgcccagacgggataacatgattgccgacgaactctcacggctcgcgtcctcgcgagcccagaccccaccgggcgcctttgaagaaaggcttacccagccgtcggcgcgacctgaccccctaggggagacgggtgtgcctgaccggcccccgaggcccgtcggagtccaggcctcgggacccgaagggagcgctccaagctcccttagattgattgcttggatcgctgagatccaagcatacctcacagataagactctacccgag

SEQ ID NO: 31543 - DNA, 7952 bp, Oryza sativa
ttttctaccgattcataagtgtgcaccacacagcaccagaattacatttgtctaaaaacaactatactattacccgcccccaaaaaaaaactatactatttatcgcagcaccagtgcagcatatatatcagtttctttcctaccacgtctgagatttgttcttgactacagattcatctttgataccctcttaatgttattactgtaccatagctatatatttctttgcttccaatatttatcatcttctttagtccgagtttatttcttataatgtacaacttcctccactacaccggaccaggtcatctgtgacgggtccaaaccctcacttttgacaggtttatcccttggtcacaaattagtggtcactgatgacttaacctcacctgtgaaggttgaaggtccgtcagtggtgagagacacctgtgacgggttacaattagcaaaccattagtggtgagagatatttctaacgagttataattagaacccgtgacagattatgccacctcaaacgagttaaagcagtcaacccgtcacaggtgtgaaaaatcaaccaaaaaaaaacctcgctgcaacaatgatttacagatccacgctgaataatccagaacattttagactacatttctgatccaagaacttacaaggatgatgttacaatgaacataaaaacaaactagtgcaacactgcaaactacttgagaactacaatgtacaccaccttcaagaaaaacaaaacacatcatgtggcttcaacaaacaaatcagtggcaacacatcagtcatccacccctgcgattaatctccagtggcaacacataatgcggcttcaacaagaacacacccggattaaaaacttggcaccgataacttgcaatatctaaaatcaaatcacaagaatacaaaacacatacaaacacatgctcgaagatggaggaggcggcaaggaccggtgctcacaggaggaggtggacactgtagcagccgccgctcggggatgaaggaggcggctagcccttggaggtggctgctcggtgatggaagaggagccggatccggtttcccccgacctggatctggcatcccctaactcgcccttggaggaggcggctagcccttggaggagccggatcaggtgatggaggaggtggctagcccttggaggagccggatctggtgttggagaggctggatttggcatcccctatctcgccgacgttcctgccgggcctcggcttgccgatggacttgacgaggtggctgcagcggccgccggtcctgcctgaactgcctgacgaggtggctgcagtggtcaccggatctcgcccttcctcggccaccggatctcgccacgccgacactcaggggatgggacgccgacgcccggcacatctagccacatctggccggcgcccggcggcatctagccgcatcagcgcccgacggcatctggccgcccggccgaggaagaagggagaaagagagaagggcggaagaagaagggagagcacgggtggaggtggaagaagaagggaggcagaagaaaaaaggataagaccaatgggcgtgggttcggagcagggaggaggttatgacggcgatttttttaatcatctttgacgggcagacaaatatttggcccgtcacaggtgacttacctcacctttgacgggttccgcttttggcccgtcacaggtgactagttacctgtgacgggccatatatttctagcccgtcagaggtgactttacctcagttttgacgggttccatttttgacccgtcacaagtgacattacctgtgacgggtcgccgccggatggctcaccgatgatggcatctcatgatggcatctcataggatccgtcaaaggtgaccctcatcactaaccaacacttatgcccgtcacatatgtgccgtcacaagtgtgaggatctggcgtagtgctctctctttaattgacctatgctttcccacagacaaataaacagtacttgctagcatgaggggaatactgaaaatcggttctaattaatagattgatagctaagtgcatggcaaacacttgtatatatagtttctcccggagtttggagtctcgactcgccttctcttccctttatattgatgcacctcttttctcaatccgcgtttttctttcttcactacttcatcaccaaactctaaatacgaaggaaatacatttttcctgcaggttgctagagttacaatttaggactgggagatgtcaggaatagacactgcaggattttgtgtcatgtaacaatatgtcgaaggcattgaaagttgtgatgctttcatgactgctcacctaattcgttggttccattacaagtaagtggcatgttcggctgctttgtaccgtcgttgcgctgccacagccagaagaaacaacacactgttcttgttggctacagcacagcaaaaataagagcagccgaccagagccaagaatgaagatccatgtagaaaaagaagtacaatggcatgctggaacagaaaacgactgtaaccaagcactcataacccaacctaaattaaaaaaaaaattgccgccagaaattcttattagtgctagttctagccacgattcggcaatggtaagtgcctcatgtaacgttccgcttttcgtgagtcgttaaaaactaattcggcaaaatcctatatgtgaaaatttcgttctttgtgtgagagtataagttgtgccaagatctcaattcaaatctccattgttgttccctctcgtcgccatcaaaatcctccacctcaagattccaattccaattcaatttattccaaaggtcaatcgcctcctttgaatcatcgccaaatacttgtcccgattccacaaatatccgagtccaccttaaatccattccttgattcctccctgaaccctcgagttcggatatcgaatttgaatccaaatccaaactccaattctctccaattcaatttctctgccaaagtctgatttatctccctctggctcgttgggccgattcttcctcccttggcccatctcctccctcagcctcgcacatgcgttgcacgcgccgagcggagccgagagagagctctctcgccctcttgtttttctctctctctcccgtctccgttctctctctcttttctctctggcgccgatttcttgctgccgccatccgaacctccaccgccttcgtcactccggcgccaaatcccccgcccatcgccattcaattttcgccgccgcccatcggtttcccccccccccgccccccgcgcgcgcgctcgcgcatggtcagccgctcggtcgccgccgcgtcagccctgacgccgcccgtgaccgcgcgccgcccagccccgtctgcacgcgtgcgtccaagagacgaaggcagagcctcgctctcacgcgctctcccttctctctcagctcgcccaaaatcggcaaggagccgagctcctttctccctccccctttttgctttttcccttccatcgccaccgtcacctcctctgccgcccgtgagcgccagccgcgcccttgacagccagctgcccccttgaccgcctctcccgagtcgattccttcccatcgaagctcctcactcgccacctataaaatccgcactcccctcccatacctctcgctccctctcctccatcacaccatttccgcctcgccgtttgtcgtcgtcctcgccctcctcttccatcgtgcgtgccggggagctagcgagcacgaggagtcgacgaggagctccgcgccgccccatcctcgcgcctccctcactcttctttcccggccgcacgctctcggtgccgcgccgtccctggagcgccgcctccacgaaagccggacacgccccgccgccggctctcccttctcaccaccaccgccaacgccgttttctctcgccggtgatctccccaccgtacccatccctcctaccacacgctgtgccgcacccgccgccgctcgcctaggctcgccggccatcttgctctgtcctggaggccgcctctcgtcgtcgacctctctcggtgtccctccgctccatctgaggttgggaatgcattccctcggtcccggtggtgctcccgccgcccggaatcgagccctcgtcgagcgccgccactttccctctttcctcgccgccgtcgtctcccctcttgtcaattcctcgtgccaccaccctccttgagcctccttgactctccccgaaccgccgccacagccgctggccttctcctttgcttccgcgccgtgctgcctattcctccgccgccgcgcaaagtcgcgtgccgccgtcggccctcctctcattgattcccggcgccgccaccatccccgagccccctcaaacctccctggcgcgctgttgctgccgctcgcctcgccggccgcgcccgcgccgtgccacccatcccgccgtcgcacggccgccgtcgccagccgccgtcgcgccgcctctccatcatccaagctggtggatggaaccgcctcgaccccctctcgcttccagtgtctacgcctcactccggttcgccgccgttcgccggcgcctctcggccgccgcgagccgttggatcccggctccctttcctccatccaacgtggctgcccgcatggcgttgaccgggcccgccccgcccagtcagccggtcagccgcctcctttctctccccagctcatgggctcggcccactagccgtccccccctcggccttttgagacaaagtgagttcatatgttgtccctccttgccgagcctaacacacatgcaacaagtccatatttcctcccaccatcaaatccgctcccctacacaaaagtccatctttcccccttgttggtcccacatgtcaatgagagattaaagaatattcttgggaatattcttatccacaaattcaataaataatttcatatactccaaattccataaatcctttttctttgttccataaatcaattccttattccaaaatttccataaactatttcctttggtcccgcacgtaagtgacggtcaataatattcttgagaatattatttttataaatttcataagccaatttccccttgttccacaaatatcttccttcgcccagaaattccaattaaacttccaaaattcaatatcttctcaaccgttcatctgattgactccgttccgcttccagtaattccataaaattgagatctatttaatggcactattaattagtctaaataggatttttctttgggtccttgtttaggtttttgattgtttgcgtatagtcgcggttaccggattttcgtcaatcgcgggttttctcgaagattcatgaagctcaatgaagaccttgtgcaaggcaagtcacctttgatcatcttgcacctataatttaaatctaagtatctcttttccgcaaatattgcatgaataggattaacacgagtatttcggccacggcttgcgagatagcttgtcggccccaatcctaattgctgcaattaccctccttgaattattgaacacttaaacctcctttgtcgactgttgtgctttgatgcacgggcatcggaacacctcccctcaaatttaaaacatccaacgatgggtaaaacttggggttttgcaaaagacatggaaaacccgacacatgggtcggtgcttgcgaactgaatgaattttccaaaaccgcagaccgggggacgtaccgggagtacagtttcccgctcttgaacttaacgaccatttccttggaatttcattcgaacataaggcaagtgcgacaacatgggtggaatgtgacacccctggctgagtaattagctaatcgggggaaccatgatgccaagagacatgtggattcaacggggtggtgccggggagaacccccgggcttactggcacagtatggtctgggatctaacctgttgtcggtctgggacccctctcattggcatatggtgaacctgtgtcagcttttgaaatgccttgtcgtgaaagccccaagtcaccagacatgtctgatccacacgggctaggtgaccaaggctagtaacgtcgtgtgggtaaagtgtaccctctctgcagagtttattaaactgttcgaacagccgtgcccacggtcatgggcggatgtgaggttattcctagcgtagtattgtttgactactgctttgtgaaattgctgttgtggaatgggatcgatgtttagaaaatctgcagctgatgggatcagctaggcccgggtggccgtttgaaagttgttggccgggtgccaaccttgaatcaattcaaagactgatacattgcacatactccgaccggacgagacgcaccgtctcatccgtgtcgtttaagaagcactcacttagttgttttaagaaggagtttaactaaaatcaattgtgaaaacaagcagcctttcctttgaagcctgcattaaacacttaattcctatggcttgctgagtacgaaagtactcacccttactctatataaatatatatatagttcctctgccctgaaacttaagatgaagtgaagtgaagaatagggtttcgttctggtccccagccgtcgcctgtggtgttggatgttagaccgttggttccgctgctgttgttgttgttggtgtttcctcgtccgtgtcgtctgttgcattctcaggctgtcctgagctgcaacctaagttaagataaataagtcctctatttattttaaggattacaatgattcatgtttgtcaccgtgggtaccagcgctatgtcctgggactggtactgtgatcacggttttgtaggaagcggttcgcgccgtttttcctacgacacactcctatcaggtgctgttgtacggcggtgccagattggggtgtgacacctcaacagtgctagttttttccacgaaccatcactgccaagatcaatcaaatcagtgttggtttgtttcccgaatcaccactaatacttatcattatcccttatagtatttagggacggagcgtgtaccaacttttgccttcccagagcgtgtccagggacgggtggacaggagatcgatcccatcagaaactagctttatcatattcgttttcatatttttttctcagaatcgaaatcggaatcggaaacccggatacgaaaacggaatcgaatattatcgaatacagatacggagcgaatacaaatcgaaacgaatttggtaacgaatattaatcggaacataaaagcccctcaaattgaccttcacaaatcaacgaagaaatataactcgttattttttttaatagaacatatcaacattttcaattttagtgttaataattttgttatatccgattttgtggtcgagggagacgattcaatcaagagtaagacattacgaggctattattgtgttctaaaaacatgttctattgagttattgtgttcttactgctattattttggccatattttcttgtgactttgttttatcaagtaaaattttgattttcaaaaaatagcaacttcaaataatattttgaagcagtaaataatttcaactgaaaaagttatgaatataaaagttgtagaactcatcaagagctaaaacttttattttggtcatttcttcatccgaccaagtgatagtaacattgttcataaaatttgcatatctcttttataacttatgaaaccatatacgagatatgtaaattttgtaaacaatgttactatcgctttgtcggatcaaaaaatgactagaataaaagttatagatcttgataagttatacaactttgttgttgatgactttttgagttgaaatcatttagtatttgaaaatgttgtttgaaggtgtcatattttgaaatccaaattcaaactatttaaacaaagtcatatagaaaaatgacccaaacaaaagttgttgatcctgatgagttatacaaatttgtta

SEQ ID NO: 31544 - DNA, 3380 bp, Oryza sativa
  unsure (1)..(3380): unsure at all n locations
agctcccgcaactgcgtgcggcggacggcaacggtgacgtcgggggcggggcctcgtgcggcggacggcgacggcgggggctcggcggcgcaaggcgacgacgtgcggcggacggcggcgagtggaaccggccgcgccggcctcggggcggctgggtcatggcgacggcgggaactcggcggtgcgaggcgacggcgtatggcggacggcgacgccggtctcagggcggccggatccagggtcggcggccccgtagccgcgggatccgatgtcgtgaggcgatggcgatggaggggtcttggcggcgtgagtggatgacgtgcggtggatggcgacgagcggatccggcgtgcgacgtgcgacggcgacggcgggaactcggcggcgcgaggcgacggcgtgcagcggacggcgacgagtgattttggatgttgttaatttggattttgctgtttattttgattcggatatccggcaaaaaatgtcggatagtttccggccgaatccgatttccgacaggtaccatcgctattgtattcgaattcgtatccgagaaaaactatccgaattcgtatccgaatccgaaaacatccgaaaaaaatccgaccgcaacaatccgcatccgaaaaacaggattggaactcggaaattatccgtaccactttcatccctaatcccatcagtgttggtttttgtctaaccagcatggataggacaccacatttaaggcttctaggagtatgatagtggtccatgcatagcagtttgtgcggtgtgcgtctactatatgtaataaaaaaaaggtttaggtgccaatgttaaatttttcattcagtaaaaaaatgttaaaaattcttgtggacgaacgagtgaattcacaagagttttccataacaaaatcgaatgaacacagacatgcatgatttaggcttgctctactactcttggaattgttgtagtcaagagctttctgcagcccctctgatcatactgatgcaaagttgcaaaaatatggaacatgcagatatatactgggaatcataaatcattatttgcacgttccatttgcgtgggattcctaattaattactcatgatgtttgtgtcatgtggttttcaaatcttgttaggtaaagtttttcattgccacatcaaaggatgcatatggttatacgagactatgacacgctgtgtgttaaaccgaaattaagtgaagttaagacgaggcaaactgggtagatgagccctagaccatcaaccacatttctcctttcaaatttaattggttttaaaataaagagattttttatttctccaattatatactcacaaagtaggcaatgaacttcagttggatgtaaaagataaacactgtacattaggcgatttaaaggaggctgaatacaccatctaaggacatgttaattgaacaaattttaatcatttatatgggatttgaagattggatatatttggtgcagttaagggaagaaactgttctagacaaaaaaaaaaaactaactagctggtactaatttatcttctcataaaactgctacctatatagcaatgcaagctttaagcctccacttgtgttttgcatgtcactaagtacttcagggctgttgaccactaaggtatatccaactcagctcgttttagatttcaaccaaatatattttaaccaatgtagttcttctagttaggaattttttaaatccacattaactatttctcaacacgacttgtgtgtttagttaggttggagaatgcagttgttcaattttggcatgaggggcatcaggaaaggtcatgcaagcaagaaaaagaatgattggagttgaactggctagtggaccaggagcttctccgtgccatgctactgtccgatgatgcacgctactacgtgctacgtttcgtgttgcaggtgattggaacaacggttattcagggaaggtagctagaccagctgtaatgtagtggagccttattagcgacaagttgcgcactctggatcagagcaatatcaaagtaggatgggaggtattaacctggcaattggtgcctagctagcaggatcgtccttgctaattaccttggcaagtgaaccacactactagggaaaagcattatcgcaatcgggcaaaaacggtcttcgcaagcgtggcggccgtccgtccgtaagcaaacgactgtgaagatcggcaggacgcccgtccgtctgcgaagataattttcgcaggcggacggggctagttcggtccgcctgcaaaaatagtaaccggccgcctgcaaaaaaaaaatatccgcctgcgaagataggtagaaaattttganatttaataataatttgcccgtanattttataatattttgcctgttaatagaaattcttgcaagtagattattatgtacatatattgaaagattatcaagcattaggtactgattaatttacatatattgcataactcaaaagtgttgccaaaatatatatattacaatatttttttacattgtcacttcaaatacgccatccagttatattatggcatagcagtgttccactcccgaagatccttgaattcgtcacttgtcactagggcaccctctgggtcgaagaaatctcctttcacatgtcagcattcatggtgtatgaagttgcacagatcacactggacatttgtgatgcctgtatcgttaaagcttgttcgacgttctaatcttggcaactgcatgcattgaagataaacaatatattagtatcataaatatgtgaagctttctagtacatagtatagatacttacatcctctgcgttaaccctgtacctctcattaaccctaaggaattcgcacgcataatacccgcaaaggacagttcctctaagttgcttgtggacacatcatagaaaaaatagttaaattttgcaattagtgaaacaattggaatacattaagtgagtggagtattactggccaataggtatgtactagcagcttctcccttgtgtgggtctgttctccacccttgaacttgtagtattggtacgcactgtatggatgtcgtaccgtttcacattaaggaggatatttaattataatattcatataaaaatgtaagagtcacaatcacttactactgtaagattgttagaaattctttgtatgactggtgtctgtaatcgagtgggtctaagactaccacggttccgtctttagggtggatgagtaaacagatataatgatcgctatatattaacaacaacattgtttgttagtaccagctaaaataagacatatgtgtagaagataaatgtaccagacttactcaaaattataagcggccatgacgactctcttattttgaaagtgcaagaag

SEQ ID NO: 31545 - DNA, 11010 bp, Oryza sativa
ctttgttgggtgatgcctcattgccttaaaccggatacaggccttgatgatactgcaatatttttgttttaatgattaatcaatgtggttttcgcgtaattgatgaggttactgcaatatttttttactgaagtgtaatttcattcatgttgcacttttcacttatacaaaaatatcggtttgcaatatttttttgctattctaaactacctacctgaaaacaattttgctattctaaactcaatggacagcgtgcaacgttgaagcaggaaagcaccaatccttctattgttgccgttgtctattgctgccttgacgcgggatttaagcaggcgcaccaagtcaaaaccgaacaaacgttttgaagacagggattaggaaaatcaagggaattcatcccacagagattaagtgacatgggaaggatccacttaattcctccctggataggttccccttgggggtttaattccaaggaaccgaacatagccttaagatatacatgtacttcccacaggctagcatgtgctccaggctaaatctaaagtgtagcttaacctaatcaatataccacggcaagggtggacgtgatggagtatggatggaccaggtgatgtgaactagggttcccgattttccgaaaggttatgagaaaaagtcgatttaggtagagtcgcgacacaaatcgatcgggcttctaaacgaacatgctcttgaaccccgcaatcgcagcaccatgtctcctttgattatcacacgtgttgaaatgcggatgacctcgccgagaaggctaatccctatttgcgaatcgaagaacacaaacaagaacaaggaagaatacaaccaaaattgcatataaatgattaagctcacaaattggggtcttacaaaccgatctggcggcgaaactgttcttgacagaataatctaagcaaaaccccaaaggtgacggcgtgtactgatatatagagtttaagttcgtgcaaacaacccttgatgcaactctaatgggttccaacacgatacacggcacaaaagcctaaatacggtgacgcaacaccgggactgattctggacattaacttgttcggtcgattcccgttgactcggaaagaatttgaatgtgggaccagaacaattggaaatgttatcttcttagctttccatccatataaagaacgccccaatccgagtacgtatgcgacctgggcgctcgtttaagtgcagactggtccaggactctaaaacatactcgaagtcgacttggtttgggcctccatcttaacttgacgccctcgttgatcctccatgtcctagatttcaggttggatccctctataccccttccgttagttgaccgctaattgaccgttaaattcctatcataaagttcatttgccctttagaaccaagaaaatattaatttatgaaatatattgatgaagtatataaatttattgtatgcgactattatatttatatgagtttattttgagagatataatctaataaaaaataatatttttgtttctcctccgcgaaggcaaatcaaaaaatattttttatctatggcaaaatttattgttatatatatcaaaaaataatatttttcacgattaaaaactgtatatacatatatagcatattttttatagtagtacaacgttttctataagataaatttatttatgtgctaaataaatatttttttaataactaaaataaattttagttttatgtcatatctaaaaataaatttttatcatagataaaaaattttttgccgtggaggcaaaactaaaatattattttttattaaattatatatcacaaaataaactcataaatataatagtcgcgtacaataaatttatacactccatcaatatatttttcataaatttatattttttttattttaaaaggcaaaatagactttatgataggaatttaatgatcaactagtggttaactaacgaaagaggcatagaaagaaaccaaaatgaaatttaggggtatagaagaaaatgagtaaatctcagccctcaggggtatggaatagattgtgcgaacttttaagggaaccagggaattttctctttttataactagagatcgcgacaagcgttggctgcctacgcctcctggcgccggtttcgagcggatgcagcattcggaccggacgagctgcgtgcgtgtgagcgagcttggagaaccgcgcgcacatggaggggcccgtgcggagggcgggcaagcgggcgcacggcttccacgcccaggcggccaggcggccaggccacacaggggaatgggcgtggccgagccggacccggtcgcggcgcgctttgtcctaccgctgctgctgtttttcgggagagttttttttttgagttaattttagtttgggccaccttctagtaccgatatttcgctttagaccaccttagaactaatgttttcactttggaccgggtatttttacctttgtatcacattagaccaccctcactcttttatccatctacatccaacttgtaatatgtcgaaaaaatagtcttacatatagctgtggtagttcattgacgagtaggaaacggcgtaatcgagatcgttcatatgcttgagaagagagttgggtggtccaaagtgaaacaaagataagtttacccagtctaaagtgaaaatattgcttaaaggtggtctaaagtaaaacataggtaaataaaggtggcccgaagtgaaatttactttttttttttggctggggccacggtttcttttgtgaacaacgcatgtggtatctggtcgaagagattcttcgctttctctctttcgtgtttttttttttaaaaaaaattgtgtcaggtcaaggagattgggagattgggagtttgagatgctgcaagccctgcaactgcaagctgcccgcatgaagcagggtgaaacggactgtggcatgttcctctgcttgattcactcgatgcaaactactactatctcggttttccttaaagccaacgtagtttcgctgtttcttcagcgataagttgctaattgtgggcttatcgccatctctctcatttataccacaagtagcaaggccgtggatatctctttcccttgcaggaagaggaaaacgcaagcaaggccgtttggctggctggctacctcgtcgctcgctctctttccacacatttacgatgggcaactagaaaccatgtcgtttggcctaaacagccaaaaaataagctaaaatttaaatttttgaacttgattttgaagttagttttgagatgcttttaacgtaatttttgttaatgttggcttttaagtcgctacgaacaaatctataaaagttttacttataaattaatttttattttctaataagccattttggcttattaggcaaaatgggtaaccgatgggagcctagaacatgcatgaagtgtgatttcagcgtaatattatcatttccttgtttttactatctaattctcttttacaaagacactcatatcatacgaaaaggctaatgggcgggtgatcgctcccccacccgcccagcgatcacctgcccaccctctcccctatactactagatgtactcctcccttttctcccccttcctcctctccttcttctctttctactgcagtagaccacacaaaattttttgaaaaacaaaagttagaaaaacttatgtatagaaatactatatataaaaaatttgaattcaaattcaaatttgaatcaggtatgtaaacttttgacttataaactttgggtctataaactttaggtgtataaactttagatgtatagaaatactatatatagaaaatatttaaattaaaattcaaatttgaatcagatataattcaaattcaaatttgaattgggtatataaactttaggtggataaactttagatctatagaaatactatatatgaaaaatattttaattcaaattcaaatttgaatcggatatttgaattcaaattcaaatttgaaacgggtatataaactttgacttataaactttaggtctataaactttaggtgtataaactttagatgtatagaaatcctatatataaaaaaatatttgaattcaaattcaaatttgaatcagatatataaacttttgacttataaacttttggtctctaaactttagatgtgtaaactttaggtgtataaactttagatgtataaatttactcaaataggaaagtaatgcggtgccaaaaaaggaaaccaggtggagggagggaggggggaggtggggagcgaatctgatcgctaccccatccccacggcgatcgatcgcccattaggggtaccccatatcatatgcgctcaaggacatgtacaaaggcatttgaaagcttaaaacctaacacataataattcctctatagagctctctaataatagtattctactaacataaaatgatataaccatcgatttggtatggtgtattagtaactactaaatctatggttgggagtaattttggtgtttgtgtgttttttttcattcgttactcatatcgctcaatatgtgttatgtcaccacatcgtccttctatcgattaagagaacttttatatagaaagtatttgtaaaatatgtacacttagcaatttaaaaaacatgctcacgatatacgagaaagtagtcaatctggtaagcatggactaagcctaatatgagtgatcaattgtggaggcattcctcaaatttgttgaatgactccattttcatctctttattagcttttacttttaagtgctaaggtgattgtcagggttacggataagtcataccctctatcctattagtcatgagatatacgaatacggcatatcttacgatatacggaaaggatacatgtaaaataagggaattggcgaattcctatgggaaatatccttcactagtaggaccgtgtcaatatcctactcggagaagggaaggattgtattgtatcgtgtgggatccgatatctccgagttctacttggagaccaagatgatctttggtataaatacataccccctgaggggtataggacacccggcaccacagaagcaatttggaggacttgaagcctatttgccgatagatatcgtcgagaccctctcgacaaggatctcgtcgctaaatcttggagttcaattgttctcttttgtattctatggttttcttcataatcccatataaactagattaaggctattaacttacgaggggcctgaaccagtataatccttatcttttgtatgcttaatgtcgtatcgtgtagatcctcgtaccaatgtatcttaataccctcagaatacagtctacgggtaccccccatcaattgtgattatggacaaacatattttgtttgtcgaaacaactaagctatttagaataaagcgggcaattgaccatcttgtttcccaaccaaaacaatccttaagggcatcctaaatgtatatacaacaatgaacaataacggtgaggtccaatgcaggaagcactagctatagcaagatggcacgacttcagtgatggcaccggtggtggtcgtggatgttatggcagcacggactagcagatgtggtgagatgcggcgacattggctgaagacggggggctagtcttccgtccctttctatgtcaccaatgaacttggtgggcggcggcgacgttaggcagagactaggttagtcccctgtcccttcctctgtcactagggggtgggcagaaaaagagtgaaccgaaaagagcgagaccgagaaattcgatcactagttcgacctcatgagtcgaaagatcgaatgttgatcgatcaattatgttagtccattgcagtaactaaatagacctgacagatcgatatttggtgcattaggtacatataggtgcaacaacccatttaacccaaaattttcccaattttaggctccaacatgctttgatatctgacccatgatagtgaagtgagttgatttgtgatattttttgtgtataatttttttatctagaacttattagagacttggcttgattatcttggaccttttgaaatttcgatcatgaacgagaccaatactgaattacctgagaccaaatttcttggtcttcattatttttcaagaccaatcggtctccagttttagatgaccgaaatttctaaaagaacgaagattgagaccagatttttcgatctgaccgaacatccacccgcatctgtcaccggcagagaggactggcagtgtcggtggacatggtgggtagtggtattggtggctctcggtggcagtgtcctaggggcggtggcggctaggtgagcttcagcgcctagatctgaccacggccaggcgaggacggggggtcagtggttgtcaatgattgggctagctgatgatgcaattgtcgttggcttgcctgacgcatatgaggaccatgccagcagaggctctcggtggtggcgtcctagaggcggcaactaccaagcaagtgtcgacgccaaggtctagctgcggattggtgtgaacgacagtagagtacctctggtgagctcatggcagtaaagacaggtgcatgtcatgcttgacggcttcacgacactctaggagtgatggcgagttcgacagtctgtgaaagacggcggtggcatggtagagctacatcgggtgcactaggggccgtcggaattaatgcggcggcgtaaggggatttggatgatggcgtaggacagtagacacattaattagtagcagatggcattgtgattcgaggcagagatggtgtggcgacaggtagcacaaactgtttcgattctccacttccgccctctcatgttgcaatagaaataataagtcgtcaatgagggttacagctagtttttcttttatgtgtgtgtgttcctgtgtatttctcctagtgagggttggaatctaattacctatatatgttttgcccgtgtatatcttttatagatatagagtcttattatctaataatgaaaaatccattattaaaaaaaaagctatagcaaactccataataatggttaaaacctgtgagagaaattaaggtgggtcctgttaggtcccacttagtttagaaaatattgcttcttgggagttttttattcaagggatcgatgaactaactccctcctgtgggcagcaatattattttattttattttctgttgtgaccaaaccacgagcttatagtgaacattagcatttaatgttttattgtcaggtttataaggatagtcacaagctcgatcacaactcattctttcaacccttgctatgtccgccttaagtgtctaggcctaactatggcattagagattggggctatttggaaattgtctcgttaagcattttattattaatgattgtaatgctctatgtgagggcatcaccaatgtatatattaaagtgatccatatagatgtggctcatataaatagatttttcctatactccctccgggttgataatacttatcattttggacaagggcacggtctccagaaaacaactttgaccattattttctattataatatgtataaaaatgttaacaaatatatgatcttaataaagtactttttaagactaatctatacatgtagtcaccaaatttgaaagacaattattttaaaaatggttcataatcaaatattctaaagtttgacctcacccttatccaaaacgataagtattatcagcccggagggagtaacaatctgtgcaatgtataagagagaggagtagagatacttcctccatcccaaaataagcgcaactatgagtttccgtgtccaactttaatcgtatgttttatttgaaaaaaattatgattagtatttttatagttattagattataatacatgaatagtactttatgtgtgacttatgttttttattttttcaaaaaaattaaataaaacgaacgattaaagttggtcacggaaactcatagctgcgcttattttgggatggagagagtagataatattatttatcccacatagtcgtctatatacatatgagtaacttttgttttttttcatgtggactagtttatacaatgataatagatgattgaatgaaatattatattgtttatagattacttttacacgcctcacaaacgttgcagcaaaaaaaaaaagcaacaaaacaccggtaatgaaactagggagagacgtgatcctagaacgacccctgaaccggacagtcaagacagtgtgaacgtctctcgaatccaagcaagatgacaaagctagaaacacaaagggcttgtgcttttgcaccgggctaaatttattttagtcgggcaccgtcccaagtttccaagaaaaggagccgaaggtccttttccgttcgtgagtgccgtcatccatccacatcgcttttgttccttccctatccatgcggctatcccatcgtcgtttgctttgatttgatgcttgtttcgtggcagcttaccactggaacggaaaaaaacccgcaaagtttagggggcgtgccaatggtgcggggactaacagaagaaattaatcaatgtatagttgattttttagaacaaatcaatgtatagttgtgtactagtgtcactcacgccacccgtctcatatccattcgcatggttgaacttttagggcgtcacggcgtggaacaagcaaaagcacagcactgtatcttggatagtaccaagagctagatggatcgatcgatcagtgagcttaaactgtggtcaactctgcagtggattggagtattctattaaccggtaagagacggcaagccatgcccattcccaaattagactctgtctgagattcctgcgaccaaacaacccacacaccaccacacagatcacaacagcaagttgttttgttttttttttcgtcagaaacagtagaccgaattaagcaacgtgaacgagacgagagcgagacggcgtcaccgccacacatgtagcgtgctgcgtgcgcgccgcatcaacaccaccggaaaacagcaggctccccccggccagtggatcggagtaggagtagtagtacgcgaccacgcgcgcacctgggtgatcgcctggctaagcccacggtttccccgcctccgcccgcggcacggtgaataatctccagcctccgggcgcgccgcaccacgcaaaaacgcaacgcaacgcgcgatttgttatatatatccacccgcgaagtccaacgcctcgatcgatcggttgataaggggaggagaaaaaatacagtagtggagcgagctagctagcgcgcacggggtttcaccctcttctctgtactgcacgacgactggatcgtggtggtggtggtggtgcagcttttgcttgcgtgcgagggggcgtgtcgcgtgctggcccagcttatatagagttgagaacttgagatagatagatggccgtggcgttcccgcctcacatcatggtgctgagcaagatgcagcggctgtacgacgcgtgcgacatgatcttctcttcgccggcgtccgcggcgccgaccatcggggagatcaggtggcttcaacacctccttggtacgtacgttcgtgagttcttcccggcgcatggagtgaagagcgaatccataatatgtgatggcttatgtggtgtgatggtggatctcttgtgtagatggcatggaggcggcggacgtcgggatcgatgacggcgagtcaccgccgtcgtcgtcgtcgtcttcgtgttcgtcgtcggacgacgaggtgagctcgaaggacggccggctcctgccggcgcgggcgttcacgcggatcacctacatgcacatacaccagtgcgccgatttctcggtacgtacgtacgcatcgatcaactaatgcaaagagcagtagcacaatagcagtcttgtgctgtgtacgcgtacgcgacgaggttaattggtcaatggtttggctttggcagatgggcgtgttctgttttccggcgggcgccacgctgccgctgcacgaccacccggagatggtggttttgagcaagctcctgtacggctcggttcgagtcaagtcgtacgattgggtcaccccgccgccgccgtgctccagaaagagtaagcgtgcgttcagtgcccgaatctgattcgttggtagcacccgtgttacgcattagcctcagaagcaaatcgattggttcgtgccgacctgaccaccaagagctaacagtgggagtaacttgttgcgcgcgggcgcaggtggtttggcgagggtggtggcagccgacgaggtccggcacgcgccgtgcaagacgtcggtgctgttcccgcggagcggcggcaacatgcacgcgttcaccgccgtcacgccgtgcgccatcctcgacgtgctcacgccgccgtactcggaggagctcggccggccgtccacctacttcaacgacatccccatcccatctctgccaggtacacgtctcgtcacccccacaaacacacgcgaagaatgcttgattcgatctattatgtgagaatttattttctcgttcacaactttagtactatctgatgattaatctggtagtgtacgtgtcattttgcttgattcaggttttgcttttctggaagagacggacttgccggaggatttcagcgttgcaggggcaccgtacgtcggcccagagcttgagcttgtggtcgatatggatgatgatgacgacgattacgatgattacgacgagtagctagctaggctagctagctcactgctttttcagaagagagctagatgtgctacatagaaattgttgcgtacgtgcaacgttgatgtacatggagcggtttctctttgtggatatatatatatatatatatatatatatatatatatatatatatatatatatatatatgctcttacaatatgggcaccctatgagtaaattgcacctgctgtgcattgatctgtacagaatctactcgaacatccttttaacttc

SEQ ID NO: 31546 - DNA, 21296 bp, Oryza sativa
  unsure (1)..(21296): unsure at all n locations
gtaatgatcacagctgcattggagtccccttagtgggtgaatatggctgtctttagttccacgttaaaattgagagtttaaaaaaattggaacgatgtgacgtaaaagttaaaaggttgtgtgcgtagaaaagtttaatgtgatggaaaagttagaagttcgaagaaaaaataaagttaggaactagcaaggccatgtgtgatcgatgagtcgtgaagctgtgggagagggaaaaaaaagggttatgtgtgattgtgcaaggccgcagtgggaaatgggaatcagtgcggtaaaagtcaggtctaagttagccgcttaatcggacgtttatttgtacgtcaatgccacgaaccaaagaatcgggacgtgttttttccacggttttaaatctccggctacagcggtttgagaagaattatagctatttgctctcacgtacagtttagtcgctatagctccatttagcccgctataactaccgctatagctatttaagaagctaaccgctaaacattttaacctgctatttaaaataatggatttctcaccgccaacgcctgattggccgatcctgcttaatcagccgaaaagcagaggattactcaccactgcttccttctcgcgagtccgcgcctccgttcgctccacgttgcacgcccgcaccctgcaccttgagcagaagcacgaattaattagcagaagaggtcgacgagacgttaacaggaggcggcggcagctaggacgtcaggaggtgacggtacatgtcggaacggtggtcgcagtagcagaaggacaaacactcgtagcaacgatagggaataaaattagcttgcagtcaaggagaggaatgaaagggagaagaggagaggaggtgctacttcaatagtgacagacgcctcatcagctagccaagtagctacgactcgtattatctgctcgtgccttcatacagtatcagtggatatcagttggtatccgagatgtcaaatctgataccctcaggtaccattcttataggtttatacccaaaggtatcagatgacgcatcacacgacgtacctgtgcacaacacctccgagcagcacgatgggttggtgagcaacatgaccattgcaccaccacatcgacggtcaatcgtggctccatatctagcacattcgttggaatccccctctatcatcaccaacaatagggaggaggagctcgctctggtgggagtcttccccgacatccttcgtgtgagtaagatttagcgattgttgccacgccacgagtacaaaaaggaggaggccacggaaaagacacagtccatcaccctcgtcatcagcatgcgctcggggccaatccaacaataaagtgggcctaggcctctcgatctggtgttggtggcctgcttctcgactcgacgggaggcatgaagcagcagagggagcagagagtaggtggatgagtaggagccagtgaggaggagaatgaggagtgatgaaccaatttctggtttgtgcggtcaaaaggagagggaggagaagaacagtaggggaggggggaggaggaggagggagggccacaatgggtaaatcacttgggaattcatgaaccaaatacatgaacttttagaaataagaacaaccttactcagttaatgagttgcttggttggcctactcaatgaaaacattattaaaaccactccataagatatattgtcaccaacttcttattgatagcaatcaaagaaattgatgaatagcttctattccgataatatcaacgacatgtatataaaataaagttgttactcccagtatattgccagcaaccatctttctctaagcgcacacacaccttttctgagcctataggattgaaaagaccaaaacgttggggttgctatttggcgctcacgtgccaacaatagagctggtgtgcgcgccatctggcgccccccacgcacacattttcatttctttttttttttgcaatctttttccctattttggcgcccctcccctcgcgcgtattttccttttttcctgcgttttttcccgattaaaaaatcgttaacacacgtgttttcgaatctcgatatgaaagttttccaatctgaagaaagtttcaaatctagagttgaaagttttcaaattttgacttgaaagttttcaaacctgagttgaaagtttcaaatttgagttaaaagtttttcaaatttgagataaaaagttgaaagttttcaaactttaacttaaaagaattcaaatttcgagtgagagttttcaaagttagagttgaaagtttttaaaatttaatttcaaagtttaaattttgagttgaaattttcaaaatttcagtttagagtttcaagttgtaagttgatattcttaaaatttaggtatggcttttttaagaaaaaaaatagaaagtttttttcacgtatagatttcttctaagtttcaacctttagggaaaaaaaaggaaaatcttaccttaatttctattattatgtaaaacatcatcagccctttagtacagattaaaggcccattcctgtttgtgggccatgaaattagtacataatccccatccggaataagttcactttgagttccttaaaagtgaccagaatctaatccatgaccctaaaccgtaataccggatatctcgacccctcaactattaaaatcggtacaatttgactccctcggcagttttggatggtggtttcctaacatggcgtctacgtggcagtattgactaggtcttcgtcctatgtggcgttgacgtggcgcttaagtggcattagaattaaaaatatatatgcgggcccatttgtcattcacaaaaagaaattgtgggcccactgacatgtggggcccacataaatccctattcctcctccctctcttccttctttctctttctctccctttctcatcggttcttccccttcggccggcggcgggcggtgagggccgaagctgcgctgggtgacgagagcgagcagctggcgggcggcgacgaatggctcgactgcgctggcgtgcacgggaggcggcagagagcagcgggccagctgcaagccgacagtgacgccggcaagcaagcaggcaagtctgcaatttcattatcaccagcagatagatgctactgtagctttgatggggttactagctcagctcgggttcgagctcgtagaatgaattgacgagcacgtcgtcggcgagctccagcctgtcgaactgcttcatcaccaagtcgaagtacgccgggtacgggccggggccgaccttaatgaaccacggcaagccctccagctccagcgccggcaagccgatcagcgcgatggcgccggcctccacggggatgtgtacacggccgcaccacgcgtggccgtacaccacgttgacggcgcacgactgcgtgaagaacgtgaacgccaccgccgctgcggcgcgccacggcgcgcgccaagaggaggaacgcgtcgtagaggaggacgcacacggggcgtccacctccaccccccggcggtggcagcggcctcgtcccggaggagctcgtccaacgtcaccgcccacgctgactcgaggcgatggatgcggagccggcgaggagatgaaccccgatggagaggtcggggaggacgacgccagcagtggcgaggtggaggtgccggcagtggcgaggtggaggcgccggcgacaggaactcatgacgccggcgtggccgcatgggggagagagagagaaggaagagagagagggaggatgaagaagggatgacgtacgggtcccagatatcagtgggtcccgtatgtcagtggacccacaaaattttcttctgaataacaaatgggtcccatatgtatgtttttaatttttaatgccacccaaacgccatttcaacggcagacaaggtcaacattaccacatggacgccacgccagcaaaaccagtttttaaaacttccgaaggagccacgcccccccggtttcgtcagtataggggtcaagatatctggtttatagttcagtggtatggattagattcggatcacttttaagggagtcaaagggaacttattcctccccatccacagatgtggtcaggcatgtattccggcccatccaagtatccacaacgaaatcgcggaaggaaaaccgaccgatctcgatatcacgcgccccacccccacgccgccaaaaatatctcaggaaaacaactgcaaatcacaccacctgtacgctgtagtcctgtaccatgtggtcatgtctttgtcgtgcacggaggaagaaaaaaaaggaaaaaaaaaccggcaaactttctcatttgccagtttttctcaccagcaacagcaaacgacggcagcttcctgcaccgaacgatccggcttacatatctccctccgaaagctcactttctcatttgccagtttgtttttctccctccacagtgcacagccatggttgcgccgtctcggctcccatcccatgaggagcaatccgccgccgccgcagccgacggctcggccacaccgtcccaaggaatccccgtcgtcgatctcggcgtcctcatcaacggcgcggccgacgagcggtcgcgggcgatccgcgacctaggcagggcatgcgaggattggggcttcttcatggtaagttggggtatctctcaaaacgaacatatccttaattttgttatgtctcgtctagaatgtgaaagaaaaaagaaagttttctccgtttacttcggaaacgaactatttcaaatacgaaaatttctacgagctgtttgattgtttgttaattaaagtatattgtgtgataatgatcgcatttatcagtaacaactccaattcgtcagtgacatgattgattgctagatcgtctcatctgaatctttcatgaatgaattaaggtgactaaccatggggtgcccgaggctctccgagaagcaatcatggacgcctgcaaggagctgttcagattacctttggaggagaagaaagagtacatgcgtgccaagccgatggatcctatacggatcggtacaggtttctactctgtcgtcgacgccgtaccatgcaggagggactacctgaagatgttctctcatcctgaattccactgccccgaaaagcccgcaaagctgaggtacatccatgatcattattaccaatcgtaaaaattcttcgccattgacatcatcgaccggtgtaatgtgaagattttcttgtggtttccttcctctaaagaaagatttgtgatgtgtcaacaatgtcagggagattgcaacggagtacgcgacctgcacgagagccctgttgctggagctcaccaaggcgatctccgagagcctgggcctcgccggcggccgcctctctgaagcgctcaacctcgagtcctgcttccagatcttggtggggaaccattaccctgcgtgctctagaccggacgagcaggcgatgggattatcggctcactccgaccatggcctcctcaccctgctcttccagaacggcgtcgatggcctccaggtcaagcacgatggcgaatggctcctcgcgaagcccctcccgggctccttcttcgtcatcgccggcgatcagttggaggtattggatcaacaatcactatgcgtgttcttgagaagtttatgaaactgtgaaatggattttaaactcttgaagggatatctttatgttatttttttagataatgatctttatgttatttacatatcatctaaatagttataaaaaatatatataaaaagatgaattaatatatgatataatatattactccacaaacatacaaactaaaattcaacttctacgagtcaaaaaaattaaacttatattcgctttcaaatttgtttgttcattataacatgttaaatttaaccttgtatgtttacggagtggtgtattgatattaatctatgttattaattttttttaaaaaaattataaccatttggatagcatgtaaacagaggggatatcttatcgagaatttagaatagtgtgcgagattcagctcagtatgcacttgtgttggtgtgaacatgcgtgcagattgtgaccaacggaaggtacaagggcgtgctccaccgcgcggtggtcggcggcgagcagtcgaggatgtcgttcgtgagcctgatcgggccgtgcatggacaccgtcgtcgagccgctgccggagatggcggcggacggccggggcctggagttccgggggatcaggtacagggactacatggagatgcagcagagcaacagcatcaacgagaagacggcgcttgacatcgttcgcgtgatgcatcaggccgggtgacatgttgacatgccaaggaggcagtgccatgttaggaattgggccggctgcactacgacccaacacagtgagtagcccaatccttggcccaagcaagattctagtgaagaaggttgctaacatgccagtacgtgaacagttcagcagaagctgatcctgcagggcctgtgtagtttgcaggcgctgattcgttgtaaagctcgaactgtgatatgtggaatgttcatcatcatcatatggaaaataaatgccaagtccgagtttaattccaaactttttctttaaacttcccacttttctattacatcaaaactttcctacacatataaacttctaacttttctaatttaaccaaactttcaattttggcgtgaactaaacacaccccatgtatggttcaacctatcttatgcatcttgaataacccatgaagcaaattgcccccaaaggcgtggtttgcttgcaattccctcctctctttggccaattctttggctgtcagcatcaacactggttacatttcgacaaaatctacagttagccagtcaactctttggccatcagtatatttaactaactatcatcaacaactgattgtactttagaaaacacgtgtgatcatcatcatcatcaaatatatggttagccaacaaattatcatcaattgatcgttatcagtgtaacgaggtcagcggtgcttcattcacctcctactccatccggagtgggccaggtgtcagcatgtacgagcagtgcgtgggcaatggcccattcagtagcacgcggcatgcccggctggcacggagctgggccgctcacttcggacgttggggggtggtgggcatgtgggccgggctccgacgcggacgtggcgtttgtttgggcctccaacttgttgtggtggtgggaatttttttatttatacatttttttattaaaatatttaaaaaataattttttgtttcgaaaatttataaatctaatcgcctgctgtctgcccttccagagagcggcaagggatctaaatgcaaaatttttatttatgttcaaaccctttccaccggttttaattgcttaaaaactaataatgcttattcgatactctaaatgattttaaatgaaaaagtgataaactacaaagttatagatctcatcaagatctacaacttttatataaaatttatctccatccaatgtcgtttgaaatatagatatgagatttttttaaatgtgttttatattttgtaacgaatatttggatatctaaaacatcttaaatgaaaaagttgttaaatacaaagttgtagatctccttgagatctataatttcgatataaagttttatttcatctaactttatataatataattttaaattgtaaaattatagagctaacaagttgtgctggaaaattgcatttagatcccttgccgccctctagaaggacgatttttaaaaatctcaagacgattagatttgtaaattttcaaaaaaaatatattttttgtaaatattttaataaaaaatatataaataaaaaaaattctggtggtggtgcggtctgacgcggacgcggtcggtcaaacgaggtcggccaccacccgcacgccgcacgcgtcttcgcctagcccgatctcgtttccctttcctcctctcttccaccacgcgaggaataaatagcaggacaccggattggagtaacagagaatttatttttttttttcagttttttcccccacccacaccacaagcagacgaagaagaagaacaaggtaagaatcctttgcttcccctctcgtctcggatctgggatcgactacgctctcgaatcctctgtcgaatctggttcaattctctgcctcgctgcttccccctctttgttagttctggtgccggtggattttgggggattttggggttctgggctgggggattttggtggatttttgggttcaggtcgcgagcttgaagtcgaattggcgtcgatcgggacaccgagcgaactcttctgcgccatcatccgccggcaactgccaccggccccgatccacgccaacgccggcctagggtttgccgccgggatcgacgagggccacgatccgcgccgccaccgcccggtcggcctcgatccgcaaccgccgtgttccagtgtcccacccagcagacttgcgctcgcttggatcgtccccgtgttctagccaaactttatgttcaaatcgaactcgacttctctcccgaaacggcaaatcgttgccaatccctgcctcggatccatccgactcgcgcgctgtctctgcatcacaatttatcgtctcgatctgtttagctggatcgaatctaaacacaacgattttgttgtttgatctatcacaggttcgtccgtcgagatgttggagaagctgctcatcttcacgcgcggcggcctcatcctctggtcgtcatgccgggcgctcggcggcgccgccctcaagggctcgcccatcgacgccctcatccgctcctgcctcctcgaggagcgctctgccgacgccagcttctcccaggacacctatgcgcttaagtggacctttaacaatgacctcggcctcgtgttcgtcgccgtttaccagcgcatgctccacctcctttacgtcgacgacctcctcgccgccgtccgtaaggagttctcacagatttatgatcccaagcgcacctcctatgatgacgccttcaatgaggtttttcgccagctccacctcgaggctgaggctcgcagtgaggagatgaagaagaataaacaggtcactggttcccggcccaccaaggttaccactaagaccaatcgtggcgacactcagggctctggtggtggtaggaagaaaggtgactcggggaaggacgactctgatggtgactccgggaaggagcacactttgccaaatggtaattccaagatgcaagagaatagcctcaaggacaattctcatgcccgcagtgttgttgttaaaggaaaggagaacggagaccccaacgatggggcctttgatgtaaataagttacagaagatgagaaacaagggtaacaagaagaatgaggttgctagtaatgtggccaagaacacctctaaggctaacacaaagaagaatttgaagaaaaatagggtttgggatgacacacctgatgacaagaagaagctggatttcacagacccagctgatgagagaggggatgaggtgatagaccaggtggttgtcaagcagggggaaagcatgatggataaggatgatgtcgtgagcagtgatagtgatgaagaagaggaagatggagaggaaaattctggagcttcccaaaagaagaaaggatggttctcctcgatgttcaagaggtaatacgcatgtttcgcatcttttgacatggcataatgtgtagtcagttttgtttgcttaacaatttcaaatgcgctatatacacttgggtggtttaagcttcagcatgttttttattcttagccagctcattgtttcaaccgcagagagcaaccctgatatgcttttctgctttctagaatgctccctaatttggtgtgctacttcagtcatcttcttaaataagttatgcgtagagtagaatggcagatttgtgctatgtattggtgttagatgacttttgcagcctgcagcctgttctgtctctcattgtttaccctctcctagatcaacacacacacacagatgaaattgctgttttccatttcccttgatcctgcattcaagtatttgtggttgccagattttcagctccctcttataatctgttaacctgtgaacttaaatggcattgtttctatttttcctgtgctcagcattgcaggtaacaatgtgcttgagaagtctgacatccaacctgcactcaaagcgcttaaagataggctgatgactaagaatgtggtatgaattttgtctagaacacttgcatgatagttgataagcttactggagtggttttttgccttctttgttatttatttatccaaggtaaataaaacttttcatcttaatgcaggctgaagaaattgcagagaaactttgtgaatcagtggcagctagccttgagggcaaaaagctgggatccttcacaaggatatcctctactgttcaggtttgtagcacaccctagtccaaatttctgcaaattttttcttagggcacatattctctttagcttcctaaatcctaatactccttttttttttgggtaactattgcagacagctatggaggaggctcttcttcgcatcttaaccccaaggcgatctattgacatattaagggatgtacatgctgccaaagagcgtgggaagccatatgttattgtttttgttggagtgaatggagttggcaaatctaccaatcttgcaaaggtagagttatcttttatacaccattgatgaaaagaatagtgccatacttgcatggaattatgctcatcccatgtattgtaatattacaggttgcttattggcttcttcagcataacctcagtgtaagcctggcagcatgtgacacctttagatctggtgctgttgagcaactgcgtactcatgctcgcaggcttcaggtagctgtctaaacacttgaatatccatcccattactctgaccattgtagttttagggggggaatatctagtctccatcagttggttttagtttggtttcactttttctttagtctgggatggtgtatgaataattttttcttcgcaaaaatgcgttgaactgtattgatataatggtcttgtggggtgcctcctggtgttatgcgataaaaaacgacaatagtcccagtggaactactcggcattcacttatgaatgctcactgctaaattttgttgagttatatacatgtgccataccttcctggatatttacattctagaatttgtgcagatacctatatttgagaagggatatgaaaaagatccagcggttgtcgcaaaggaggctattcaggaagctactcgtaataagtcagatgttgttcttgtcgacactgctggacgtatgcaggttggttgagtggcttaaccagagtcttatgtcgttctatttatgtccttcgaatgcatcttttctggtcaacacatatctaacatatcttctctgccaggataatgagccactcatgagagcactctccaagctcatcaatctcaatagcccagatctagttttatttgttggggaagcattggttggtaatgatgctgttgatcaactcactaaatttaaccaggtactgatagtctttcaaggactggtgaatgctactccctccgtttcatattataaaacgctttgaactttttcttagtttaatttttgaattttgaccaagtttataaatttttttgtcaaaatatatttaatgttacatttaatgaaactaatttggtattataagagatactacatttccctacaaacttggtcaacatgtgctttcactggaatgcactgaacggttttgtttgttgaacagaaattagcagacctttccgctgtccctactaccagattgatagatggcatcctgctcaccaagtttgacaccatcgacgacaaggtctgaactgtcacagaattttgatttactgcaattgccttcttttacagtatttttatttttatgactactcaatatatatataggttggagctgcactttcaatggtttatatatctggagctccagtcatgttcgttggctgtggtcagtcttacactgacctcaagaagctcaatgtcaaatccatcgttaaaaccctgctgaagtgaatgtggtgcgccgttgtgcggcacctcgaattcgtactgccagtattgctatcgtcgaaacccccatgacctcgtcgtcatcgtgttggatgtgttctgtcctggtttactgttgtagtagcacaaactatcgtgcgctttttcagttatgtgactgctttgtatcacaggttttacctgttttaccctggaatatatacttactagtggttaacatgggctgatattctctccattaactacttgcattgatacggtgttaccgctatcaatggcggcaggcggaagtcctgtgtacagtcgtaacagtacaggctgatctgtagaatgttcatgagttcgtagacagagtactctgttgtggttgaaagtaaaagagaatgcaggtccgtccgagaacagcaacagcaaggagccaatgtgtggctaaacaccaaattgtcaattgaccagcgttcgctatataataatataacgcactgaaactctgaaagagctgatgaaagaatattgttctgatcgctggtgttggccaggctctggtttgtgaggtaggaccgtaggagtggattcgtttcggtgcatatatatcatacacgatggtaatgggctaccgtctggcccattttgtagtgtccggacgtcttacaatccgcgaacaacacacaggcttgcagttgcaatatccattaaatagtatactcagtgcttacatgtcgcaacttgcaaccgagtgcaaatttcaggttacaaggctaataaatataatcccaactcacacatactatcaccctacgcaagcctctgcactcttctccaatgttctcttggcaaacgagcgtcttcagaaactggctgtctgcagcctaaggtaacgtgaatatgtctatatgtgaaacaccagctatgccttccaaaatgttctcgtcttcttgatctattctgatggtttgcctctttgtactgagcagaagttgcggttcttctgctgcccactgaagtgccccctttgtgtgtccaagaaacctcaccaacacactgttggtacttggttgcttcattttgagctggcccatacttccatccttgtacttgctttctttgcctgcatgcaaacacaccagatatgttcaaacaaatgtgctggtccatttttgtgacaagataaatttgaaggaaataaaggagttcacctcttcatcccaatcacagctgatagtgagataggctaatatcagtgtctgaacagctgtgccaccaatcaacccggaccaaattccctgcaatttgggtatgaacagtcagaatcaatccaaacattgccatgcattcgaacaaaattactgcttctcccccaaaacatactaataaaaatgtactggggtgtgttcggatcattaccccaactccgaaatgcaatggccagcccaatatggcaccgatgggaactccgaccaagtagtagctaccgacgttgacgtaggctacgagtgcttgccaccctgagccaatggccacacctgcaatgccaatgcatcagggagctagcttagaatcaatcacccatggctcgccaaacttccatccatgaatgcaatgcgaaacttgtggcaacgaggctttggacttgcctgagaggacgggctgcacgctgttgaggaggacggtgaaggcgagcagcacggacaggtcgctgacggcgtcgagcaccaccttgctcgacgagaagaggagagcgatcttgtcgttgtaggcaatgatgaagcaccagaagacgaggccgatcgccacggaggtggtgacggacaccacgatggcgaaccgcgcgcccttgccgctgccggcgccgagctcgtttgccacccgcacgctgcgccatttcaagctcatgtcattgactcatggtgcgctgatcaagttcaggccatggactgatcaaaccagtgtaggaatgcacgtacccagttgcagccaagaagccaaaaggaatcatcatctcccatccgttgatcgtcaagctacgaagtcaagaaccagtacaatgcaatgcaatttgtgaggaagactagtttggatttgaaggaaaaatgttcaatcatctgctagtgctagttaccatatggagagtgcatccacagcgatttcagcgttattcaggtaccctgtaagcaacaccaacaccctgtagtaccagttctccaagctgtatatacatgagcaaattacaatttagccgagatgatgagttcatgtatattttgttgtgctcgagttgtgtgagaatgtgtgctcaccaaagcatcaccccggaggccgaggagagcttgatgaactcccagaagtcggcgaacgcttccatggagaatcccttccacgacagcgggcaccagccgccgacgacgtagaccaactgccccagcacgacgatccaccacgccacgttggcggcggcgacggcgccgaggaggcccaggtggagggtgttgacgagcaggtaggtgatcacgaggtggagcgcgagcgcgacgccggcggtgaccgcggtgacccagttcttgagctgggactgcaggaaccgcgtgagcgggagcagcatcgccatggcgaagtgctgcggcagcagccagacgctcatcttgccggcgaggctggcgaggtcggccggctgcccgatcagcagcagcaggtcctccatgagcacgtacgtcggcgtcagcgcgacggcgaacatgaggagcaccagccacgaccgctgcaggtacacgcccagcatgtggtacttcttggcgccgaacgcctgcccgcacagcgtctccagcgcgctcgccatgcccagctaattaaccacaaacaccaaaaatccaccacgccattgcttgattattaccatgaccatatataattcaccgtactgttaagagctaccaaaatggtttcatcccgagaaagccggatactatggtttgctaagccgagtgacctggtttcggagagtttgcatttttctcagattcgttacgttcgacttgtacgagaggtaataccttctcactctataaatatgaaattgtcacagcggattcaggtatccaaattattattttatcatgtcatggccgattcaatctatcaagtttaattacctttttctcttatcccttgtcttttatcgttctaaattctagttgtcgtttaatttacttcgtctctatatggtaattaaagacgctctaggtggtctactgaccttagagcaatcctagacacagctgttatgatggggtccctctcggccaggtgttcgtaagttcttatgacgagactgtaaaatctaggatgtgtttaattcacgttaaaattgaaagtttagttaaaattgaaacgatgtgacggaaaaaatgaaagtttgtgtgtagcaaagtttatgaaaaagttgaaagtttgaagaaaaatattgaaactaaacacggccctagatggtcttgtttttagaatcaggtggttcgatccgttttggcgaggagcgtaatgatcaacgatccgattaaaatccacacgttctaatacttacaccacttactaacagtttactgctatctcaaaccacagtgtctagcacttactctagcttatatatcaccatggcgtgagccatgacgcattcagagggggctcaactaattgcagatcatgtcgtttcgtacctacgcagttggtcatagattggtcgcggccgccgtgcgtggcggcgtcagtgtcgggacacagacagggacaaacataaagaacaataactgcagcagcagaaggcgacagcgatcagagagcattgattcgcccaatccatgtgctcagctacgacacgatacttccggcttaattcattagtcattacagaacttttacgccgggcaaataattaattgcaaaaattacaaaaggaaagatgattagggtgattggatcacttatcctcgattaactacccaactatttccatctgttcttggattgttcctgaacctcagcgcataaaagaactctcggggcatttcataaggctgtgtttagatccaaagtttggatccaaacttcagtcctttttcatcacatcaacctatcataaacacataacttttcagtcacatcatctccaattttaactaaaattcaaactttacgctgaattaaatacagcctaagtcggcttcagatagctactgtccgtgtaaataaattgctagctctctaagatccactcaagcgtgcatgcatgagatacatgcatgaagccgaccggcctcctactgttttacatattttttttaaaaaattcatgcataaagtctactctacctgaaagttactgtggaagtgtggatgatgcagagcctattgaatggaccaaattattgcttccagccaaaaaaaaatggaccgaattaagggctcagagctttcgatgataagctgtgaacccgtgccagatgttacctaaataaatacagtatgtgcctggaggtctaattatagcaggttaataataaatttcaattcaatccaacaaccgcgtgcataattcgatcacgcgcatacaaattggagacgacgaagtctagctagtccttaaaacactagtactagacactgctgttttggcagtaatgctgacattaattctacttaatttacggtgtaacagtgtgaagtgagctaatttgccacaaataactgatgagccatttcttgcaaggtgttaattgcttagctgtcggacactttcatcaggatttccatatgaaaacttgaaatttatgtagcgggcatgcatgactagctggattgggcatgaagtcgttgcggtttctatttgtgtcaatcaaatgatagaacagagagaagctgtccgaatagctggtcattttaattctagccgggatgaatattgcaatgaactacttttgtctcgatccaaatcaagtgcatacgagacaaagtttaagcacaaagttatgtgagattggtagtagcgtaaataaagcagcatgcagcacataccaggaaaccgaagttgaagccggcgacgacggtggaggcgatggagaaggcggcaagctcgaggtcgcccatgtggccgatgaacgcctgcgagacgacgttgatcccgtacagcgcgatccgctggaagatggccggcccgacgacgcgccacagcttcttcgactccacccaccactcccccgccaccctcgcgccggccggccacagctgctgcttcaccgcctccgcgtcaacgccgccgcgcggccgcagcagcggcgccgccaccgacgtcgcctcgtcctccatgacaaacaccacgtactcgcccgctaactactcgcttcgtacttggttaactcgatcctctcctgcgagtgctgcgcgcgcggtgatggtgtgtgtggagagagagggggtttttatgcgtacgcgagtggagccaaaatcaatcgatcgatcgagacgtcggcgggcaaggctgtcacctgctcgcacggcgcgcgcgcgtgtgagccagccaatcgctcgatcggccggtccgatctatcggctgggccggcctgtacttatttaggcgagagataaataaaataacagtcaacagaaagccagcaaaaagaggacgatcgacttcagcgggatcggggaaatccggcatggaagggaagatgcaatttgcaattgtttttggtgcagcgtctggttcacgtgggagtttagccgatcgatctctgctcctctactaccttgttcgtacctacaggttccacgttacaagttattttgggtttgtaataaataaactttttaaagtataaataagtttatataaaaacgtagaaacatttacaataccatattagtattatcaaacattactatttttttataaatttaatcaaacatagaaaaagttatttacgataaacccagagtaacgtataatatggacgaaaagatgattaggaaaaagtacaaaataccccccccaaactatcgaggtcggccgagttacacccccgaactactactccatactcataaaggaagtcgtttaggacaatatttaagtcaaacattgggaatataaataatgaataactctcaagttgttgagttttaaaatgtaaaaattatatgtatagatttgtcttgaaaaatactttcataaaaatatacatatatcacttttcaataaatatttttatagaaataagaagttaaagttgtgttttggagaccgtgtcgctgtcctaaacgacttcctttacgagtatggagggagtacaaaactagacattttatacctagaacttttcaaaccagacgaataacccccctagcgcaatccagagcggtttcgatcttacgtggcatacacgtggcggtgtctactcagtgaaaagttaattaaaaaaagtgggctccaccggtcagctcctctatatgttctcccacctcctttcccttccatatctctcttgctccctctctctctctctcacggaaagccagaaacggcagcgatgggtgactagcgtcacggcggcgggcagtagggcgttgggcagtacggcggcggcttgaggggaggccgccgggctggggcggcgggcagtgacgctgcttcttgcgtcgtctcggcgccatcaccatttcgagcttggtgagggcattggagacgacgggagggcgcggcggctggtgggccgcgccgaggaggaatatggagtcgtcgtgcggcggcatcgcggggagggcgtgtgttaacagtaaaatttggtaatcggcaaatacgtcatcggcttagaatcattatcggccgcaacatctcggaatcagccgataggagttatcaagtcgccaatagtcgggttcctgctatatttggttaaggaaatcaatctaataaaggaagcttatccctaagtgaccgagtttaaagaggatgcggcatggcaatttatctattaattaggaatagtttgttagtttccttttatctttaggttagtttcttttttatccgacaaggacttgtatcaacccatgggtataaatatgtacacccggggtctatgtaatcaatcgctacgatcaatacaattcggcgcatcgccaccctttttacttatacttttgtttttacgtttcgacggaacttggcacccgacgcggggctgcatcgtcttcgatctccggcaaagggataagtccaatgttcagccggtccaggcaattgtattgtctacgtcggcgtcgttcaaggctgcatcagtacattcgacctcttggattgctctggtttggatgatatatttgcctacctatttatcatatgtctctgttaatctagttttagcatatttagttctatcggctgcttctcgttttagggtttctgccggtatctgctaaatcgcgttgctagattagattagcttagacatctaccaccctaaaaactcagtcaacggcttgattgtctagatattatgtttcttttcatacttagtgttgcatcagttaagtttgatctactaagtcgtgcttagaaccataatctctagcctgcttcttgattgccaataagggtttcatcggggtttcagccgatgagttatctggatgttgcatcggctcataaggattgcatatacatataagtaggatttagccgatgacaacaaagatttcactgtttaatctaatcttatggatttcatgacatcggacctccagccgatgtgtgatttgaccttcggatcgatgcttatttatcatatcattatttgccgattggtttatactggattatattgttattttattacatcgtcgtcagccgattgcctttatatcattatctacattggacatataactgattgcttaaaccctatcgctatcggctggtatcgacatcggctggaactactccatcagcttgtcagccgatcggttgttttgatctactatttgcatatcttgtcagttgcaggatcaaactgactggcatgctcgcatctcgtcaatatttggacctgcacaagagctaagcagatctcccagccggtgtgtttgaatttttcgtcaacagcgtggcagcgggctacgcgacgagtccgctgccctctcgagctcctcggctacggcatctctctctctctctctcatctcatctctctggcgttgcgggcggcgaggacggtggtgggctgtggcgtcgctaggagcacgcggcaggtggcggactggcgggcggcgccgaggagggcggccgacgacgggggacgaggtggtgtggcgacgcagcaacggcgggccgggcgcaggcgggccaagcggtggcgagcgcggagctggaagtagatggcgccgctggcatcgccgtcctcctccttctcctcgtccaggctacgctgccgtcgtgcgtttcgtctggcatcgtgcttcaaggtcgcctcattgtcttcgcccacagcctcccgtacacgtccccgacgaacgcagcggtgtcgggggaaggagagaacccgccgaggtcgacgagcggcgccgtgaggtcacccatggtcgatccctccctcgagatcaagctcggccacgtcggcatcaaggcgttcatgcaggcctcctccgcctcctggtttgggttngccgccctcgacnngccccctngnnccgccgtcccccgcccgcccttgcgccgccgctcttgcctcctccgtcaccgcgctcgcctttttcgctagcatgctcgcctcgcctcgccactgcctccgccgtcatcctcgaagaaagagattgggaaagagaaattgggaagcgagctccgcctccttctgtcggccgcccgctccgcctccgtctcaaccgcccgccgccctccgccgccggcagcgccgcctgctcccgccctcgtgcggccaccgcgtgctggtgagaagaaagagagagatgtaggatcgaatcacaataactaagccaaccagaggggggggtgaatggttggtatacccaagaaccgaaaacttttagcggaaataaaagttaccctcgaaatcaacggatctcggtctgaccgagattgatctgtcggtctg

SEQ ID NO: 31547 - DNA, 8905 bp, Oryza sativa
atcaatttaaataaaaattgatggttagatatttgtgtttttcctcacattttctagatttttttctaatttattaaagtgcctttttacaacttaaaatatagttaatgtgaatactgattttctatctcatgtaaccaagatgggaaaaaaaaggaaagaacaaacagggtaggtacaaatagacgtgcacatccatgaagagatagaggactttttctacgtgtgattcattttccagatgaacgtaatttcaaaatcttaagatagatccatgttagctaaataatagaagaagttagctaaaaataagagagaagggaagagttggagggtggctatagggagggagtacgtagttgcggacgtatagtggagggtgaggttaccggattttttaattttagagaaatctaatggttaaaattaatgggttcatcgatttaaagtaaaatcagtagattttttctaatttattataaccccatgtaacaacttaggaccgtttttagagcatttacattgtacatgttcttaggagtcccacgtagtggcttgacaacgtttgtaggaagtttagatgttaggtgcctcctaatctgggtcattcattttttttaaaatccatgcagtttttttaaggagggtaacatatgcacaggatattctttttggctttttttttgtcagtacaatgtatttatatgtacgtgggatttttttgggaggagttattttttaatagatgtgatctaatactataactggttcatcaatttaagtgaaaatcgaaggtcagaatttctagtatttcttattataattacataatttttatatgaagatgaatgatcaaatatacactcaaataatgtgaatagcataaaaaaagtaatggttgtaaggcaaaaaaaaaagggttaaatgggggagtgaaagaagcaggtgtatgtacaaacgggatgaagcaggtgtatgtacacgtggctaaggcctatctattaattccaacaatccacttcaaaggtgcttttttacattatattgggtgactaatagcaaacaaattaacaaccaataatcccaaaaacaaacaactaacaatttattttatgtcggtttattataatttataatctagattacaataatcttaagctgaaacaaattttaatctaatataatggtctaaaataatagacccgccaatttacattaaaaacaaatttattcggtaaataatgaagtaagcacgtaaagaggatgatattttttggcttttttttcaggtgaatagtactatatattcgtacgtacttaggatattctttttggtttggtatgatatataccatgcaatcgggatgagggagccttacgtacgcgcaggtgagatgaggggaaggactaattttttttttagtctaatcaaatctaatggcctaaaataatggacccaccttttaagtgaaaatcgagggctagatatttttaatatattaaaacgtcacatggtgatctaggagcgcttttagaaatcccatgtggcggcttgagatcgtttgtaggaagtttaatggacttttagtatataataatagatagataataactatcactaatatgtaatacaattatatacatatgggtcctccgactacatactagcccccatataatttaattttatcgtaccaggatagatcacatctcatactagctaggttaagtaagcttttatccaaatttattgtattagtatgggtcacattccattataggttaaggttgtgtttttcaaaggtttgaaacggctaattagccgcacataaaatgagaaatgtgattagtacataattaattaagtacaaatatataaaaaattgatgaataaatttattatatttttaaacaacttatataaaaaaaagtttttacgtaaaatgtattgtttaacagtttgaaaagtgctaacggagattgatgagtagctaagttccaatagctacaaagaacgcagcctaagggctcctttgaatcgtaggaatgaaaaaacggaggaataggaaaaacataggattctgacaggaatgtaagtgtaaaacagaggattacaaaacacaggaaaaacacaggaatgatcgtttgattggaccataggaaaaacataggaatcagatgagagagatagactcaaaggatttttacaaagaggttggacctcttgctaagttttctctaaaacctatatgcaacaagccattctataggaattttgtaggatttggaaaacttcaatcctttgaatcaaagagctacatgggaaaatttcctgtaagattttaatcctatgaaattccttcataatttttttattcaaaagggccctaagtttattggaacagagggattacctttttgcctttttctctttgactgatgggatgattgacatgttaaccctctaaccccgcatgccatttccatgttaggttgttagtggtgaaaattgtgatagatttatcgctcgtcaccaacaccactccttgtaaagaaagatttaccactcgttaccattactactcttattaaaggagtatacattactactgtctatcagcgtttttgatccaggtgcttacaagaattttttatattattgttcatcgcctgtgatttatgtgtatcataaaacagaattgctagaaaactttagcaagtcccccctctaaaacttctagatttgtgaccattggattacctcgagatctgtgaatgaaggaaaaaaatgttagaaatttttttcacacatatcatgcataagatcccggtgctagccatagttacagtgtacttataatgtagttgtagtgcagttacggtgtagttacaatgtaattatactctagctatactatatactatagttatatctaaaagttttttactcgaaaaacttgcggtagtttttttaagttacctccattgtaagaagggaaggtttacataagtcgaagactcagactaatgatcttcgcgtcttcgcctgaggtcccgtaggaacgtaccgaacaagaacgcagctttccagagttcttcagttttgggatgctgttctatcacctcaaattcagcagccgcgtccattggctagtgcctgtgactgtgagccacaagccgctggaaagtcgccagcagctagctcgttgatcgatcgatccgtggaactttgcactgtgcattttgtggacgtagcggctttgttttcatgtgtgttgagctcaaacggatcagctgcgtcgtcgatcggtcattcattatctttgttcttttgttaggcgtgatcattagatttcgtttattctcgctcgagtgcagagtttttggcatcttgctactaccattgcctgaatgtgtgtcctttgagaatctcttgtactgcagatggtaacgggtaacccgatgtggggaataatagtcttggggagccaaagtcaagattgatccatgtaacatctggcccatgtaaccatcactccatcagtccagtatgcagaacgaatcgatcagaccactgttacgaacgaatccagtatgtaggctattgctgcaagagatacacatacagttacagtcacactcgcacactgttttcttgctacttcagttcatacaatcattagtactagccctaacactgtgggccgagctaagctgcctacctaccgcaaatctacaaccgaacgaaaagctgtttcgatacagtaatgacgacggacacttggacatcaccaggggccacgtccctacgcagctaccactctgatttgtttcacaagccggccggtgggtcatcaatctgtatccgaatttcttctgcacagtgcactacactgttatatactaccagtactccggtactccctccatatttatttttaacgttggttagctcaaaattaaactaactaacgtcatacatttatgcatggaggtagtattatttatttcgtactaaaatacagcaacataataccaaataaaatatatcgtatattcgtgttactaagatctgtcttattctaatactagattattatattttaaaagagaggaaataccatactactaggtatactagtagtatatgatcatatgagcaaggcaagcagaaagcaggaggcctgcaaggcccagccgacgcctagcccgtccgcgggtggtgctgggccggcgccgcgaaaaattgcgggccgggtcatatagggacgtaaaaaggcttagctgatggaggctgcagcgtctggccacagccagcatctttcacttcaattcgccacattggtgaagacaaatctagaatagcttggctttgagccataagctttatctccaaaatcgtatttaaattcttttaagtcatgatataattttttttaaaaaaatacttcattagagcaagtttaatagtatagccaactactaacttcaaatcatttatagtcaatttcataaccaattcaaacaataattacctatagatatatattgcactagtaatacctggtcccacatatcatacacacattgcgtcttgtagcctgtgatgcagctggttataaatctgtagcctagtgctattctctctccttatttattttcttgatatgtgtttatagctgtcttatatagtatgcacttagttgagtccacttagttttaggctttgataatttttggcttcgaaactgcttagctcgatcgtctttaagggcacccgcaatggttatctataggctctctataagatatccatgtcagcatattttcctacttaaaagagattaaatgaagagagggagcaaagctatctaataacctggagatagtctatagagaaaaacgagacaatgcattagagagctatagatactcatgtagacatactattgaggtggtttactattaatctagtctattactgatatgtatatgttttatagagagcaccttactttactattgcgggtgctctaagcgaggctagctggctgcaacgcttgacgacaccactgacaccacaaaagatactgtgcgtattgacgaagcaacagcagtcaaacccatcacgcggaagcagattttatttgtgctactaccacatccggacatgaaaaaacataagtatgtttaaaacatatacaatcatataattaattttttcaatcatgctagaagcctcctaatatatttttttcatcatggtctttggcccctccccctagctccctcctccctttatatcacgtgtctaaaagtattataggagtaggcaaaaaaagcttacttgtgatattctttaatgctacccttttatccaatgaacatcatttatccaaatctttatccaatggtcaatatgtttgtaatggtgtggcatgtcgttatgtaaaaaaagttgttgctttcactatataagacataagagaagataaatgtcaccagcatataaacagtacgataacttctagtcttaaaatttaataacttatccacctaatcataatatttcccattcaaatttcctacatacctcctcttctaaactaatcataactttttcccggtttttggaatactgtacaaacgcatgcgctcacaatgagtgcacactcacccttatgcacacacaaacatccaatcaatatgagtaactctggaaaattgggtcggcatatcttaagattgacgaagtcatcacattcataactttcctccattgaatttcaccaattctcagtacccatgtctaattttaaaactctttatattttagggcacttgtagtaaatgggttttatcatttcatttgcactaatctacaaacgctattcttttttccgtgtgataaactagtattccgtacgctttagtttttcttccttaggagtatagtactccctccatcccattttaagcgcaaccataaattttcgcgttcaactttaatcgtctgtcttatttaaaaaattttaataaaaaaattagaaagcataagtcacgtataaagcattattcatattttattatattataaaaaaatactaatcatataaaagttttaaataatatgaacaattaaaattgaatacgagaactcatggttgtgtttaaaataggacagaggcagaggcgtactgaattttcttttgtgagtgtagaatactctttagagcatgtacaatagcgggctataagtcagttataaacatattttaaagagataaaggaagagagagaagagcagcgggctacagatctatagccagctgcagcacggactttaagacgtaatgtgtatatgacagataggaccatgtcctaattatatagtaagcaactattgtatgaattgactattagattagctaccagcggcaccaggcccctcatgctccgggtcagttccgcggcgacgcgtgcacactgcatgcgcaccacgaccacgaccgacccggtttctcccggcccggaggcaggcttcacctactagcatcggatcagctgccaacttattagtaactgtaggccgggtgttttttctttccttcagcatcttagcccctgtactcgtatagccactcatagcttggctcgcactcagagccttcagacgagtcatgtgaggcgacacgaaagacaggaaacgaaaggaagaaaagctactccagctgctgaacacaacgcagagcgagagagagagagagggagaggtggctttggcttttgggaagcgaggatggattggatgtttggattggattagaccggaccgaaagtgcatccatgctggccgtcgtcttggcttcccattgtgttgtcttcatcaggagacattgttttcaccgcagcaatcgattgcctcctccgtgccccgggtccggacacgggcgcgatcctatcagtatcgctctcgctcagcacgcacacacctgctaatgatggctggtgaggaaaaggaggcgcatgccgtgctgctgccatgttgcgagacagcgagagctttcgtaccaccactactactgtttaacgtcttctccacctctcataaaccctatggaggagaggattatatacgatgataaattaggtcagttgattcagcaagaagaacagcataaaatatcaagtgatgtccttcttaatagtagttacagttccaaatttctgcatcatgcatgcatgcatgtagtagtatgatacggccaggtctaccaacacctgataacgttagattcttcaagggacaaaagatgtcgaacttgacgaaaggatgattccacgatcagtgtaggcctaccatgcgtccatgcatggcatggcacagaaacaaaatgaactcttgtgtaatgcgaaaaacatgtcgccgctgctgcttgtcggtgagctagctgagctgatcgctctcgccttacatcttttccgctcccgggagctggttccttttggcgagagcatgattgctggaacggaggcacgatcgggagctagcagccgggagaggagaggggagaggggggacaggatgcatcacacagccagccagctctcccacctgtggactcagaaactgcagatgagatggggtgtgatggcaagtgacaggatatagctagcccccggctgtgttcgccttttgcgtggtgtggagtggtgcagtgcttgtgcggggtggagtggtgggacgacgaactagtacgctgaactagcagctaagccgagacatgaagtgactaatcatgagctccgtctatatcactcgtgacccctccagatcaccaggtgctgaaacgaaatttacgcaaatactgtaatcctattacaccaagagatactactcctccctccttcccgcgggtgtgtgtttggttcctggtcaaggctagataggatattgtcatctatattttaagggatatggtggttcagtttttttgtttggttagatggatatggccatccagtttcttgtttggttgggtgaatgagaatggattgaatgaaaacaacaacatattaattattaataaaatatgttaattatcattaatatagctatagtttatacaaattaacaataaaatagagtaattatatctaattagcactaattttgacaagttaattactaattaacaacaatataatttaattattgctaatcaagaactaatgatcaagattagctaaggtggatatcctcatctggccaatttgtccggatacactcatccaacatcttcgtggattattccctctccgggccgccctatcctccctcgcccaccaaccaaacacactcaaaaactgggtcgtcatatcccatctagggatatccctccaaccaaacacaccctaaatgttcgacgccgttgacttttttaaacatgtttaactgttcgtcttattcaaaaacttttgtgaaatgtgaaaaactatatgtatacataaaagtatatttaacaataaatcaaatgatattaaaagaattaataattacttaattttttttaataagacaaacggtcaaacatttttaaaaaaagtaaaatgcgtcaaatattttgggatggagggagtactatttagtagtaggaggagttgtagctaaaagaaattccagatatagattgccattacgttggttatactactagtacgtactgtaattatgtaaactccatcatggagtatatatatatatatataattctgggactgtgtagaaactaaattgtgttcgtaccaaataggaacttcttataaaaaaaaactcccagaccataatgaaaattggtatttgtagtgatgaaatattcaaatatctgttttaggttataagacg

SEQ ID NO: 31548 - DNA, 25411 bp, Oryza sativa
aaagtcaaaacgtcttgtaacctgaaacggagaaagtatcatctttacaatccccaccacccactaatcaggacagttaatgaaggcattctagtctctctttttttttaactctcggttcaatttccatgaaaattccagaaatagctatatttttaacatatggcatatcatgtatcgatatatgtatcggagtatccgagcaatatagacgatgggcaaaacacaactaaagctaaaagtggccagaaatgatgtggatcatttcggcaaatgcatgcaggtcttctttttttcttttgttgccgaaaacggctgagctaaaaaggaaaataatattaggaatattggaaaaataaaattatttggacagaaacatataaatataaggtttagcagctagaggagttaatgggcctctatggtatggcatatatggttcatatcaaaacatgggccacatatacaggtactctaatatttagacgtatagtaattaccatattatagaatactaataatttctgtgaaaatataataaaccaaaacagaacgcttagtagcatggttgttaaggcggtaaggcataaggcgaggaccctaaggcggtaaagcgtaaggcgaggcgacgccttatgcagatagaaaaataggagatgaaggactttttttaatatatacaaagtcgatggactaaaatggatgatgaaaataggaaatgaaggacttcttcacaatatctacagagtccaaggactaaaacgaaagatggtgatagatatttatcaatccatccccatccccgaccccatccttatccctaatcccgtcgacacctagccgcgtccgctccactaccgccgacggcaagaaccctgcccagccaccgtctccatctccttcatcccttccgctcctctggtccttcctcttcccctaccgcagccactcatcgtcgggtggtgctagccatcgagggaggtggatgtggctttgctagtggtcggggacgacggtgatgacgatttaggttagttctttgtattcctcccccttcccctgctgttgctgcttctccaggaccttcccctgctgctgctgcttctacaggatcggtttatctccttgattttgctctttctcctctagtttttcccgtaaggcggagcagatgccttacgccctggacacgccttaccgccttatggacgctaaggcgtcgccttacagacgccttaacaaccatgcttagtagactagtaaaaatattttttgtttctactttcatattgtgtttctagtaatacctccgttccaaatttgtggtcgttttgacttcttgtttgtaacgtttgactattcatcttatttgaaaaattagtgcaaatataaaaaaagacaagtcatacttaaagtacttttggtaataaagcaagtcacaaacaaaataaaaaaattattccataacttttttaataagacaaatgatcaaaatttacaaacaaaaactcaaagcgacaaatattttgggacgaaaatagtagtatttttatttttatttctgttagtaaccatttcttcagagggtgtatatgtaataattggatgtatattctgtgaaccaaaagccagaattaattatattatctagaatgcaatttaaaagatagccggatgttcgggaattactgggaccgttttcaccctacagtatgactacatattcagaaaggttatcttaactgccatcttcacctattttcagactaagcctcaaacgtctatactaatatgagttgacaccatggtttttagaataattaattggttagactttttttatgaaacatgctaattaaccggatttaagggttaaacttagcatagatgctcatacttatggttaatttgttaatcttaagatgtcaatgtctatcatgactatcaaccttaaaatataccagcccggtatctattatattattaaaacagccttgaaagaaggtaccacgttcgcttaggggctagaaattcccacattaatcggagaaaaagaaaaagagagtccaagtataaaatacaatttaaaaataaaattcgcaacaaaaaataagtaatattgaaagaagagtctatataagaccccaatacgagattattcaaaatttgaaataaaaataaaataaaatccgaaattagaaaagaaaaggagagttcaagtagtaacaaatttagaaatagctgaaattcggaattaaaaataaggaatattgagagaaaagttcatataagaaccagtacgagattatctaatattcaaaataaaataaaaataaaatccaaaattagtaaaaagtacaaggaaaatttaagtaggaatacaatttaaaattaactaaaattcgaaattaaaaataaacgatattgaaagaagaatccatataaaaacccaatacgagatcaattaaaattcagaataaaaaataaaatcatatccaaaattagaaaaactaaaagagagttaagtaggaatacacttttgaaacaactgaaattcaaaaataaaaaataaaaatatttaaagaacattatacggtattaattaaaatttgaaaaaaaaaatctaaagttggaaaagaaaaaaaaagatttcagttagtattacaatttataaataactaaagttggtgataaaaaaactattgaaaaaaaataccatctgaaacacatgacgagataaattaagtaatagacctataaaggagtagagtggtggcggttgatacgacatataaaactgttagtaaaacaccaaatataatcctaatgatgattaaaagaagggacaacaggcaggccatgaagcaaacaggcaaggcggttgccgggacttctagaaagtaaaaaaaaataaacctcattgataatcatatttgatttttaaaatctcaatgacaataaaaatgaaaagcagcgggcggggtgtataggagtatagttgcagagccgccgacggttagcgggacttctaaaaaataaaaatgaattccaacgatagttatgtttgatttttagaatcacattgataataaagagtaggcggcagatgggccgtagaggagtatagtaacatcgtttgacgggacttctaaaaattataaaaaatgaaacccaacgagacaataaactctgaaaactataaggtccaactcttttaaaggttcgaaacttctaaaaagtaaaaaaaaaccaatgaaaatcatgtttgattttaaaatcttaatgacaataaagaagggaggcagcgggcgagccataaaggagtacaatggcaaagccgttgacggtttggcgggacttctaaaagtaaaaaatgaactcgaacgataattatgtttgatttttaaaattccaatgacaataaagagaaaagacagtgggcgggccgtagaggggtataatggcagcgtttgatgggacttctataaatcataaaaatgaaaaccaacgagacaataaactgtaagggacttctagattaaatttttaaagattccaaggagaatgaataatagtggtagatcgagtaagaaaataaaaaaggatatgacagaagtaaggggtactaactggtgtgacttttaacaactatttaattagaaatacggggatgataaggcttggtctttcaaagtcctaagagaagaagatagctatttaataaattttaagtaaaatcatacttaaaaattatatgattttgtttgggtgttagccgagtaattgcgcgggccatccaactagtttttaattaaatatgtgcttataggtcggtttagattgtgggtgtgtatgttcatggccacgcttgtactaagtttctcaaataaaaatgaaatacacacacgcgtacgtatgtatctcattcgcagctaacctcgggtaaatctagtagtactccactactcaagaccaacagaatttccgctttttctatccaaacccatcgctttatactccatttcctgtaacgcatgtatggttatgcatgggagcgtagagtagagtcatgtttgtgagacggagacatgaacaatgcacacattggtaaaagaagagaggtaatctgggctgatactgtccggtggagggtggcgccatttattcgttcctttggtgaggatgggcagtagctaggctaggctaggctaggctggagtagctgtagccagtaggaggagaggcaggaggaaattatggcaatcatgaggggagaatagagacaacaatggaatatgttcagtgacctcggctccctcacctggatggggctcgctgttgcagctgcagctgcagctggatccatggcgaaatggcgagtatactcccctatagctggctagtcttggtggggcacccaaatctgctgccaactgttcgtgcacgactgaataattactgcttccgagcgtacattacgctcactgctctctggtaattactgaggtgaaaactggagagcaatgcaaattttactctcaaagcattgcaggctctcagcacaggttgttgctagaggcatggagtactgtactacccatgcatgattcaggtcatcaggaaataaagccaggccaccggtaccaaacttgtcctagttacttcagtaatttaatttcagctgattacttgctgaaagtatgaaacatggacttgcagctcggtaatttgacaggattattttcagctgggagtaacgtttgaaagattaaaaaaataggggtcctgaaaacaaaaggctgccaggaatagaaatggaaatcacggtcgcgtccccccggcccctcctccttttcgtcgtcttgtcactatctacccactccttttccagcagatctctctctccctctcccaaggggacagcccagtttgaaatttaatcacttttggttgcaaccccgcattcaaggccacgcacagtgacacacggccattcgtccggacacacgcagttgccaccaccgccacagtgcgcgcacaggcccagaataatcctgtagcgaccggtcgatcgttcactactactcgtgcccgtgcatgccgtcgccacggatcatgaggatcgcgttggctaatttactcctcccgcgttccaggtctcgtactacgcgaaataatacatgtgttataaaatcgatccaaaatcgagatcgataatcaaatagtgttcagacatgatatttgttaattaacgaggtttaactgaatcttatatcccgatatactgattacatgcgtttatccctatatagcatattacatcgtatccacgatcctcgattgactggaccgctgactagccataccagtcataccaacagctacgttattatacgccgtgtttatttccaaagtttttcttcaaacttttaatttttccatcacatcaaaactttactacacatacaaacttccaacttttccatcacatcgttccaatttcaatcaaacttttaattttagcgtgaactaaacacatatggttataaccaggatgccagctctaaatttaagagagcctatgatgaatttgactttaactatgtcttacacctattacaacttcgaagtcctaaactgttaccgactttgtacaaatatttggcacaatctctaacaaaccacaccttgagaaatatgctgaacaacctaaatatgtttgttgcgcgaacctccgtgtgtcaggacttgtgttgttttcatttgttattcactctgaattgtcccgacaagtattcaccaggctcaccgtaatcaagagtctctgctatattattgtaacttcttcccctctaatctacctataataaagtgttgcacctcctctcctatcatcatagttattttgccaagtgaaattagactcagttggggcatctcatactcccccaagaccatattcatctctatgttccatattaaatttgatttaatgtaatccatagacatagcctatgtcattatcgaatagataaattcaaacacaccatttataaaataatactttcttacctaacatcatactccctccgtcccacaatatctccaaccctagaatcccaaggcaattttagaacaaagtggcaaaagactgaaataccctcagtgaaagtacatccaatcattggttacaaataaaatagtagtacaggttggattattacttctgctgcaaccattaagtgctcaatatataaatactactaatatacagccaccagggcgccaaataatttgaatctcagcattgcttcattggcggcaaggatcacgaatctcagcgcaccccactacaacaaaccctatataagtgggagcctgggggagcagcgtggagcgaggcgagacgggcggggaggagcgggagggaggtagggagggagtcggaagcttgcagggtcgtacatctggacgccgccgcgtcgatgcaatcgatccagaggggcgacggggaagaaagggagagaaacgcgagaggaagagagagatgcgatatgcggctaggaggagataaggttatggagaagtcgccaactcgccatccacctatccccacacatgatacgatagagttgaggttattcggttttctgtgcaggaatcgttttttttttttgacaaagccctcccctaggaatcgagatattgtgggacggagggagtatgaatctagctaaaatatccaacaatgatatggattctcataaatcctcatcatactgatttgtacctttcgaatatgtaatgtaccgccagacagttccgttaacgtcgtcaccaacggatttaaccggatgttgcccgtgcagtagctatatgcgcccccagaataatcctgtagcgtccgggtcgatcgcctagctatgtgcccgtgcgcgccgtggccacggatcatgcggatatttactcgctatttactcgttcccccgcgttccagctctcgtgctagcggtgatacgttcccgcaccgcgcgctgcgcctccgttgcgcagattgccgcgtgcgacggtgatcgcctcggttgtccggtcggtgagacggatcgggggacgaacggttgtaactgcgggaaggttgtacgtggtacgtggtactcgcgcggtgtgggtggccgtgacgcggtgtcgccgtgtcagcgcacggcagcacggacagggggcacggacagggggtccggcctgctgatcgatctgcggctcgccggccgggacgacgccgtgaccacatgcatgcacgggatcaggcgctcgttctcatgcctctgccttctgcgcgactggccatttccagcgatgtgatcgttcccttgtttcggacgctatggccccatggctgccagacagtcctgcctctgccacgtagtctgtctgcctgcgtgtctcctgccacggtagccatgccaatgttcctactagtaattcgtacggaccgagcatgcatatactgtctcttcctcaacgttcgaaagacggaaagggttgcgatcgacttggaactactgtaccttctctcaggcaaggcaagcactatacgcgcactggcacgtaaacactgcgtactattcctactcgtactcagtataattacttcctctgtacttgtaagtcgttttgaacagcgatacggtcttcaaaacacaaatttaacttcttatttctataaaaatatttattgaaaaatgatatatgtatattttataaaagtattttttaagataaatctattcatataatttttatattttcaaactcaacaacttaagagttattcatgatttatatttctaaggtttaatttaaatattattataaacgacttttattacgattacgagtatagagggtgtactaaatacagtagtagtacgagtaactcgcagacggatcatgtgatcaactgtgaggtacagagagcattctgggtatgcagacgttggcatgcaatgtgcaagtatagacgcagtagtgaaagtgctggcttgtgatgacacgcactactttataccagtgtgtactatacgggtatacgtaggttggttcggtttgtggtctaaatagaccttaccaaattttatcagtgtcaaattttggcataactaattttagtaaggtaaaattgtgtttagattgaagccaaaatagcataagttcactattgaaatggcctattttcttaggcatactaaaatttagcttcaaaccaaataaatactaacactattaaaattgacaaatattggtaagtcaaccagcccgcaattcctccgtgcgccggccctgatgcggccttaaatatcatggcctgctgactgctgtttctggccgctcctgctatgcatgcatgacccagttgtttatgtccacctggaatattgtgggcagagggagggatggaggcaacacgcagacgcagactggatgcaccatgcatggccactggccgcaagagctggagtagctgctgcatcgatcatgtatacgtctacaattactgcagcaatatgcagtcgattttattcctccccttaatttacttttgacctgctacttattgatattgacattttgcttcacttgtttgatcactcgtcttatttaaaaaatttgtacaaatataaaaaacaaaaagttatgcttgaaatactttagataataaagtaagtcataaataaaataaataacaattctaacttttttaataaaacgaatggttaaacagtacaagtaaaatatcaaaatcccttatattatgtgacggagggagtactatatatgcatcatcatgctgcagactactctctacgtctcatattataccactcttccttaagagattaacaaatggagtgaaattaaataagataggacggtgattgattaagataagataagagattaacaaatggagtgaaattaaataagataagacagtgattgattaagataagaaagttaatgtaaaaattatttgagaaattttttataattggttgatataaaaaaatgaagaagttgcaatattacgggacaaaatataaaccctaaaagtagctactccgtataaagtggggtcgagagtagtagagatcaaggttttattggggagttttaaaggccgtggtttctgttagtaacctttctttttttaaaatagtcaagattttcacttacattttaagaattagtgctccctccgttcctaaatgctttctttagaaaagcatatctaagatttaaattttacacaaaatataagactttgtgtgatagtgattccaatgcataggaattaaagaaagcatttttcagccaatcgatcatgtgcttagatgctcagaagaagaatccaaggaatataaaattaaaaatttgatcaatacgaaaccaaaactttcttcttatctcaaatactacggtactacaatttagttcatataagcttctttcacagggactaatagactaatacacttttaaattatttctactcatccctgtttaggactaaggctgtgtttagatccaaacttccaactttttccatcacatcaacctgtcatacacacaacttttcagtcacatcgtaccaatttcaacccaagcttcaactttggaaggaactaaacacatgcctaaagtagagggactaatggattcgtcccttcagcctaaagtagagggactaatggatattcgtcccttcaagcaaacaggcccataagagcatgtacaatagcaggctataagccagctataaccacatatcgagaagaaaagagagaaaagagaagaaagcggtgttaacagtgaaatttggtaagcccggagtagtcatcggcttagagtcagcatcggcttcgaagtcctgagattagccgatgagagttgtcaagtcgtcagttgtcggattcttgctatattcggttaaggaaattgatctactaaagaaagcttatccagaagagaccgagttcaaagagaatgcggcatggcaagttatctattaattagaaatagtttgttagtttccttttatctttaggaaagtgtgtttagtgtcctataaggactttatcttttccttttatctttaggaaagtttctttcttgtccgacaaggacttgtatcaacccatgggtataaatatgtacacccggggtctatgtaatcaatcttcacaattaatacaattcggcgcatcaccaccctttttaccttttctacttcattttatcatccggcgggacttggtgcccgacggagggctgcatcggtgttcgatctccggcgaagtggtaagtccaatgttccgtcggtctaggcagttatatcgtctacgtcggcgtcgttcaaggctgcatcagtacattcgacctcttggattgctctggtttggatgctatatttgcttacatatttatcatatgtctctgttaatctagtcttagcatatcaatttagctctatcgactgcttctcgttttagggtttctgccggtatgggctaaatcgtgttgctagattagattagcttagacatctaccaccctgaaaatcagtcatcggcttgattgtctagatattatggttcttttcatacttagtgctgcatcagttaagtttgatctattaagtcgtgcttagagccataatctctagcctgctttttgactgccaataagggtttcatcggggtttcagccgatgagttatctggacgttgcatcagctcataaggattgcatatacatataagttggatttagccgatgacaacaaaggtttcattgtttaatctgatcctgtggatttcatgacatcggacctccagccgatgtgtgctttaaccttcggatcgatgcttatttatcatatcattatttgccgattggtttatactggattatattgttattttattaccactacaccatgacactagattaccaacagacatctgtcggtaaagataaacaattattgataggctatttgttggcaaaggcttttggcaaattatatgttgggaatactatgtaataagacatattatatgtcagcaattctaaatttttttggggtcaaaataactgtcagcaattttaagactagaaaccaattatatgtcaggaaaacttaatgataatccatctgtcagcaatacttcgtccgtcagatcttgattcaacggctaggatagagcgcggtgaaagctcaggcaggaaataaaaaaaaccgccgatattctgtgcgccaaaaaaaaaacacgccaaaaaaaaccctagctaggtcgccgcctcctctccccgcttccaccgcgcgccgccacctttcccccttccaccgtgcgccgcctcctccccccgcttccaccgcgcgccgccacctctcccccttccacgctcctccccatccactgggcgccgccacctcctccttggccaaatccgccgcgcgccgccacctcgctccccatccaccgcgccccgcttccccctgtgcctcggcgaaatcctcccaccttctccacaccttcatccaagtcggcggcggcggcgagttcaaagttcgaagctgcaaggtacgtggtagaaacgaaatcatattttcccgcaagatcatcatgatgattttctatgtgtgccatgcagcgcggtggttccctgagccagagaaggtgtgtttcgatttgggaagaagaaggccttgctgtccagtgagcaggtacctcaattaactctcgatctgattagctgtgtttctgaattcgatgtgattgcaacatgtacagcatttcctccctctcctattagctgcgatggcaataagttaatcccatgcattttttccccttggattgatgtggtgtagctagctagatgttttttttttggatattagcttctttggctaatctactcagtgtactggaaaacatctccgcagacatagcctggaaatatgacaaactaagttacataataaaattaaaataatgcaacataccaagttgtttcacacttcagagttatgcactttgtttttttcactgccacactgtgagtattctgaaataaatccaaaattagtatgtttaacctttaaaaaatttagatcaacaagatttttatcagattagtacctatatattctcccattattctataatctgagtacataaaaatcatactatttatacttggtaagctgcaatgtagtgtatattgtctctagctcagttgcttctggaaaaaatacactgcaagattactcaagagaaagggaccaatatcatgtcttaatttgtgtatttagaaactggacttgtatataggctagaaaaaaaatcacagttgctcaactacgtttatgctactgtttgctgattctgtcaactaatatatcaactaatatatcaaaagattactgtggactcaagttggacgttagctaatcatcatggataaggcgtggatggatgagcctaggcacacacaaatctatatacaaggagtggacaatttccttgattttgcatttagcaagtctgcaataggagataaaatattatacccatgtagaaaatgtgtgaactcatcatggaaacaactagtgatcactcaacagtttaccttgtgagtgataggaccaatatacaaaatgctgaatcagtactacaaacttttttttcatgagtgttttataaattgcatggcaatttgagtgtggaaccatgaaaacattcatagacatgatcacttaactgaacacttcttggtgacaagtgaaatgccattgtatctgcaataattagttcatttgagtcctctccatgagggttatacttaacattgtatctgcaaggtattgtggtctattggaccttggtactcccgtcactgactgtcctgtttgtaggtgtgtctacatttttgcatagcattggatgttagcattattggggcatctgaatctgaatacagtaatgttttgtcattattggggcatctgaatctgtacagttcattgattatagcattggatgttagcttacatatattgatgatagtagttctgaagtctatcaatatagtattcccttattctgaagtcgaccacctgttttttttccaattcacctttccctatttcagctgcaaacatatatatgttgtttcgttgtggttaccacaagtgaggctgacactgaatcttggctatcatgtttcacatggtgttttgttgggctatcatgtgctgcttctatgaaaaaaatagtccatggaactgttagatgaaaaaaattgggctttcacatatggtggcagtatcttctatactgtttacattttttatttcagcaaagagaatgtgatattgtggactgaagcatagctttccttattttgcaggcaaccataaaaagggctagcagaggtgctgtaaaagaaaaccaagaacctacaagaaccataaaagagatgatttgtattgtttttggaacctcgatacacctacaagaaccttagttgcatctaagttatgtaattattgctatgtacttgaagaactccattatatctaagttggacatttatgtaatagctatttgagctgatggacaactgctatttgtatcagaatactgctattgtgatactggtacttgaaggctacttgatggatgaacaatagttatgaatagtttaatattgtgttatgcatgtgtgtaacttactaaaaatgataatctgtgttgcaaaatttggagtggtattcatccatgtatgttgcaaatttaatttgaggtatggttcataaaatggatgctaataggtaattagtatatttttttgtgtggattaccgactgattgcttgtaagttattgtgctagccatctatacattaattgtcggcaaatctataacacaatgatatgctatctgttgggaatcttcttaagtgtcggtaaatgcccatctgttggtaaaactatctgtcggtaaatatgtagcaacactatcagtctatctgtcagcacatatttatctgtcgggaaagacttttgccggcagcacttggcctgacagaccctatctgtcgggaaaagttttgctgacaaataatttgacagcatataggtcctgtcctgacagatatgtagtaagcaaactaggggcatggtgtagtgtacatcatcatcagccgattgactttatatcattatccacattggacatataaccgattgcttaaaccctatcactatcggctggtatcggtatcggctattatcggctatcggctggaactactccatcggcttgtcagccgatcggctgtttagatatactatttgcatatcttgtgagttgtaggatcaaactgactggcacgcccgcatctcatcaatatttggacctgcacaggagctaagcagatctcccaggtcagtgtgttcgattttttcatcaacaagcgggctatagatttgtagccagctgcaatatgggcttcaagacattatgtgtgtatgagaggtggaaccaggtattaatggtgtagtatacttttatagttaactattatatgaatggactattatattagttatagataatttggagctagaattcggctatactattaaacttgctcaaacaacggaggagtagatcgtgagtagtggaagaagagtgtactcggtactaccgcatcaagactagagctataggaacgtcgtcatggtgtggactctggaggagtagagctggagaactgttgggcatttgtcgcctataacctcggctggcaccaagtcccaacatgcagctaacctctgatccatcttttcagctgcttggacgcgtccctcctgtaggctgtagctagctgctgctgctatcctactccaacctgctaccgctgctgctggcagctgctggcggtggtggcgttggtgcatgctgcatgcatccattgcatccatgcgccttttttttttttcatcccctttctttggacgcacacgccgcgcgcatcccccgccaaaggctacaaagcggcggaaacgcgaagagccgtgtggccgcgcatgcatgcggtatcatgcgcctcagcagcagcagcagaggcgcggccggatcttttgccggagctagcacacggcgcggtggcgccgtacgtacatatgcccagccgatcaggcggcggcgcgcgtcatgcatgcgcgcatccgaggtcaccatgtgtctgcttgcgtcgcgcgcgtgcgccgcctgctggtgatctgggtggtgtggcgtggcgtgtgcgcgcgcgggtgtgtagtggtggatggagatcgtgtggtccatctgatcgatctggccatgcacgcaccgaaccatggagagaaaggatcgtcacatcgtcatcgatcgttttttttttttgagacatactgtaggtggaggatacagtatgatatgctcacagacgacacagtactgtccttttgagttttgatggtggtcgttgacttgttgccgatactactatagcttgagccttgagggggtagccaactattgcgtactgcaaaatgaaaatgcgccacgcatcctagctactatactacactactgtaacccaatcttgttcatgtcttttatggcttctttgaaacacgagaatttacccctaaaaaaagaaacacgagaattttactacataaattgtactacttgaattagtagtaattcattttatcctgcaccctttgacttagagataaggtaacttttgtcagaatgaaactgaactgattgttatccaaattaacccttgaaaattgtttttttaagacggaggtagtaagaatgtttaagcaagatacattgcccttgatataacttgcgatgtgtactcacttgttggtgggagaaattggatccctgggttcacaaaattgatctaccttggaaaacgctcccaagtggtttttcggttttcatgaaatcattgaccaacagtgaaatttgtccaaatcttgcataaacttaaaatcagcttgaattttgttgaacttcgtaagttaactaatgagtggtctatgatctcgagtagcttgaaaataaagtgttttatactccgtacatgttttgtaaaccctagcgaatactcaccatccacgctgaaacttggaatccatatcttttaaaccttgaatgtctatgtcttcactcttttattaattagattattttgaatgtcactcttcgagagtgctagactctaataattggctgcagctcttttgagcaaaggccgggattctttcattctattatctaaaaaaaataattagattatcctttgaacttcactttttttaggcaaaagaatataataacttattcgtgtgggatgaatttatggaccagatgatggcaattcctacttctacacagattattgcatggatagaatgtgagatattgaccagcttgcaattttgcaagtatgaacagagaccagacaggcagacacaatcccttttttttccaaggcagatcagataaaatacctgtttagcttcaacgcacatagtaaaagtgagggcctgctagctcgtaactgtttccactctatagctctcacacactgtgtgctagctatattgtagtagtaacaatgataagacaaatcagacattacccgatagtttgtacagtttggctatggggtcccatgcgactcgcacacaattcgatcggattcggattcagcagcagctcccgcgccaaaaatgagaggcgcgagagcttttctccctttcctggacccaaacacgcgccggtgaatgtccggccggtgggccaccgtcacttgtggagtggtcactagttctatcgacaggagaaaatgagtactcgttcattccctaagtatttgacatcgttgatttttttaacatatttaatcatttatcttatttaaaaaatttaaataattattaatttttttattatttgatttattgttaaatatatttttatgtacacatattgttttacatatttcataaaaaattttgaataaggcgaacggtcaaatatgtttaaaaaagtcaacggcgtcaaatatttagaaacggagggagcagtaagaatttaggatatctgtttcgtattcggctaacaccaatgtactatgggatttgtgttcttgtggtaatagcgagtaatcacaggattttccctttttttaaaaaaaaagtattttccttcatttttttataaaataaataatccaatggtgaaattttttacaaaaaatatactgaatcatcaaagtaaaaaaaaccccatcttatccaacttcattgtcaaagttgttatcactcactaaaaccgcgacatgacgtacccaatgtcgccaaatggaaggaagggagacatattggagttacccattacgaggacgtcacgtgtacacttttggaaaaaaaagctttatttttgcaaaatggaaaatgaaaagattgtcttcaaatcaaattctacattgtcgtgataggtggtgccatgaagtgatcgtgttagcgttgacatattctaaataggataacttactagatgacccaaagaggttagacacgaacctatccaagtactacataggcaaatatattaaattttaaaataaaggtagtattaagcgatatacatatgtcaatatgatcggtagtatataatacactctttacgaaagatagtactcccaaatctattttagatcctacaaaagtacttaaccatggtggcttatgggccctctcccaagcccatcccactatgtggtgctcatcttttatttctgtggctgatgaacttcttaggtatatcagatctctttctgaccatgcatgttttatgatcatgtcacatgatttgctagtcatttgagatcacatgattctatacaagccaagcatacaagtatatttatatttattgttgtcagatgtaagcatttaaattccgtgtgtactaattaagtgctaatggtcttttgtttattttaagtgttgtggaaagacatctaccatttactttttatgagtattttggaaattaagtttagaacttatgaagaatttctatcatagttcattaattgcataaataaggcaaatactttttgagtggacaattttttcataatattttttgttgcagattatttaccagatcgctgaaacaaattatttgttccacgtgtaaagaaatacattttcttggaaaactttcttctacttatatttcttagactacgtgttttaagttatttgttaagttctattaaaatatgtaatttatccttatagttaagtagataatacacagcaacaacctacacaacaattcaaagtgaggtaagaatcacatagaagaaatccatgtggataaatctatgtgcaggatgtgactagtcctgactgcgggtgcaagccggccggcagcagggatacaggaaggtgaaaaggagagtagtagggcaatatatttgattggtttcagttcttggatttaatggctagatcactcaaatagcttagttgcatcctccacctcaaatactttatgatcgtacgtaaatatgaaacaacctacattttagaaatgaaatgaaagggtcaaaaacattgatatgctttcgcttgtgcggctaactcccaaggagaaaataagacgctcctctaattcgtccactcactctcatactctactgctcctcccggttgcgagtaagcttgctagcatccaacaacgctgactgtgtccattgccaccaccagggagttccctaggtgcatccccaccccaacgccctccctcccctccgtgcacctattttggacacctcattatcatcgtctccctattagatctggccacgctaagctttgagacgtcaaatttggggatatcgatcggtcatgggaaggtgcgcatgaggataagtgaggggttgcccatgtgaagcatcgtggaggtggtgacctttgcggtggtagcaattttgggacaattcaacctcaaaggcaaaacgacacattcggataggcaagctgatcatcaggattgctttctcatgtccataagtggagatgacgtacaagaaggacgaagccgataacaactacactagagccaacgagacgttgcagccaactaatgggatgtcctccacattccgatttatgaggcgtcaagagaaagggacatatttagaatgcttttacaatttatttgatgttccagcagttggaatatgaagtttcagggatgggaatgcaacgtttaatatgtctgacatctttaatttgtgattttattaattattttcatcttacagatgttggcaatttaatgtttgttttattttggatttaacaatgtttcatcttttcaaattattatggatgttgcagtctaattacctagattatttatacgtgtgtttctaattaatatagttccatcggacactagttctcgtcttttttttttctcaaatgttgtagtaatgactattcccccgtttaatttatattattagacttatgactttttttagttaatatttttatatttgatcaaatttatagaaaaacatagcaatagttttaacaccaaacgaacataatattaaaatatgttcaatattagatttaatgaaactaatttggtgttataagagttgttacatttttatgaacttgatcaaacttatagaagtttgatttagcaaaaagtcaaagtaaattataataatatgaaatggagtgaatagatcttttgtttcgcatgacgaagtttatgaaagtagaaaataattgcactaagagtagataaaatgagaaataattacattggaatttgataaagtgatggtattatagtcattttgcttttgtacgtattgatatatgtaaggtaggtgaaaaataaaattattttaggataaagtgagtaacatataactccgagtttgcctgacagccaaatgaaactgtttgaccggccggcgacgttttgtctaggttgggtgctcatcaatctattcctaaaaggctaaaacaattcacacatataagaatttggcgatccgttattactacgacatcacatttttaacacggtttaattcatcatgcgaataaaaagaaaacgtactagctagtacgtgtgggagctgctagctagctagtggtcgatccgatccctactgtacacacttcactcaattaagatttgcagcttcggtacgtgaagtacgcaatatatatgtaccagactttcaattcgtacgtagtactatacggtactatactgccatgcatcctgtatgtatgtacctcgtctagttagtcaaactgtaccgggtgaccttgccattttcatgtgaggccattacaaatgaacagtgatcgccaattcgccataacacgtacagctctgatcgatctcagatcatcaaaatatgtactgataattaaagtgttcagcctagattccttttgtaagtacgtagcaaacggtgatgtacgtgtacctaagagcacgtacaatagcaggctataagccagctgtaaacatattttaagaagataaatgaggagagagaatggcagcgggctaaatatttgtagccagctgtagcacggactacgagacgcagtgtgtgtatgacaggtggaaccaagtattaatagtgtagtatgtaactattgtatgaatgagctattagattgactatagatgaattggagctagtagttggctatactattaaacttgctctaagtagagtacgtaattgtaccgcttatcgatctgaacaacaattaagatctgtatagttaggatcattattcagatttacagtatctctctcgtacgagtatacgttggctagctggattagttacgagattgatcgagggttttggatgtttggatggcaattcttaattagctacgaggctgtcccgtttatgccaggcagatatatataggacggcacggtgtttgagcaagaaaaacagaaggtgatcgagtgagtttacaagtacataattaaaaacactcaaatgttcacggaatctaagtatatgtagttaacctcagggtgtacaaaagaagattgtaatcccggcccaaaacacagcacatcagccgtcctgggtcgatgttcaaccgcggccattgatggtgcaatactgcaatgcattagcagttgaatgacaacgcattgcttctctagcttcgcattttgttggatggtgctgttgcccagttgatgagaaatccaaacttttgtaaattaatttttgtgcccctaaaaaatcatttagtgtaagcataagggattcaaatggagtattctttagaaccttaataaactcctattttaacaaatgactccatatgaagtattttaagataaataaagggatgtcataaaacataagtgatacatgtgtcacctccggctcgggcgactcgggcggcagaaacgctagccgccgctgccacccgccttcccctcctcctctgccttgccgcctcctaagagagtcaccggctttgccggcggcttgctaggatagcagcggcggggctcgagatggcgaccaccctagatacaacgcggtcggatccgaaggtgggggacgatcggagtggtgccggtgtcggggttggcgcgcagacggaggcggcgccagacggatcctacgcatggacggcggtgataggcggaggtggaggcgggggcggaggagacgacaagtggtggggtagaccaaagacggtggtggtggggaggtcatggctgcggtgagcgttgccgaatccacgccaggcgccaccagatccagaaccaaacagaggcggaggcgacaagcggagggatatagaccgagcgtgaagcacgagacgacaggtcggaggccgtggccacgatgggcaccaaaggatccgcattgggcgccgccggatctagagccagatccaactcacctcctcggtgcaggtatctttgatgtgggaggctagagttttctttggcggcgcagggaggctggcgcggcgtgtgtggcaccaggagggttagttcgggcgatggcaaggaggccggcccgctcgatggagcgggaggctgacatcaccgacgacaggggggccggggaggctgacttgtggggttgtgcaggtacatcggtgaccacatgccgatagaggatggtcgatgatgcagcattggagcattaaaggggcaggcagcaggtgtaaatcctagcttggccttgcgggcaagcaacgatgtcattttccctcttaggagcgttgtcgagccgcccctctttctcaggtaggcagcctggtgaaaaccttgtcttgattctcctcgaggcctcgaagaacaacgatatgggtgttcatcgtcgccttttctcccaggagacactaccaaaacctctctccgacaggttgtgcgtgctctttcttgattgatgtcctctttcggaggcgccctagtcaatgcaagttggccatgttgacgggccctgtagaggagagcggttccatcttctctctcatcctctctccttgaaccctaagggcatggatagagctgagtacggtgctcgctgttaggatttagctttgggtggcccggttgtagcttctctgttggcataggtgcaacaggttcggtgctagctttctgctgagttctgtgtatgtgttttcggtgcgtggtgcgtggtggtggtgtttttctttcctttcctagctactaccttctagggtgctagctttgtaattttttctgttctacttaatgaatcattgcaccgtctagtgttggctgttaaaaaaagtatttagtttaacctaaacaataattatgttcttattatgattgctagtgtcgaaacaattggcaactatatatatgtcttcatatatttaaaatgatacttgatgggaaagtgttttaaactctcgagaacatcacttcataggatacgcacataacttcacacgttccaatgacaattccaagtccaagtccagttcggcctccagagacaacactaactttaaacgaacctagcacattcatgttaactccgatttagataatcttagacttgttggaaaacttatcttgtcacctgtcaaacgcatatggtttcatatccaaattcatttgaagtcaatgggaatcatcaaaacaataaagtggtgttgttgaaaccgaacttgggccttgggccttgcaataggttaggcccattttagaagtgcttctctccacctccatgaactagcacttaatcctagctttattttcctttataaatgtctatatacaccctctagaacaattggattttatttagttgaattttgccaggtgacattcgtcttgtctctagtcctcacttgattagtcaacgactatagactcaaagctccaaataattggtgtgttgatttgccgggtcgattggatctaccacttcaatcgcagctatttctttgtgcttaattacctattcgcaatatctaattgcatttatcatgttcttgcagtgttctctcctttgcattgcagggatcatcaactgcgtgtcacaattggtacgacatcgttttatggtgtagcgattgcatgacatcctgaacttgctctggttgatagctacgtcgcatttgattgaagtgagagttatcccctcaccagaagatcaggctatgagagagagcttcatcaaggagttactacatgtggtatgggaagtctgatgcaagtgcaatgtgtgagccttctgcaacgtggtagcatccctacctaccataatagcaaagatcaaagaaaaagagccagtgacttcgataaagcggaggcgtacaaactccgaaaacctctgtttgggagagctcacttagttacctccttttgtaggcatggtttttgcctgtcctatacatacatttatctttgttgtaggcctcctctaataatatatatgcgacaaaactttttcccttatcaaaagctatatgcaggtatggtattttcgtattgccctaaaaaatactagttccaaatgatccagaatccaacaacaataaattggcatggtggtttacctcaaaagcagccatgatcaatgcacatattaatggtgttggagattcaaaccatgggtgccgatcatacctgtttttataacaaaatgtttggatataatcaggggcagagccaggcttgagacaatgcttgagccttagggttggctaaaaactgatgaggactagggtcccaatcttccattagatactagataggttgatcatggagactcaaagttgatgatccagaggctctgattactagaatgaccgaactcctcgcaatcactacactgcccctctgttggcctcatcgaaaaagtcgtctcctgcaaacgaatcgctaacactagtaagggagtggaagattcaatctaaatatactgtgttgataagatatctctgggttccacaaaccaaactagcaacaaaactgtagtgacagaataatctaagtaaaacacaactctaattcgatgatggttactgattaaattggttctagggccgacctaagacccctaaacacatccctagtggactctaacatgatacacggctcaataggtttaaagacaatgatacaacatcccgacagtttttggacgctctcttgtttcgatagtttccgttgacttagaagtatgtttgacgtgataccaaatccattggaaaggtggtctcgttagctttctgtacatatctagaacataaaaaagggagtccgaatgaggtccaggcggcgattttgttgcggctgctcatggatgacgaggtggactcgaacttgatttgaattgggtctgtatcttttagcctcgtacatattcaaatgagtgacattctcataaaaatctccatgtaaaaccttgagatactgtctagaaattttgaaaatatataatttctaactaaaattgtcaaattcatctttagaatttttttccttttcctttgctccatcgatggatataaggattatctactcgtacttggtacatattgatatcttcttaaagatccatccatccattatattattaaaggaatagaaaaataagcctccacgttcgctctcatggcctagaaattctcacattaatcggagaaaaagagaagacagagtccatataaaaatacaatttagaaat

SEQ ID NO: 31549 - DNA, 2298 bp, Oryza sativa
tttagaaatagctggaattcagaattaaaaaataaggaatattagaagatcgaggagactagagtccatatagaaatacaattaggaaataactgaaattcggaattaaaaaataaggaatattagaagaggagactagagtccatatagaaatacaattaagaaataactgaaattcaggattaaaataacgaatattagaagtagagtatagagtccatatagaaatacaattaggaaataacttaaattcggaattaaaaataaggaatattagaagtagagtatagagtctatatagaaatataattagtaaataacttaaatttggaattaaaaataaggaatattagaagtagagtatagagtccatatagaaatacaattagaaaataatagaaattcagaattaaaaataaagaatattagaagtagagtatagaatccatatagaaatacaattaagaaaaaaatagaaattcggaattaaaaaataaggaatattagaaatagagtatagagtccatataggaatttaaaactaactaaaatttagaataaatataataaaattaaaagtagagtttagagtccgtataaaaatacaatttacaataaaaaaattcaaaattaagaaaaacatgggaagaagagtttaaggttaatataggaatacaaatataggaatacaatttagaagtaacagaaattcgaaattaaaaattaaagaatattgaaaaatgagtttagagtccacatagaaatacaattagaaataataaaaattcagaaataaaaataaataatattggaagaagaacatagagtgtatatagaaatacaatttacagaaaattcgaaattaaaaaaagaaatatgaaaagacgagtctagagtccatataggaatatatataatttacaaataactaaaatttgatattaaaaataattaataactaacacgtatataaaatatatatgaatattacacattagtagttttgtaaagttattgcaaaatttaaaattatgttgtcattttaatatatttgaataatataatgagaaaacacatatgctgttatataagagaaaatataatgatgttagccgcgcaatttgtgcggaccaccatactagttgtatataagtcattacaacgtactagcaaaatacgtactacctccgtcccaaaatataacaacctaggactggatgtgacatatcctagtccaataaatctgcacaacctcttgtctagattcattgaactatccactcccaaattactatattttgggatggacggagcgtgtggttgctccttagaaagccatataaagattgcagaagcaaacaaaattggaggacttctctgaagtctgaaatccggaaatcttgtgaaacaatggactggttattaattgttactactactattgaactcttacgaaaatcccagtaggacacatcacgcccgtttccaacatggggctaaaaacacggtactactaccgtaccttcaaactccaaatcatgcgttagtccaacacaaaatctactttgttatgatggggataacgagtttcaaacacgaagcacctgtcacaatcaaccgaaaaacactcctagtacagccctaaacccccatttttaaaacgagttggagccaaacccacttccagtagcatacaacatcacacggatgccgccgagcggagacgtgtacttactacatactactgtacatcgcgagacaacagagatacacttcactcacacaccgccccgtcattgccccggcgcgacaggtgcgccccagacaagtactactagtaacactctcactagtgagtgagagagagtttattgcatcatctagctagctactcctactagctgaagggtacagcagcaacagcagcagctgctgcttgcagcggcgcgtcaaaattagcaggtgtgtgtccacagtttcacactcccctatacttgctcatagcctcgtctccttcctctattactccctaagcttttcttaagctcgccaagaacacacccgagaaatccaaaagggagggaaaagaaagggggtggccggccggtcggtcggtcggcggccatggatttcgacgaccatgacgagggtgacggcgacgaggagatgcctccgatgcctctgagctcgggctacgacgcgccgatgcagcccgggcttggaggtggcggtggcggggtgcccaagccgggaggtggagtcggcggcggcggtggtggtggtggtggtggtggagga

SEQ ID NO: 31550 - DNA, 1839 bp, Oryza sativa
ccgtccacctcccactcgggacgcgacgaggggtactacatgtccggtatggtcggccccatggtgattggccccatggtcggcatgtccatcggctccgccggcccctccggctccggctccggcaagaagcggttccgcacaaagttcccgcaggagcagaagcacaagatgctcgccttcccggagcggctcgggtggcgcatccataagcactctgagtcccccgtgcagcagttctgcgaggaggtctgcgtcaagcgccatgtcctcaaggtttggatgcacaacaacaagcacaccctgggcaagaaggcgccatagctaagctaagccaagcaagctcagctcagctcatctcctcccggtgctaggtacctgcactgcaactgcaactgcatgcatcaccatctccatctacttctactacctccttacccgcggctaattagcctttttctttgccttcttttacctcacctgagtagaagcttagctaggttcgtagcgagcaagctgttcttgttggttttaggggaggtggtggttgctgctgctgctgcttttgcatccttccttgtttctttttcgttattttattccattgtggttgggttctttgggcttgtggttgccgtcgttgttgtttcctagtagatgatgacgacgacgtttggtgttgggaaggaagaggacatggatggcgatttgccgatcgatttagatcttgggaatgtagtacttttgtgttgcaattgaaatttccttcctggggatttgggttgctgcacggtttgtttgtttcatcatttcttttcccctatatttcttgtgcttggcacttcatcatcagtagcacttgtagttcgtctagctaacaactagggcagataaagattcagaaaggtcggctgcaactatatgagctgcaacactgttgcattcacatcgatctccctcgcttccaatttccagacctgggcaccaacttgtccatgatccgtccgcttcacctgtctactctgaaattccaatttctctagctaccatgttcgctgcatttttcttccgagttctcgatctcactgtatccgctgcatttactcgtcttccacatctcgcgagcagtgatgccgcattgctgcccatgtgttaggacgcagagcttgcagaagctatagcaatggccggggactttttagaatttagcctatgtgaattcaatgaagcctcgtcctctcttttactctacactactgcttgttgtcttgctactctctttgcttgcttgcagcaatgtgcatttctgctcatgccatttacttcgtggcaacatcgatccacctttctgcttttattaaacgaggccgttgcattcattgcgatcgaattcgtgatacgccattgatgatcacgacgagctcctcccgtctactagctcgcaggctagcatgcacatttatgtcctggccatgatcaccatgcggtatgcttggcgagagggataggaattgagagcatcatggcatccgccaatggcgcggctcgcaaggtaaaatggtaggctccacggccggaaaggaaggagacggccgtgccggggccgggggccgggagccagccttgcaagctgcctttcctttatcttttgaaagaaaggccgggggagagaaagaccgggagagggagaaaaaaaaaaccactccggtgatctcttttttggccgtccgtccggccactttcttgcttttcaccgggccgggcgcattgcctttcccgttgttcgtcgacagcggcggcgcgccccgtgcgaaaggctggcgtggcgcgtgatcgaga

SEQ ID NO: 31551 - DNA, 630 bp, Oryza sativa
ggtgtatggctagctaagctacttgggctatagctgctggcattaatggaatccaacatcttggtccggtacgacgcgtgggtcaggctctcgatcgatcgatcgatcggtcgtgtagagcgatcgagtagaggagggagggggatttaattgggaagaaatctggttgggtttcggatggcggttggagttggaagtttgctgtctgagcgcggccgctctcacatgtccactggttgcgccactgggttcgacgcctgaactgtgtgcatgcatatgtaatccttagctatatggcgaaagggaagttgtgtctacagttgacctgtactaaaaatttaggctatatttcagtttcatggtagggaaatttgaacagattagggtcaagaggatatcggcggagcaggacatgcccagttggcattgttctgtcccattggattgttacgtgcacaggagttgattttaaactctcgaggggatgtcttttcgttgcttgcatgttacttaaattattatgaaaaattttgaaaaaattgagaaatatattaacatgtgatatatatatatatatatatatatatatatatatatatatatatatatatatatatatatatatatata

SEQ ID NO: 31552 - DNA, 623 bp, Oryza sativa
cccatcacaatttcggaaatctatcatttctcaagtgcaagcacattaaatcacctggttcaaccttcacttcttacctatctttacaaccagcaattctatactttttagtcatcttttcaacatagtacttagttgtctcatgtattttcaaaataatttcagcacgtgccttagcatcattatgaaccctctcactagtaggtaaagacaaaatatcaataggagcacgagggttgaaaccatacactacctgaaatggacttatgttggtagtataatgtgttgcccgattgtatgcaaactccacataaggcaaacattcttcccacatcttcaattttttcttcaaaatagccctcaacatggtacccaaagtacggttgactacctccgtttgtccatctatttgtgggtgacatgttgtagaaaacaatagttttgtacccaacttgttccatagtgtgcgccaaaaatttcttaagaattttgcatcgcgatctgaaacaatagtagagggcataccatgcaagcaaacaatctcatggaaaaacagatcagcaatatgaacagcatcatcacttttatgatatggtatgaaatgtgtcatcttaaaaaaaaga

SEQ ID NO: 31553 - DNA, 18328 bp, Oryza sativa
atatatatcactttgcaaacatgcaacttaaaatttattttttacatgtcgcaacgaaaaaaacaaatttgactgtcaatatacgttaactagctgtagtttaatttgtttttttgttgcaaaatataaagttaaaatctaagttgtatgtttatggagtgatatatcacatgctaatacatcttaattttttttcataactatttgagggggcatcccctcgagagttcatgatagtttccctattatgcactaccttcgtctaaaaaagaaactttggtttttggctatgcacatggataattctttttgagttggagggtatattgcttgggggattatgtgcgttggcggtgggtgttaatctcccgaatgatctaaatatttgagtctcgtgaacatatatacgttctgagttctttatggcctttggggaggaatcaagatgtatatatagctcgtagcactaatcaggatgggaaaaatattatacatgcaggaattacacatgcaattatgtatgtggtctagaagtcggacagatttttggtgttcgttaattaggagaggggcatattttccgctcccattttgttttgtactccagttcaattgaaggaaaaacaaaaggtcaatatgttttttccttgattcttgaaaatattgagggaccggagaaaaacttcctggttgtacaacaatcttcattttgttcatttcatgatattttctaaaatgatgatgcatccacttacaaaatgggtagaatccatttatggaccttgaagtttattcgaagttcatcttttatcttaactacaacctgattattttcattatgaactcttcaaaagatgactaatgttgcaaaccgaagtacatcctggaacttactagtactttttatttgttttgttttaaatgtaagttgtttttctagctagttcgtacttttattacgcaagcattcgtatgttcatattagtgaaaaaccatttacctgacttttttgggtttgtgggtgaaaaacaaacggttttgtagtttggttttgggtgagatagaaatggactttgggcaaattccatgagttaaagttggacttaacccttgacaaaattttcaaatgtaatacagctgtgaccctttgggggaatttttcgaattgtaccaggaatgatcacgagctggagcagtagtaatcttgtactcggtgtagttagcaattactcatgtactggcaagcaggtcgcaagctaggtgaccgtgccaacactctagtgaaaatgtgaaatgctagattgccaggcatgtccttgcaccgtcgtgtgctgtaaccctgtaaggctaacgtcggcatgttgacgctgaatgcttccgggcatccggccggccggtccggtcacgtccgtcgaggccatttaaccatgagcccattcatcaacacggcgtacagatgccgtatacatcatgtgatcctcaatgctgcaatacatgtgatcctcaatgctgcaacttagtactgtacattcagtggaagcaagcgatcatcaacttgttcaattggtaccgtacctgaccgagacgagattcgctggctttaaagagtgtgaggaggcgttaagatacggtcattcccagttattgccccacggtcattttcgggcacatattcccatatgcatatctagctatagagtcatcccattttttgctactaatttatcttcttgatattgtagctgcgtgtcttggggataattcgcttctttgccaaaaaaaaagagaccttatcaactattggtaatgccaaatgttatcattgtcaaattttagtatgataaggtaaggtttggttggaagccttttcaactcttggtagaagttttgagagtagaaagttttggaattatcaaattttggtagagttggattggtaatattttgtttagattgttatcttatcaaattttggttagaaaaggttcaaaatgaacaaacccataaaattttggttagaatttggattttttttttagggagattactatctgaagctgctaaggctcccgtgatcactagagattgttgcactgattgctggttgcaaacttgcaatggtgctcaaaaccaagttgcccaattaatctggaacgataatccaaatttccattcctgtactttgggttaacagcagaacacagtaatgaggtgcagtttttttttcccttcattgctatagtacacaactacacatacaaagctggagagcaggataagcacagccttgttgtcgtagttctcgggagaggcgatcgagggagagcctttacttcactaggatgcgacaaaatgcagagccagccctttcaccagcggcaaaagagcatggacccaacttgtggtttctgggccgaaccggcggtccgtccggactccggagccagcaaagccgcagcagcagcgccgatcgatcgcctaccgcaacaccgcaaagcatgtattccttccatcctttaaaaaaaaaaatacagcaacatatatagtatgaaataaaacatagttttcgttactatgaaattgatcaagtttgtagaattagcacatgtgtaatcacatactaagattactatattttgaaacggaagagagcagtagtcgacatgggagtaggggttgcacatgttcggtccggttcgacgacttgatggaaagcgagcaaagtgtaggaggaagaagagtcgacccccaaaaggtgtagtagtagctagctagctagccaagctaaagccctagctaaagagacaccaccacgacatcaacttgatccatcatccatgggcatgcagctcgctcgctgtctcgctgaccgcagcggcagtaaggttccaaatgcctcggctgtctgcatgcacgcacttgtactgtggaccggttgttgctaaagatatgatccccattgcacaaccttttcctcctactctctctctctctctctctctcagacagagacgggtaacagtgcatggcaagccggtgatcatatgcagcgagcaggcgcctcctttacttggtggacatgcatgggatcagatgctgtgtatcacctgcaggtaggtccaccacacctgatggagacagcggcatggccgagctcgtagtcaaacgttggagcagcagctcagcaaaagatcgagctatccatgatccatccatccatcgatctatctatccgtaaaaactgacgagagtttcgcaggcctcacgcttactagaggacctagctagctctctcgcgctttaaagccgtcttggacgtatcgtcgcagggggttgtgtaaacgtacgtagtactacgcgtgaaagggacaaaacgaggacggcctttagctaagcctaacatgcacgctgatcgccggccgcgcgctagctcgtcgtcgtcgaagacgccgctcacggctcacgccccggcgccgcgacactgtgcagcgcgtcgcagcgatgccatgtcgggtgatgggtgatgcctgccctcctagagatctcatgccatgtcgccggatttatgcgtgcaggatagcctgagccccctgagcctggctggatggctgaccgatgccaaattagggtatctgcagtacagcagcagcaggaacagtattatttgcactgcacacagcatcgtgcgcaagtacagtacgctgtaaaacagcttatcgatcgggatgtagctatatagctactgtaacaactgtcttctagtactaccgggcacgaatccacgagcaaaatcaaagcttgtgcagcgtgcatacgtgagcacagtggcgctacactgctatccgacgtaggaggacgatgctcgcgccctgttcagtttgattcggagatatggtggccacagttggctagctatagtcgtcggtatacatgtgcacgctggtagtataaaggagcggatgtacgtgtgtcccaggggtatgttgctgtgtcatgtacgtatatatgtatggtcctcactcctcgctttgccgagctagttgccacaaattgttgctgcgtcagtccttactgtagctctctgccttctctcccactaggcctcactgtcctctggatggccatggtttttctggacttcaagtcgatgtgggcttgtgggcttaaggcccatataagcctaggtggatctcgtgaacgcgtacggcgtatctatgggcaagcatgtctgttttttggcccaagacgtgtttggcccagagccgacttgtgatttggggacttcgtctcgctgcgtacactccgcgcgcgcgcacgcgcgcttcgcttggcagaggaacgcgaagctgtgccgctctgcaacgcgagcaatccaattgcagccgtgcgccagccttgcaggctggggatgtttggtctcaggcgaacacacacacacaacacaggctagctgccctgcacgtccctgggccccatgcagaggcatggtgacaaatgcttgttgtaaaaaccttgtcacccgtaagatccaacagggttttgttgttgtgttgctgtgaaagagatcagctgatagcgtgtgattttgttctgttgtgaatgttggggctcacgttgtcacagactcgtagtactataaacgaacggttagctttggcacggcttttgctctctctttctttccagcgaaaacacaccgttctgtctcgctagtgctctagctgctccaagcctccaagaatggagtatataggataggtagctactgctactacaagagtaagggcacccgtaatggttatctataggctctctacaagagatccatgtcagcatattttcctacttggaagagattaaatgaagagagagagcaaagctatctactaacctggagatagtctatagagaaaaacaaggcaatgaattagagagctatagatacccatatagacataccattgaagtggtttactattaatctaatctattgctgagatgtatatgttttatagatagcactttaccattgcgggtactctaataagcgcaccaccactatgtgcaccttgctgtgtgtggtgagtggtgcaatgatgcatccccatgcagtatatttcggttggtccccttgaacaaaaccgagcatccaatgtggcacgcaccctgacaccacgatagccacacacacatactctccccgtctcggtctctccacgcacgagagagagagagagagagagaggcggaagtctccacgggcgcgcgtgcacgcgttgctcgaatctttccggcactagctggtatagcttactacctccatgcccaatctttttggctgggctaggagatctggtccaccggtaaaatcatctcgccaacgagctcgcaaagccgtagaaatcgatcgatcgatcgggatgatcattgcacggcacgaccctggccgtgtgtgtttgttggccttggccatggcggtgtcccggcgaaaggaaccgatcgcttcaaccggcgttcgcctcgtcagggacgccccgcaattctcgatgccctcgagagccggcccccgtgcgaaaattctctgtgtttttgtatcttccttttttgcaggccgtcatgatggctcgggcaagttcctttgattggccggaccgagtttgcagagcagaacgctcgatgagctctgctgcagcttagctttacccacttgtgcagccaattatggggtaattaacgtatgttaataattccctacacaacaatttcaacgggtattttttacaactgatttgctagaaaacttactcttcgaagcatttgttacacgtggacaacacaatacgcaatctatttaaagactgtcaaaaaatcaccgggatatgtaactcgattaaatgtaacatgagattttttttgataaaatttaatccaaccgtccaaactaggtctggacttactactatattagtctcctctatatcgtcaacccaacacatattgtttcgccctcttgatctagctagtattgtaccgttgcctcccatttcccttcctaacacgttatatatatccatctgcctcgctggtgtcacctttgatgttgagaaagcccactggactaccccgcccttgttgacctcctctctaccatgtccattgccatcgaacttgccttcggtgccccaatgttaccttcttccttgtcttcgacggatgttgccgctgatctatttatgcaccctctgtctcctaatgtatcgttgtgcgtttgctctcgctacagattcaacccaccactctatcctgaccttggctttagttgcggtggcggcgtctcaatggcccctttctccatgtcccactactgatctgccatctgcccaagcactatcgtacgtatcaatttacaagacgttaaattaattggtatctaactgtgatcacaatactccattattaaggatcgatttacacaaaatgtttttgctaggtcccattataaaaattatttccaaaatacgtcaaaccggcaaaactaatttatttcaacaccgaggccctcttctttatcaccttttttattacaactttggacattacatttcattatatgttttattcaaaattttagtgtaaatatgaaaaaaaattataagtcatccttaaactaactttaatgataaaacattgttctcaatatgttttcgccattacttttttctcacatattaatttctacattccaacctatagacgagccatttggctccacacctattatttttctaccttccaaaagctaagaggttaattgggacgtacgacagattcactgtccaccacttacttttttttataccgttactagcaagaatgccagtctgttgtaacgggtgaaggcaaacatattaaactacatgttatctcatgttttttttaacaataatggcaatcatattaggtagcttatcattgtaaagatacaacatcgataagataggaaaccgccgttggacctcccctccaccgcctcctcacaaagcagccaacgccgaccaaaagctctcttgccgccatacgttgctgcacctcggccatgtgtcgcacccctgctcgttgcgtccaaatcacctcagcctaagaaatcaaccgatcaatctcttcctttttctttttctccatgttcaacatggcttccttcctgctcatcaactccgactccgactcgagatgcgggggtggagacggaaggttgaggggcaactgaggagtagggatatggctgttggatctatcctactcatcaactctgactccgactcgaaagcgagggcggaggtgaaaggcgaggggaaggagccgatcagtcctgctcatcaactccgagttcgattcgggaagcaggggtggaggcagaaggcgaggggtaggaatctggccattagatctattggataaagggtcatgattgttggatttatggtagacaaaaacactatcaatgttttaagtagtatatagataaagataatattataaatggaggggtttctttgtctggagaggataaaagtcttttatgctaaaattacgttatatcggtcatgtatcttcgcaagttgcatcccacaaaaatgcaatccaagcaggctaaccataaaagaaatccccaagcttcctccaacaggtcccaactcacaagattcaccatcctgcgtgcacattttgcccaaacatgtaagtatgtaacacgacaccagtctgacgacgcagtcgaccgcctcgcatcgtgagctccaccaactccgtagctagatagtcagcaccgtgcctggaacgcacacgcgatgagctgcttcgcctcgcctccacacccgcgattccatcgatctctgccgcccgcgtcgctacacgttcatcatcgccccagcgatataccaagatatggttaactatgctcctcagggagaggagattagttacggttggtttgatgcagcgctgcacggcgccgtcggcgaaaaactagtaaaaaagacggcgtctttagcgggtgcacacgcctgttaaaagttaataatctcagcgatcggtgatcagctggtcttttgcacgtaccgttccagcttttgccgcgcgctgtgagtgacagccactgcgactgcgagcttaccagttacttccaggctttccctttgtacgtacgcgcctgctgcctcttgctgtgccactggtcgattcctcgaaacgtgatgagtttaataaactttacttaaaacatcgaagagctcacatctcgggtgataatttaacggtgtggcatacgcaaatttaatcaaatggaattcttgttcttaacctttctgcgtgccaagagacgttgtgtacactgacgggtatatgtagataagtagatttatacttgagcgtaatgttaggtaatgtgcagagatcaagatcacatatagaacggccatgaaaggagacaaggattataaatgtgtatgtgacagcgttgagtagtactagatatgatggagactctcgcttaggataatctccgtagacgcctaaaccctgtggtccaatgccctaatacacatcataacatcactgctactgatgataggatttgcgtagacaacgtactagatctctgcccaagagcttgacgagatccatttttcccttgaaatgctgccggagaaatgggccaaatggcatgatgattacatagagatagtccctactcactagcacaaactttcatatggtaaacttttcctaatttcaagtgccaacaactgaattatagacaatcattttttttcccgagatactaatacctgatgccagtatgtcactcattggtgataatgcacttgtatgaatatcgatctggcattatatacactttgtgagaatgcaaatgtaccgttttaaaatgtaaggaatttcacatgtagtagattataagagaatgtgtaaggatatatttaaagtgactagcttacaatatcattccaattttcttaagtctccaagtttgaattttaattttagataatggaaatggtttacaactttacatcttcagcctccactgttgggcacaaagccaaaaagtctttggtcttctagtttgaatgagcagtgaaatttccaatccggtgagagttcatcactgcaatttgcagccaaaaataaaaactaagggctctttctcatttttgtggggaatgaattgcttcttataaagtgctagtgctagaattttctttataaattgagttatattccattctcatattccctctatcccatatcataaggtttcagtaattttaagaaaaaacaacacttgtagtctttaactagcaagtcagtaacaagtgggttgtttggctgcgccacagtcatgtcaagcggcagctgactgcaatgcaacatttttacagtgcagtccaacaaccccaataaatgtatttctattgttatgtatattgtatcattatattcacatttggaagtatttttatatgatattaattttgtatttgttaataatatattataaaagattaatgacagtgtaatgttagagacagccatactttaggttggagggagtaatatttaagaacttttacgctacaatatactagtatacttatagtataagtgatataaaggtttagattaatgtgtcctctcacttaactatattatagttaaaaggattaaaactgtgtttctatactaccgggtgttggtaaatctatgaattcgtagcatacagtgaaacaaggctaggagttttccttgctcaatcacattcctcatttgtcgtcatcattcaccacggtgaggcacgctagttaccgcaagtcctcgagcgccgccgccaatcaccctcgatgactagagaacaaaattactgaaatattattttcaattttgaagaaaaattctaaattgtcctattttcatctccctcgatggattcttttttacgtaacaaattggacctctttatgataggatccaagtatccaacccaactcggcatgggaccattcatactcttgacagccctatgtaactgttctttttagatgattgagcatttagcccttaaattaaggagtaaaatactaacagaagcacctactaattcgaacaaagagacagatgctcaacgctgaaaccgcatggtattgttaagtttgtcttcccaaggttcgtgctgacaggtcacaaggtccccttcttttatttcctagggaatgcggtgctcatggtcttagagcaagtttaatagtttaatagtatagcctactactagctccaattcatctatagccaatctaatagttcattcgtacaatagttacatactacactattgatacctggccccgcctgtcatacacatactacgtcttacagttcgtgctacagctggctacaaatttatagcccgctatccttctctctccttatttatctccttaaaatatatttacagctggcttatagcctactattatacctgctcttaaagcagacaagcagtcaaacaatatagagataggcaggcagagcaatatactgaaagaaacccatttcctctttttctgggtcttgttaattttcttttctggttacaccatgttattttattcatgtggatgatcatcattgctgatcacaaaaaggagtgctgccgcctctaattttctccttacaaatgaaatggaaaaaagaaaacaatactgcaactaatgcaactagagctagtgaacaaaagaatactacacagccaggtcagtgcatgcctagttcttggacttgttgcctaaagcccctcaccatcctttgtcttgatcatctcatgtagcttttatgttttttttcttcttttttttttgaaactcatcaagcttttatgttgctacaaagcttttctttgttctttgggggcacctctcatcaccatggcttgctggcttgcaaaagcttagcaattaggtgttgtcaacctcacctctttattcatcagcaacttcttgctagctagctctctctcgtcatgtcaaaattccctcccttttggcccccttccagtgttctttctttctaacagtcgttgcaatcgaaaccaattgactttgcctttgtcgagatgagtggtgtacagactacagagagagtgatctatcatttggcactttgactggtcagtcacctgctaagcttcctcctcttcttgctagtgaccggggagctatcaaagcaactcttccttcttcctcctccatgtgaggcaatagttgctgcatcagtatcatcacttttgtagctgaggcagccagcatccagcaccgcaacagggctctcaggcacagaggaggaggaggctgaggctgagcctctcctggtgcttgcaggtttaggttgcacagtgttaatggtggccatggagtagtgatgatcctgaatcgcttcctggcattgcaacaccctcccctgcagacacacagcggcaaaagccgaacagcacattaactccccgagctcacacgcccataaatgcgtttcacgcattctgaaccggtactgtgttctacgaaagtaccggttgcaaattatgagttattataattcagttatgaatgtgatggatccaaattggtagtacacatgagttattcagaattaaacgagctagtaagagtctatgaggatgagtttacgtgagggtttgcatcaatctgtaccttatctacatgggtgaaagcctctgcgatgtcttcttctaccacgccggtggcttctccggccactgtggcagccaccgctgcagcgatctccgagggtctaaactctaggaatccagttcctgacaagtttaacatgcatcgtcagactatgctgagaatgctgaattatggtctgatctataggatgtcactgaatgaaaccatgttcaccaccttcctatcatggcacacctgctgctatgcgcaagatgagctccgacgacctcaggagccagcttctcggcgcggcattgccgctgttgagctttcgtaggaagtagtcgatgtaggagaatggagtcacggcttgcatcctccaattgaggttggtgagaacaagaagctccattctatggatcgtctccacctcgaacaaaaaccgtggttccccaatctgatcaacaacaagaacaacgcttagaacaatatcaaacaaaaacgcaacgcattgcgaaatctgagatgcttgtcacggtttgatgctgacctgaagatccaaacattgcgggacgacggtctcctccatcttggcggcgatagacaagcacgcaaccgagagcaactgtgtcatccaatccctgccttcctgtatttgcaagcatgaatcttagctcatcatctagtacttgtatgaacatggacagcattggccacatcttgagatgattacaaacacaatctttttgattcttaccggcagctcgtactgagacaggaaacggtccaggtagtttacagccagataggcagtgacagagctgaagttgtagtaagtgtaaacctgtagaaagataaaaaacacaataagttagagatcacatggtaaaagaaacaaatttttcaggacaagaactccacagcaattatcttctatgcttttatcagaagtttttttttttggctccgaaaaaatgccgccccatcattgcaaacgttgtagtagtacaaactagaatcagacaatgcacatcgacatctcgtgagtaagcgaacggatgaaaggccagcttcgtccgagatgtatggtcccaaaatttaaccccaatttgcttttgtcatcgtcacatttatcgcactacgacaaacaatgtttattactcgaaacacagtgaaaaaaaaaactcttcagtgcataatatgcattgcatttacgcccgtggacgaacgctagctgcagattagtgaaaactggccgagaaaacaagttgcaggaatggttttgaatccatccagaaacgaagtaaaaaagacacgtttttcccccctaaatgaacggagctaatcatggcagatctattgcatttactcagaaagaccaaagaaaacagcgcaaaaatcattcctttttttttctttctttcaggcaatggcgcatcctgtgccagatcgatcaaagaatgcacctcccaaatccagccgatggcctcgctgcggacgcggagatccacgtcgccgccgccgccgcggagccgctcgccgtagtccgccctcggcatgtgcgcctgctccctctccaccaagctcgccacgcactcctccgactgccgcgggaacatgtcctcctcctcctccactccacccccgccgctgccgccgccgccgccggcggcgaggtccccgaccatcgaccggcaaccgccgctcctcctctcccccacctccccctcctcatcctccagccacaggatgctgctgttgtcctcggcgcagagcagcatcgacgcggccgcgtcgtggcaggacgacgagctcggagccatctctccgcctcccctcccctcccctctccggttggtcttcttcttgggctagcgagtcaaggacggacagtgacaaggacagagatagatagcgagagcgagagagagagacgctgcgcgctgtgctgctgccgccgaggccgcgctttgtactggggagggagacaggagggagaggggcagtttgggaaagcgcgacgcgacgcgacggtacgccgaaattgggacagccggggcgggaatggagggaggggggcgcaggaagagggcacggtcacggtagtggaggccgtccgatcggatggatgggcggctgaaattggaggctgggaggacacgggacaagccccttgcggctctcgcgcgaagggttgcccaaaaggctcggccctgtaaacacgttcggtgtggatgtgctcctgtgacgtaactttcaaatggtttggtggctgacatgtgggtccgagagtggtggagctcacatatcagtcacgttgaagggtaacatcagaggatcatcttccgtgtttgggaatttggacacggttataaaatacttttagcgagttatacctaggtagtactacatgctaaatttagtcattttttatggtatttgtaacgttacatgaagcttcgtccgatatgtttatagggtgggcgtttaatccgaccgaaaaattcagtctcgatctgttatttagaaattttggtcatttaaaattagagatcgatcggtcttggacaccaagaaattcggtctttgtctaaatcatgaccgaaattttagaaggtccaaaataatcaagcgaagtcttaatttctagataaaaaaatataaacacaaaatagactcttgactatcatggatcaaatcaaagcatactgaaggctaaaattgggtcaaaattcggtttaattgggttgttgatcgagtactaaccgaattgaccgaataaaattcaatctttcaacacctgactggcctagtgattgaatttttcggttcggtctttttctgcccacccctatatgttcaacagtttaaaaaattaaaaggtaaattggcgaaacccttgctaaatttacctttggctatgatggtagaactacaaataagtcgaaaaaaaagcaaccaaaaacaattttttttccgttaaaccttggtggttacaatagaaaaagggcaaggctagaaaatagactacaataaaaaaaagactcaaaatcaacttaataaaattaaatttgagttggaattgataagctaacaagcaaataacgagagacaaaataagttggtgcttttataacaggattgacacataccccctccaaaaaaaaactaatcttgggtttgaatttggacatacatattcaaacgtaggattgggtttttttaggatagagggagtattttatacctagattgtactctctccgtcccaaaaagaaccaattcctggctatgatcttgtccagattcatagcgagaaattggttctttttgggacggagagagtatatgagaaacctcgagatcgtatatggttggttgggaaagggctcatctaaagtactgccctctaacgtgggtcactgacatgtaggtccacatatcagtccctcaaagttagacaatagtaagttagagggctatgtagcttaagtatattttataacataggagatgactatgtagctcaagtatataattagtgtgtggtgttctttttaataaggccttgacgtttttctaaatggaattcatatacatattttattttacgaggataatactttaacaaacaatttctctattacgctattttaatagaaaagattcttattaaaaaaatgcttactaattatgcttccatgtcacataactaattattaataaagcgaatgatagctaaaatcttatcctaatgaaacaaaatgtcttataataaaaaaacaggtgatattgtctaattgagcgatgatgattgtccaattaaataacccggtgattatcttacgagcacatatagctgaactagatcacagagcaaccaaggttagttatgacacacagataaacggaatcggcaaaatgtacatgatagctgatgatccaataaaaggggctaacaagtaacaaattctattgtcagtacacatgcagtacgcattcgctactagcaatccaattaaccacacgaatgacccataaatagtcatttgaagtgtagatgtacatcaaagacaagcacaaaactccacctaaaatcattcactgctgaacatgtactgtacagaacgttgtttgatcatctctagcgccaaaatgaaaagaaaaaaaaagatactactgtactctgctaattagggcgttttggctgacgagcagctactctctgtttgtatctagttgtgtgtacaacacgtactgtctgaagactcatagtactaacgaactcgagtagagatcagatccgaaattcgtgctgctgagattactgtgtggtaagtaaatgacaggagtacactctgtacactatagttcagcgtaaccaagaaatcaaacagagtagcaatgcatgcaaactgaaaacgatggctttccatgtttgggtctacactacaagtactccctccgtactaaaatataaaagattttaaatgtatgagacatttcctagtactatgaatttggactggctctatgtttaaattcattgtattagaaagtgtcatatgcatctaaaatcccttatattttgagacgaagggagtactactgaagttatggaatttccagaaattatatatatatatgggactccatggtgctcgggctctaaggtataaaacacacaaattctctcaaatttttaaaaattttcaaattgtgagtatatacctaggtatgaatttgattcatacaaatacctaacaacaaaacaactcaaactcaactttatttcacaattcattattacatacctaacgaattatatgtttggatgttatatacctagaaccaaaatctaacaaagaaaagttcaaactcagttcaaacttgttagtaaaaaagttaatgttcatatctaaacatttaaaaaaatttcatactcattcaaattgggtatatatatatatatatatatatatatatatatatatatagtaaatttgtttggtgctccatggtgcccgggcaccattgttgaaattgagtatatacccaattcaaatgagcatgaaactttttcaattatttaggtattaatattaactactttactaactagttgaaagcaaatttgaactgaatttgaacttgtttttgttagattttgattctaggtatatagcatccatacatataattagttaggtatgtaatcatggattgtgaaataaagttaaatttgagttgtttggttgataggtataggtatgaatcgaattcttataactaggtatatactcacaatttgaaaattttgaaaaatttaagtgattttgtgcatttgaaaccatggtgccccatatgagtgtcatatatatatatatatatatatataaagttgaatccgacatgcatttatagtctatagaggcaatttaatcaaaaattgaattcaccaagagttcttactatcgacatatgtgggagcgctctcgctcccagagtctttgctcgggatatcgtgtaaggaagggcgcacaaccacgtaggaggggtgagaaactatgtttttcaagtagccacctttttatttaggaagttaatgctcaaattctctttagagattctcaaagggaggagtgttggatatctgttggtgacgctcttaaatgcaaaatgagaggttttagatattcctatgaggacctcacaagtcacaaacaattctacaagattgtaaaattatgctactacatctattctaaaatatagcaagtaactatagtatatgtggtgtcaccaatcacatcacaaatttaatttcaagcctaattttgatcaatacatcaggataaaaattatgctgaaaaaaatgtacatgtacttcaagcaacaaggacaagacttttgtacaatataatctaggagtactctgttttggtaaagacttgtacaatataatctaggagagtactctgttttggtaaagacatgtacagcaaaatccaggagtattcctgttttggtaaagacttgtgtaaaatatagacatgtatgaaatgcctggccccgtgcagttgtgaaactgtgagaggagctcgatctgctagttagtatttaattttgctcaactacaattacaatctactgcaacaaatgcaattggcctgttgatgatataacacaacacaatcattcacaaatgtgtctgatattattgttccttcccagtacagatatagtgtaaaaactatacaaacactgtgattagtgttagtacaaacatggccaggagcaggacatgtactcgatcacatcacgcatgcatttccgtcctagaagcattacggatcgtcttggttaattaagtacagtacttagattcaatctgaatacggattatgattacaatattactggttgaaagtaaaaaagaagaagaaaacaacaacgtgtacaaggcttggacccaagttgagacttgtttgggagataagagcttcaagctaacaacatggcggttcttttgtgctttacttgcatagaatttcggatcgcttgcttgc

SEQ ID NO: 31554 - DNA, 8374 bp, Oryza sativa
  unsure (1)..(8374): unsure at all n locations
attggctttcccgaaagagcacacagaaaaatatgcagtttatcttccctaaaaaaatgcctagattaaactgcaccattagtatcatgagcaggtacaacaatgggttaatagcatgcttacataggattttttatacatggccgagaaagaaaacttggagagagaaaaacgagcgactatttagtcgctggctcttcgcgcgagcctatgcatttcacctaccataggcccacctactctcacgacaaccaatgaaaaaatgaatggggacgtgaaatacacttcttgatagtgggtcccgcgggcaaccaacgagggatggtcacaataaagtatacaaatcactttcagatgtaattgaaggtaaagaggggaggtttcgcgaaactctgcttgggaaacgggtcgattactcggggcgttctgtcattgttgtgggtccttcactttcattacatcaatgtgggttacctctagagatagcaataaagctttttcagctatttgtaattcgcgatttaatcacgaaacgtgctacttctaatgttaggattgctaaaaggaaaatttgggaaaaggaacccattgtatgggaaatacttcaagaagttatgaggggacatcctgtactgttgaatagagcacctaccctgcatagattaggcatacaggctttccaacccactttagtagaggggcgtactatttgtttacacccattagtgtgtaaaggtttcaatgcagactttgatggggatcaaatggctgttcatctacctttatccttggaagctcaggcggaagctcgtttacttatgttttctcatatgaatctggctggttcctttggagtagacactagctcgattaaaaaaaataaagaagtgttgcatgttgttgtatgcattatagattagctctctattgaaggatgtggcactcggttgccgccagcagtcgccgatactattaaccttcctctaacatggcagcagtatccagtaaagccagtaatgcatggttcctttagattgaatgaagttcatagaattttttgcaccattaaagtacttggaaaaaaaatctgtgataccctttgaaaaaaataaaaacagcgttacaagatttctatgggttgcttccctaccctattctataagaaatttaataacgacatcaaatctttgtattattttattttgctaagtccaatacaaactctctatctctctcccatataagattttctttaaaatcccattgtttcaactaatgtgaaccatccaaagagtacattatttatatctattgtttttcgatttgaagggcatgttcattttgttaccaatttcgacctgacaatgtttaaattttgataattttgacgttgttaaactttggtagtgttggatatatttagtttgacgtctttcaaaaatttggtagcgtttttataagacgaaagttcggaactaccaaattttggtaggatggcattcataaggtattgtttagtttgctatcttaccaaaatttgatacgtatcaaagtggcaataaagagaacaaaccctaaaatctcgaagtattgtatagcatgtgacaacatacttctattttttccccatgttttaaaaatcctaccacctgcgtttcgaaatataagagatttagctatgcaaccaaaattccttacctcctacatcccaaaataaatatattgttcacccatctcaacacatactaatacaaaagtaaaatgactggaataactttcactttatcaaatcccaatgcacttatcctctgatttatctacttctaatacatttatctcctacttttataaactctaaactgcttaaaaatacacttattttgagataaataagagaatacaaagataaacttattttaaaacgaatggagtatatttttaggactgagatcgtatgatccaaaggagccactaagcgtactccctccgttccataacaaaccaaccgagaataaaactaatcgagaagtaaacgggatactatctaatactataatggtatatccagattcattataataagcgtagggtacgagaaaataacagtactccaacaacagtgcagttttgttgtgacaataatcgccgccggccggccggacgggggcgtaaaggatggtaccagacatgcacagattttgttgacaaggacgtcgatacgaatcggcaaaacccttaactccggctgtctctcgccgtggcttaaacaacgcacggcctgtgtaactattctctcaaggtgccattgggaccccaattgctttaatttgcaggtacgtacaagggaaagtagaaaaaccaactaggagcttacattaattcacttgcgtgtagtacattaaaatttgcaagagagatagcagtatatgtgcagtagcatgcatgtatgtttaattattaactgcagtagtattatgatttatgagagagtagctatagtagatcggaatcattgccctgtcgaggataaggtgcaaaactctggcccgtaggatcggagggagggtcacgagatcgtatcgtatcctgcaggtgtgcccgcgtacgtgcatcttatcagtgcgtggtatatatggctcagctggcctctcgtatcggcgtgcaatctgatccccactctgtcctggtagtgcttacattatttgttttattttttctttgcaaatttgctaactacctttagagtttggacagacatttgagaaacaattctcatagttttaaaccattagattgatctcaagactcgtgtgtccgtcctctttcttctctcgctccgacaacgaggatgtggcgataatctcaccgggttaggtttttggggtcggaggattgattcaaaggagggttgggtttagagcgagtctagaagaccagtggacggtgagcaataggaggatgatgagacggtgggggcgccactaaagccgtgagagtgaaggagggcgatgggaggtgaaagatttggttggagatagtaggggagtcaagacggtacgtattaaagatgacggatattgatggccgatccaacggcagaaaccacaagaagtggaggaagatagctcaggagcaccgacaatgagaaacatgatgggggagagagaaaaatgaagtggagggagaagatctgtagtgttgttctcggcttctcgctaacatcagaggtgaagtcggagagacaaagggatgacagcgcgtgaggcagggagaaaggtgtgtatgtgatgatagcaggaaagtcgatgcgagtgcgtcgctcaaatcctaatcgatgggccgggattaggggacgatgtgttggagacagatgaacacagatagcgagggtgatgtgtgatgcatttgattttaattaatcaaatgattagaaaatcataacattacattggggaatttctcaatgatgtcttataggtagtatttttcccataaggcttacggtagaattggcacactagacactagtaaatataatatatgcatataatataattagagatcttgagggtaaagaaattaattaataacaatttagtgaagatgatgtgttaattagttaattgtatgtatgtatgcacgtcttatgtaatgaaacatctggaaaaaaataattgtatgaaatgaagcacaacttaaaaaaaaaggataaaaggcattagggtagattatagtagtttcatcctactcttgatgagtaaactctggctccgccagattcacgatggaattattgacggtgcctgatatcgccattacgccctaggcgcgcagcacaggatggcctcagcacaagatgatcatctcgctgcacctaaccaaactcctccgtgtgcccgtgtggcttacctcacatgtacacttcgtgcggtttccaccaaaccgagctcccgtacattgtacgtgcactaattttgccgggggcgcgcgcggtaacggagcccaaaaaaaaaaacgaaactgtagatgtgcacggtacacgtctccgtggtccacgtgctatacgcaaacgcaacgcacaacgtcaataaatcccgtggtccacgtagcttgctagctacacacgagttagcttagctagctagtacgtacgtacgtaatcgtatacgtagattgtcacttgtacaacacagtgtcccgtacgtgatctctgacgcacgtacgtacgctttgttaattagtatacatacatattggctgtgggtgccgggtacgtagtgcgaaatgcgcgcgtacgtatgtagggcgagtactatacagtatgtgtctctctcttttggatgtatatgtgtatttgtgagcctctgcaatcgatcggaatcggagggagcagaggatcgagggcagagtccgtccggtagatctctctcctgtctccagattcgtgatcacgtagcttaattttgtctcgggcggttaaagagttaaaacatacacgtagtaaaaaataactgcaatgggagcgtttgccctctacttataaaaaaaatgggactattatttgaccccgttttgaatcctaactatcaatttgaccctactttttagagtttgcttatttgaccatccttatcaaaaacaaagcttccgtctgaccctgtttccattagtccattaagttttgatttaaaattaaaaaaatacaactaatattcataatactcaaaatacccttagaaaaccatatgcatccacccaaccctatccacatttctctccttgcggcaacggcggcgacttgtggcgagtcagcgccgccaccccctcagatcggcgccgccctggtgatgacgacgatgagcaggcaccggccccagtgacgacgacgagccggcaccagccctggtgacgacaacgacgacgaggagtggtggcggcggctcgtcgacgatgaagagccgaagccggtgccctgctgacgaggaggaggacgacgacaaagagccggagccagcgccgccacaccctcgccctgtaacgacccgcctctcccaggccaggcccacttacatctaacacctttcataggtcatagactgccctcacagaccaacacatgtcttttctgcacactttgtcctcactcgtgtgcacccgggaagaatttcccgatcggtcacccatcccaaattgctccaggccaagcacgcttctgggaagaatttcccggtcagtcacccatcccaaattgctccaggccaagcacgcttaaccctggagttctttggagattggcttccagaaaagaagttgcaacttgttgatatgagtattctattaatcctattaagccctaggccgggatgttacatgccccctctccctcagccccctcagagcgccgccgccaccggcccatcagtcgccgccccgtggaggagaggagaagagaagagaagagaggagaggagaggagaagagaagagaggagaggagaggagaagagggaactgcgggtgggtcccacacgtaatagggtcaaatcagtaagggcaaaagagacattttgtgctttagttaacaccgttagatgcccttaacagaacagggtcatacgcgagcttctttttgaaaaggagggtcaaataagcaaactttaaaaagtagggtcaaattagtagttagggctcaaaacggggtcaaataagcaattgtcctaagaaaaatagaatgcagtaattatgagaaaattttaccagtttgggagaaatcgataaaatgtttttttaacgactcgcacgagatggtacgaagttctatttacagagcagaaaaaaaattacaagattacaatattggaaggtcgtagctagaaaaaaggaaaaaaatataccaccacccacacaccgacattgccaacacacaggtccgggagaaggctagcactggaccggtcgccgctaagtgtgaccgaccaccgctaggccaacaaaggaacacagacgagatcgcccaaaaaaagtccttacaaccaacacaaagcccaactctatcctagagcttgctcgcaccaatcattcgagtggtttcggcaagaggatgcctaaacgacgtctccaacgaaataagcgacagaaaaccgtcaccgccgttcggcagggactcaaaagagccaagattgggctttcgcttggcaaccacccttgagggataagacggcacgacaacgccctcaggagggggaatgaaccatcgttgtcggtccggccaagtccgggctgggttttcacccgcagctcatcacctgcgagtccacggctgacgcatcgatgctccatcaccgctcaacctctgccgacatgtgggaccactgcactggcgcccccaccgggcggcctttgtgcatcgaagaccgcgccacacccaccggtagcttctccttgcaccgtggtcgtctcctttaccgccggccgggcctcatcgcgccgcgtcagcctcctccacccccggacgcgtctctcgcgccagtccggcctcccgctatcgccgtgcctctcgcgccaagccggcctccaccaccgccggtcgtgcctctcgcgccgtgccagcctccactgccatcgcctgtgcctctctgcggcaagtcggcctccgactcctcctccaatcattgtcgtgctagctaggtgcggtcgtctgccacgcctccagctagctgtccgagaccgccatgcctcctcccaccgtagtcacggtcaccaccatcgtgcctcctccctccgcagccacagtagccgctgctgccaatggccagccacctcgccgttgtccggccgctgccaccaccgtcgccacgagctccgcgccgctgtcgccgtcttgagtgcatctggttgccacagcagccggcagccgctactgttgtcggccagctgcgggctccgtagcgccgccaccgccgcgagctcgccccacaccagatccgtcctcgggggaggggggatccacctccggcgtgactggatcctgcctgccgtcaccatcttcgctaccgccttccattcccgccgtcgtcagtccccatctcttctccttctccatcgccaccacctccagaccctgccgccaccaccgccaaccgccgccgcctcaccacgctgcctcgccgtcggctgcctccccgccagatcgcgatggctcggatctgggtggtctttcgccatccgcacggccccccactaccggcgagacgagagaaaaacgaagccccgctgccatcgtccttgtggccgcgcggctttgccggcgacggcgaggcggaggaggaaggggggaacgggcgacggcggggttgccgcctcccgtgtcgcccgtgagggaggaggacacgaaagaccctacgaggacggacttagacaccttgatgtaaaatcgataaaatgtcatactcactctgagtagcctttataagggtacaattcgtcattacaaaatgcttcgttctactaaatgccgctacgaaatgaatttgatgaatgccatcacacgaaaaaatttcttccccttttaccttttttgtactttttgaatgaaaagtatcccacacacgacttctttgatcaagaaccacatgcactagcaacgttacatggtacactactagggcctaagggttaaaatagataagatcagatctacttcaaatccatccgaaatgagaatatggtatgactgtatttatagaaatctagtagatataatacgtgcattcagatatagatatggtgttcctaatatctggtggatactaattatgctacggaatttttattggattatccaaaaaattttaacccatgtaaccactccatttgtttttaacccatgtaatcactccatttgttccatagaatataagttggcccatgcatcaattcatcagataacctagactcctctatcgcaagctcacactgtaacacctcacacctatgtagccgccaccactcaccaacgcaatgcagggatgtaacgagcggcaagagacgccccttccggccatcctaatctcctctccgactcagcatatagcctcatgataatgtgatttccaccacggctggtgatggcctacaacacgatggtagacagcagcaagcgatgcctctccgactctcgtctcttgatagctgactgattattgtcctcgagagtataaatcatgttcagaaatcatatgctctatagttattatattgttgcctgttgcattgttgactcattattaataactgattatatatacgtggaacctccaataattttaatccatttttaaactnnnnnnnnnnnnnnnnnnnnnnnnnnnnnnnnn

SEQ ID NO: 31555 - DNA, 1068 bp, Oryza sativa
cgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccacttggcgggcactctcagtgtctatcagaatgccacgggcaagatttgcggtgtctggcgaccagttccacgtgattacaagggcatcctgcgcgacgatcgtctccatgttgtcctcctttggggcaacaaacagcaggccgagt

SEQ ID NO: 31556 - DNA, 1001 bp, Oryza sativa
cttactcacgttcagtaagaatgtaagaatgattagacatacttggatccaatcatcaccaagtcctctaattgtaaaagggcttcatgtactactgtgatacaatcctttttaagtctgtatttcagggggggaaataattgtttgggacagacgtgatagtttaattcatttttcagtataatttcatgggaatgggtgggcagttgactattttatacatccagctcaataagtgtaccttagcattcacaaatcacataggttttgaggaagtcttagaaacatgggtttgatacatccagaggaatctaagtaatattttatacagaatggcaataataatatcatcatatgcatacttcagaaatacatgaatttctcaagtgagtcctattgcggtgcattttgctctcaagattaaattagccaaaaccaaattaaactaagacaaggcaccttcttttcttgtacagaagaacaacaaaataaattccgctttggttgggagctcactagaagagctataggtacacagaaagctcacccagcattaaagatgatcggtggaagcaaataaatgaagaagaggtcctcactgaacacaagaatgtgcgagttcttcccaccactgacgagcagaatcacacctccagtgatcagcccctgcaagcgccaacccacagaacaaaactcaaaaccactcccctgtaaggcaaaaccacaaacacctggggtgcaaggccagagagccctctcatctcaccatgacaagcgcggtgatggattcattgacccaccggttcccttccagcaggtgcccgatcacaatgcagctgcacagcagcgccacgaagatgttgatcgcgacgatcgagtcgtagtccgacaccaacagcccgccggatttgagaacgagagctcccaaatccaaccccatgtcgaccgccggcacctcagtggatccttctcagctcacccctgcagaatggaaacgaaca

SEQ ID NO: 31557 - DNA, 734 bp, Oryza sativa
  unsure (1)..(734): unsure at all n locations
gctaaggtagaccatgatctgaagcaggtaatatccgagcttcaaagccttcctctcgttgcctcctatgtcgccggccgccgcagcatctctgacgaagctcgctccttcctcctcgccttccgctccaagtctttcaagaagagccatgagaacgatccacccgaggacaacaaggcctctaagcccaatgccgccaccgccgccgacggccagaagccgccggcgaagaagaagccggccgcgaggcccggcgacaccaccgccgcctccgccaaggttgccggcgtcaagcgcgccccgtctgatcgccaggaggagcttgccaccaagaagaaagccaagctcaacaagatcaacacggtcgccactgacaagaaggccgccggtctggagctcgccggcgcggcgcctgcggcggcgaggaagaatgatgcgatcgcttgccaggaagaaggagaaggagccggctctggctccggcgatcaaaacgccaatcgcgacggcgctgatgatngaagttccgccgaagaccacgctgccatcggtggcctccctcaaggcaaggttcgcgcggttcggcccgctcaacgtcgacggcatccgcgtctactggaagtccacatgtgccgcgtcatctacaggttcaagtccaacgccgacgtcgcgttaaagtacgcgcgcgccaacaccaccatgttcgggcagggcgcgcccaactactacctccgcgg

SEQ ID NO: 31558 - DNA, 1542 bp, Oryza sativa
tatgtatttttacataatatataggcctgaaacgaacatcgagccgtggagcaaggagttcagggacatcaaggaaggggccaaggcaatcaaatggcaagacagagtggcaacggcgtactggaagggcaaccctgacgtggcgtcgccattgagggtcgcattgcttaactgcaacgacaccaacatgtggcacgccgagatcatgcgccaagtatatattccactcacataaataaacacgtgatcaatcattacattatactctctccatcctaaaatatcgtaacttttagctattaatcataaccgaaagtattacattgtactacctatgccataaagtatcgtaacttttacctattaattagaacataaagtattttagaactaagatagtaataaaggttaataaaactgactaacattatgatgaatgcagaattgggatgaggaggtcaagtccgggtaccataactccaagctctccagccaatgcacccataggtaacgcaacggtgtcgtggcgttaaaaaaaccctatgatttagttttatgcaccgatcaattcaacccaaacctttgtttcaggtataaaatatacgcggaggggttcgcgtggtcggtgagcctaaagtacatactgtcatgtgggtccatggcgctagtgattgacccgcagtacgaggacttcttcagccgtgggctgcggccggaggtgaacttctggccggtgcacatcgacgtcgccgccggcggcatgtgcgagtcgatcagggacgccgtggagtggggggaggcgcacccggcggaggcggaggcggtggggcggcgccgccaacggctgatggaggagctcgacatggacgccgtctacgactacatgctccacctgctcaccgagtacgcgcggctcatgcggttccggccggcggaggcgccgccgccgcggccgccggcgcagaaggtgtgcgaggcgtcggtgctgtgcctcgccggcgaaaagcagaggcggttcctggaggcatcggcggcgagccccgccgtgtcggagccttgcgtgatggcgcccgatgccggcgagtgataaaatgtgttacattatgttttttttagagcaacacggtaggatacgtaggcagaaaatttgagcagttcaacttgggattttaggatttgctttcagccttaaacttattttattttcagccgagcgcaaaacaattcgaaaattttgagcaaggcgtgcatttgaacctccacatgttgagttctcaactagcaaaagtgcttcaattacaagatcagaactttcaattacaagatcgctttcgtttaaaatccaaaccatacccaacatcttcatccgaattgaccgaaactagtcagcacttctcaacctctagaaacacaccaggagaaaaaaaacaagtgtgcttttaagaaagcgattccatacaccagaaccaacagcgctggtattttttttaaaaaaaaaaaacaaaagccatcctggtgattaaaatgaagatcaagagcaaa

SEQ ID NO: 31559 - DNA, 11219 bp, Oryza sativa
  unsure (1)..(11219): unsure at all n locations
aagtgcctcagttatccagcctaatatgccctgctcccgttttatctttgagattatcatcattctcctatccgatgacgcatgtacaaaatgagaccagaccagccagtgctgcagccagggaagaccgcggtacatcgtaacatagaaatgcccaaaaaaacaccgcatgaccacgaaatcgttgatgaagcatcatgacaccgctgcagcgaagctcgcgagtcagcaaagcttagctgtttcttgacttagcatcaaccaccaatcaagccaggtatctgtacacattagcgttgtccttctcgcgttccaggtaatcccttgtgatgaggtcctcgattcgcttcttgatggctttgaagtcaggctgcagtggacaaaaaaccaaagtaagggaatgcagtgtactgtagtcatataactaatttaaaagaaataacttcttccttatgataagaacaacttctcgagatgaaagaaaaacagctaattcaaaatgattgacatgtgagctcagaacacattagcacatcagctaattcaagatgcattgaagacaaaaatatgccgcatgagttgtactcatatgcaactatacaagatgtgataaggattaaaatatgtgggatttcctagaagtaatatgtagtcggtaccttgaacatgcggctgagctgctccacacattccgcaactagctgctgatggcccataactttgcgactcttcataatgcgcacaatcgatgcatcaattgcataccgcctgtccttgtcaacatcttcgacaacctttttcttttcatcaacaggaggtaggggtatctgcacataatatgaagaatacaaccattaacatcatagcattcatactccagaaagaaggcccaccaacacgcaaaacacaaaaacacgaaataccttaattcttctcatcctgtcagtgaattttgaattgaactcaaaaacatcgttgggagaaatagatctattagctggttccttgttaagaatcttgtattttgcacaggagagagaatggagcaaacgcactacatcatcatctgataagtttagctgtgttacaatctcagaataagtaagcctgtcagatccgttgaatagcagcagcaacgcagcctgcaaaaggagaggcatgtcaaaaaagtatcataaaggtttttagtgcaacagatctgttgacagtcatataatttaaatttacctgatatgttgtgacaatgagctcaatagtttttgcctcaaactttgcattgatattgcaggttcccaaggaatatatccaggtaagctttctgtgttttgttcttgtttggtaaaactccttgaaaacctccacgcatttcacctaaaaatgataaatgcaaatgttcatgtaaaaaggatcacatggcaataaatgtttcatggaaaagaagataaatatggatcatgtttcagcttaacattatcaaggacaattgacaagcatgtaatgatgaaccctaaagatctgcaagaaaaagtcacttaccatctcagcaggaaggttaatatcgaaagtcttgtaacttggccagaatcctgttgtcaaaacagtgacagccaagtctatcccaggattcaactcctgatgtgcagccacaaactcttcaaacttagtttgatggtcccttgcaacagtaagatcagtaaccattccctccattttagaagtaaattgtccaccacactgctgcttgagtttggtaagtatgcttctttcatgttcatcattggcactcttatcaaaaagcaatctccttgcaagttttttcctgcaaatagctccacacatgaagcaatatgaatacaaagtccaaaaagtaatgtttcttaaattcaggaggtatataggcttaaaacaagataacacaacattacctgtaaaactcagcaaagaggtctttatcgctgatgtatgcaagcaatcgcaccacctgaatcatatttcattttcagcttagatttccttctacaaaaatttaataatggtagcaaaagagaagggagaacatgcaccttctcaagagcatcttcgatggcttcatcactgagcttttcactgcaacctttcttcagaatattgtcacagaaggtggcaagcagttcagcacttgaactgccagagacacccttgttacagaagacctcgaatgcttctttaagggcctgtagaatgagaagtttaagaatgaggcatcacatttgacttaatgaaccaatggtaacaacaaggaataggaatgtgtcgattggcagaccttatgaaagagggtgtgaccctggaaacattctgtgacataagctacatacttgtcatggagctcaatgattttccagacaaaaacctaaaaagaaaatcacatgttaggtggaaaacatttcatcaccaacgaagtgcaagaagttcaagttgtgtacctgttcctgcataccaaccatgtcctttttctcgggctgtacaaatagttgatattagaatattagctaaataccagtttgttgcaacgaatttgaaataatcaaaagttctgaacttcaaaagatctatatatttctcagggaaacatataattgtaatcaaatataaacccacaaataatctaactacaactctacaagctacatgcaaaaacaatcttaaagatataatgtttctcagggaaacatataattgtaatcaaatataaacccataaataatctaactgcaactctacaagcaacatgcaaaaacaatcttaaagaatcacatagcatcccaccaaccgtcaccagtaggttctttatacagtagagcacaaaaaactaaatcaaataacatgaatttgaatcactaataataaatgcaagggaatcaagcatttgagtgtaaccagaaacagcatataccgtgtcaggaattgtgcacactaggaaaactatagaataaaggacaattttacaggattaaatagaaagagacagtcagcgacctctgtttgatcaactgaaaccagtttaaagggagctaatttaaagcactaatctggcatgcacaaatcacaatcctaataaccatactttgatggaacacaagtaagaaaaatgctaaaataaataccgcaccttcttattactagcagaatcttctgcttgcttgaccaaggctgtgccctcatttgtaacatgctgcagagaagtaataatttaatcagaatgcacaaaaaggttatagggaataagcagaccaattttgaggcaatgaggcaataccgttttaaacatgttagcaataggttctagaccgcggttaattttggagaagagcctgtacatcctagaaaggtcttcctcctggagaagataatgggtattcaatattatttgttttcatgatatacggttaagaaatgaatcatgttgtccaacaaaccttgtcatcacgaagcaatgcaaaacacccagaatgctccttctccaacaggggagttgcatattgtgcaagcaattcattttgcactttctgtgacaatccaggaaggataataatatgagatgatattccaaaccatacagggaaagtgcccaaacattatttaagaaacatcgatatggcagtccaaatacaaatctgtaagaacatatctcaaatgcaagtataagcactcatcaacatgaagtgattggaaactggaaaagggaattctcaaacaaacctccagtaacttctgttcactactaatatgcaagtagtgaccaactcgctccttctctttcttcaagcactcctcagcctaacaaaaacagcacccatttattacaccagagatgtcatttacaaatacagacagaaccagtcagaagatcctcctcaaatgtacctttatcatgtaatcaggacaagagtcctcgagaatccagctttgagccttgagagagtagtaatctgtagtatccttaagcaagaaatcttcaaagtcattctcataacattccatactgcctagtccaatttcaacaaatatgcccaggacattcttcagcagggccctgtctatctgttcgccttcacgctctttgtcaatctgtcaaagaaaggtattgcaactatttaagtatacgcgcaaaatcattttcccaattcaatgtaggaatgctgactcaccagagctatcactgcacctttaacttgtcctttgatttcttggtatatctgttatgagttggtcagattaggacacagaaagtttgcaacacagagattgaacaagagcaaaagctattttaccaaatctcggaagcaagtaagcccaacttgttcaagtggtataagcgacctccgtgagatgaagtatcgatcaagataaaagaagaaacgtgacagccaccgaaccatgattttatggtttgaccacctctttactagttccctcagcataaactcgtcatgtttatctcttaatgaaggtaagacctgaaatatattaaaattaagtgatataaagctcagagtgtacatacaaatataacaaaggagcatagcatacaaaaagagcatgtaatacatgttagaatatcagatcaatatgcacaagtaggaaaaatagtttttgtttcaagcaaaatgtgtcagtttgcttagcgcaatcctaaaaaattatgtacatgatttctaccatgtttagacaaaaccaggagagcaatgctaggatgcaaagcatgatgttcgtcaaagaaccagtatcagccagacatttaaggatatctcctgacctcaaagtcatggaaacaatcagcacactggcatgaacctaaaaggatgccttttatagttttatgtttctaggctatagtcacttttacagcagccttggccaaaacagtgggggcggaaatgcaacgttcacctagtcactagtcgttagttgatcaatgacccactgactagtcggaggctccaagcctccaaaataaccaccatttaaggatatcggcacaattttttacatgtttcgtggtatatgttgagaccacagggtccacactgcatacactagtgtgggtgtgcctgggactggcagaagggaagaccggtatgcgtgcggcaaatgcatgggcccactgtgagcaggggcatggcagtgtgtaggataaaaaagaagcaacaaaggagccagggggaatttggggaatttaggctaaccgtagacccctttaccccccttttaacccacacttttgggcctaaatatttcagctcataccatattctgtctcctagttggtctgcctgattgattagtcaccaactaaaaccaactgactaggaccgactagtcggtcgaactgactagcccactgtttactccctaatcgagacggtgactaggaccgactagtcggtcgaactgactagcccatgtttaccccctaatcgagacggtgactagtcaggctggtcggccaactaggtgaagtattacaacccgccgcacattggtagagcgatcagctgttgactgactagtcatagattcgtatcctacttgcagagttttgattcacaaggaaaatcatcatcgtttcagttaagttaactaataaaaggaaacaaattatgacctattcaactgagatagacttactacacaatcgaatcaaatagatcacctctatcaacaataatcaggtagccgaatcagacaaaactaagatccccaagtacactaaccccattctcctcctaaccaaggaggaattataacccatcggtgcccggccaccacaaccaaaatcgcctggatcaaccccaaatcacctactatcgaatccaaccggaaatgacagacatgcacaatcatatcaaacatttacaagaactgcagaaaaaaaaagatcgtctcaccatggaggtgatgtactcctcgaatgactcccggtacttgtcgtagagctgctgcgagtagtcgtgcggcggcttctgcgtgcacatgttgtatatcgtcctgcagacaacaacagacacggagtggggggaaaccctagatcagcaccagatcgaagcgaatcggaggggaaaccctagcgggcgggaggaggaggaggaggaaacccagtagaagccggcgccggcggcggggnacgtacgtgtagagcatcatgtagtcctcggagctgaactgtggctcgggcttgccctcgaggatgttcttcagcttggtgatgcccttctgcatgaacgcccatccctcctccagatcgatcgtcctccgctcctgccccgccatcgccacagccgccgccgccgccgccggtgaacggaggccgcgcggaccaaaccctaggggagagacccccccgcgtgggtttgggttgggttccgcgcgagaaaaatggggaggaagcgggcgagagagatagagagagagagagagagagaggaagagggagcggcagactgatgacaagttgaggcggtgacgcggttgggggtaagtataccgcttatatcggtgtagtaagcgtgtcacactgtcacacaaatccgcaagtgaaattgggctgcgaattgcatgggtgatcgggtcgaggctatcctctggatatactctatttcaaaatataataacttagatttatttattcaaatttgtactattaaaaaataactcatccgattctaaattgacaatgagagtattttacagcgaattattttgtatgaatttctttatctctatccattctataatcagagtcgtcatccttccgttccaccaaattctatgttttctctaagttaccctcatggcacatctctaattatatgggtttggcatgttataacatattaacatgttacctctactctcttaaaatcaccggatccactgctttattctcttaaaaacaccttcctgacacatctctaattatatgggattggcccattacaacgtatcagtatgttattggtgggagtatgagagattttttttttgcgtgcttcggtaataaaaccatatataaatcgtaactttgctatttgttgagcgattaaataaatcccaaatcacagataattgataattttgttggtttgatattcaatatttttcgaattttttcaatcttgagagttgagacaccgtacgtctctaaaagcaactgcttcttcttcggcaaccacacctctcctcggataactattcgagtgcactgacttaaattttgaggagtggctaagcatactgctttaatcgtgtcacatgagagcattgtaccaactgcatttcgcaatgaagtgtttttaaggatagtgggagacaaattcctcgcatgaatcggtaatagaggggtgctttgttgatttggtagttaaaaacatattacatagattacaattttagtatacttgttagctaattaaaaaatctcgaatctcacaaatgatctcaccattagtttgattcccaatagctctgttatatctttaaagggagacattgtctccctatcatcggcaattgcttcccaggcaaccacgtgctcctccgattctttggcaacaacccttttagggtgactatgacgttcctttagcgaacacgacttattgtattagatcaccacgctgactctatttcatgatggtttttcctatgcagcggtgggagagaagtttctcacgtgctttgttagtagagaaattttttacttcggtaatagaatcgtatataaaattctaacttttctacttgttatcaactaaaattttccaaatctcaatcaatttaatctcactgctagtttgatattcgatgaatctttgagtgtcttcagcctatagacatcatctatccgccaacaactgatccttctctagcaaccaaaccactcctccggcaactaccctcttatagtgagcacacccacaactcatcgtggatcaccatgtaaactcccttttgcaatggacttttgtcgacgtttgatatcacaactacggtattttgcatactatagggatcgttggtaccagggtatatgcgagattgaagtagaaaagatggagacaatgatttttatacatgttcggccccttatctgtcaggtaatagccctactcctgttggccgaagccggtgttgcttctttattcatctgaatcacacaggtacaataattggaataactcatctgactgtcgtcgacttggcggtatggataaccaactcgtagttgacgacagggtagtcttcctcctcgaatccgcactcggcgagatcagagatagcagctatatctctcttgttgacctccgcagacaccatattaggtttgtctaggcttatctctgatgtcgatatctggcggcgtgtgttggcttgtattgatctatattgatcttgctgtggctttgtgtcattgtggcattgtggcgtgtcccctcttctcttagggggccttgtatttatacccatagatgtccccttgttcaagtagaactagggagaccaatatggatacaatatgttgtttccatatataactctactcgtcattccttatccgcaactctttctatatacgaggtttgtttccgtataagacatagtatgtggtgggctctaccgtgcttaggtatatggtatccataaccctgacaactttcttgtgcggtggtggaagataaatttatcatgtgtttcagtgtagaggatttggtaataaaccatatataaattgcaactttgctacttgttatgcgattaaaaaatatccccaatctaggtaaatgatatccctgtgggttcaatatccaacagcttttgcatgtgctcaacctctatacatcatctatagatattttataaaatgttacgtaagatccatctatctttctaataaatagatagatgctttttttttgacaagttttaaacattgtttcacctgattaaccacattgccaattgtaatctaatttcaaacaacatgcaactaagtttgcgtggtgatttctatattgttgaaacatgtaggatatatctcaataaatatagtaagttgaagtatggtcgtgataaaaaagaagtattaatgctatgtttatcttacgatgcctcatatattacataggcactagaataagtcagttgttgcatttagtgaatctgccaaaccccaccaatctaatgatgaacttatcggtaagaccataggctcccaagagtcctattcatgtttgttaatcaccttggtgttcgggattgacatcaccctggatgcccgtgactaacaacataggcggtaaagcatgccctggaggaaccgaatggagctagaccaagatcaagggtgaccaatagaggtcaacactatcaaaatgacactggcattgataaattaacaatggaggatgatggattttggtttatattgcccaaatggctttcaggctcactgtccttgtttactactgcaaaaagggtgtggtagtagctaaagagaatgagagagaatgagagaagggagaaattgagggtacggtggtggctgggtagggagggaagaggagacttgggatattgacagctaaaacgagcgccatgttgtcatattataaaaatatattatttgataagcctcttatagcaattttttattttacatgtgaatgtacatgaactagctaataccaactagcattgcttttccattgttatgttgctcttacaatggcaaatttcgcctattaaattctcatacaaacgaacagttcattttattttatttgacagtgatacgatccatttataacctactgattttttggtatgtgtttaaacaatgtatcgcccttattatattaaccgtacctagtttttgatatcttgtaggtaaattagcacgaaaaaattgctgttctcttctaaatttgagacctacttcaacatatttcaatgtctctgaagactggttatgatgtgaaataaatattattcactatgatattttctatcgtagttagatagtacataaacctacacagtgatatcatatacggagtaattaaattgtgcttgattaccagcacactatgccacaatttaccatgtacaaatatttggctagagccattaggggtgggcatcggtccgatcgaaaattttggtctcggtcttcggcctttcggttagtttggtcattgaaaagtgaagaccgaattttaacgtaaaaatgtcaagaccgaaaaattcattattggtctcggtccagaccaaaattcaacaatagtttcatatatgcgatcatagaaattttcaacacaaaaatcacaaaaataatactttcttcgtttcacaatgtaagtcattctagcatttcctacattcatattgttgttaatgaatctagacattaacaacaatatgaatatgggaaatgctaaaataacttacattgtgaaacggagggagtagtacgtatgagtaaagactttttttttcatgtctagaaggaatagagatgtgaaaaattagaatttaaccctattgaactcagtggatcgtaagttgcatttggacatttttttttgttaatttggtcttttcggttgaccaatgagactagccgaattgaccaaactaaattcggcatttcactacttaggaccgaattgctcggtcttgatcttgtcttttcggtccggtctttttctgcccacccataagagctacagttgtagcaaggttcttttggaataaattagatccacaccaattttacattgctccattaacttgacaacaccatcaattttacattgctccgcatgacttaaccatctataagtctaacaccatcattgttataaccgtatacacatgacgatcacttaccctacactggctatgcttcgggagagggttgggaagcctaactccctagcgcgcaaaacaaagcatcgtttagtgcataattaattaagtattagctaaaatattaaaaatagattaatattattttctaaagtaatgtccatatagaaaatttttgtaaaatatgcacgtttaacaatttgaaaagtgtgcgtgcgaaaaatgagaaatgtgagttaggaatgtagagataagagctcaaccgcctttaagggaaaaaatgaattttatatttttgcaaatagaaaaga

SEQ ID NO: 31560 - DNA, 5375 bp, Oryza sativa
  unsure (1)..(5375): unsure at all n locations
aannnnnnnnnnnnnnnnnnnnnnnnnnnnnnnnnnnnnnnnnnnnnnnnnnnnnnnnnaatttttgtaaaatatgcacgtttaacaatttgaaaagtgtgcgtgcgaaaaatgatgaaatggtgagttcaggaatggtagagactaagagtctcaactcacctttaagggaaaaaatgaattttatatttttgcaaatagaaaagaaacatcgaatgaaatctgcagtatttcgaattcgaaagatttcatttcatacgcattttgtcttttttcttcacccccaacaacacgcatccggctggctcgatctcgacacaccaaccaaaaatcgaatcgcgttcgagccatcgagccgacaaggcgacaacagccacaacgcctcactccccccaccccacgcgctccgacgagctccgatccgccgcccacctcgccgcccgccggcgatgagcaccgcctccggcgacggcggggacggcggcggcggcggggatggcgcctcgtcggccgcggggggcggcgggaggcggatcccgcccgcctcgtccatgccgtgggtccgcaacctccgccgcttcgtcggcacgggcgccgacctcggatccgagcccttgatgggtcagtgccgttcgccgccgccccatcccttctcctttcctgtggtgtttggccgggccgggattccgttcctcatcgtggagatgccggtgcggttagggtttacgcgtctcttccatgaaaatgatgatgtgattggggaggagaaattatgggcccccctctagtgggaaggattactattatgtgttcctcaggtttgagattgcataacgcagcgtgtggatgcgtggaatgggctcgctcttgcttgatttgcagtgggtgatttgggtggagcggcatagtttcttgacatttgacgaaggtcacaactcacaagatgttcaggcttctgggagtcctctgcacagaggaaggcttgccggctgtggacgcagtcagtagtggcaatgtagggtgatgggctgggattttgagtcttcgtcgtggagatggcgataaggttagggtttacgcgtctcttccacgaaatggtgatgctattggggagtagaagttagggtgctctagtgggaagggttactggatgagttatagtgcctcaggtttgaaattgcataatgcagccggtggatgttgaaatgaactcactcttgcttgatttccactgggtgatttgggtggagaggcatatgcttttcacctttgaggctttcacaaaagtcacaagatgaaatcttctgggagtccttttcacatactccctccatcccccaccccccccaaaaaaaaacccaatcctggggtgcatcgctaggattgggttttttttggtacatagggagtagtaactagtaaggcactgtaggcttgtcggccacagacgagtaagtagtggtaggagtagtaaggcactgtaggcttatcggccacagacgagtgagtagtggcattgtaggaagacaaacatcagattttagtcatgtgcgttttacttgttgatacgtaagctgaggctattggtaatgtggcttgaggatatctcccagctagttcaggaaaactttgatccatatagtgcatatagttgaggcttagttgtccttttctgttttaatcgcatttgtggaattagggactataagataagatgtctcattggcatgcaatttttgggtgcatttgctacaataacatggttgctttgttgatcaatattcgcatgtttttcatgtgcctgcttgtaaactatttgttttaaacctttgatcgcagaactggaaacaaaaaggatactgcttgagattttcaaggagcgccaacggaagagtatggaagctggtgccattccaagtttttataagaaggtgcacagcttggttcagtttattggataccgagatttcataatcttttacgttattatcaaattcgcagcgtaagcaaaataaagatcttgacaacagtagctgctttgacaaacgatgataaaaaagatattggtttcctaagtatcatagtttagttctgattcaagaatgcattgccttctcgtcaactcatgaaattaatatctcctttatggacagaaacctgaagatggatccattagcaatagagttcagaaattggcaaagtacaggtttctaaaggtaatgtttgatttcttcttattgctattgagatattcgtgtttggttggcagcttacttgcattgccatttaaccttctcatggtttgggccttacaatagttattttaaacaaatggcagaaacaatctgaacttctgcttaatgctgatgatcttgatgccatgtgggtttgtctcagagaaaattgcgttattgatgatgctacaggtgctgaaaaggtaggttgttttatgtacctttatttcagaccagcaatctgccagtttttaatctaaaaagttcagatccttggatgacaatatgcatcatatgtctacaatatgcacgcaaaaaactcatccaaaatgaaaaaaatcttttggtgtgatatgcttaatctcttttaggggatttttttagttcattgctacttgcttgaatttggtgtacatactgccctgtaaatctaacgatgatccttgtatctgtatttgtgtttggtgtagttgttcatgtagcagttttggttcgattaccttgctcatctatttttctggagtcttgcagatgaattatgaagacttttgccatattgcaacagtatgcacagagcagatcggccagaagtgcaagcgtttcttcagcccttcaaattttatgaagtttgagaaggatgattctgggagaattgcaatcctaccattttatctttatgttatgcggacagtaagttattttcaaacaaatattattaggattaccaaatttgttttgtgtaatatttgatgtcttccatttgcatctctgataaactggtaattctagcccacaccatgcttcttttccaatttcccattggatgtactcctagttctttttactaaatgacaaagtaggctagttatatgttatcatcagttgctccattattattgttagttagcttttattagaaaagccattcaaagcaataacaccaaatcgctattacaatacaagaacatgagtcatgtcattcaccaaaataaacttgatgggtgtaacaatgcccaaggaagctaaaatcgtttcctcctattacatcagaatgggtcacatttaagtctgaaacatcacataaactctgaattcccatccagcaaattttttgctgaatccatatttatagctgtaacttatttcaaatcattatcatgcatgctactgtttctttttccttgcgtatacaattgtatgacattcttttaactaatttcttcaggtatctctcacacaagcgagaattgatatgagtgagcttgatgaggattctgatggtttccttcaacctcatgtaaggacatcctaacacacgttaacgccattgcacaccttagtaatgtttgacatgacttaattctattaacaggaaatggaagcatacataagagggcttatccccaatttggcacaactgcgtgatatgccatcagcatttgttcaaatgtactgccgcatagctgcacgcaagttctttttcttctgcgatccacacagacgaggtttagaaccaacctttaagtgcagttgtattaatatgcaaattactttaatcgatacatttattctttgtaagagtagctaactgtttgtaatcgatacatttttttttcagggaaagcatgcataaagaaagtattgctgagcaattgtcttcaggaacttatggaactacatcaggtttttgaagaaacatatttcatggtttgctggtacaaactctgtaaattttatacccttataggcttacaacataatattgctgtatcctatattctgtttctttgtggttacgattcttatcaactatattttcaggagagtgaggaagaggttactgatactgagcaggctgaaaattggttttccctgacgtcagctcagcgcatttgtggtatgccagccaccctcatgtctggttttctgatttttcttttgggtagcagtagcacacaatcagtgctctccaaaaagttaccttttgccattctattgcagtatagttgatgatctacctaatgcgcatggtcccatgcagatatgtttcttgcacttgacaaagatacaaatggaacattgagcaaacaggagctcaaggaatatgcagatggcacattgactgatatcttcattgaaagaggttaaaatccattatctgctctcatgatactttatgtttgtctttctagacgtcctaaccaaaaagaaacatgcaattgcagtatgtgaagtttttttatgcattatacacatagatcatggtgtatttcataaatctttagtcgtgaatagataaacaatattataacttcttttctttttccagtttttgatgagcatgtacgccggagcaaagttggaggtggcaacagtcgtgaaatggactttgaaagctttcttgactttgttttggctctagaaaacaaagatactcctgaaggattgacatacctatttagatgccttgatcttaatggaaggggattcctgacaactgctgatatccatacattatttaggtatgtacggggaatctgtattgtatattttttgggcagtgacggaaacatctgcttcggaaaagtggcttaagcaggagaaagttgattgttgttcattagaatagcttttccatggcatataaaagttgagctagcattgtttttgtcaaaattgggaacagcctctgcaatcacatgctgaataatttactgctattctattcctctgttaacttttatctcggaagaaaagaaaggaggatgtgagagttagcattcctgcctgatacaatcttcctagatttaatctgccattttgtttgcttgctgaactattagacagttttgctggccttagtgggcaggacatcaccatgacattggttcaatcgcacataggtgtcgctgtttcttacatactcacaagtgcaacatcttcatttgcacgtgtacatatttttatatacttcagtattttctcagtttcttatgagaactaattagtaaataattaggaaatcttgatgtgttcaatagactataggaatggttcaaactagatgtcatacatatttgtaatatcctttggacctttgtaaggccttgttcggttaatcccaagagggagggattggag

SEQ ID NO: 31561 - DNA, 6059 bp, Oryza sativa
  unsure (1)..(6059): unsure at all n locations
nnnnnnnnnnnnnnnnnnnnnnnnnnnnnnnnnnnnnnnnnnnnnnnnnnnnnnnnnnnnnnnnntagcatactgttatatgatgaattcaaaatgactaccattggaaataatgcaaataggatacttgcgggggtgcacatctttgtgtcttcatcacctgcgagcagcgaggctggtatgtccatgaaggtggaaagcttggtaagctccattgagtagctcgggaaatggtgctaatttggtcttaaccattgatagtccttgttctgtccagagttggatcgttgaagcatttacgctacttaatctatgggaagtctgtttatgttgttgctttgttgctaggagcttaactgaggattcttcatctagaagaactttacattgtcgatttctgttgtctagaaggtccaatattgatcttcttggagcttaaggtgtcagtgtattgcaggtactgcatggtgatgctttgcatggagagaaagaatttcgcagggcactggtaatattgccgataaatctatgttgatagaaaaacgataatgcattttgggatttcattgtattcggaaatgtaacacatgattcagaccccagttctgaaatcttagtctcttatttcctgtttcaccatggtagagtgcctacaaacaagctatgcaatacagcaaaaacattcctaggcaagcaacaagtaatactagaagctcagtaactgccactggccggtctccttctccaaattcttcaagtcttgcaccactcaatgaaaatgaggtgaaaacagctcggcaggccattagatattccgttcgttgttatttatttgtcatatctagcaagcaactcattctttttctactgttgcaggtgaaatttaaaattgcactttgctattctgctctacgtgagcatcgtgaagcacttcaagaggtttccatttttcattcacctttgtttagttctctattatattcctgaatgttactccatcctgggaagtggaaaggcaggatcatctgaatatatgtaggatgactcggactcacttgtggtagcttcttctgtatgatggaagacatatgatgcaaaacatggcctctatgttgcctgcagatggaagggattccttctaaagcgaggactctaaaaatgaatctgatgttagggaagctatatcggatatccagaaataatcgtgcagctgctgtatgttataaagagtgcctgaggtatgcaatgccaaattattttgcttcctagctcctcaattctgcaacagtgcaaacgatcacataactaccattttcttttgcatatcacgtttccccctaaacattgatacagaaaccaacattttttttcaccattaaaaatattgcccctcacttggccatttcatgaagatttagtttgacaaatttctttctacatctatatgctcttatgacaggcaatgcccttatgtttttgaggctattacagctttggctgaaatggggctttcttcaaaggagttctctttgatattctcacaagtaagtgttttgctccataggcagcttgtattttcaaactgaatatagtgcagttttagtgaggtcagataaatactagttatgctagatcctaagactcttgagtgcttgattgcctgccattttttctggttgcctattatgcttgccatgtatataggctgtctaatcccattgatgccatgccttggccagtattgctacacaactacataggtcattgtttgttttgctttacatcaaaggaccatttctcagcatcatataaacaatgatattttattgatggaagatgcatactgcaacagagaaaaagaagtaaattacatgctgttaatagttctatataatatatccctttattttattgatgatctctttatttcatatacaatatttaccttcgcacaattcaatgttattacagaaccatcatcccaccaattttttatcctttctatatttcctttggcgccgtgagcactgcaaaaaggaaataatgagcgcacatcagtttatcatgcaattgaagatgtggtattctctgtaggcaccaaatcgaggaggcaaggctccaggtgactctttagatgcacagcgttggtggaacgtaagtgaactacttgcacccttgtgtagatagaacatgcgaaccccaaaaatatttgacatttcttatgtttgatacaagtaaacttctatgctggattttcttagtatattttatttacattgattattgaacctcaaaaccacttttactttcgaaacttattaaattggaagagtgggaatgaagtcctttccttttcagctctatgttaccattgtatgaactgagcccacttgtggaacagttctatcatgcacagcttttaactcatggagttcttttccctgaccacaaataatttgtcaccactgcgtcaacaaatgcacacctgcacttctattgttttcttgtagtggggatactgtgatcaatactagaacattaggaagcaccatgatattgtacctactgatcacatgcagttgtatttttttttatgttgtggatttatcagaagaacccattttgttccgctcacagctacagtgctgctttagatttgggctcaattatgtataagagtttccttgcaaactctacttaactcatgcagcatacagttgatcatacttattgttcttgttattggttgactcaaacaattattgacttaaatcattgttttcttaacagcgctatgttgaggcccaatgttgcattgcttcacatgattataaaggtgataaaatagcattaatccaaattcatttgacagttctaaacgtaagatgcacttattttatttttgtcattgtcaaaaaatcgtgttgcatgattacagaggatttccactactaaacaaatgatatgtagtgttaatgtgttatatcaccctgtattgtcatctatgtcttaattttctgttggcccttgttcctttggtgttggtccttgtgccactgggtaaagcttgatagtcaacatttcttaacttcgatttgtttgcttgtatcctctcatctgttaagcataaacttgaagaagtaatactgatatgccaaattcatttatagtggtcgcaaaatataatcatgttatttttttgtttaggtggccttgacatatatctagacttaatgcagcgattcccgaacaatgtgcacatcttgctggaaattgctaaggtttgtttttcttcaagcattctgtttatgttttatgtgctctctgtaacatgtggattcttgatgcattgagcaccatggctatgtcatacttcttattgtttatgtacttcatgtttggttctgctgtgctcctctgtcctgtctataaaatttccttttgttatgtgttgaaattttggagttcctcttaaaattttcatttggtggatttaattcccctccattatgaattgatcctgaatttggagcttattatttgaaggttgaagccatcataggtaggaatgatgaagctatcatgaactttgaaaaggtaaaattaacaagtatagacttggaaccccttaaaacgtaagtatgtggtaaaattatttgcttccttgcaggctcggttaattgatccaaacatcatgacatatatggatgagtatgcaattctccttaagtcaaaatctgactacacaaagcttaacaagttggtacatgatatgctgcatattgaccctgcaagaccagaaacatgtcttgctcttgcagcattgtgggaaagaaaagatgaaagaaaagctttgacatatgctgaaaaggtttgtatcgttacataatcttttattgaaagctaatcttgatcctaatgttccttgattttccttcaacagagtctccgagttgatgatagacatataactggatatatcatgaaggtaataatgcaaaagattgtccgaacgactggattttgcactgttgtagacatgcagtggcattttcttgctttgcaaagtattatagagaaatctctgcaatgaattgcgtgggattaaaaccaaaatgttattttatcaaagttaaaaccaaaatgttgtgatggtttttcttggtatttactctgggaagttgtatacttgtaactttgctacctttgtttttgtttatccacacgtcaggcttattgtttgcttattgcttttcaagggaaatcttcatcttttgttgaatcgacctgatttggcagtcacagacttcaggggagctcaagaacttagggccgatcttcgctcttatcaaggtattttggtgatgctcctgattttgaagatcaaatcataccatcagtctaatacatatactatatcaggattggtacgtgcttatctagcgctctctaaatgcaaagatgcattattcactgcacgtgaagcaatgaaggttatgcatcagtctgcaaaagctctcaaattagttggtgatgtgcatgctatcagttccagtgggagagagaaggtaatatttattttccttggtcatttatacctcaattatattttggtaatggtcagttagtcacttggtcacaattatagtttgcatacttcccctcaataatagtaccctttgacaaattcattgcacaatttccaggctaggaagttctatgaatccgccattcgtcttgaacctggatttctgggagctgcattggctttggctgatctgcatgtcgctgaaggacgaaataaggatgcagtattgctgcttgaaagatatctaagacagtggacagatgattctctacacatcaagttggctcaagtttttgcagcaacgaatatgctttctgatgcactttcccactaccaatctgctctaaggtgcgacttttctcttggagttgaactgtcaaatagcatcattgttgcaatagcgtgtttcctcttttgttattgacctgaaacccaaagagtacttgagacactcaacacacaagtagtcaatatataatgcattgatatactggatataactaaagtatgtgggtaagattgtaatgctggttcctggactatgtagcagttaagttttgtgctgaatccgataactgggttggacggggtgaactgaattatctgtatgatacaaatttttttggagacactactgtttcagctggtggaattcgtttttttataacctttggctactacttatccatgtgccaacataactatttcatgttctagttgaaaaagtttccacccgtgatgcaggataaacccacataatgaggccgcaaagaaaggattggaacgcttagagaagcaaatgaaggttcgtgttccatatgtaaccatctatcatggagcctacccagctctcacatccagaacaagaaaaaaaatgactctgattttccatatgcagggagtagacccggacgcgcctgaagaggacgaagagaacgaagctgacgatgtcgacggtgatcaagacgacgctgaactactgtagaaaaaacctgatcaactcacatcaacccaaggcaccacctcttaccaagcgtcaactgcgaaagaggaccaaatctgcagccgctgccacagcaggagagcccctcaattgccatatatcaactagcaacttggaaggcacggcaactggaagacgagtgacgacgacgggtgcctctcccttaccgcgagtaagttttcttgctaacgcgaaacctcgtcgtagagttgcaatgctcaccgtaggtttatttttctaatgctggggaaatgtgaactgaacttgttggtttcaagtcaaactttattactacctctgtcctaacatatagcaacttagtacccaacagtccaaattcctggtatctaggatgtctcatttgatattagggtgctatattttgagacggggtagtaattaatttgctctccatgtattattgttttttacattattgtgttatatatcatggcgacaaaaaagggg

SEQ ID NO: 31562 - DNA, 3404 bp, Oryza sativa
  unsure (1)..(3404): unsure at all n locations
cttatatagtgtcttatgcatgttggcgaaatggtatatcgcgcgtgcaaatgctgggtgaagatggagttaaagaatcttcagaggaataattaaaggcgatcgatcgatttatgcatttctgcgggttttttttttcttctctctctctcttttggttttgggataatgcttggcaccatttttgggttgtgaaaaagatgagctgatagataggttggtaaggaatatggaacattttggcggcgacggaaacgatttgcggcgtttttttttgcacaaaaggtggctgcattttgaaaaggcctgatacacctgataatttttgttatgaacgatgatcgtgctgtgcaaggttactttttcgattatgatttctttcttttatccggtaaggatgatcagcaatccactagactgtcgatacgtaacaatgtaactcggtactatgtatgatgtttgggagtgaattaacacacgatcagagataaccaatgtgaatactggctgtcagattaacttaatccatggtctacacatgccgacatgcgtatacgtaaagagacctgcaagttatgatgatcttaggagtcaaagaagatcagcaattaaattagtttatcctatgttctgataaacttgtttcatttgagacaatacagagcagccaaactgacaaaatcttgctttgctacgtacaacaaaagctacttctgcaggtatatcactgaagctacaacaaaggctaaagagcatccttggacatttgtgaggctattaaactctggatccgggatagggactgatccaatcagacatctgatgcaaagggacaaagaaatactaggaaactaatacaatttgtacttcatgtcagctatacttgacaattcagtaatttcagtcagtactgtggtacctcgattatcaaattgtcacagaacttactcttatttttactttcacattcagaccacatcattcctaagagtatcgtcagctcaagaacaatgttctcaagtctgaaccacagctagtgataattacagacaatttcagtttttgccgtattaacccagaatcaactctcgaagggtcagatcagcaatcagggaagccagattccacacagaatccctcaagaacaacaatggccattaaccacttgatcagtgctgctctatccaataacttaaagcgaatctccaaaagcagcagaggcttctcttctccccactagttttctcaccagatatggacagcaagcgatgccgcgatccgagatcgcttttgccatcggtaaatctttcaaaacagaccaggatgatggaatttcatatggataaggagcatctggtctgatatagggtagggattccaggtagagtgtggtctcaggagatcccatgccacactgtatgtggcagattgtgggaaacatggaaccttgggcagttgcagcaatgatatttataatgaaaggaatggaatggattctgcaagtggaagatcaaccatgcatattgtatttgacagattagggaatttttctgtgaggataatctttatcttccaaactgtgacaaaaagcattcagtgttgtacaacagtacggtataaagaaccttgatgtggacaacataattcttacagaagtttactggaattgaagcatggaacctgcgaattatagagcaatggcgatggcaaaacgagtattgttcagggaaaaaaaatcagagatcattgggtaaatgatgagttaatcaattgttttaaatttttgtaggagacaagttatgatttcatacaacatcacacaatgaaacatagcttctgtggtctatgaaaagttaaaagactaaatcatttgttatagtaagaacataccctatgtggcttgaggagatgagggcatcaagaagatgtgaaacttatgacaattgtaaaaaaaaaaagaacaaatcaaatagatcaactttaaaccatgccgagcatggaattgttctccctattctttagggaaattactgccagtcagagccaggcaattagactttatactcctttttttagggagtatatgggaagtgtaaaaactagaaacaaaacaagcaagaaaattacaaacctttcaagatgttcttttttttttcatttccatatttatctttctgattgctgctaggagttatcagaatctatctgctacaatgcaacaaggttggatgactatgggcttcagctcaggtgatgagctgaagtgccttcttggggtgcctgtctatgatattccaaatgccgtgtgctgcatctaaaatgtctctacagtcttccagatgattccagttgatagcttttacacgtataccaattgaagatatttgaaactttacggtgaggagggcaaagacgagaatcaactggaattagaggagatccaaacaaagatggatgccatctgcggtttgttgtcacagtatcacaaaaaagtcaattcacatttaggcagaatagatgtttgtttcgttcataaaaagaatgggtgtttgttgattgcacctgtcaaggtgcttagaagtatttgaccacttaatgcctatattattgtgaaactaaggatgaatcaggcaggatacagcttaagaaccaaagaaataaattggaattcctgtcatcctatgctgtctgaatattttaaataaaagattaggcactcaggcaaactgatatccttattatttccaaatggtgcaaaaagctgaagtttcaatggataatttattatcaactttccaactgttaaagcaaaatcatacatattctatgcatgctatgtcgcagcaaaacctgatcgcataaccatcctaattcttctttgggtattctcttgcaccaaatatagtcgatccaactctaacatttgtgcttcccatttcaatctgtagaaacgcagaaacagtagaaaatgttagacattgagttactaaatctattaacatgatggttgcaacctgttcttaccgcttgctcaaaatcagcagacatgcccatagacagttcacactgctcctctggaattccaagctccttgcacacctctttccggcaattagccagtgcctatttgttcaacaaattgcacatatattaggccttacccctatggaaaatatagtccagctaagtgtgtctcagaaaataaccttgaaattctctggagttgaggagtaatcaagcatccctattgtcatcaaaccagaaaacacgagattcgggcagcctaatttgacatgctttgcaagctctacacatcctgatggatctactccaaatttcgctgcagaatnnnnnnnnnnnnnnnnnnnnnnnnnnnnnnnnnnnnnnnnnnnnnnnnnnnnnnn

SEQ ID NO: 31563 - DNA, 1476 bp, Oryza sativa
  unsure (1)..(1476): unsure at all n locations
aaccaaaggaataagttggaattcctgtcgtcatatgctgtgtgaatattttaaataaaatattaggccctcaggcaagctaatatccttattatttccaaatggtgcaaaaagctgaagtttcaatggataatttatcaacctctttccacctgttaaagcaaaatcatacatattctatgcatggtatgtcgcagcaaaacgtgatcgcataaccatcctattcttctttgggtattctcttgcaccaaatatagtcgatccacctctaccatttgtgcttcccatttcaatctgtagaaacgcagaaacagtagaaaatgttagacattgagttactaaatctattaacatgatggttgcaacctgttcttaccgcttgctcaaaatcagcagacatgcccatagacagttcacactgctcctctggaattccaagctccttgcacacctctttccggcaattagccagtgcctatttgttcaacaaattgcacatatattaggccttacccctatggaaaatatagtccagctaagtgtgtctcagaaaataaccttgaaattctctggagttgaggagtaatcaagcatccctattgtcatcaaaccagaaaacacgagattcgggcagcctaatttgacatgctttgcaagctctacacatcctgatggatctactccaaatttcgctgcagaatggcaattcaatttcagagctatggataaaatattcaatgcttgtgcacaagaatatagtgcttccatatgcaagattgatcattccacgtacttatccatgactacagacaatccgatgcgtagcaatgctggacagtataacaataaggaacagagatgcaaacaatcatatgaattctattgtaagtttataaccaacccaacgcatgtagatctgttgctaccagaaattaagttaaaaagtagtactgtaaaggaaattagagtacccacattcttctccactggtgttgacctggactaagactttaaggggttttcttcccaagtcagctaccacacgatcaaggcgattggcaatctgaaaaagcaaacattgcatttatcttgttacagttgcaagattgcgaaactgatctgacaaccaattattcttccctaacttatgagtgatgcaactgaagtcatgctatacaaaatatgaaataatatcaagttctactacaacattgatatgcaatcattaaggcatactatttttttgttatgttactttcattgaacctgtaagtgatacctaattatccgaaataagtatgttgagttgatgattgatcagataaatatggtgtctcttatagcgttagtatttcaaagcgtaaagtaatctctcgaaaaaatattaatttgacgttacccctttgatcatcatannnnnnnnnnnnnnnnnnnnnnnnnnnnnnnnnnnnnnnnnnnnnnnnnnnnnnnnnnnnn

SEQ ID NO: 31564 - DNA, 722 bp, Oryza sativa
agtcccactctattatgattcacgtgtcagtgacacagctgtaaattacacaagccactgaaggctcatccattaataacatcctactcattaggtcaacataggagtactttttaatttttaatgtatggcctgtatgtaaaacaatcgttagtagtactatatggtatgatatcttaaacgtcacaaattagaagaatcattaagaaaagtcaaaatgtaccctgcatgagagtcgttaataatattactgaggaattgggataacaattttgttttgtccaaccagcaaggcatcgcatcattaatgatacggaaactacatgtcgtacgaataaataggacaaaacttaattaaaaaaatctatatagtttattcatgtatatataacaacacgatctattacattattatatattcctactgacaaaccgtgacacactaaaataccaaactatatactgtaacataacaatagttgtattctcatgacaataataaccacttaaattttgtaaggtcacctatttttttatcttgaatagcaaaagcggttatgtatagtttatgcaactaatcaattaattaattcacaaataaaagtctattttaactttaagcagattttggcgccttgacggcctcgaagcgtggcttcttcgcatcgaacttctgcttggcgtacacatccatgtactcgccgacacgtacttccggtact

SEQ ID NO: 31565 - DNA, 834 bp, Oryza sativa
  unsure (1)..(834): unsure at all n locations
nnnnnnnnnnnnnnnnnnnnnnnnnnnnnnnnnnnnnnnnnnnnnnnnnnnnnnnnnattctcccgagtctaatgggattgctgaaaggaagaaccgcacactgactgacttggtgaatgccatgttggacaccgcgggactgcctaaggcatggtggggggaggcattgttgacctcaaatcatgtgttaaacagaattcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagcttttttccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagnnnnnnnnnnnnnnnnnnnnnnnnnnnnnnnnnnnnnnnnnnnnnnnnnnnnnn

SEQ ID NO: 31566 - DNA, 1906 bp, Oryza sativa
cacgttgctgagccgacgtgtggtggacaagaatgaccgatttgtgaccggtctgacactgctcatgtcgtcagcacacagccacctttccacgacgtgcccgcctcaggcagaagtggaggtaggtatgtgccgtcccgtcaggaggatgttcggaggacgaccatgcaaatctccgtccattttatgaaaagaagaaaagtccagtttggaaagggaggggtgcatgtggtatccccttgaagtataaaaggaggaccttgcccatagaaaaaggggttgattctttccagattcagagcctagaacgagggagaggtcggctcacactttatagctccttcatacacagatccaccaaaacacaggagtagggtattatgcttctcagcggcccgaacctgtatacatcgcttgtgtttcatgttctcttgagaggtcgcgatctttccgtcatctacagagagagcttgagatctcaccctgagcccccggccgaaccggcaaaggggggcctgtgcggtctcccggtgaggagcgccgcgctccgtcaacagtacacatgtatgtatacgaaagtggggcccaacccatatgggttgatatgcttgatcttgtcgttgtccctccaaacagatcaactcatcaaccggatgtaacgggctcacctgtcagccgacatgtggagcattacaaccgaaattttcatcccaattgtctacggacccacctgtcggtcacttgccgataaagggggcccatggggtaaactgggagcgtgcgttaggctcaaaataggaaaaaaattctaaataatcgcaacctctaagtccatgttaggaacgatttttgaaggatttttttttacgtttataatactttggaaatttttcctatgaagttagttggaacaaatgaatggggttgttggtttcctttggaaaggtagtaattcctccattttcataggaaataaaaaacatctactttgatctaaaggaaaatttcctttgcttcatgcttgcatctgtgtttctctgtcaattttttcatgtgatccaaacagtccaaaatgtatcttcctgtgttttgaattccattgttttcctatgttcttttttcctatttatgtgttttccattcctctgttccaaacatgacctaaaagtgaaacatgaacatatatcatatatcattgtagtttatgtggtgtgcttgaggtgcttttgagttttaaatagattagtgtttgagagggagccctttctttgttggtgttgtgtatctcttctctatcaaacaaaatgaggcaaaaattctgcctatgttttaaaaagattgaacacatatcctcaagtagaattcaaatccagtcacattgccacagcaatggaggtgaaaccaacagagaaatgacctttgtgctctccaaacctctactactaaaaatacccatgacactatatgccaccgacatgaacggctcgccgcacaaattaattacacctcgtaaacacaaattaagccctcaaatcttaattaaccttgtttgcaattaaccaccctgcgtgcatcgtccttccttaatccaagaacgtgaacacttgcgagagaaaaaatcatttgcggcttcatttgatcggtcgccgtcagtgaccggccggctgttcgccgcggcggcgatggcgcgccgggtgctggaggtgacgctggtctcggccaagaacctcaagaaggtgacgatgttctccaagatgcgcgtgtacgccgtggcgtccatctccggcggcgacccgcgggtgccgacgcaccggacgcacgccgaccgggagggcggccggagccccatgtggcacgcgccgctccgcttccccatccccgacgccggcgccgacatgcgcgccat

SEQ ID NO: 31567 - DNA, 3246 bp, Oryza sativa
  unsure (1)..(3246): unsure at all n locations
nnnnnnnnnnnnnnnnnnnnnnnnnnnnnnnnnnnnnnnnnnnnnnnnnnnnnnnnntggagagtttttctcgaacgagtttgacttattctgtgaagaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagaattcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagcttttttccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttgggacaaaccttgaggtgataaatgaggttaaatcattcttgtctcaaaattttgatatgaaagatttgggagtagctgatgttatcttaaacattaagctaattagaggtgagaatgggattactctcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacttctaatccgggagatgatcactggcgtgcgcttgagcgagtaatgcgctatctgaaaggtactgtggaattgggacttcactatactgggtatcctgcggtactggagggttatagtgattctaactggatctctgatgtggatgagatcaaagccactagtggatatgttttcacactgggtggtggtgctgtttcatggaggtcttgcaaacagacaattttgacgaggtcaaccatggaagcagaactaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacaaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctatccaagtgaagatgcatatactctcgtgagctgcaaggcaggttggctatgccttaatgagttctgttggctttaattagcaaagatgttgtcctgcagagcattcttgaaggaactcacctttgtgagcttgactgttggtcgcagtctatgaagattttgggtgaatcttctaggaagcttaccaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccactggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctcgcctggcctggcctggcctggcctggcagggcagggcagggcagcgcgtgcacgacgtacgcgtcgaatggtccgaaaaattggctcctcacccttgcgcagatgcagcctccttttgcagttttgttttgctgcaaattcggattcgttttgttttggaaacgttccgaaaaatccggtgcg

SEQ ID NO: 31568 - DNA, 7495 bp, Oryza sativa
gagatgcatcatgtatgaaagtgaagcgaatcttagagttggaaagggcaaagaggggcgtacgctccgggcgaggtggtggcgggacctgttctcgccggcggccatgtcgacggcgacgagctcgtagctggcgccggcctcctccaggcacaccagcaccgtcgccacgtacggtgacgccgccactccgtacaccttcgcgaccatctccgatgtctctctctaaactctgtctctgtctctatctctcttgagaaagcttgatgtgagttcttcctcgttctacacatgctgacatttataatttaggcatcagttagcagctccatttccgtctaatttaatcagcaagaagcttcggagtaggtgcttggacacttggcgtgaatgatgtgaccataggcttgatgataatggtattactactgctgctgagtaaaaaatataagaaattagaatcggatgaaacattttgtggcaacagaattttaattgacgaaaaataatgattaacttgctattatcattattttctgtatatatcatctcttaaattctatatatatttgtaattaatatatgatccatatgacgttataatatcatttgtctttcccagtaaaattagagacgatggggtggttaacatgtgaaccttttgaccccacatattatttctttattacaaaagagtaagtagttggtgatgacagattaacccctcatcaccatcactgctctttttaaactagcatagaaatcatgcatgcaagctttttctttttttaaaaaaaaacacattacaatacagatactccctccgtccaaaaaaaaaaagacaaaccccaggtttccgtgtccaactttgactgtccgtcttatataaaatttttttataattcgtattttcattgttgttaaatgataaaacatgattaatattttatgcgtgacttgtctttttaatttttttcatatttttttcaaataagacggatggtcaaacgttagacacggaaaccagggtttgtcttctttttttttaggacggagggagtagatgttaatgtacacacttatcctaaatctgactgttaatgttgttgtcatctagagttcatataatagatatatgttgttttaatttttttcccttccaccttgatgtgatcctatttcaatcaatcagtttgtatgggtgatttgagtttttcttttcttttccccgtctttcggtgaaaagatgcgtaatcgtattgcgtgttctgaaaaaaaaaagagaacaatataatcaagtcttccccacctcgtctctcttttggactatatttttttaaaaaagaaaatagcagacctaacacaataacacacgagggagtgaggccatcgtgcattcgtgcaccctgcaaacttgttacatggatggccaatagcatccattcttatccatgcatgcaccctcagataaaaatcagtgcaggattatagcctcatacattttgcattatgtacacttgtaatatgataggtcattgtcaagcactagtacctgtgcattctagtgcatgcataatctggcaaaatgcatccgaaccgtatatgatatatcgaacgatagaaacaaattacactgacgtggacatagaaggagaccttacagatggcgcggcctcatattcctgattgactcaactgtaacttaattgttagttcttgacgccacattagacaagttcttttagaggagtaatgcacaagtgatgcaacaagccaaaaacaacttgtacatcagattttaagcacggtacgaaaaacatcccatcaacaacattagtgatcacatatacgtaccttctcgagatgttttacgatgaactttatttgtaaaggagtaccgctatacatccgacccctattcgaccctgcctcatcagccaatcaattcacttcatacaagtcagtttttttccatgtaagtcacggcaagcagtagctaagtactagtcatacgcaagtcgtacacactagtcgtatggatagtaattttctttgtaaaatcaatagtaaagaaatagtcttatcttgatgcaataggaatcgacacaaaagaactcctttgcccccctacctcctctgtgttgttcttaattactggcgctcgcacacaaacatttctatcttcaccgcatgacacattgctatcaaatcgagactgacacatggcccccaccataataatcaactcctaagtagtataacagcacggtggggcccaactgtcagtacgtagcctgtacagtggggccttctccaagccgatggctcaagacgtcacgcgggcatgagagcggctaccatcaacatggccaccgacggcgtcgacgagcgcgagctcgccgtcctcagcaaaggcggcgatcttaccaaacggctgcaagaacagaacaacgtatgcaaatctatgatactacacgactagatgtccactcgagtgattaaaaaagtttcaaacacattaagagatgcaaatctgcgttagaaagggatttttttcaaaatacttttaaaatttttaattttaagaatgaatcatttcaaaacttatttccaaaatcttaactctttgaccacatctagcattaggaaaaaaaaacattgacacatcacctgcaataggtgtgacggttttatcctatcatatcagcgaggatggtatgagtaaataacagctacgtcagttagattagcgtgacaatatatttttgccatgcaagttagcgtggcaaaattgttcatatgttaaaaataagttttgtagatttatttttaaaattaaaaaggtttttaaaagaaattctcagaaagggtgggcggcttacgttccgggcaaggtgcggccgggtactctgttcgcgcgccgccgccgtgccgacgagctcgtacccgccgccggcggcggcctcctccaggctcgccagcaccgccgccacgagcggcgatcccgccggcccggtcaccctcactcccatctctcttctctcccgtgtgagctgaaagccttcttgcagcagcagctctgcttccgtttaatttatcggcgagaaggcggaagcttcagtgaaacggcttggtgtggtgaatggtgatgtacactcctgctcacgaaagctagcttaaccatctctgccgatttcaaactagaaatggtatagtattaccttgtactaatctcttcgatgataagttagttatatggatgtttttgtcctcgtgcaaaacatgtcttgggtcctttttaaactgaccaaatcgtataaaccacctcctccgttgtcactctcgttttaaacattctactccgtaacccattttgttgcaaaagctcaggcaaccaaaggccaaaattactccctccatacacattattagttgatttggcccatttctttcaatatggattcgctgccgatcaacgccattgattgtcattccacccttcttgccacttcgaactagtataaggatctgttttggggagtttctagtaggtgcagtttctcccagaatcaaaaactctccccaaacaatcgagattgtcacatagattttgagaatctattattctacttaaaaaataaactaaaattcagaagctatgtttagtagcttctccatattctcataagctgtctatcaaccagtagattctcagaatcttaagctctcccaaacaggacctaagaacgagctcaagtcaaactcacctcatagccatattagatgaacacaacatggcttatacagttcactgcgaatccatgtcagaagaaatggagcaaataagctactcacgtgtgtacggtgggtgggcttttgcaacgaaataggttatagggtagaatatcaaaactagagtgacaattagggtggtttatgcaacgagatttgctccggtccaacaagaagtacctcaaggtaccagtacctcatggtactaaatcgtttccgattgttggattaccttctaaacaagtgccattgtacctgtacacggattgtgtgacattgttgggctacttactagctcggttttgaaaaatataaagttgttgacttttaaacctcacatttggtcatttattttattaaaagaactatgtaaatactcgctccgttttaggttactctaaatttgactaactctatagaaaaatatagtaatatttacaacatcagcatagtttcattaaatatataattgaataaactttcataatatattagtcttggattaaaaatattacaatttttttccataaaattagtcaaacttaaaatagtttgactttgaccaaaatcaaaacgtcttataacttgaaacggagggagtatcatttatttcgacatgacttgttttatcattaggtgctttaagcacgactaataattttgcatatttgtatcaaattttagtatgccatgtaaaaaaaaggggagtatgccacttggctaaagttcaggatttaacaactcggtgcgagtgaaagtttttagggttgtaaaatagactttttttctcaaagaaatactcaggaggtggcactattatccatttcccaatcgaatagcaaaaaacatctgaggaacataatttcttcaaccatgctcttttgcttcatctatttgttggaaatatagtcatgaatcggcatattttaatccaaaatgttaaagcaataaccatggcataaacagtgtagagtgatcttaacataaccagtagcatactatgcgcatcatgaatgtcaggaacagaaacattacagtaacgcaataacatgctagaggcatcatgaatgtcaggaacaggaacacagcgcacataacagtaaagcgatagcgctaacaaagggaacaggagaaggatatacctcgagaatggccctccgttggattatgaggcagaattgcctccgttgatgttgtcgttcgcggcaccggctccagctcctggcgcaccacctctgccatctcctccagtagcggcggcggcatctccagacatggcgagcaatcgtgcgagaggcactacccaaaaacctgatcacccgcctacccggtgcagatctcaggcgaagatgtggttttggaggcactgctccttccaatctctcgtgcgcgcaagagatcagaagcgaggaagcgagaacagcactggtgcggaggaggaactaacaccgggaaagaagcaagcgtccgttacagatcggactcgcggcctccttatctatcaggagagagaggcagttgttggaacgtggttagtggctgcaaaagaatagcgacgtgacgcacgcacgccgccagccagcctcgcccacgcccacggcctcggcccggcgcgcgcgcgcgcgtggcattccgaaccccacctcaaccagtcaacagggggcctccaataactccctatttaggttaagatattcctcgcttaaatcctgatgtggtattattatccttaacacttattatgggcctttgagatttaataggataagttgggcctagcccaattattctaacactattgactatgtcttactgaaggaatacatttatctttacaccagttcctaatttctttggcagtttggcactgaaaagatgtgtcagttacatgcattctgtcattctgatgattctggtgatctggtttgataccaagcagcacattatgctctgaaactgtgacagagatagacattcaccttatccatatatatgctctgaaacgtgatgtttgtataagtttctgttaatcctagtgtaattttttccttcttatttgcacatgatcacctggtgtcatctgctgctgcactgtcatcggctgtctctttagaaaccatattttgattcagtacaaacctcaggctgtcaccttcttcaagctcccattgctttgtgagttcattgatggctcttgttgcagccctggctacagcataattggaatcttgagccaatctctgcaattgaaagagcaagcaaagattgatgaaacatcaatagttacccaagtaacttcaaagaaactagttcatgtagcaagtagcaactagcaagttcattcaacaataactgattattatgcagaaacaggctgcgttgtactatggattttaaccttttttagataattgatcacaagggagaaatgagcttcagtttgtacagcttggaaatcatggttacaaatgaatatgaagatcaaatttgaactgtggggcaagcatgattcctggctctgagaggcttagaaatttctcatacaaaaaattctgatatgaaggtaatcagaaattgtcaataggaggagctataggagagatttatgttcacctgtaatgcacccatcccagcatttccaagaatccacatggatggagctgcagccagtgcattagctaaagctttcctacaaggggtatacatacataataatggtcaatacgaatgcgatgtaattcagaaatataacatagagcctcatcgtttgccctacaacgaatcagccaccgccaaaatttatttaagacttaatttttgagttaattctacggtattttcaacatagttccttttttgaattggcttttaagtcactaaggacatatacataatagttttatccataaattattttttgtcgctaattagctattttggcacatagccatgatgtatagagacaggacatatcaaatctgcattctttatattaacattctctcattttctgtatattctcattttctgtacttgaagatggattcgatcttgctaacaacgcagaagcaacatacattgcaggtaactgtactcaataatgctgtgatatacctggtattaacatctggagagcttgaacattcagcaagtaaggaaacactctttttcccatccatggcgtccaggtcaatgagagttgctactaacaactcaagcttcagaaacagaaaagagaaggttagaaagatggacataggaaggttcatctttataatgtgggtaaaaaatgtttcacctcctcaggatctgtgtagtcgataccatcagcctcagacaacgcagatgccatactccagtatgcttgctatggataacaaatttaaccaaaattagccatatgatgggagttttctgctaaataagttaatctagatataacctctatggcggtaatctggtccgttgaaacttcatgaggaaacagctcgaaggtatttccatttttctcaagggtgatgaaacttcttgaattagcaggagaagaggaaccatcctttgcgaatctaaagtatatttattttagtacaaatcagattgttctaacaatgaatatgaaccagcgcagtaaaatcataccctccttaattaaacattgaatttctctaagaaatggggtaccgagctcgaattcgccctatag

SEQ ID NO: 31569 - DNA, 1671 bp, Oryza sativa
atcttcagcagttatctcaaatttaactagacagcatgcagccatgacaattaggaaatgcataattgattttctaaatggtgacacatcagtcgccccccttaaatctctaaatacaccaacatttctcgatcctagatcagtttgcagttcagaatcacaaacaaaaacacagcggggaactgtacttgcagtaatcagctaattcgaaactctaaaaacgataattccaaagtagtaaacaggaagacattcgaaccgaaagaaatggcatgtatgatccatccatgcgataattgcccaaagatgcataatactaaaacaagcataaatttcaaagcgagtaaacaacagaatatctgatccgtccatcctccacatctagcatgatcaaaacaccaccaataaaacaccatcttttggaacatgcagaggctctcgagtgacaaaatacaaccaaaactcaacgagaacaacaacttggtgattctatttttcttaaacaaaaaagacacctactttgtggaatccgaggggaaagaactcgaacctttgctcgccggcctatcctgcctccgtctctgcacaggccgggaagagagatagagagagaggaggggattggaggagagagatgtagaggttgaggaatctcaagcaaaggaagggagatgaatcaatggaggatggcggatgcggccttgtcctgtccacttctctggtcgcgctgcccatgcctgtagcggacacgtggcgctcatccgctggtggcctcgcatccgtggcggggcctacaggctcggggatcatctagagtcaacaatttcattccacactctttcgctgtcaacactatctcaaaaaaaaaaaaacacaatcccgttgggtgtccctgacacgtgggccctccacatctctctatcaactctatagcctagccgtatggagcatgcttgttggaacgtagttttggaataaaatttgaaaaaaatatatacttcttttcatggttttggatttatatacttattttggaaaagaaagttaatgctattaaggccccctttgaattggaggataaatggaggaaaaacaaatgaattgaaatcctacactattcatgcctttgatttgtaggaatgataaaaggaaaaacgtaggaaactttcctttcctacgattctagaggaaaaatgtaggaaatttaacatccactccgacctcttggaaaacttcccttgagtctatctctctcgtttgaatcctgcgtttttcctgcggtccaatcaaacggccattcctgtgtttttcttgtgttttgcaatcctttgttttacacttgcattcctatcagaatcctatgtttttcccattcctccgttttttcaatcctacgattcaaaggggccctaaaaatggatttaagatagatcaaacaagcaaaccattaactcaaaacattatttaagagtttatggctcctttgaaatgtggggatgagaaaacacagcaataggaacaaatgtaggaatagaatgttatacttagggagttcttatgggatttcgaaaagttgtttgattatcatgaagtaagatatcatgcttattttcctctaaaattaatcttgtaaggttcattccacatgaattcctaagaaattgataggaa

SEQ ID NO: 31570 - DNA, 814 bp, Oryza sativa
ttggaaaacttcccttgagtctatctctctcgtttgaatcctgcgtttttcctgcggtccaatcaaaggcccattcctgtgtttttcttgtgttttgcaatcctttgttttacactggcattcctatcagaatcctatgtttttcccattcctccgttttttcaatcctacgattcaaaggggccctaaaaatggatttaagatagatcaaacaaagcaaaccattaactcaaaacattatttaagagtttatggctcctttgaaatgtggggatgagaaaacacagcaataggaacaaatgtaggaatagaatgttatacttagggagttcttatgggatttcgaaaagttgtttgattatcatgaagtaagatatcatgcttattttcctctaaaattaatcttgtaaggttcattccacatgaattcctaagaaattgataggaaacattttttatttcaaataactctataggattatttttcataggataaaatcctctataattcatatggtttttcctttgtttcaatcatgctaagactgtgtctgtctcatggagttgggaattgaccccctaatcacgaaaaatggagcaacatagcacataattaattaagtatagcttaaaaaactttttaaaggattaatatgatttttaaaaatcatttttctatagagattacacgcgccaaacaagagagggaaatagggaacataaataaacgaactcagtccgccctgttcgaattttagaatgaaggcagtcctatagtcccgttcttttgggtaccgagctcgaattggcctat

SEQ ID NO: 31571 - DNA, 1160 bp, Oryza sativa
ataaaacaacatcggtactccagaaacatttggcagctatatatcgctcagtattttcaactagttccagcaaaatgaagtgaaggacagagaactagcacagacctccaaagcaccatcgctccaatgctgatctgctgctttcttcaagtctgactgagcctgttcctttaatatctgaatatgcatacagaggtaacaggctaaagtacatagaggtagaaaggaacaaaaagtaaagcacatggatggttcaattatctaaacatattgaaaaatcatactctcgcaaaatgggtaagccgcgctgccctttccttcacactgtggtcaatttttttagtgtccttccttgcacgagctttcagtaaataatagctttagatggatagttaaatcataccaaagaaactaagagcttgtcagctaaaagggaaatcatgtaccatcaagcttgagaaatcctgaccctaaaacagcaacatcctggcacgcacgtttgttcagccttgttatgccactaggattagaaatgagacacataattttgttatgtacaaatctcttgtttttaccaagggatatattttttaaagattattatgaaaggaataccgtgaaagcaagagaatatcattttgagctctttcattcacaaattttgcatcgttgtaaacaaatttgcaagcttcagccaacccttgactagatttgactgattttttctttgctgcaacttgattatctgaaaattgggaggctcctcttgaatgttcttcaaaatccctgcaacaatagatttagaaatttaaaaagacaaacaggttatgtcaaccataaaaacaaaataaaaaatgttggatgggttatgtccatcttaaaaatgactgtgttcagctttgtacataggacgtgtcatttaaagacagtagaaagataggaattaggatgataatgaatttgcatgtccagatacacaaattcaataaacattggtcatctggggaaaaagtaggctcattatcctgtaatgtagtacaaatattacctgtatgaatcagtgccatcttcaaggctgcactctttagtttcactgctgttatgagaaccataagaatgacaccggaaattctggccttgttggatcaaggaaccatttg

SEQ ID NO: 31572 - DNA, 1251 bp, Oryza sativa
  unsure (1)..(1251): unsure at all n locations
actttttcgattatgatttctttcttttatccggtaaggatgatcagcaatccactagactgtcgatacgtaacaatgtaactcggtactatgtatgatgtttgggagtgaattaacacacgatcagagataaccaatgtgaatactggctgtcagattaacttaatccatggtctacacatgccgacatgcgtatacgtaaagagacctgcaagttatgatgatcttaggagtcaaagaagatcagcaattaaattagtttatcctatgttctgataaacttgtttcatttgagacaatacagagcagccaaactgacaaaatcttgctttgctacgtacaacaaaagctacttctgcaggtatatcactgaagctacaacaaaggctaaagagcatccttggacatttgtgaggctattaaactctggatccgggatagggactgatccaatcagacatctgatgcaaagggacaaagaaatactaggaaactaatacattttgtacttcatgtcagctatacttgacaattcagtaatttcagtcagtactgtggtacctggattatcaaattgtcacagaacttactcttatcttttactttcacattcagaccacatcattccttagagttatcgtcagctcaagaacaatgttctcaagtctgaaccacagctagtgataattacagacaatttcagtttctgccgtattaacccagaatcaacctctcgaagggtcagatcagcaatcaggggagccagattccacacagaatccctcaagaacaacaatggccattaaccacttgatcagtgctgctctatccaataacttaaagcgaatctccaaaagcagcagaggcttctcttctccccactagttttctcaccagatatggacagcaagcgatgccgcgatccgagatcgcttttgccatcggtaaatctttcaaaacagaccaggatgatggaatttcatatggataaggagcatctggtctgatatagggtagggattccaggtagagtgtggtctcaggagatcccatgccacactgtatgtggcagattgtgggaaacatggaaccttgggcagttgcagcaatgatatttataatgaaaggaatggaatggattctgcaagtggaagatcaaccatgcatattgtatttgacagattagggaatnnnnnnnnnnnnnnnnnnnnnnnnnnnnnnnnnnnnnnnnnnnnnnnnnnnnnnnnntta

SEQ ID NO: 31573 - DNA, 2639 bp, Oryza sativa
  unsure (1)..(2639): unsure at all n locations
tcatatgattctatgtaagtttaaaccaacccaacgcatgtagttctgttgctaccagaattaagttaaaaagtagtcctgtaaaggaaattagagtacccccattcttctccactggtgtggacctggactaagactttaaggggtttcttcccaagtcagctaccacacgatcaaggcgattggcaatctgaaaaagcaaacattgcatttatcttgttacagttgcaagattgcgaaactgatctgacaaccaattattcttccctaacttatgagtgatgcaactgaagtcatgctatacaaaatatgaaataatatcaagttctactacaacattgatatgcaatcattaaggcatactatttttttgttatgttactttcattgaacctgtaagtgatacctaattatccgaaaataagtatgttgagttgatgattgatcagataaatatggtgtatcttatagcgttagtatttcaaagcaaaaagtaatcacacgaagaaatattaatttgatgtttaccttctgatcatcaacactctcgaccatgtcaagatttggtacaccagctgtaggtcaaaacacaagaagataaaacttagttgaattttaaacctggaaaaaaaacttcaaatacctaatattcaaacaaaattgatagcttcattgataaagaatgagtctaacgttccatgaaaccagaacaagaatgtaattcagtgctttacatttaggaacatacagaaggcccacataatagtcaattgcacagttaactattcaacaaactgagtaattgagagtagataactctggctgctagaataaaagaacaagaaagcatatattgaacggccgacaaaattggcagtaagaaactaaagccatgttttagagatagccatggctaaccagtgaaagagagggaaaaaaaaagttcaagcacatcgtcttaattacaagtaccaacctaggagggctctggccttgttgctttgaaggttcccgatgaaatgccactcaatatcctctggaagctgcaaaacagacaatacttgctcagttgccaaagtttgaatatgtttgaggtcatttaattcaagaaaaacatccaagaagaactccaagtgaatataaaagaggaagaaaaggaataatgcttcactaagtggagtgcttgttacatatgaacacagaacacggtgagaggaataatcagtgaattccttgacatttatctttattttcatgaatcatgattcactacaggttcaaaatcaaacaatacttatgtatacattaccatgagaagagaaaccatgaatgagaatatctcaaaataatctacagataaggtttagtgatgtacatgattcacatgatgtgaggccaatccaaacaaaattatcaccacacaaaaccaacacatcctctcttcaaagtacaactgattgtaagccaaactctttggaactaatcatagtgcaacggcagagcgcctacagcttccaatcagttgacaacacggggatccctctgctctttacccagaatcgaactgtttgctatggaattgctgtgaaaaacctatgaaactcagtgttccaaatggagctataatgttcgaggatcaagattctactacaaagccgctttccagttcatttactaacaagctaacatgatcgatgattctattctaatcgacgaagcagtaaagcttacacacaaaattaacgcgctgcgaaggattgattacgaaattaactacttgctgatttttattacgggaaaatgcatgacgatgctaaattgctcactaccgtatatctatgagacctcaggagtgagttggatcaacaattttctctcaatcgcaatcgataaattcacaatcacacagccagcgagaaaagataaaagggcgagagctccgcgaggaaagctaagtagggcgagggaaacctgggaggccttgtcgatgagctcctggacgtagttctccccgaagcagcggtggccggcgtcgtacacgccgcggatgacgcccaccggcttcgtcttgctcaccgccaccacgcgcacggactccggcgcccgccccgaccgcgccgccgcctgctgcgcgcgggacagcaccgaccggagcgccgccgccgggccctccgccgcggcaaccgacgccatcgcccccgacccctctccctcctcctccgccgtggccgccgtctccgccgccgccgctggtgttcggtggatagtccgccgcctccgcttcggatggagagatcctttcaccttaattcacatgagttttgagtcactgacatgtgggcctggtatggacctacatgtcagtgactctaggtggtgtttggatccagggactctaactttagtccctctatttagacactaatttagagtattaaatatagactacttacaaaactaatacataaatgaaagctaattcgcgtgacaaattttttaagtctaattaatccataattagagaatgtttactgtagcatcacataggctaatcatgtattaattaggctcaatagatannnnnnnnnnnnnnnnnnnnnnnnnnnnnnnnnnnnnnnnnnnnnnnnnnnnnnnnnntt

SEQ ID NO: 31574 - DNA, 4454 bp, Oryza sativa
  unsure (1)..(4454): unsure at all n locations
atagacattttcaaaaaatattttcgaaaactgaacttttgcgtggcagcattgtcctgccacgccaacaatggtgacatgataaaagttatttggccacgctagacgaacagacgtggctaaaagtttcagattttaaaatacttttggaaatggtatattaataaaattaaaatataaaaactctaaacaaaatttcacggcaatgggaatcattttgaaacaaatcaaactgaaaatccactcctcaatcttaaatttttccttagtataataggctaattaggtccaactacataggaacttcttcgagctaaagccaaacggtttggcttggtcccgtgggaacaatgtcgacttgcaccactcctcttccctagggccgctctggcgagcaaaggaagcggcaacgatggaggggatccggtgatgggacgacaacaaaagcggaggaggaacacgtcctatgccttagtgcatccatcgattatggcaaacttagggtgcgttcgttccatggacaatgagtgagatagcacatcgttttccgcgcgcacgcttcccaaactattaaatggtgtgttttttgcaaaaaatttctataggaaagttgctttaaaaaatcatattaatccattcttacaatttgaaatagttaatactcaattaatcacatgctaatggcttacctcgttttgcgtatcttcccaatcttctcaatcccctattcctcaaactcacccttagagaacatggggataatggaacgtgctatgaattgaagctcgggttattggataaaggaggaaggtcgatggcgagttacgagtggagatatcggctgacttgaggtgtgacaacatgttcccagcatggggaatccattttcgacgttgtggaaagtggatgagaactatgtgatggctagtgcagctaaagtgcagttgggagtagaggcatgccttaatggtggactccacaatggtggagatgaagggaaaagggagggaaaccctagcttcggcgacacgaggaatcgacaagagattgtatgtagcgatagaaggatgagatgtcttgaccctccggattggctaatgccgatcaagaaccaaactagaaaagctatccactgcgtgacggagaaaaatatagatttatacctaattaaaaaatacatgtaaacatagagatttagtgatgctaacaagagcttgtgtgttgcaatggaaaacaaatgattttgtagcttattaagttaatcctatcttactataaaattacagcccactagtataaagctcgacatacaaatataccacctcaatggtggagatagggcccggccagcgcgggcaagtgcccaggctccaccactatgcagcagtttatcagcacttagttacaatgtttagtcaccagctaatcagcatacaatttataggtaatgccctcttgcacgtgaatcttcttgttgattaccatgcttaactaaatgcctgttactttcagataattaattcaatttcacaccatcacaattatgatctaaagataaaattatataactttctggtatcagtcttatttttttttcaataagatagtacaaactccatactctagcctatatagccatcatctcattgatatattctcataggatttcctctcctaaattagaactcgatgaccgtcaattttacatacgtatatgataaaaggtatacatatttgaattgatttatgtatatttgtttttcgctgttagacttgcccaagctcaaaagtattcctggatccgccactgtgccactcatcatccactagcaataattacactgaaaaacttatgtaagcatgcaacatcatctataattcattgaattctataaattaacatacaatcatctttctttatattgttttttataatgtttctaacatcctccggacaacataaacttcttttattttttaagtagatagtagatagaagtagaactgtagaagtagatagatagatagtataaaagagaagagaagagaagagaagagatagagataggctgtgtttaattctcttcaaactttcaacttttccgttacatccaacgtttgaacatatacatgaaacattaaatgtgaataaaaaaatcaattgcacagtttgtatataaattgcgagacgaatcttttgagcctaattatgccatgatttgataatgttgtgctacagtaaacatttactaatgacatattaattagacttaatagatttatctcgcagtttataggtgaaatatgtaatttgttttattattagtctatatttaatactttaaatgtatgtccgtatacgttaatttttttttcgccaaaacaactcaacacggtcatagagatatagaaaaggtcgtgttggatttaggcatgatttggttcggacttgttgattgggaggaggcttgttagattccacccttctttttttcttgggggtaagaagaggaccttcactgttggttccctccatggtgtctcccacgaaaaagaagagatgtttaggcaaagggatggacggtggcgccggcgatggcggctggtccaccctgagctacgacgccgacgtgctccacatccaccaggtttgcgcccattggcgcgcctccacggcccccttggctgccgcccggccatggatcgtggccggccacgagacgtcgggcattgtcagcgccatcggcgaggactactccttctggctcccccatggcggcggccagaggatcatcccctgtttcggcgacgcgccgccggcggggctcctgtactgctgcggcacgcggcgggggtggctcgccctggcggacgcgccgcgctccccgacgcggctcgtcctttgggagcccgtctccagggcggagatcgcgatgcccccgctgccccgcgcggggttcgccccgcagatcttcctctccggggaccccctcgccgccgcggcctcgccggggtggatggcgatcgccagccagcccttcagcgtcgcgggcaagtggcagacgctcttcttctggcgccccggggacgccgcctggacgccgcagcgcgagccgccgatggacaggatcgacagcgcggcgttccacggcggcttcttctacctcaccgtcaggtactggtacctctacgcgtacgacctccgccacgacgccggcgcgccatggccaccgccgcgcgtccgctccaccttcgtctacctcgacgccgaccgcgcgtgcgagctgtccaggcaaggccgcagcctgcgcgccgcgcacgtggtcgccgccgccgacggcgtcgacctgctgctcgccgtgctctactgggaatgccaccgccggagtgtacagatggtcgccaaggtgttcaggatggagtgggcggcggcggcggcggacctcgagctctcgccggtgacggacctcggcgagcacgcgctcttgctgggccgcggcgacgcgctcgcgctctccgctgcggagttccccgcgatcaggaggaactgtgtctacttcgtcgagcacgacaatgccccgcatcggcattgggctatcgccatggatttaggggcaaatgcttcggagctgattccgcatccacaatttcaggaagatgagccaagcgaagaagatggcaaatgcgccgccgatcgctccttgttgccgtattcctggttttgcctcaaacaacccttcttcaagcataagtgacatggccttcgccatcaataattgacatcattgactttactgtatacttcctctgtttcacaatataagactttttagcattactcacattcatataagactttttagcattactcacattcatatagatgttaataaatctagacatatgtgtgtgactagattcattaacatctatatgaatgtgggcaatgttagaaagtcttacattatgaaacggagggagtaaatttgatctattatggcaagtacaaaggtagagaccgatatggtctctacgttaattagaggctatcacgttacaatagttaagacaatacggtctctaatcattaatgtaccaaaatactttcttactagtcatctttcctttattagactcaatgcaataaaaaatttcctaataaatgctaagagtcgactctatgctgttgtcatgtgtagcaaccatctttctcttttcttttctctctctcttccacatcaccaaatatgcttgcatgacaataaagagagaccgctaataaagaccattgtacatgcccttagtttcatcaaggattctagtgattaggaaactatggaagggagatttttcccttctatgggaatttgttcccaagtagagttgtagagggacnnnnnnnnnnnnnnnnnnnnnnnnnnnnnnnnnnnnnnnnnnnnnnnnnnnnnnnnnnn

SEQ ID NO: 31575 - DNA, 1008 bp, Oryza sativa
tgcgaaaaatttcgaccaagcagccggtcttttcgtcacctcggtacgtgttcaatatgttgcgcatatttgatctgttcatgttattctgcgtaagttacatgtgtagatctaatgatgcgttcatgctagttttcatctgtaatgtcatgatttatttatggaataaattaaatccttatatgcccataatctcaacagctttgacgttcgtgcgcgactccaccagcgtggcgtactcggtggtcatgaggtagtaggtgtaggggaaagtggttcaggtcggcgacgctgacgaaatctccggcgaggtactccgactccgacaacctccgctcgtacacctccagcaccttcctcagcttctcgacgttctcgtcgacgatggcctggtcacgggcgccgccgccgatcatcggcttgatgacgcactcccggataatgtggaagatggcagggtcgtagtggtgcgcctccacctccatccacatgtccaccattgccgactcctcaaggttgccttctcttaagagatccggtttgttgtaattgcgaagcacgtagcgttgaattgcacgcgactctggtaataataataataataataataataataataataataataataataataataataataataataataataataataatatgggggatcctctagagtcgaaaaaaagtgaatactcattattcatttccaatatataagtaattgagatggagcatatcacagtaattcgggtgaggtgtggtgttcctcataccaaagagagtgacttctccgtcctcaaaggcagggatcttgccaaagggctgcgagaaacacgtgcaaatttgaacgaaatatagccgaatttgatttttttttgaacgatatagccgaatttgatttgattgattggttaattaattcagagatgaaaaggtttctagcgagcaattaattgattttgtgcaagaagagatcgagatgcatcatgtatgaaagtg

SEQ ID NO: 31576 - DNA, 1610 bp, Oryza sativa
  unsure (1)..(1610): unsure at all n locations
gtgtcgacaagatgtataccgcagggcttggttgnatgcagaaaggaaagcctcagcctgtggaatttgtacgtctatgcgacaccacgcatgtaattcggtttgcaactgcaagtctatatacgcaaaaatacattgtatgccctttgatgcagtggttatttgtgcccttctccgtgccaatcactagtttgctttcatttgaacgtgctctactttctgcatttggaagattgcacagatttcattgactgctccctctacgttttctagcagtgtttaaggttgagatgaaattcgtttgatgccttacacaactttaggacccctttgaatcgtaggaatgaaaaaacaaaggaatagaaaaaacataggattctggcaggaatacaattgtaaaacagaggattgcaaaacacagggaaaacacaggaatggccgtttgattgggccacaggaaaaacacatgaatcaaatgagagagatttgagagatagacttagagaaaatgttccaagaggttagaactcttgctaactttcctctaaaatatatataggattactcattccatgggaattttaaaagcttggatatgattcaatcctttgtttcaaaggacttcataggattttttctataggattgaaatcctctaaaattcctacatttttcctacaaatcaaaggggccttacttgtttggaaaagacgatgcaaaattgcaaatgccctatatttatagatggtgggagtaaatattttgaaaaactttcaacaacatatgcttatttttgttgggtccccttatttactggttggttaaatacagtggtgatgccggttcggcccttttggacactactagaggttgtgttcggcagcccctcttccaacccatctctctcgttttccacacacacgttttttaaactgctaaacggtgcgttttttttaaaaaaattctatacgaaagttgcttaaaaaaatcaaattaatctatttttgaaaaattttttagcaaataattaattaatcacccgctaatcgctactccgttttccgtgcgggcacttagtgttgggaacccctggttggaacacaccctctgtctggaaaaaaaactaatttcatataaaaacgtgacacatctaataaaataaatattgacataaccaatttatctgaacatagagttgttgtcgtatcttagtataaagttggtctattaggatggagtacacactaataactcttaatttgacttgattttttttcttaatttgaccttttaatttcaaaaaacaactttgaaacgggccaaaatgtgccgccaaacagcgcaaaccccatccattttgaaacgaaagctgacaagtgaagccagcggagtggagtggacaaatctccgaaccacaaattccaatcaaaaactttttccccgagtagcctcgccgtcgccgtcgccggagatggaggcggcgcgggagtcaatggcggcgctcgtcgacgccggcatttacgactgcgcccagaccctcgtccgtaaccnnnnnnnnnnnnnnnnnnnnnnnnnnnnnnnnnnnnnnnnnnnnnnnnnnnnnnnnnnnn

SEQ ID NO: 31577 - DNA, 643 bp, Oryza sativa
  unsure (1)..(643): unsure at all n locations
nnnnnnnnnnnnnnnnnnnnnnnnnnnnnnnnnnnnnnnnnnnnnnnnnnnnnnnaattcagttcaccccgtccaacccagttatcggattcagcacaaaacttaactgctacatagtccaggaaccagcattacaatcttacccacatactttagttatatccagtatatcaatgcattatatattgactacttgtgtgttgagtgtctcaagtactctttgggtttcaggtcaataacaaaagaggaaacacgctattgcaacaatgatgctatttgacagttcaactccaagagaaaagtcgcaccttagagcagattggtagtgggaaagtgcatcagaaagcatattcatagctgcaaaaacttgagccaacttgatgtgtagagaatcatctgtccactgtcttagatatctttcaagcagcaatactgcatccttatttcttccttcagcgacatgcagatcagccaaagccaatgcatgtccagaaatccaggttcaagacgaatggcggattcataaaacttcctagcctggaaaatgcgcaatgaatatatcaaagggtactattattgatgggaagtatgcaaactataattgtgaccaagtgacttactgaccattaccaaaatataattg

SEQ ID NO: 31578 - DNA, 1020 bp, Oryza sativa
tctgtttactactttggaattatcgtttttagagtttcgaattagctgattactgcaagtacagttccccgctgtgtttttgtttgagattctgaactgcaaactgatctaggatcgagaaatgttggtgtatttagagatttaaggggggcgactgatgtgtcaccatttagaaaatcaattatgcatttcctaattgtcatggctgcatgctgtcaagttaaatttgagataactgctgaagattacagaaggcctagaattctattaccccattcatagagtagctgtgattctgacaatacaatgcacagcaggtatttagaaaggaaactgttactacatggttgttaacagcaagcagctattattgatctgataaggaatgaagttctacagtatttttgacgcgacgtattagcatcagttttgctcaagattcacttactgttgcgtgcaactaatgtccaaatttcacatcaggtactaaagatcatatctcttcaaactggttaggaagcttacttaatgaagacacaattggattgattttagtggccaaacccaagccaacatacagactgtgcgcatatggctactcgcattcctggtactgtagcagctagcggggtgtactacaatgatcaatacagaatgccatgtaagctgaaaggaattcattgcatggcattgaattgtataccgcaaaaagcgaaggtaaggaagtgcatgaatggatatcaatcaacattcaggttttgtgtaaatgagaaaaatggacaaaccaccgggcagtcaaatggttccttgatccaacaaggccagaatttccggtgtcattcttatggttctcataacagcagtgaaactaaagagtgcagccttgaagatggcactgattcatacaggtaatatttgtactacattacaggataatgagcctactttttccccagatgaccaatgtttattgaatttgtgtatctggacatgcaaattcattatcatcctaattcctat

SEQ ID NO: 31579 - DNA, 2058 bp, Oryza sativa
  unsure (1)..(2058): unsure at all n locations
nnnnnnnnnnnnnnnnnnnnnnnnnnnnnnnnnnnnnnnnnnnnnnnnnnnnnnnnnaaattatgtgtctcatgtctaatcctagtggcataattcggctgaacaaacgtgcgtgccacgatggtgctgttttagggtcaggatttctcaagcttgatggtacatgatttcccttttagctgacaagctcttagtttctttggtatgatttaactatccatctaaagctattatttactgaaagctcgtgcaaggaaggacactaaaaaaattgaccacagtgtgaaggaaagggcagcgcggcttacccattttgcgagagtatgatttttcaatatgtttagataattgaaccatccatgtgctttactttttgttcctttctacctctatgtactttagcctgttacctctgtatgcatattcagatattaaaggaacaggctcagtcagacttgaagaaagcagcagatcagcattggagcgatggtgctttggaggtctgtgctagttctctgcccttcacttcattttgctggaactagttgaaaatactgagcgatatatagctgccaaatgtttctggagtaccgatgttgttttattaccggtgttaaccttctttgtgtgtgttactatcaaattcatgggattatgcttatataatacactatttatttgcaatgcaggcagatctgcgacgagctgactcggttgttagacgacgtgccatggaagatgctttcatggctttaaaggtagcccaacttgttcttttccatctctactgtctttaaatgcagcaagttggtttagttttcattacaatttacaagctaagatatgcaagattttaggatgaaaacataatcagttattttgatttatgaaagcaagatttataactcaaactcgtaacaattcttgattatttatttgcttaacatcatgccccatacatcatatttccaacaaattttgtttgttttatgagcctgctgtcatgaccggtttgctgttatgcattacattaatagctaaggtttagtttgattggcttagcagaaaataaataatcatatatctagacatgaataactagcctcagacttaatcatactctatctacaccttgccatatcgacatttttttggtatttgttgctgcacaaaaggaaaagtttatggatcacatactagatgttttgatcaatttgacccttcccaattcttggtatttctcatacagcatcttgattattaaatattacacgtatgtaattctgtaatatttagtgcagtttgttcgggatatccatgacatgatggcaaacagattacaagagcagtaagttcatttcaaatgctcatttcttagagaaattcaatgtttaattaaggagggtatgattttacttcgctggttcatattcattgttagaacaatctgatttgtactaaaataaatatactttagattcgcaaaggatggttcctcttctcctgctaattcaagaagtttcatcacccttgagaaaaatggaaataccttcgagctgtttcctcatgaagtttcaacggaccagattaccgccatagaggttatatctagattaacttatttagcagaaaactcccatcatatggctaattttggttaaatttgttatccatagcaagcatactggagtatggcatctgcgttgtctgaggctgatggtatcgactacacagatcctgaggaggtgaaacattttttacccacattataaagatgaaccttcctatgtccatctttctaaccttctcttttctgtttctgaagcttgagttgttagtagcaactctcattgacctggacgccatggatgggaaaaagagtgtttcctacttgctgaatgttcaagctctccagatgttaataccaggtatatcacagcattattgagtacagttacctgcaatgtatgttgcttctgcgttgttagcaagatcgaatccatnnnnnnnnnnnnnnnnnnnnnnnnnnnnnnnnnnnnnnnnnnnnnnnnnnnnnnn

SEQ ID NO: 31580 - DNA, 1179 bp, Oryza sativa
ccattttctctaagtctatttctcaaatctctctcatttgattcatgtgtttttcctgtggcccaatcaaacggccattcctgtgttttccctgtgttttgcaatcctctgttttacaattgtattcctgccagaatcctatgttttttctattcctttgttttttcattcctacgattcaaaggggtcctaaagttgtgtaaggcatcaaacgaatttcatctcaaccttaaacactgctagaaaacgtagagggagcagtcaatgaaatctgtgcaatcttccaaatgcagaaagtagagcacgtccaaatgaaagcaaactagtgattggcacggagaagggcacaaataaccactgcatcaaagggcatacaatgtatttttgcgtatatagacttgcagttgcaaaccgaattacatgcgtggtgtcgcatagacgtacaaattccacaggctgaggctttcctttctgcatccaaccaagccctgcggtaatacatctggtcgacacgacaaaaccatgttcaactcaaaatatgtcagatttcactccggttacacaaatggaacacttacaggttacaacaagtctcccagcgaacaggttgaacttgattctaatacactatgtaagctacaatggcacacatacagtggtacaagcaattgcccgtgccttgcggttgcgagataccagcaattgccagtgccttgcggttgagagtttaccaggttggttgcacggcagctggagaactcaggcctcttccacttgctcttcctcttcctggaggaggttctctctgttgtcgtgggcccagaagccgcgcacatctataagcatgctggcaatagtcccgccttgcttgcaagatagaagatctgttagtgcgatcctgagaggatctgccggctttaccatgtcccagatttcatccctcacgtcttcgatgcaaagttcatagtttccgccttcaatccatttctggtgtacatccctggaaacgatgacgaagttgcttgagtaagatgaacaatcgaagtaaaaataatgatgactggtgatctaactggcaaacctattagaagtttaatatgaataactgttccaaaatggttttttgatggtaaaaccacttaggtcttgttcggttaatccctcccacaaagggattga

SEQ ID NO: 31581 - DNA, 3334 bp, Oryza sativa
  unsure (1)..(3334): unsure at all n locations
tctgttaggaattctgtttaacacatgatttgaggtcaacaatgcctccccccaccatgccttaggcagtcccgcggtgtccaacatggcattcaccaagtcagtcagtgtgcggttcttcctttcagcaatcccattagactcgggagaatagggaggcgtcctctcatgtatgatgccatgttcttcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcttcatcatccacactgccacaaatatggttcacagacttattgcagaaatcagaaagggaaaagcggaacagnnnnnnnnnnnnnnnnnnnnnnnnnnnnnnnnnnnnnncccaggtttaaacatgcattatttattaggcctcaaagagcaactttaatccgtctctagtcaacggggaccacttacaaaattcctgttatagaaaggacatggtgcacgttcttagctgcacgattgttccgaaagtaaacttcagatctccggtgtcaacaccatgatcagaagcattgtgacccattccgccattaggactggtggaactcctgtgcgatcctgataagaatgaaaacaatgagatgtcagcacaaacatgtacattggccccagtatcaacccaccaattagtagattgattaactgaaaaaacagtaggtaaattaccatacccgcttcatctccagtgttgccaatggtcacattagcagacttagaagtctgccctgcaggtgccttcatccccttgcgttgtggacacttcctagccagatgaccaacttggccacacacaaagcaagtcctctcatcctgattaggataggtgttgctcttcttctgcttcttgaagttggtggtctgctgagctttgtatttccccttgctcttgttctgggccttgtgcacaacattggcactggactgcccaccatcgtccttagacgcggcatctttttcccgagctttctcctcaacatcaagagacgcaatcaacccctcaacggagtattcctgtctcttgtgtttgagtgcagtaccgaaactcctccaagatggaggaagttttgcaataatgcacccggccacaaatttgtcgggtaagacacacttaaggagttcgagttccttagccatggtttgtatctcatgagcctgttcgactacagaacggttgtcagccattttgtagtcatgaaaccgctccatgatatacagatcattgctagcatcagtagcaccgaatttagtattcagtgcatcccacaactccttagcgcccgtcatatgcatatacacctcgaccagacgatcgccaagaacgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatgggcatataaggatttaatttattccataaataaatcatgacattacagatgaaaactagcatgaacgcatcattagatctacacatgtaaactacgcagaataacatgaacagatcaaatatgcgcaacatattgaacacgtaccaaggtgacgaaaagaccggctgcttggtcgaaatttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgcaggtgcacgccggcgagcgggatggagtagtctacgagcgacggcgcagtacagagtaggaggcaaaccctagactgcatctgcgcaagggtgaggagccaatttttcggaccattcgacgcgtacgtcgtgcacgcgcgccgcctgccctgccctgccctgccctgccaggccaggccaggcgaggcgaggcgagcgagcgcgcgcgcgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaaaagcatggtgggagcggctgctcgcgaggccggcggtgaggaaggtggccgctctttccccccctgtgacatcaacctgaagaagctccacctcttggcgttaatgacaatgacagttgggccccattgtattgttaacttaggttatggttgggacccacttgtcagtgtcagttcgctagcatatagaattactatatgaagtactatgcattattgtgcgtctatcaatagaagaataaaacagaggagataccactatacagtgtacacggcttggcaatgtgtcaatgtacatgacacctattatttttttatgacaaagcagtataactaccattgttcatgtcattattgaaattcgttgtgaacaggctaggatcatatgtcctaattactggatgttgtggaggaactataaacagaggcagtgggaagtacaaccacaaagtataacaactgtttgctgatccgcacacttgtttggaccctaccactttcatgcaaaattcatgcatatgatataaatatatttacacctgatgcattttagcttaattaaattaatttcctaagaagtagtgacaaatcaagcgaaacaaaagcaataaagatgaaggct

SEQ ID NO: 31582 - DNA, 1931 bp, Oryza sativa
cggcgcggcggaggcggacgcgtgggggctcgccaagatcgcggcgctcatcggcgtcaacctcgccgacgacgccgtgttcgacatcggcgccggcaagatccgcccctcccccggcggcggcgccaagggggacaaggccatggacgcgtgcgccaaggcgtacgacgccgtcggggtcgccttcgcggaggctgccgacgagctgggctcgcgccggtacgccgcggcgaggcaggagctggcgcgcgtggcggcgctcgtgcagcggtgcgacggcggcctctcccgggccggcgccaggtcgccgctgcccaggtacagcgccgactgccagcaggtggccatcatgggcatcgccattactaacctcctcaagtgacacgtcgccgcgtcgaacacctttggtggtgtggcttggttcttggctgcttacctacaaagtgaataaattttgtatctgtagtttataaaatccaataaattaagacaattcattgggtgtttgtttggtttaggaggttgattttcattgtgttagattatatttggtcgagtgatataaatattttgggactatctatatttatggcgccatatttttcaacaaaaaatagtcggcatgtatttatgttgtagcttcctaaattacatatgtaattttagtgtatttacaatgtaaatcccaaaaatacatatataagtcctaaaattacatatgtaaatcccaaatttacatattaattacatatataagtgatgtgtaagtgaggtgtaactactgtgtaaattcgtataaatatataaataattattaattttataacggaggtgaagtgctaatgagcttagagcttgattaggtgcagctggttctttcacaaaaggtgtaagatgggtgcatgtgcttgaaacgaatcttatcggaggatctcacggttaaaacatccgactgtaaattatcctaaaatatgtcgacacaaatttagcaatatcgaatatttttgtgtaatgtgaccaaagttctagatcaatgggttgagaaacaacatcgagaaacgtgggatgctatttctgaatggttttaaattttaacaaggaaaagatgagattgtacctatgttattaggatgggaacaatggttcagaacgagggatgcggcatgattccacgttcttggtgacttagattttgtaatgttggatttgaaaattcatgttatttgcccacttccttttaccaaattttggccaagaccatagataccatgttactgccaaataacaaaccttttgtgtattcaaaatttaaaaacctgtttcaaaaaaaaatcgcataactgtcagtgggaagttccatgcgttgtaatccaaatgaacaactcatatttcgttttcaccatgtaactgaattctagtccaatatgagtttggtccaacaaattgtaggatcaagctgatggcaaatgaacaagggggaattcagatcaaccctcgataaattaaatcaataaatacgaataaaagttactcaggtttatgtcaaaccgtatggttcaacatatggataaagttaagcgataaattcaaggcgagatcatagcatttcatatccttatcggactaaaacaaacaaacaaattgataatagtagtcattttgacatagatctttgttccaaattcatatgtgcaaattagaaagggataaaaacttccatgatatattcatgtcactgccaaacagtgcaatgcccattgtgacacctgattattattaattacatcaagagtcgtgcagcacgtacggatggatcagcagctcatgccggcgtccaagggcgtgtccatctcgccgtcggcgagcatgtcggcgagcaccatccctgcgaccgcgccggcgacgacccccatgccgagccccgcccccat

SEQ ID NO: 31583 - DNA, 5228 bp, Oryza sativa
cccccccctcggggagaccaagaggtgggcgcacacattaccctcgggcccgacgtcccccgagggtgccaggccacgtgggcgattgtgtctgcctcaagcctctagtcatgatactcccggtcccatgtcaccgacaactgtgaaagtgtgaactccccttaacgtacaaaatgaggaactatgtcacaaagaaggaggttcgactagctaaaataggctaagttagattcacatctcagactcaacaaaggagggttcatcatgtccctgcaagaaaaaggattcatcctctctcacttagatcatcccaacatcatctgccataaacttgatcatcatcacttagagtgagtttgaggagaagtggattaagaagattggaaagatacgtaaaacgaggtgagctattagcgcataattagttacgtattaactattttaaatttcaaaaatggactaatatgattttttaaagcaactttcctatagaattttttttacaaaaaacacatcgtttagtagtttgggaagcatgcgcgggaatacgatgtcctttctcaccctatgtcacctaaacaaacgctcccttagtgcaagaacgtaggagtagggcattatgatttcgagcaatctaaacctgtataaaccatctgtcttcattctctaatatcccctcgttctcatgcacgacctaagcacgagctcgaacctgcaccatgaccgaactatcaaacgagggtactttgccttcctgcttggggagttccttgctctaatagtattgaacacttggcacattaaacatgaaaaaaaatatactatcatggacaccatatcaacaagaaacacacgtcgttgatatatattttgttctttttatacttaaattgcactgatgagttttaggataaactcaaacaatcaatttctaccaaaataataggtgactaattgataaataagtaacaaatgacatatatgtatataaaacggatatatcaggcccacattaacatcacgcggataaccatctatgctacgcgcccactgtttcgacgaaaccgctcctgcgtctattcgtaaaataccccgatacaccattacaattatgcgcaaatgccacactactttgtctcactttataaaaactttgctacccctatatgtcatttcgcattatcgttcgactatataacataggtcccgcatctggcttgcctgacatagaaaccatttctctcatttcttttttctcctctcttcccaatttcccatcatgcccccgatcccctcccgttcggggcccaagctcccgaaatcccccatccccaaaagtccaaaacccaagccaaaatcaagagacgccgcaaccaaatttagggtttagcctcctctccgcaggatgtccgatcccgcccccgccgcggccgtctccacagccacggccacggccgccgccggctccggcgccgcggcgtccggctccggcgccatcgtgcaccccggaggcggcggcgcgtggccgcgcggcgtccggttcggcgacatggtctggggcaaggtcaagtcccacccgtggtggcccggccacgttctacagcatcaccctcaccagcgacggggaggttcgccggggctaccgcgacggcctcgtcctcgtcgccttcttcggcgactcgagctacggctggttcgagccgcacgagctcctccccttcgaggagcacttccgggagaagttcgcccagccgggtggccgcaacttccccaccgccatcgacgaggccgccgacgagagtcgccccccgccccgccctcgcgttcctctgcccctgccaccgccccaacggcggctggcctcgcacgagctcgacgcggaggtacctccttgtcgacgtgcctggattcgacaccgacgccgagtaccaccccgagcaggttgccccggagcgggagaagatcgatccgcgggcgctgctggactacctgaagggtgccgccgtggagcagctggacgccgccgagctgatcggcaagcccaagcggcacatcccggcggtccagatgagctccatgcttgaggcctaccgcctatccagatacgcgctgaaggatcccacctacgcccaagctttcgggatggactacgacgaggcgcaagcggcgaaaacagcgttggagaagaaagctcgagaaggtatactcactcgcatgcccaatcctattaatccttttagctgcgctgtatgctactatgctattgtttctgctgctatgtactcaaacatgctcgttaagctaaccgtaataccattgctgagatatagattgaagtttgattcctttgttctgaatagaagtgtagatctggttcaattagttttctgtttcatatttttgttgatctgtctgttgcatgattgttgtttcattggggttgatgtggtttgtcacacgattattatagaattgattcaaaatgaagtaaaatttgacagatgcattgcagcaaccaatcttgagttgtcgtagattcatgggtattgccatgatctccaatttgatatcttattttttccaaacaattactaagggtacaatgagaacttatttccccactaccttgtaggaatatttttttataaaaaagattagggcctgttattattcgattgtgattttgttttgtcatgcttttattcatatatctcaattagagatttacgtgctacttagtacttgctgcagtttataggccaggcctcagttcctaacttgctatatgtttggaaatcgtgaggtcctctcttttcctaacatttatgcatcatttttctgttcattgcccatgcacttcagattgtatgcttgctgtttgttttttttttcatccctatagtttggcatttagacatgtgcaagcagtgcacaacacaacatttgttggttaagcgtaactaaagtcatgcatcataaaggactactataaatattggttaatgtacctgataaaacagagttatgagaagtgaatgtgattgggtttctcatctgcataacatgttttgttctggatgcactattccttgttcattgatgaagcaggctctgaggtaaggtggttgagttcacctttacattgtaaaggaaggcaccaagttaagatacgtatgcctacaacatttgttacccgtgcttgttggttattatatttattaaacatgtataaaatgtatgaacattactcacgtataagtttctttgctgttatttagattgcatcaacctgaaccgttcgtaagcggtaaatatgattagaatttctgttctttatgaaaaagggtaattctcaagatttgcgcataacataacaatcacaagaaaggaaatcatataattatgtgtcgtcaacctaaaaaatatataaacgaagcattctttgcagactccaagtttataagtctgagagatccatgcctggagtaaagcaaggtgcatctagcttgcactaggatcagaggttccaacaccatcaaatagtgagggtactgaaagggggatcaatcttttgcctctcctgtccatgttcttgaccaccactagtgtgtttaagttgctccttcggttagaagcccccctccattcttcccgtgatcacaaatccttcatattggaattgtctcttcatattaccttctgctgctgctgtcctgttccagtgatttacttcccttctcgtccttttcttaactcgactagttcctttcttaagatgatgccttcagctattgctgctgctgctgctgctgctgctgctgtccaattcctggaattaacttctcttctcgttcttttgttaacaaaacttgttcctagaatcaatgctagttcctttctgaaaatgatgcctccagcaactttgctttgccttcagagttcgtagcggttatcataggttccttttgcacagaacagaatgattagggaaacactagagccttcagttcagtttagtttagtttattactctttccatccgaaaatataagatgttaggactggatgggagacatcctattactatgaatttgaacatgatgtttagattcacagtgctatgatgtgctccatctgatcctagtaccttatattttgggacgggggagtactacactagagccttttagtttagtttatttttgaaaagctaatcacagtgcacaaaaaaactgaacctctccggttgccaccaagaaatagctccccgcggttttgcttgttctaggcgatgcttcttcctgcccggacaaattctcctctttcctaggaaaaagcaaagattccatgaattgaatatatagacaccccttaggttgaaattcatccgaaattcgaaacgaatccacataagattatttcagtaaatggacatgaataacattaaattacaaatttccacctgaattctccatcactctcttttggcgagatggtgataccgagtcacatggaagcttggaaagacgtggagagccaatgggggttggagaggcatcacagaatatgctcctcctccgttagatatttggtggccgatgagcgagacagacgccagcatttgtgccgtccaggagcaaagcactggtgaattttgtcctgccgtgtcagtcggactgtcaccctgtcttggcttaaataaaaaagctcttgaagcattaaacccccaaaatggatcaaccaatccttgcctctctactctttagcctttccaattttctgcgttagataatgatcaattgacaaagaagaaagttaaaggagctcattggctctctctggagctatttttcaactagacataataattcatggaagggaatgaagggatttcccttcaaaaagaagatctcactttgcatggcaaatgagaccaaaggcgaatctcttcctgccacaaacaaatcccaagaccaagaatataggtgacggtcacgtagtagtagcagcattggtagtggtcgtacgtcattacttgcaatttgcatgtgcgtccacgtatgtaggcacattttcttttttttaaaaaaaaaattctgatacattgtgttcgctcgagagagaaagagaagccactacatactcaattcgtttcaaaataagttaacctagcacattatgtgactatcctatttaaattttaaaataaattaacctaatacagtatg

SEQ ID NO: 31584 - DNA, 1527 bp, Oryza sativa
tttgggataaagggagtataatatttttcttttcgccatataaaaaaaatccctgtttctttggttggatattaacctggcccaaagaaagaatcccaggagaagcagagtcgccagcactcaccttttgcatccaccgacacggatggacggctaggatggatctaccgacggtctggattgcgcgctggaagagtcacccatctatcctcgccagtcgctgattctttttttaatttttggcattgctacactttctttctttctttctttctttttgcaaggtcttttttgtgtgtcatacacattgatttgtcaaggagatgagtaacaaataaatataaataaaaagaaaaaaaatcaggatgcatttccctttactactctccagctcgtgctttctcatcattcttcttttttcccccaagagtgaattgcacttgcacgtgttctgttacacagtatcagtgaaaggcttaatttttttttctttttgttgagacatgtggcagtcaaagccttcataaacgaacgaaatgtcatgatgtttttttaaatctctctaggcaagagacgtgtttggtgggaccggaaaacacaggaggaaccccaggatgatcagggcgagtcttcaaatacaactcctgcaggtattgtactgtacagtatatatacgactgtacatattcttctcatttttattatacttgtattattttgtattttacatttttcttccttccaaaaatccaatttctttcaaaacaaaaaaaaaccccgactattttaactcaatcacaatatcattagttaaattagtttattgttgttttatatatttcaaatacaacttctgcaggattgtaatgtacagtatatacgagtacatatattcttttcatttttattatactagtatagtactttgcattttcttccaaaaatcctatttctttcaaatccaaaaacactcgtctattttaatgttgatataatttccactagctcaatcacaatatttaaattagtttattgttgttttatatttcatatatataaaaatggaaaaccatttgcgttgacttggtcttgatgtgtggctacgatgcgtttgcaggtcgtccggcgaagggccgcaagaaggcggcggagaatcccggcggccgccgccggaagggcagcgcggccagcacggcggcgaggctcatggagaagatcatgcccagcgcggcggcgatgaagcccatggccaagaagaaggaccagtacctgctcaagcgccgcgacgacgcgcgcgccccgccgccgccgtacatgccggacgccttcccggcggcgcccatggcccccgctctcgacgacgtcccgccggggttcccttccgatcccccgacgccgccgctccccagcagcaccctcgccgccgacgaggagttcttgctgcacacgcgcactccaccgccgctgctgtccgcgccacccaccccgctcgcgcttcctcccgcccccgtcgggcaagtcggcgac

SEQ ID NO: 31585 - DNA, 2548 bp, Oryza sativa
cattctccgtgcagcagcagcagctccctccaccgccaccataccacctccgccacagcatcgacggaatgcaccaccagctccccggaccaccgctgccgccgtcgtaccagcatcgcgccgccggcggcgtcgtcttccccggacagcatcagcagcagccataccgccccaacagcgacacccagctcggcctccccggcgccggcgccgccgccggtgacgtcacgccggcgtggaagagaggatgcagagagttcgactctgaggagttgatgagggtgatgcggggaatcgccaagatggtggagccattgacggacaagaacggcaacttcccctaccacctcttcacctcagcttgagagagagtgagcagcgtctctcacagacatatgggccccactgtcagtggcagtagctgggctaccataacctcttcacctcggctcgagtgagagagagctgtctctctgacagacagatgggccccactgtcagtggcagtagctgggctggtagtactagtagttggactagtagcttggtgacttaattttgccaagaagaaaaaggattttaaaaacaaggtgtgtgtgcctgtcatgtgatgtactcttgttgtagcggtactgggattaagtttggtttggtatgggtgcatcgaccatactattattagtacctttatttctgggattgactcatggtcaagtgaagaaacagttgcagacttgcaatatgttatttctgactatgatgttgcagggataacataggaaaatcaaaatccacaaaccgtcaagtagctcttcacgaggcacgacttatctccattttaagctccccggctgcgttaaatagtcttgattctcgctctggattattaggttcagtaggtttagaattcaaaactgtaatagtagttctagatttttttaaaattatcggtgagaaactgagagtacgaaaaaaattctttagctcttccaaacaacaccttagctttgtattcttagttgttgctctttgtcaactagctattgggtcatgagattcccgtatataacgtgccatattggtgaggaactttatcatccttcatatatgactttcgccttttactctgttatagttcctagctacgcctctctctctctctctctctctctcacacacacacacacacattgagatggcctccttttttatttttcttttaagaagaatttgagatggcttcctagcgatgttctcttgtcaagaagcacatgcatgtctccctcgtcttatgagaaatggattaatgaaccagttattattctattatacctctaaagaacctctgtaaaatcctatattccacgatgccgggggtagagccaggattatatcaagaatatggcttaatcactagagtatgtacttcttgaacaagttttaataagaaaattagcaaattccttggtattttttccgtcaggtgtggggccctgcatgatgcccaaacattctggacatagagaggccagtttacacgatttagttttcttataacattacttcatttcaaagtataagttcacacgaataagatagtgttcctttctagtgaagataaaaataaagttagcaaacgtaaaataaaaacgccgaaggaagacctgaaggatggaacactgtcctccttagcaggggcggattcacaatgggggcgaaggggtcttgagaccccactaccgcccccgggacagtggagacccccctaagcccccactaattcttttttccatagatccataggatgtggggactggaggttcgatttatactgatgtagtttattcagtccccactattattttttttctagatccgctcctgctccttggctaaacaatgttaatttacatgccttgcgactgtcacatttgaaatgaagcacaaaccaaaccaggtaatttctattaacaaatcgatcaattctcattccaataatattggcacggctaacaatcccacatgacaaactcttacaacctctagtcctagttgaaaatacctacagcccgattaaaatttacaattactttatttcataatcatagaaaatatattaaaattaacatagttccacttaatccataaataattgaaaatttttaattcaattttactctattatattgcccattaattaattatagtaattaatttaagcagattttggcgccttgactggctcgaagcgtggctccttcgcatcgaacttttgcttggcgtacacatccatgtactccccgaacacgtactccgggtactcgccgccggcgccggcgccgcccttcaccgtcggcgagatggtcgcctcgaaggcccggttgtagaaggacgcgacggagcgcccgttgccgtcgcgcatggggaggacgcggtgccacgcgctgcgttagcggccgttgctgagcacctccacctggttgcccgtgtgacgacgatggcgtcggcgagcggctgcacgtcgaccccactcgccgccctgagcacc

SEQ ID NO: 31586 - DNA, 10552 bp, Oryza sativa
  unsure (1)..(10552): unsure at all n locations
nnnnnnnnnnnnnnnnnnnnnnnnnnnnnnnnnnnnnnnntagtggctgaccttggtgccgaagaacggcgcgtggcggccgtcgccggtgaaggcgcgcctcatgcgccccttgtcgaggccgaggttctcgtccatggcctccatcaccctctcggcgagcccccgcagcgccgcgcggtactcccgcatcgtctccttgaactccggcggtttcgacggccactggttgtcgtcgtggaggtagaagatgtcctcccagtccatgtcgtccaccggcgccgccgcctcgccgcgccgctccgccgccatgagcccctccagcgtcctcaccggctcgactccatgaacgccgcctcccggagtcggtagctctccgagcacaccttcttcacccgatcaagaagctccttcgggacgccatggttcaccagctgcagtgatcccaagagattattaaccatcttaatcaaacatgatcgatattgctgtcatgatcagctaatcaccaatcatcacatgatgatctggttaactcgataatgaaaatgaattacatttccggcttctgttataagtcaccagctaaccgttaacttgcattataatataatttttggtcgctgtaacaatttcagctccaactaaaatactccctccgtctcacaatataagggattttaagtttttactcatagtgtttgaccactcgtcttattaaaaaaattatgcaaatataaaaaaataaaaaattgtgcttaaagtactttggataataaagtaagtcaaaaaaaatagataataatttcaaaaaattttgaataagacgagtggtcaaacagtgcaagctaaactcaaaatccctcatattataggacggagggagtaggagtgaagctgggtgcgttggagatgaacaagagagttggagatgcgttttgactagtccacaacttcactccagactcaacacctggagctaaatttaggagttggatctctaccaaacagaccctaaaaatgcacgcagatctgattaattagctacctggaagaatccccactcctcgcagccattgtcgatctgcgccatcgtctcggccctctccgcggcggtgccgtcgagcttggagaagttgatcaccggaaccaccatggctgaaaccttgaagaagatggtggtttagaagttccttgtaaagaatatcaactttggtgttttcagtaattgagctgctaatgctgctgcttaattaagttgtgatggcttgagttaagctggagatggagatggagcatggatgaacgcatatttatagggtagaattgcactgatcaaggatggacataatagtttattttgcaataatgaacaaatagtttgcttctaagaaataaacaggataatttggtcaaagcacaggaaaatgttggagctgacctggcatctgccaggttatctgggatgaagcttctgggcagcgacagccgttggatgcttctggcaaattggtactatttgcatctccatgtaattatgcaccaattggagcaagctgatgatgatcatgtccttgtcatacgtgacctttgaactaaccctcattacactggcagaggattgccatgttgacaggacaaatccttgtaccatgatttcatattattgttcacatgaatgatgattcataattcatggagttgatttgatctcgtttatcatgatggtagaagtttagtttatcgaaaataataaaaagaactcgatccttgaaactagtagaatgatctttattaaattaagaaaaaaaaactatacaacacgacactaataggattctcataaaccacttaataccttctgccggcccggcgaaaaataaaccactgaacatagcctatcttgtttggtatcttgtttggtgggaggtacggatgtaaactcttagaaatagagtctgtcgtcaactcctattattttttactaaaaaatattcgcgtatggcggtatctgtaccaacaagcactcctcaattcttggaattctctcgtggaaaatatgtgagactatgacaaatttctatcaacacggtaaattttcctgaaaattggcatctgagatagtcggtgctactctctgaagattcacacaccaaagagtccaatgatcgatggcaccgtattccctgaggaaaaagagaagaaaatgaaaaagcttgctgcatcttgccaaagaacaaattgttctgagagtgttattgatgtttcctggatttttttttctctccaggaaagtgtgaggaaaatggctggaattcgtaggggccagaattgtgttcctctctctatctgtgtctgaaactctatctctgtttctgcttgtgaattcagagttgccatctcctttaatttttaatttggtcactagctcatccaattgctcagacttcacagtggacttcttgttcctttgctcttgtgttttttctgcaagtgcagcaaaattccataaatcccagtcactgcacctatcagcatgcaactgggggaccaaatgaattaaattgtccatgtgattgtcaagctgtcagatggaacctcggttccctcttccattttgtttccattgtggatatgtaaatgaatatttcagtaaatgtttgcagcaagaaattttgggactccctctcctcttctgaggtttctttcaaacaaaaaagaaattttgggaaaaaaaatttcttcaggtgtaagacgtataagtgcataacagagcaattcattccggaaccctactagttttggccttgttttagatatattgttgagcaggttattttcacgaattatcgatttaataatatgataaattattttttaaaaaagttaacaaatgacttaaaacatgtgatttaaacaatacagtagaaaaaagtatttttatggagaaacatgtttttaagcttagatcaaataatttgttttaataatccagtgaataagcttaaaagaacgtagagttagtggttgatttagggctaatttttttattggaaatatgactatcaaaaatagatggagagagagtggatttatgaaatcagtttacagctacgtatggaagaaagtttaggtcaattttttcgttaaagaaagtttagacccaattatattgcatattgtcagtgctatcaattctgtaattaattttcacgttgaaatcggaatctggccgtcgcatcacgtcagtgtaaaaaagataatagacggccaaatgagaccaagaaaaacatttggcaggcaaatgtcgccatcacctttacctgcataggagggtcatgtagaattaggcatggttaggtgaagtaattaattaattacataatgccttgttgagttaattattcagttagttgccattcgttccagatcaagaattcaaagattgaggatgatatatttaatttgcatgttgcaacatgtatatgtaagaaaagataagagtatatatcaccattgcatcagggggtttgcaatttgcatccaagataacaaaatatatttttcttgaggaacatttgaattcttctccttctcccatgccactggtgatgtatgcattcatgcatgtgcattttgaataagtcatttgtgataactaatatacctaatagcccatgaagtaatcatgcatgaatcaattagttggaaccgtatctatatgtccatgaaaataaacgcattatatgtacgatggaccacatggcacgtcgacgaagaacacatgatgaaaaagaaagacattccaatttgccagtcctagctatgttgcattagggatgatgtgaaagacaaaaacttttaatcaacacaatattgaattgaattgaaatctttctcgtgaactcgagaaatctccaaattaaacatcatatattatcagttccctcacattgttcttgagcaaaacatgcatgcatatgaaacggtcagcagccacacaattgtcaaacatggatgatcaaccgtgtgcatctatatattggaacttttttaaaagtttttcataaatatgttactagaactactatagcgcgcgtagctgcaaagttgattttctcactgctcgatcttcaaatatcactcattttttttacggtgatcgttgaaggttactacttactagtcaatgtacacgtgttgcgtgtgttttgtggtcgaagttgtatcctttcattctctttaaacattatttttcttcttatttttaaagaaaaagtagcaaccaagcgttaaaaaagacgacaacaaataagagtacataaatttgctaattcctgaaaattcatatttttggctctagtagatggggataacagtcctaaagggcgtttgcctacatctggttatttggtgatgaaaccaggatttcttaattttatttggtgcaagggctattaggccaaattttatttaaattccgataagtacaataactactattgaaatctcaaactatgggagatgcctacctacggcccctaccatgccctataggttatttttcatgaacattgggaaattataatatattcttttttaaaaaaaagtgcccccaatttcatttgagaacacaaaaagctgagtgaaaataatcagaaaacagttccaattttgtccgatgcagaacaacatatcatgagtcgatatcctctctctgcatcaacttgttcggagatatatcaatcatcctttatgacttgatttgctttcttcatgttgcatcgaccggtagactagactctttgagtccgtttatcaatctactctttagaagagaagtcatacaaatggacaacacaatgactacgttgtttgggttgatgagaaaaaaattaaagtcattgataatgacaagtaatcaatcaaacaatggtatatatgccaaatctaattaagcatggcacatatccaaccaaatacttggcaatctatccaagcatcctggggtgcgctacatcccagaaacttctaatttttgccacatgcagaaaattatttattatttacagcagccaaccagctgattaattggcctataaaaccctcattccctagctccatttgaagccatcaactgcaagcttacatcacactagctaattagctacttactcttcttcttgctagcttgctagcttctgcatttagacattgcaaaatctgaaaaaacttgagaaattaactaaacaaaatggttgttccggtgatcgacttctccaagctcgacggcaccgccgcagagagggctgagacgatggcgcagatcgacaatggctgcgaggagtggggattcttccaggtagctatacataatcagatcatgtgtcttcttagttgttgcagagatcgaaagttataaatcctcaattatatataagaatagttggtgcagtgatcgaaagttattctcgatgaatttaaacatatcaacatattgtgaccaaaattatccttacatttttaagaatagttaatcaaatgaacatgtgatgattggtgattagatgatcatgacagcatccatcatgttgattaatgattaagatggttaataatcacttgggatcattgcagctggtgaaccatggcgtcccgaaggagcttcttgatcgggtgaagaaggtgtgcttggagagctaccgactccgggaggcggcgttcatggagtcggagccggtgaggacgctggaggggctcatggcggcggagcggcgcggcgaggcggcggcgccggtggacgacatggactgggaggacatcttctacctccacgacgacaaccagtggccgtcgaacccgccggagttcaaggagacgatgcgcgagtaccgcgcggcgctgcgggggctcgccgagagggtgatggaggccatggacgagaacctcggcctcgacaaggggcgcatgaggcgcgccttcaccggcgacggccgccacgcgccgttcttcggcaccaaggtcagccactacccgccgtgcccgcgccccgacctcatcaccggcctccgcgcccacaccgacgccggcggcgtcatcctgctgttccaggacgaccgcgtcggcggcctccaggtgctcaggggcggcgagtgggtcgacgtgcagccgctcgccgacgccatcgtcgtcaacaccggcaaccaggtggaggtgctcagcaacggccgctaacgcagcgcgtggcaccgcgtcctccccatgcgcgacggcaaccggcgctccgtcgcgtccttctacaacccggccttcgaggcgaccatctcgccgacggtggagggcggcgccggcgccggcggcgagtacccggagtacgtgttcggggagtacatggatgtgtacgccaagcaaaagttcgatgcgaaggagccacgcttcgaggcagtcaaggcgccaaaatctgcttaaagttaaaaatagacttttatttgtgaattaattaattgattagttgcataaactatacataaccgcttttgctattcaagataaaaaaataggtgaccttacaaaatttaagtggttattattgtcatgagaatacaactattgttatgttacagtatatagtttggtattttagtgtgtcacggtttgtcagtaggaatatataataatgtaatagatcgtgttgttatatatacatgaataaactatatagatttttttaattaagttttgtcctatttattcgtacgacatgtagtttccgtatcattaatgatgcgatgccttgctggttggacaaaacaaaattgttatcccaattcctcagtaatattattaacgactctcatgcagggtacattttgacttttcttaatgattcttctaatttgtgacgtttaagatatcataccatatagtactactaacgattgttttacatacaggccatacattaaaaattaaaaagtactcctatgttgacctaatgagtaggatgttattaatggatgagccttcagtggcttgtgtaatttacagctgtgtcactgacacgtgaatcataatagagtgggactcatatttcagtgatgctagtacccatgatacgcactattctaataaaagctcctttcccattttttaattaatgctatgagagaaaatataaaccaaattagtcatacaatcgtaccctaggcgggtgtgccgacctatgcatcatatcccatattttcctccaaattcagatcctgatactgatagtgtcggataacatatcactcatactatatcatgttccatattattttatttgaattagattcaagaacgaataaactatttgtatctctagtatataaatattaaatataagaaggcaattaaagtaccaaaagagatatatcaaggaaaatcttttaaaatattacatgtgagctcgtaaaatagtgattaaccaatcgtttatcatcatatttgtaggtggatttataatagatgttcatatatgttttataacatacgggcggatacaagtcttcacatatcctaacccataattttttatggatttggattcgaaaagtatctgggattccattttctctctcatattcttcccgcgagtctcgggtcaggtgggtggtcgggtaatacccatcccattttcacccctagtaggaagtgaccaagcatagatcaggtgataaaatttaccaaaaaaattggcaaattttgtatgagaaccatatgggtctctcgaagtaattagtaattgcttttagaatgttgtgtgcttaattgctcaaagagtgtagctgatccttaaacttgtataattgtatcatctagatctttaaacttttagaatgccgcaattataggtccaaggacttgttaaattgtgttatttcgatctcaaactgcaatgacctcatagggatcctatatagtttgccacatagacgctgacatgctataatcaactatcctacctcgagtgacaagtgggtccactaagagttcttttttctttcttttcccgttttcttttggttccctctttttttttctctttcttttcttttcttttctcttcttctgctcatggtcatcgtggaagccatctaggggacaccaccagacgagggtggatggatagcggaggccggaggggacaccactatggtggcgaagcaagaagggtgggagaacagcggagcctggaggctaggatggacaaacgaattgtagaggcgctttcgtcaccgctgcctaggaagcaagagcaaacggtggggagcgacatggggacaagggttggtgggatggctatagcaaattctggagcaagctcttgctgtctagtgctagcgaaaagacggaaggagggacagcgccacccgttactatcaggtgccggaagaacaagtcacggctgctcgtgagattgtcttagtgggagggggatatgtgactatcagttggtgtagaattagtgataataccacattagcatccatgtggcatgccacgtgagcaccacatagatcttggaggggtcgtggcggtttgcgacacaaaagggcacaatttaataggttttgggacttagatctgtgttttgagagtttaaggacatatatgacacggccacgtaaagttttaaggactagctgtgcactttactattgttcaaaagaatatagtaatagtagtaggagtttagtacactcatcacaagtgcgttaggtcatatatggcatgacacaactccacgttccacgttggatttagagtttaaaagttaaattagagttatttccatgttggatttagagttatttcaatttgtatatttcatctaaaataaaaacaaaataatttatctaaatattacttatcaatataatcacagctacggttcaccgatttctgaagctgaacacccagctgtcagtcataagaaatcttgatctggagtaccacgggacggtttagtgtgcaaccgtagatccctagatgccaactttctggaccaccatcagtgcgcgtccaaatcagtgctccagcctccatgtggtagcgactctgccattggcgacaacaagggaacaggatgctattgcacagtgcacacaaatggattgaaagaaaaatggccacaaaggctctagctacctctatgatggaatggtctttttttttttttctctccttccttttgcgtttttttggatgattggtccatagtggagcaagatgccttagctggaggctatccatatccctggtatagcataaatgtcttctgtggcgtaggttatgccaacttacatagtagaaatttaggccctgtttaattctatgggtgaaaagttttggcgtgtcacatcggatattcagatatacatttaaagttttaaacgtagtctaataacaaaataaattacggattccatctgtaaactgtgagatgaattttttaagcctaattaattcatcattagcaaatatttactgtagcaccacattatcaaatcatgatgcaattaggcttaaaaggttcgtcttgcaatttacacgcaatctgtgtaattagatcttttgtctatatttaatacttcatgtatgtgtctaaacattcgatgtgacagggtgaaaagtttttgtgtgagaactaaacaaaaccttaatagaaaaaagggcatgtaactagactcaaggttgtctacgaaattgttttgagatattttgcgttttgaatgaattttggttacttgttggagggaattggtacacgaatcccctaagaaatgcatataaataattgtttgaaacaaatatggttttaaagcgtattttatcgtcctcggcataatttccctcaaggattggtaccaagtcatccaaaatagtgatggtttttggttaggtttggtatcaccgaaattttataactacacctaaaaatatttaagcaccgacttgtaagacaaaactatttttgaattttagaactaaaatttagggttaatttagaggtattcactcgctgttttcatcacttaatgttacattttaaaaccataaagaataaaacgtactacctccttgcacaaatatatgacgttggttagttcaattttgagctaaccaatgtcaaataaaaaaaatttggagggagtaagattcttacaacctaattattttcactgcatccatcacatgtctgcggtttataagctgcaaccaaaacaatcctttcaaacaagtgcttggttaaaaaaacaaaatggataaaaacaaaatcatatatatgccgtacccgttggtacacgtaccagtccaagacatgtgcaagagtacaaacaccaaataaaacacccattgttcgattcgaatttcgaaaagcccgcacgaatctctaggcacaattgacggacagatccaacaaaaaaataataatgacgacgttaattagtaattactcaaccattaccatgtgctaagctaggaggaccgggtaaaaacttaaaaaccg

SEQ ID NO: 31587 - DNA, 730 bp, Oryza sativa
tagtcccgtcctagtttttgttttcgcttcttctcgaacttctcgagtttatcttttcttttttttagaaaacaagagagaatcgtgtggagggagaaaaatatacagaggtgcgggaacactctggaccgtgcgatatgaagtgaacggataagattgatcccccaccatgcgaaaaacaaatgtaaaaagaaaaaaaaaatccccttcggcgccaagctgagctgacacctccaagtccaaccaactcgtctccgacccaacggcaacgttttttttttttaaaaaatagactttttatgctttaattttattaatagacattttcaaaaaatattttcgaaaactgaacttttgcgtggcagcattgtcctgccacgccaacaatggtgacatgataaaagttatttggccacgctagacgaacagacgtggctaaaagtttcagattttaaaatacttttggaaatggtatattaataaaattaaaatataaaaactctaaacaaaatttcacggcaatgggaatcattttgaaacaaatcaaactgaaaatccactcctcaatcttaaatttttccttagtataataggctaattaggtccaactacataggaacttcttcgagctaaagccaaacggtttggcttggtcccgtgggaacaatgtcgacttgcaccactcctcttccctagggccgctctggcgagcaaaggaagcggcaacgat

SEQ ID NO: 31588 - DNA, 1363 bp, Oryza sativa
aaaattgcagccaaccttatagccaatctattatatatgttggctttaaaataaaataatagtagaaagtggactctattattatccttcctctaatcacccatccattcgccatcattgcttcccaataccccatattggtctccattcattccattatctaagaaaaaatattattggtctccatccccgggtgggccccacacacaccccgtgccacgtcggcctcacacccctcaggttaaaccaaaaccaaaaccaaaaccacaggacggcaacccagccacagccactgacaggcggggccaacccggttcagggccccacccgtcatccacatgggtctcctcccttcctctgcctggtggggcccgtttgaccgtttgacaggtggcgcgattttcgttaattaattcccctccgtttctcacggcctcatggccagatggacacgaccaccagtccaccacctcctcctctacttcttcttctcacgtctctctctctgaatccagatttttttttgttggttccatcctctctcctgcttcagatcagggtggccatctcgcttgaatctgcaggtgcgtgcggaatttcgatttttgtttttacttttattttgtgcacatccttttcttgagaggagaggtggcggcatggtggcttcttgggtcggatttggatttggagtcggaattgaggaattcagtgagaatatgtagctcggatcatctttcatcctactggtcactggtttgttgatttgggttgtggaatgattaagccgggagtgatttgctgttgctttgcggtttctctgaatttgttgacggctacagtgttcaggcaatcatggagatcgatctgcttgcttgcaccgagcaaatgatccaatttttaacattgagaattgttcgtttccattctgccagggtgagctgaggaggatccactgaggtggcggcggtcgagatggggctggatttgggagctctcgttctcaaatccggcgggctgttggtgtcggactacgactcgatcgtcgcgatcaacatcttcgtggcgctgctgtgcagctgcattgtgatcgggcacctgctggaagggaaccggtgggtcaatgaatccatcaccgcgcttgtcatggtgagatgagagggctctctggccttgcaccccaggtgtttgtggttttgccttacaggggagtggttttgagttttgttctgtgggttggcgcttgcaggggctgatcactggaggtgtgattctgctcgtcagtggtgggaagaactcgcacattcttgtgttcagtgaggacctcttattcatttatttgcttccaccagatcatctttaa

SEQ ID NO: 31589 - DNA, 341 bp, Oryza sativa
cctttccttcccctccccctccccctccttcccgccccagttcccctctccgaatcactagggtttcgcttttgcccccacgaatcagtcgctgcacctgcgcgcgcgtggatcgggctcgcttgggtctcgtctctcgtcttgggacctgtggttggttcatcgcctgtgccgcgcgaggttgggcgggtggttgggtgattgtgcgatcgggctggctgggcgcgagatatttttttttttgtctttgttatctgtttcataatgtatcgagattgatttcgggtggagataatgctagtttgttacttgcaggggtgctttcttgtgtcttcatcacc

SEQ ID NO: 31590 - DNA, 647 bp, Oryza sativa
  unsure (1)..(647): unsure at all n locations
aannnnnnnnnnnnnnnnnnnnnnnnnnnnnnnnnnnnnnnnnnnnnnnnnnnnnnnnnccaaattaaaaattaaaggagagggcaactctgaattcacaagcagaaacagagatagagtttcagacacagatagagagaggaacacaattctggcccctacgaattccagccattttcttacactttcctggagagaaaaaaaaatccaggaaacatcaataacactctcagaacaatttgttctttggcaagatgcagcaagctttttcattttcttctctttttcctcagggaatacggtgccatcgatcattggactctttggtgtgtgaatcttcagagagtagcaccgactatctcagatgccaattttcaggaaaatttaccgtgttgatagaaatttgtcatagtctcacatattttccacgagagaattccaagaattgaggagtgcttgttggtacagataccgccatacgcgaatattttttagtaaaaaataataggagttgacgacagactctatttctaagagtttacatccgtaccttccaccaaacaagataccaaacaagataggctatgttcaatggtttatttttcgccgggccggcagaacgtattaagtggggtatgacaatccta

SEQ ID NO: 31591 - DNA, 574 bp, Oryza sativa
  unsure (1)..(574): unsure at all n locations
attcgagctcggtacccttttaaaagaaattctcacaaagggtgggcggcttacgttccgggcaaggtgcggccgggtactctgttcgcgcgccgccgccgtgccgaagagctcgtacccgccgccggcggcggcctcctccaggctcgccagcaccgccgccacgagcggcgatcccgccggcccggtcaccctcactcccatctctcttctctcccgtgtgagctgaaagccttcttgcagcagcagctctgcttccgtttaatttatcggcgagaaggcggaagcttcagtgaaacggcttggtgtggtgaatggtgatgtacactcctgctcacgaaagctagcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 31592 - DNA, 11610 bp, Oryza sativa
  unsure (1)..(11610): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaatttgagaccaagactgactgttccttggatataccgaagtattctcttcactgctgcccaatggactgtagtaggacaatgtagaaactaacacaccttattaacagagaaagaaatatctggccgtgtgagagtaagatattgaagtgcaccaacaatacttctataccttgttgaatcttctggacctaatttttctccctcgtgtatagacagtttttcagaggatgacaaaggtgtattaactggtttactattctgcattgctacccttttaagcaagtccatggcatacctttcttgtcatactagaagaccgtccttggttcgtttcacttccattccaaggaagtaatgtaaatcaccaagatcctttagggcgaagtctgcttcaagactctcgagaagtcctgttgtggctgcttgggaggagcttgcaacaattatatcatcaacatacaccaaaacaaacatggtatatgtccttgtgttagaataaaacaaggaagtatctgctttagagggaacaaatccaagttcttgaagcttgtgacttaaccgagagtaccatgctcacggtgcttgttttaaaccataaagaactttgtccaacttacatatataatgtggaaaagctttgttttcataacctggtggttgccgcatgtagacctcttcctccagaactccatgaaggaaagcattctgcacatccagttggcgtagactccatcctttagacactgcaatagatagaacaagacgaatggtggccgctttgaccaccggactaaaggtgtccttatagtcaattccatatctttgcttaaaaccctttgcaactaagcgagccttgtatctatctattgagccatctgcctttttctttatcttgtatacccacttacagtcaataatatttttaccactagtggagggagcaaggtgccaagtcttgttcttttgtaaagcatcaaattcattgtccatggcagctttccaattcgagttactcaaagcatcatgcagattagtgggttcagaagtagtgacaagatttaggtacctcactgtaccatcagtatagctcttaggtttgcgtatgccttgctgcagccgagtcacaggacgttgtggaggaggtggcgacggaatgaccggcgcaggagaagcagtgtcgactgagctcggtgaagatcccacgtcctcgtgcggcggcgtctccaaagcaccaccgtgcccccctggattggagacagagcgcgcggagtggagggaggcgtcgcagtggcgccaggtgtcgacggagtagtggacgcggaggcgtcctccgcgtcagaggagacagacgcagccggcgacgcagacacagccggcgatgcagatgcgtgtggaaaggtcattagaggctcctctggaggccatacaagaaggatccccttccacttctcgatcccggcccggaaaagtgaccgacccgaatgaaagaaagggtttatgagccctagccctgtaagcccacacctatgtagagtagatcgtttaacacctcgattaatggaacgtgtattcaggagggctctgcttcgctctattccacctcccgggtgtatggatttcctgaaagtttaattcatatatccgaaatggaacggagagagaactttccgttctgggttagtgaccacataactcctgtaccactcactagtttacaacattgaaataagcgattctttctgcaatgtgtctctcagcgtttttatttttctcccacgatccagaggcacagatgcaggcgaatcggcgccggagagcgcgcctgtgcccgtgctcccgccagcaggcagagcgcccataaaaggacgttccagtgaataatcttgctgtggattgtcgcctgaaaaatttggagagtctacatatgaaacattagtagcaggtgaatcatgcaccgattgatcagctagctgttccaaacaggaggatggatcgatctggtgcaggttctcagggaggagtaaaatctctgcctggaggcgagcgccggcgttaggatgaagttctttaaacggaaacacagtttcatcaaaagtgacgtcctgggaaatataaactcgacctgctgatacatctaaacacttaaaccccttgtgcatagtgctatacccaagaaaaacacaccgggtggatcggaattgaagcttgcgagtattgtaaggacgaagatgaggccagcaggcacaaccgaaggtgcgtagagaggagtaatccaggacttgttgaaagagtttggtgagaggtgggactccgtcattgacaggagtacgcaagcgattgatgagataagcggcagtgagaaacgcttcatcccaaaactttaggggcataccggcgtgagcaagaagggagagccctacttcaacaatatgtcggtgttttcgtttggcggcgccgttttgttgatgtgtatgggggcaagagacatagtgagtgatgccaatccgttgaaaaaacgtgttgaggcgttgatactcaccaccccaatcggtttgaagagcgaggatctttttatcaaaatgacgctcaacaaggttttgaaaatcatgaaagcattgaaaaacttcagatttactcttaagaagatagatccatgtaaacttgctaaaatcatcgacaaagctaacataataagaacgcctgccaactgaggttggagcgggaccccttacatctaaaaaaataagctctaaaggagcttgagaccgactaaaagacttaggatagagaagttgatgactcttcccttgctgacatgcatcacaaatgatgtctttattgaactcactaacaaaaggcaaatcatttttgctaagaacttgacggacgatagtggatgacggatgacctaagcgatcgtgccaccgggtcgaagagatcttgtggacaccaaaggcactcttgttggctgaaggagaggacagcttcaggggatagagacgtcctttacatctgctgcgatgcagaagcctcctcgtgtcccgatccttaatggaaaaatgatagggatgaagttcaacaaaggcatcaatatcaaatgctaatcgagatgcagaaactaaatttttggtggcttccgggacatagagaacatttttaagaacaaggttaccactaggaattggaacagtagcatgaccaatgtgtgagatttccatacctgctccgttcacggcgtgaacttgttcatttccggtgtatttgtcccgcaccgtcagcatgtcaagttcgccggtgacgtggtccgtggcgccggtatcaacataccaattggtatcgataccatacgaagtggtggcaacatttgcagctttttcctccccggtgaaggaggtgtcgaagcgtttgaagcacttgatcactgtgtgaccaagcttgccacagagttggcacttgggtcgttcttgattgccgccaaacccgccgcgaccaccttgagcagggccgcgtccaccaggattggcgttgccgcggccgcggccacgttgtccaccattgccgcgcccacgcatggcggcgttcgcctgtgccatcccttgacgaagctccaggcgttgctcgaagctgatcagttgagtgatcaactctgagacagagattggttccacgcgggctgcaaccgctgaaaccactgggtcgtaatcgaagtcatgcccggcgaggatgtaggatactagatcctcatcgtcgagcttttttccggcggcggtcatctcatccgctaggccgcgcatcttgttgacgtagttgatcacggaaagattgcctttctgcgttgtagcgagagccattcttgtgttgatggcccgcgccctggactgggacataaacatgccctcaattgcctcccacacgccagcggcagtgctgacagctacaacctgggagagaacttctcgtgagagtgaaagcagaaggtaacttagcacctgttgttcttgtgcaacccattcagcatgggcaggattgacgacggtgacgtccttctcgtccttcttcacgatcatagtcggagatggcttctccttggttccatcaaggaacccagccatctgggctccccgcagtgtcgcgaggacttgagctcgccacagcgagaagttgctgcgggacagcttctctgtcaccggctgcgagagcgccggagcagagggaacagcagatgaggatgacgccatgaggaaggagaggaagatggctctgataccatgtaaagtgagattaacgtggatgcctctcagcaccacggttccgtgttaatatagcagggaacagtccccaggcgtggcgattacatgtggttgttacagctttaccaagaagaaaggaaacagaaaacaaactacaagattacatctgttatctaatcctatcactaggatcatctctatctgaaacactatccaatccattcggttgtttaacaccccctggatctggccgactaccgaccgcatcctccgtgagttcgtggtgaagcaggcccagccactgccgttgttgcagccgcgcggtttccggcggcctgctcaggcgatagtgagggagggagggagagaggggtggggtggcggcgagggtgagggttgtcgcccgtgtcgccctctaagatgaccgttatatatatttgtgggcagagaaagtacatgaatatgtacaaggtatttactgacgacttgaaagacgtacgtacccatgcatttatttccttgtaaaaatcaaccagcacatcaccaagttgatgattcagggattcgacatagaatttcgccggtgcctcatgtcaaacagtcaaagtggagacgcatagaaatggtcttttgccgattgccacaaagacaaaaagatgataaggccggccgtgtgcccacccaacggctcagccggccacactatgcactcgctcggacagtcgatcgatcagcacagcaaacatcactttcgcctttgcgatctgacggtgagatcagagcgagcgagctagagtggattactgcacctgccggctgtggcatgcagtgccagtgctatagctcttcctgccctctgccctgacgtgttgcaatagatcgacagagaatattatttttgccacggacggtacggacaagacagtgagcactatttttgctctagtgtctgtcatttgttggaattggcgatcgcttatggcacagtaccgtggaccatgccccctcattcctgtctgtctatctcggaattaacatctcgtgaactacaatactccttccatccaaaagaaattatatactccctccgtttcacaatgtaagtcattctatcatttcctatattcatattaatgttaataaatctagatagatatgtatatggaaaataatagaatgacttacattgtgaaacagagaaagtaattacaataaaaaaaactaatatatgaaaggaaaatgttatagatagtcatagctaattaaatgatactccctccgtcccagaaaaagccaacctagataaggatgggatcatgtccaaattcgttatactatgaagtgtcccatccttgcgtaggttagtttcttttgagatggagtaggtggttaagagtgaaagagagcatagtaaagaagatgggactgaaccggccgttggactggaaaaaccaaaactagcacctttgatgactcactttgttcacaagaccaagccaatcggtcttatgagccagctaaactggacggttttcttgtaaagccatcgaaccagcacagattgaaccgatcggctcattcacataacaaatggactagtggtggagccagaaattattaaagcctagcgctcaagtatagctcaactaatgagttattgattttctcaaaaaaaaattgcttgttgatttaaggggattcaagcccaagtctaaggctcaagtccaagctactgtaggcttatctccgctcgtgaataggacttgggccattttaaggcccatgattgccgaatagatgtttgaagcccattgtttggaataaattaccaaaaaactttcaaaaatgaaatgcaaatataagagcatctccaacagcctctccaaatcggactctccaaacacctatagtcaacactccatctgatttggctagtcaaactagttactcgctccaacagcctctctatccatatgtcaattgcatcatcttcttcctcctctcccgttcttcctctttctcccgcgcgagtcgacggcgcggcacctcgcgcgagcctgttaattactcaactctaatctatttaactaccaagcctgttaatttgcactctacaggcgtgcattggcaatgacatccaaaataaaaaaattcaccgagatgaaattggtacgcagtaaaattccaataactggtaggactgcaaaattcagtagcatacacacccgaaggacgaagtcctcctgcttccagacggtcaggcagcggaaggcgagatgcgcgaccgcgacgccggcgctgctgcacgagtccgactgctgctgctggctcgccgtgaacacaaagcagaaccccaggaggcggcagagcaggaacagatgctgcatcgaagaagaagaagaagctgcccacattggcgtgccactgatccccgtgccctgactgctcttcttcttcttcttcttcttcttcttcttcttcttcttcttcttcttcttcttcttcttcttcttcttcttcttcttcttcttcttcttcctcctcctcctcctcctctcgtgcctttcttggacttggcactcgatttggcttagctcagagaaagcaccggccgtcgagctcctcgcgcgcggcagcgacggtggcggctataggatcgaatcacaagaactaagccaaccagagggggaggtgaatggttgatatacccaaaaacctaaacttttagtggaaataaaagttaccttcgaattcgatgtagatcggtctgaccgaggttgatccgccggtctgaccgagctcgtgccgccggtctgactggtgttgatccgtcggtccagccacctgaagattgcctgccgcgtgtgaagtcgccgccggtctgaccgcctctcctccgtcggtctgaccgccgcctgccgccggcctgactgccggtatgtcgctggttagaccgccgaacccgatgaaacacaaattaaagaactcttaaagtagatgacaactttattgcttctctctgtgtttacaaagtgcaccaacagcactccttacaaaaatctcgactaaactcgaaaccctaactaaactagcaactcaattgctctcaaaagcgataccgggaagcctcatgctccccctctatttatacatgaggtaggcagcctaaagccatgaaccaaactcatagtaagagtcctaaacaccttaggaaaccctatagtacaagacacaaactttacataaccaatcgtaccaaatttggactccttccaaattcgactccgtatcccatacgcacacaatacctccatcgtatgccatatggaatcttcaccaaccacgtgcatcaactctagccttagtatcccgcatgatatctgaccaccacggacatcttcttaccaagccgactcctggtctatcaacgcaaatactctcccgaggcatcgagtcacctacacatgaaacaaacaaagaaaccatattccaagaccaagctatccccaacttgacttattgttagcaaacaacagtattacatacgtatagtatccatctagaagccataaccatgaaacaatcacggatattcaaacaaacaacccgaaaccgaaaccgacacagcatcggccggtcagaccgcgggccgggccggtctgacagcacacatagcgccggtctgaccggcaacctccgcccggtcggactggacacataaaataacagtgaatccgatcatcacctgaaaattgattatctccaaaaccacttcgacgataatctccaaatatcaaaaccaataatcacatatgccaattgttcatcacagaataagaatcaaaacacactttgatcttacagcggcgaggagtcctcctcctccaccggggtcgtcgtgcagcttgccatggcgcttctcgaggaggagctgcgctacctcatggtccaccaaaccgtgcagctcgaccccacgggcatcttctccctgcgccgcctctcactcggctccatggacgacggctgtggcgccgggaggacgacaactgcggtgccgggaggacggcgacggcggcaccgggcggatggcgcggcgggcagggagggagcagcagatgggatggggaaagggagagagagagagagagaggagagagggtgtgggacccacaccgatggcgagccctcctggctggccaactttggctagtgtggtgaggaatttagccagccaaatagcttggccatccagttagcaagtctgttggagcacattttttacccaagttagccaaattttggcttggagagccatttggccattctgtggagatgctccaaaccatgcaagtgaagtgagattggtttgattcccccgcaaattttgcgcgatgtactagcgggctatggaggaaccggctatggatcttcctgttgggccgaggaactagctcaaagagcccatgtctgggttgtgaacttgtgatcgaccattcccagtacatcagcccatggagaaaccgatcgagcagcagagcctccatgcattcgcttaaaaaaaaacggtgtgaagacttctctttaaaaggaaaaaaaacgaaccctgtgaaagagagagagtgacaagcttggagacatgcatgtagcgagaaccagagataatacacgtgtgacaccagaagagaggagatggaggagaggatcagaagctgggaggatggaacgttccaagctgggtaaggacctagtacttggccactttactcgggctttgctgcgtgtgtgcgtgcactgatgcaaagctctagctagtgtagtgttccagaatagaaggaacatgtgtgcgtgtaccgtagtagtgtactatgcaaggctgcgactgctgctgtgctacttgcgatgctataataaggttatgttggggtacttggatacctctgtttcctaacgaggttacaacaattatttggtatttgcatctgaattaaggactctctagctagtctagtgtgctttattgccgggcacgcctaatgcccagcgatcacccgcccgtccccctactcccccttctctctcccctcttcttcctactcttcttctcttcttactacagtaaaaaaaataaaaaaatttatgtatagaaatactatatataaaaaatttgaattcaaatttaaatttgaatcgggtacgtaaacttttgatttataaactttgggtctataaactttaggtgtataaactttagatgtatagaaatactatatatagaaaatatttgaattcaaattcaaatttgaatcggatataattcaaattcaaatttgaatcgggtatgtaaacttttgacttataaactttggatctataaactttaggtgtataaactttagatgtatagaaatactatatatagaaaatatttgaattcaaattcaaatttgaatcggatataattcaaattcaaatttgaaacgggtatataaacttttgacttataaactttaggtctataaacaggtatataaactttaaatgtataaaaatactataaaaaatatttgaattcaaatttaaatttgaatcggatatataaacttttcatttataaactttgggtctataaactttaggtgtataaactttaggtgcataaatttactaaaataggaaagtaatgcggtgccaaaaaaggaaatgtggagggagggagggggagaggtggtgatcgctacccgatcgtggtagtgatcgatcgcgcattagactttccgtttattgccttctcttttacaataacgaggaagggtagactccaatttagggtctcaaatagaactcaaataataaccatagccatccaacctcattgttgatctagcatgtaaaatatcaaatacaatataaaacccaaagcaccgagcaatgagcaaaggatatctttgatggaatagcttactactcaactttcacttaagatgttccccgtcaaatcactcgaaggcggtgagccggtgaccaaatatgttatactagtggttacccatcgcattgcagtggaaaaatttagaaatacttaaaaaacattgaagaaaatagtttataatatgtaaaaggacaatattttaagcttgataataggtgatgtggaattgcgagtgtatattacacacaaattgttatgtaccaaacatgtgaagaattcaatggctataattaatttatctaggtgacatgtatggttttaatggattttgagatttacagtaataactatattaagtgggttgtaaatgaacatgagacatgaatggttgagatcaaagcatgagaaaaatccaaaggctaatattttcttgatgatgtgactttatacatgtcaaacttttgactttatacatgtcaaatatttagataatggaagaaacattacagcctttgcacctcacgttggcgcaatcacattactaaatgaaccaaaataaagcctcaagtcgatatttattaacttcaaatttcttaattattagatcctcaaaattgctaatatgctataaccgagactgcaaatggagtaagatcgatgggtacctattaattctatttttttgaaaaatattaaattaattaagcaatatactgaatataaattccaattataagtaaattggtacttgttgggggaaggccagaggagatcccctagctagctgtctccgctctaacagtaaggatcctccggagaggcctgaggcactccgtggagcccggtgtgaaggctgcgggtcgtaaggtatcacttttttgcagcatcaagggtgtgtttggttgcaagccacactttgccacagtttgccacgcctaaggttaggcaaatttgacaggtgtttggttgtagccacagtcgtggcaagattcccctccaacaaattgggtcccacgtgtcaatagctc

SEQ ID NO: 31593 - DNA, 2213 bp, Oryza sativa
cctggatagttagttggcccatcatcatgatggacctagtttaaacatctagtgcttgtaatagaccgccctcaagaggccccacctgtcagctagacaagctgcccgaatgtcttaaggtaataaggtcattggttagaagcaataatgtaaatttggtaagcctagagtaatcatcggcttcgaagtcctgagattagccgatgagagttatcaagtcgtcagttgtcggattcttgctatattcgattaaggaaattgatctactaaaggaatcttatccagaagagaccgagttcaaagagtatgcggcatagcaagttatctattaattaggaatagtttgttagtttccttttatctttaggaaagtgtgtttagtgtcctataaggattttatcttttcctttttatccttagtttatttcttgtccgacaaggactggtatctccctatgggtataaatatgttcacccggggtcattgtaatctatcaatctctcgatcaataaaaactactctcggtgcatcgccaccctttttaccgaggtttttacttatcatccgacggaacttggcacctaacgcggggctgcatcggctttcgatctccggcaaaggggtaagtcctacgttccgccggccctggtgaatctgttggctacattggtgttgttcaaggctgcatcgcttcgatctcttggatcgctctggtttggttgatatatttgcctacctgatatctcaattctatctctaattacattgtttttagtgacgcatcggtttagttggaactgtctcggttaggtccgatcttctgtcttaaccgatatatctctacaatcataatgttgttctaaatagatttgtcatatccatcacattagatagatctatcggctcatcgagtattagattatcatatacaatctcgtgctgcatcggttaggttcgacctaccatattgttattgataatatgaatcttgtaaagccgataggttcatgctagtgttttatcggggtgctagccgataagttatctggacgttgcatcggcttataaggattacatacaagttgggtttagccgatcgcaacaaaggtttcactatttaatctaatcttgtggatttcatgacatcagacctccagccgatgtacgctttagccgtcggatcagtgcttattctatcatgtcattgttagccgattggtttctactggattatattgctatattatattatcatcagtcgattgccttcatatcattatatacatttgacatatagccgataactcaaaaccctatcgctatcggctgatatcgatatcggctggaatcggcattggttggaactactccatcggcttctcagccgatcagcaatttgatctactgatatcttgtcagttgcagaataactgactggcacgccctcatctcatcaacttttagacctgcacaggagctaagcagacctcccaggccaattaatgtgtgtttttcgggtcaacagttataccgtataatggagttttctgctaccgagaagtctcttggttagctgcatcttacactactcctttcctccaccccaaatgtttctaacactttgtattgttgttggattttgttccaacaatacttattaattccaaaatttaaagtcactaattttaaattgcataattattacttctattagtgaaaaactatagtttagactccaaacattgtactaatcgatatatcttaattctgaattgtctagttattaatttcgaatttcaatattattaaattaacaaaataagtagtgaaacaaatgaaatgttagcatagattatatatataattttatgattactattttttattcttggatctattaataaaataaaattattttcttcttggttagaggtggatactggataacaagctagctagctcggctcgcgttaaggctcagtttaatttaagctcgatatcttaacgagccagtttcactcggctcgttggccttaataaactaaaagagtagccctcgttaggctcgttaacgagccatatcttattatttcacctttctaattttaaatatttcattttatcatatattacataacaataaacattaactaagaaagaattgttgctcagctcattttacgaaccagcgaaaagctaaaacaaagttgca

SEQ ID NO: 31594 - DNA, 3027 bp, Oryza sativa
ccccctgtaacagttgacaaaccggcctagttttggctttgagctttgctctcctgcagctgcatatatacacacatgttttgcctgccgagggacgaaactccatcaattctctttccttgtgccggctatatttgctcctactcctgcatattttgacatgttcagagaatggtatatatatatatatatatatatatatatatatatatatatatatatatatatatatatatatatatatatggactttttccttacatatatatatggttctagacttttagtggagtttgttttgaaaaaaatgattagtcgagagacagagttctagtatggatgcatcgtacacactcactatccggccgcggtccaagcctcaaaggcaaggccacaattttttcttcttcttttacaggatagtaactatactacatgtctcaaaacataagagaaaaccacaaggaaaaaaaaaagaaactcttcttaatttgcctccagtgcaagcttggcccggccatgcgtacatgtttgcttactcaacatgtctcagtacactcgtccgtgcagcctgcagctagctaatcaaactcacactagctacccaaagatctggcagagttagctagctttgattgggactgcagtgagaaaggatcgatttaggtaagttgacatgaaaacattacacatttacacggtgagaaaggatcgatgagatgttataactagttatatatgccataaaaattttaaaaccttttacaacaaaaaaaaaccattgtgatcaaattagaccatcagtataattcccggcccatgagttctattaaggctgtttattttttcagtcgttagaaagtgtatatatacctataagatgatatatatgatgtacaaattctcttaatatcaatttattgtaggttcctccaaaaaaattatgggaaaagatatacgtactatactgtttgtactaactttgtacaagttaatgctattgggtcatgttgcaattaattcttgactttttagaacttccagttgatttaatcaagcggttgagatttttcatcagtaaaaagtttgtaagaaatttttagtatatgtagagcgctatagacgcacacactctgcatctatatattgtcatgtatccctgtataatttcgttacacaattcttgtcatttggcacgcacctagcttagcttatccattcaacgtgtggctcacaagcgcctccagctctgatcttttttcttttcgtattcttgaactccaccaggaagaggggaccaaatatcagctcacagacagagaacaagttgcttccgacaagagattgtcctacaatatctgtatctatatgcaggtatactatcgggatcttttccttcaaatctcgtggtgcatcgctagctctctgtagccatccaagtgttgctgatgattcattgatctccaacccatactgcccatttataattttcattattattcattaatttcatcatgctggcgatcgtcatccatgagttgtttcaaccacaaataaataaaagatatacatgcattaaaaaaacgagcgactatatatatgaatagtcaatcttgtgtgtatttaattctgtagaaggtgactataattaattaatccaaatttcaaaatataaaaaggatagtttgtgccgacggttttgtttattccgacttgcatgagctcttgctgggaaatttatgcaaaattgtatagtaatgttctatgtggtctttgagattttcttatgaaatagcttttcaagtttacacatgctaaacatgtcatgatcaagctctatatttctagctatagtttagtttaaaaatactgagagatggtgaaccctcaatctcgtactagttagatctctgtaggcacacaatttagatctttgcattcataaggagtactagaaaaacaattctgtgcgtcacctgaaaggcacaagaaattgaacttttgcaaatttacgcagtaaaactacagtatagcagaaagtcagcagaaagatctggtagatgacagacacatattagaggtgcaagtacaaggattaattagaaaattatgcacctagcatatgcactatatgcagaaagatttggtagatgacatatgctataagctgaacaagaaattgacaccacctatatatatgcaaggagatgaagaaagagctcatcatgaagatccaaatctggaaattaatctttataataacgaattctatgcatatatattacagccacaacaatgaactacaacttttcccttggccaacaaaactgatcacttgcctagctagctagctatccccctatcttcatctctcatggcctctaacttgatgaacctgcagttgtcggcttctcgccccagctcctttttctttccccacatcttcttgagttgtgtaaattcaacttaacaatcccaactcgaacaacacaagaacatatgcatagtcgatcttgtagatgagcaagcagtatcgacgatgaagatcgatacatatatacatatatgtatatatataatcaagatccacacatgaatatggacatgtacatatatatacttttttgtcttcttggcttggctatcatcagctgtagtcaccgcctcgtcccggcgctgacgacggcggcgggttgtggtggtggtggtggccgcgggcgatgaggcgggcggggagcggcctgccggtgccggagccgccgcagctgcggcagggcatccggccggagccggcgcaggtgcggcagccggagtcgccgtcggaccagcggttgcagaggcagtcgacgcggccgctgccgccgcacgtggcgcaccgtggccgcgcgtcccacctcgacgccgccggcagctgccgcccgtcgcccccgccgcccatggtccggttcgccatggccacccccgccagcatccccagccccgccgacgctatcacgatcggcccaaccatcgtactagtgtccacga

SEQ ID NO: 31595 - DNA, 6486 bp, Oryza sativa
gggacttacccgatcagatatgagagaaaaatatttgctcctggttagtaacttcaccgggactaaaaattaaatctttagtccttaatctttagtcccggtttatagtaccaaccgtgactaatgatctaaatgatcttactccagatcaaaatttttataaccgggattaaaaataatttttagtcccggtttttactagatctgtgactattgtggaaatcagtcgaccgagtaaagatcatttctccagtagtggtcctaatgatcactcagctttcatcgagaaaataacgtgtaaaaaattgtcaagataacccaaaggcgtacaatagtgttgccgtggtcaaggtcgaccagcggcaaaactacctactatctctgccctaaaacgattttatttttatatatctcacatataccaacataaaactaaaaggctaaaaatttatttactttttcaaacttaaatgcatttatcccttacatttctaaactctactaatgtatttgtagcttcaatatatatattaactgtcttagaaaataaagttcttaaagtctttgtgagatgaaaggagtaggcactaataactgactctcagcctcacctgacagagaggccgagtggactggtaagctgcagaaaattgatttattaaataagtccacgtgcttgttttaatgacttggatcgatcgatcattttcctgggtcaaaatcaaaattctaataatatactttattcgatgctggccgagtttgactttgctcaattaattaattaatctctagacagctcttctcttcttcgacagttcgacccgttctgttctgtctgatactgacacaaataatttcttcttttttttgagaaaaaataatttcttctctctttctctttctctttctgttctaaaacaacagatttagaaaggagaggcatgatgaggacacaactagctcggatctaaccatgacgacattatgtattaatcaactaaaggtgcatatgttctataatagatttacttgttatatatttgaacaaacgttgctacacaatgagtttcgtgtgtttttgtttgcagaggtactttcttgggcgaaagaaaagagaccgagcgtaaggaatacatggatgattgaagaagttgattggggactaaaccaagaccttctccaagtcttcttttatctcaccacgccacttttggtccatagatgacaagagataaagttctacacgttttggattcagatttgggcctcctgacagcatcaacttcaaacagacctagccgctgatctagaaggaattttgtagccaccaggtaactaaaacaataacatgcaaaggagaagatactattatgttataaagaaaccccttattcctacttagccaaatagatcaacaaatagttgttgtatctatcaaaaacagattttctcatctctttggaaacacataaaaaccaattcttaaacatatgagtaacattacaaggaggttgtaaattagaaaccatatgaatgatatgtagaattatgtgatgatttaatcgtggtgatgaacaattatcacatgtaaatgtttatgaaaacacggtgatgtgtttttggacggtaaacaatgcggtggtcgtcactattgccggttagaccgggtggtgcatgtcggtcagaccggaggtgtctgggcagtctgaccaggttgcttgatggtcaggccgacaggctctaggtgggagtcggtttcgggttgttttcgtgggatttctagattgcttcatgtttataatttctaaatggtttctatttgcatgtgatattattgtgtactgatgtgagttaagttggtgcgaacttgtactcaaatatagagtttctttgttgttcatatgcaggtgttgcttgaggccatggaaatatagccagtgatagatcgggactaggcttgggggaatttgaagtccagatggtaaaggatatcacatgggatgctcaggttagagaacaatgcatgtcgatgtgaaagtttccatatggcatacacgtgggtgttgtctgcatatggaaagcagagttaaatttggattaaaatacatgtttggaaagattagagtttgtaaagtttgtttcttatatgggaaggtttcctaggggattaggacttcttgtatgagttggattcatggctaggggcagccacattatgggtataaatagataaggggttgaggctagaagatatcgactttttgggagagaaaagttagggtttgcttcgaggtttcaatcctagctcgtgagttgagaagggggtgctttagatgcactttgtaaacacattgatgcaataaagttgatttattttcaagagttttattggtacgtgtttttctagatcccgacagtttgaccagtgtactactggtggtctaaccggcgaaacggcggtggtctaaccgacagcaagcaagcgctcagaccggcgacggcgagcagcagaaggcgaggaagcggtggtccgaccggtcggacaataccgatcagaccgggggcgtagaggcggtcagaccgatgtgtacacggtggtcaaaccgactacgtcaagatctccatcaactacgagggttacttttattttcgctacaagtttttggttttttgtgttcctactattcaccccatggtagatttgtttggtcttgttcgatcctacatgatggaccacaccagacaagataaatgatattggaagaacaaatgttcgatgatttcatctctgtgacaaaagcagcatatcttactatcttttcattttaatttgatgtagagacttcatttgtgtcctaaggccctggatggatcaaggactaaattttagcccgtgtcacatcagatatttggacactaattagaagtactaaacatagactaatgacaaaactcattccataactctaggctgattcgcgagaccaacgttgattccttcgacgtgtcaattggacaaatacgcattggaaatgtttgatgcttcttggggcttctttggcgaccgtgaagtcactggatgaattgccgagtagatagatcagatccggaggagagtggaaattgctcaaacagtggagtgatgtggaaagagctaggtgtcggtcacaaaaaccttaataagaagtgaggagctgattgaatcataaaaagtgattgatcgcaatcttagggcaaagccaaaataatcatgagtggccacaatattataagtctcttcctcttgaccaaatctgagaatctattaagcctaattaatctatgattagcctatatgatgctacaataaacgtgcgctaattatggattaattacgtttaaaaattttgtctcgcgaattagctctcacttatacaattaattttattattagtctatatttaatacttctaattaatgtttaaacatccgatgtgacagggactaaattgatcaaacaccagcttagctaggttatcttgtaagaactacattccaatgatatcaaaggaaaattttgattttgaacggtctttttttttataccgttaccatcaaaggtaaggtaaattagagtacccgctcatcaaagtgtcaaattacatcggtgtccctcccatcctggcctctttgcaaacaagcatgtgctaagaaaaatacgaaccggcctcatttttagctatcaaaaaaagaaaaagagacctcatttttggctcaacctatgaaacgaccttatttttggctatttcagccgccgtctcccatgccatctctctggcttaacgggtaagctaactaggaacgaaattgacatggtcagggagactcatttcgcacatgctctaaatcctgtacgttgttgtcctgcatcgcgaggtcattttcgttgagttttaacttcagggagatgagcaattggggactgaaccgctgaatcagacctataaagttgaatcctttgtttgcggtttttatacgggcacatggacatttcctgcagctgtgaagtgactgatttgcttgcgatactttttggttgtcacatcgtagcatgttaatactactatattgtgtttaatctaacattatttattaatccctccatcgtagaatacctatagtttcagagttgaacacggttattaagaaagcatatataattaaatagtaagatattgtaattggttgagaagtgaaggtacgtggaaaaagtaaatggtgaagggttgtgattggttaggaaggaaatattggtggaaaaattgttatattttagaacaaattctaagtgctaaaagttattatattttgcgacggagggagtcaggatttctcttaccgtttttggcacggttacgcaaccccgtggtaagggttacgatggtaaccgcgcggttaccgtgagatatactgtggtttcaaaaactgaaaaatttaccgtgcatgtaacagtgataatcgtgcagtttcgtaaaccctgaagggagtatattttagcacggtctccctatcattatgttgctctggctgagagattgattgagtttggaacacgtgtacacttagcatcagattatgtagacaaaaattgttggcaagaaaattagacaaaaaattgcagctcagattttgcgaagggaaatgaaaacgaccacatcgaagaaattagtggatgattaagttttggaataagtatttacttgaataagcaaaagtttagattttataatagaaaaactgacaggatacgcaagatattttgccgagacacacaagtacacaactagctaagcttattgaggtttacggacagcactggcaaaagcctattacagcatgacatcacagttctggacgaatgccttctacttttctttttgaactattatcggtaattagcagagcgtccacattagttaacagtgaattttccagcctcataaaatctacattaactcaaggcaaaattgtacacaaaagctcaaaacagtacaggtaagtaacttaaaacccttcaacctctttggtatgaacagaagctatatccactgaaatgggtaactctgtcggagtaaacacaagcatcagtacccaggttggttttctaacccagtgttgagctttggtagaaaccaagttaatgatgacggtccagcttttacaaaacattaagacgagtttagggcatcaagctggcgctgaagctcctcaaggtcgtcatcaatagccccggatgtaactggagcaactggttcttggtaggaatctgcagttgggagttcgcggacaaggccttctgggaggctatctgtataatttcgaaaagtgggacgaaatggttaaatacaaccaaagagcggtaaataaagggacaacttttctaatagcaaaaatgaattaccagctccagtgcttagaatgcttggtgtcactgtgtcactgtcatcgacaacactggataagaacaaatattgaagttagcaattctacaaaagccacatttttattcatcaagcatgtcaagatgcagtacaacagaaaaagagaatgaagttacaattagcaccaaagtgcaaccctagcctagtagtttctgaatcctacaataatgagtagctaaaatttagcatgaaacattttcaaacacatgcaatcctgcaagcagggtgcttaagaaatgatgtgggcttgagcatggggtacaaagttctatccaagtcaactatcttgtcagctccattagtatggcaactgaatctgtaatgagcattagcataattgatcacagacatcctaattattaattctcagtaattgccaaatttagacataagttgttagttcctacttcctacacatttgcctgtcaaggaattcaataaagtacatgaggaatgacttacctaatattccaatcattatctagatggaccggacattcatctgctgctgatgcttcagcttccatcttagcttttgctgctgcatctctagcaggttttgactgcatatattctttctacaaaatgatcaaaagaagggtaacattcccgatctttcacaatgtcaacaatgtaaacatagggagggcacatgggagaagacaacacctgtctctgaacacatgctggatttgaacactgtggatttggtttcatttccattgttgggaaataatccttaagtgaattatatccctgcgcaatcagagggcattacaagattttagaaactaaccagtacagtgctcgaatgttgagttgaatatgatgaatcagaatcaacgtgagccacagtggagtccccttttcatatgaacagtatatcatgttgttccccagaaaaagtatctaatcttgtgcagttacataggaatagagaaaatagcaaaaatgctaacaaaattacaaaaaagtttttttctcagccaaaaaatttcaaaga

SEQ ID NO: 31596 - DNA, 1952 bp, Oryza sativa
tcctgcagcccgtagccatacttgttaacatgtaggcctaaaacaaaaatatacaactatacgagcatttaaggctgctaaacagctacacaaatgtaaccattctaattcaaccttccacatagctttaactacagttgtccttgtcagatgagaaaaggatgagaactaaacagaaggaaaaatagaagcgtaccattgtagttggtaaagaggcagcacaaacaccttcccgctttaatgtgcgctcatccactccggatgcaacaacctatgtgcagaggttcacaatcaagctaggaagcaatagagaaataaatatgcaaaaacaggaagtgtgcggagacaccggacaggtggacacctctcccaaactaaaccagctatgtagaatgcaaatgcaaaagccagtactaaatattttatccataatataaaatagtaaactgtataagtatgttcattaagacagtacaaaatctcaaatttataaaaaattaccaatggaggagcacatgcaaaacatgctgtttcaccaggaaccagcaactgtatatgaccagaaacagcatcttctgagacacctgatgcataaagttctcaagtcacatgcaatcgagattataatgactaatgcaagcaaagcgtcagcacaaaatgaagtccatggcaaaaccaaactgttcgttcttttttccttttttaccaagggctatacaggcacaaagaatgaaaccatgtttaacatgtattctgtacatattggttccccaagtgcatgtgcatttccatgtaatgttttattaaagggtacaaaaatcaacataaagagatcatctcatatttcactagcatggtcctcatacttccataacaataagatgtaatttattagcatcaataatatctgtgcttgaggaattgtaagcaggggactagtagtagtacattataaactcacaacaaaggatgatagtcaaagtatatttgtagatgtttttggtcaactgatgtaaggcaagtaatctaaagcaacttctcagggcaaggtagattatcaaatttcacatgcaatttgagatgtctaatgagaaagaacaaaggctgaagatataactgttggggttgctaataagtacagtacacaaatgattttattctcaagaggacaggatcattaactgagttttttctacttaccagactccatccatgtctggccaagttcattgcatgcctgaaaagaaggaataaatgaataaagaacaaatgatgcaccactgaataatgcagtatgcagttatacactggcatctatggttaaattagtcatgaacaaggagacaataatttggttgatggagctatatatcatggaaatgttcactagttcacacctggtttacaaccatacgagcttcatagttatcaacgcagctcaaaacaagatcaactccagtgttacgcccatcagagcttctggctttgagacttcctaaaaatgtttcaaatcctttcactgtagtaatatttaatgaatagctctgcaggaagaaaaacaagtataatgttggtttgcatatgggcagaaggaaaataaatatactacagcatattactctatccaaggttactatccaacagagaaacttataaatgaaattctgtactttatacaacattcatcaattgccatagatgaaacgatagaaaacaaggagacattcgcaaaggagtaagagcaagttcgtctaatgattaattaagataggattcaccaagtcattggcaagacccagatatgttttctcatgtattaatagtaaaacttaatgtgtaatttgaacctgatgatagaaccaattagctggagatgaaaaaggttaacagtagttttcacctccaacgtaacatcaggatttattccagatagtgtctgcacagcagcatct

SEQ ID NO: 31597 - DNA, 15381 bp, Oryza sativa
accctgcagagcatgaatacttatattaaggtctgttttcctgagttaaaactccatatgtacagactgcagaagctgacgctttcagccatcaattgtccactaagaagactgtatagttgcatactatttatgttttgtctgtctcataaaacttaaatactttccatgaacatgttggcattgttatgaacatgacttgtattcaccagagggcaatagcccaaatatatacacagatacagggaaaaccaaaagacaggaacatggaaagccaaaagacataaaaccataaatacaacctatctaatacacatctaacacccccccccccctcaaactcagggtggatcaacaacactgagtttggagagatagaacctgtgttgagctctagtttgtgcctttgtaaagaaatcagccaactgcaactcggaaggcacgtactgaagagcaaccacctgatcttgtacctgtgtgcgggtatacgaggcatccacaccaatatgcttagtaagctcatgttttataggatcacgagcaatactaatagcacttgtattgtctgacaataaagaagtcggtgaagtcacaaaaacaccaaaatcctcaagtaaccatcgtagccaagtaacctctgctgtcaaaagggccatagttcttaactcagcctctgcactagaacgagaaactgttgtttgtttcttagtcttccaagcaatgagggaaccaccaagaaaaacacaaaaagcaaaaagagatcgacgatcggaggaatcactggcccaagtagcatcagaataaccctgaagttgtaaagatgtggagcgtggaaagaaaagacaacacgagatagttccacgaagatatcggaggacacgaagatgactatagtgattttgtgtgggggcagaaacaaattggttcaaaatgtgcacagagtatgtaatatcaggacgagtgacaccaagataacaagactcccgacaatatgacgatagcgagtgggatcagctaacggttcaccatcagtggcagaaagatgaagattaagctccatgggagtttcaactgtgcgttgatcagtgagagaagccctatccagaagatcctgaatatacttggcttgagagatgaaatccctcaggagtaggggaaatctcaatgccaagaaaataacgaagaggaccaagatcagtcataagaaactgctcactgagacgtgctttaacaaaagtaataaactccgcatcttcacccgtgattagcatatcatccacatagagaagtagaattgtgcgactgtggggtgaagtgtgaacaaagagagcaggatcatgagcactagctgagaaaccagcttccaggacaacagaggaaaaccgttgaaaccaagcacgaggagcctgcttgaggccataaagagagcgtcgaagacgacaaaccataccctctggaactgaatagccttgaggtggccgcatgtaaacctcttcatgcaattccccattgagaaaagcattcttgacatcaagttgcgatatattccaatgatgagcagaagctattgcaagaagtgttcaaacagtagtcatgtgagccacaggagcaaaagtttcatcatagtcacgaccatgttcttgttggaaaccacgcgccacaaggcgagccttatagcgttcaagagttccatcaaagcgagtcttgaccttatagatccacttacaagtgatgggacaagcatgagaaggtaagggaacaagatcccaagtaccagtacgctcaagtgcagcaagctcctctgccatcgcatgttgccattcctgatggacaacagcatcacgataagaacgaggttcagcaagaactgtagcaacataaccatagcgatcctctgaacgaatcgtaactaaattacgatcacgaaaattgtatcgaggaggagcaaccggagaagcatccagagaaagctactggacacgaggtttacgactataaacctgggtaagaggaggcacataagaggatgcagaattctcataagaaggtgccagctgagaggaagagacaggagaaggaatgcaagcacgaacaggagtatcaggaaaagtgagaaatagaagagtcatcgggagatgatgtggagctaggacgcgaaaagaaaggacgagactcatcaaaagtaacatcccgagaaatccgcatccgccgtcctacaggatcccaacaacaataacccttatgttcagcactataccccagaaaaacgcactcaacagactgagccgtcaactttgtacgctcacgtggtgcaagaagcacatagcaagcacaaccgaaaagacgcagattagaataatcaggaggctgaccacaaagatgctcaataggaatcccaccctgtagagcagaagaagggtggatgttggtcaagtaattagcagtggaaacagcctcagcccaaaaatgaggaggaacagaagaagcaatcataagagcacgagcagtctcaagaagatgacgatgtttacgttccgctacaccattctgagcatgagcacccggacaagaaaactgagaaagagtaccctgctcggaaagaaaaacgcgcaactctatagaaaggtactcaccagcggaatcagcacgaaacacgcggatgggagaatcaaagtgagtgcgaattatgcgagcaaaagatttataaatagccaaaacttcggagcgatgagtcatgaagtaaatccaagtatgacgagaaaagtcatctataaatatgatataatagcgatgacctcctttggaaacaaaaggagctgggccccacacatcagaatgaacaagatcaaaaggacgcttagatacagactcactagaatgatagggaagttgtatttgctttccaagcttacaaccttgacattgatctaaagagacatcacctaacacagaccctaaaagaccacgacgaactaaagccgacagacgagaaccacaaagatgtcccaacctatgatgccactgagcaaaagacaccatagaggaagcagcggaagcaagaagactagcaggcgcagcgaaaggaagacgaagccagtcaaggtcccaaagacgctgagaatcacggcggcgagggccagtaccaaccaggagacccgtgtgacgatcctggacacaacaagagtcagaatcaagaattacacgacagccatgatccgtaagttggccggctgacatgagttgcatggccaatttgggaacgtaagaaacagcagggacactgaaggaagaagtagaaagagtcccgcgaccaacaacagcaagaggagtaccatcgacagtatgaacagtagtaggaactaaaggagaacatatagatgaaagactagatctatcatgagtcatatggaaggaagcaccagaatctagaatccatggaatagtacctggagcagaagatggtccctcagtagaagatgaagaaccaagaacagcagaaccaaactgtgcagaaggtagagccacagaaccaacagaacctgtcgcagcagaagcagtaaggcgacgaagtaacataagaatttcctgtgaatctgaacctccagcactcttctgagaagaaccactagtacccttcgaagaattgccacgacgtaaatccttcttcctgaagcaaaatgactccacatgtccatctttatcataataggtgaagtgaaggtgacccctaccagatggcacaactgtggcaggaggacgcgccgatgattaagaggaagaaactgtagaactaacagccggtgtggaagaagccaaagaagccacagtacgaatagctaacaccgaagaaggaagtggtagaatacccgcctctcgaagacgaatgtcctcagaacgaatctccgtaagagcttccatgatagtaacacgcggatgtcgagcaagtaactgtgcacgagtggactcatactcggatcggaggcgtgtgaaaaaatcgtagatccgacgaagatccatgtgagaacgctgacgctgacagcactgacaggtatgacaaatagccggtcccaaagaatcaagctgacgccaaatagaggataactgtgtatagaactcatccaccgtactatccccctgttgcaaggactgctcctgacgcaccatagcaaggtaaagagcatcactagtaggagcataacgatcacgtaggtgtgtccacatgagatgagctgaagtaagagtaaccacctcaccagtaagatgaatctccatactagctacaagaatagcagaagctcgagcatcctcatccaaccaagccttgtataaagcaaactgactctgataattttccatggcatcatcaaactgctctttagcctttgctctatcgtcatcagtagcttgacttgcaagtgaaggcatagttggagcaatagggcaaggaggaaaaggtagctcaccagataaaacatcccaaagacgctgaccacgcatatgaagacgcatgtgctgagcccaatgactatagttgacaccatcaaaaagaactgggcaacgaggaacagacacagtgccggataaagacgacatcatcaagaaggaagaagcgacggcgagagagcaaacagaacaagcggcagcaagttttttttttttaatgcctcagcccaaaatatagagccaccacgtgcgatcagagcacaacagtagcagagccagagaagcctttttcttttcttctttttttttcgtttttttatacctcccgatccagatccggatcggggaaacagacaccgagcgacccaggcgacggcgccctacaacccaggcggaggcgcccgcgaccagggtcgacgacgtccggaggcctacaacgaggggcgacggcggccggaggcccgtgacgagcggcgccagccggaggccagcgacgagcagcgacgggttccggaggcccgcgactagcagcgacgggttccgacggcggccggaggccacgacgaggggcgacggcggtcggcgacaagaagcgatgacagccggtgatgaggacaaccaccagccctctacactgttctgaagaaattgacgacgttggggagcagagatgaacgattctcagcgacaccatactagatcaagaggaacatcatggcttcaagatgaagaggccgataatcctcaaagaaaatcatggagaagtcgagagagaaaattataagaagacgagaagtctaaacctgctctgataccatgttatgaacacgacttgtattcaccagagggcaatagcccaaatatataaacagatacaaggaaaaccaaaagacaggaacatggaaagccaaaagacataaaaccataaatacaacctatctaatacacatctaacaggcatgtgacaaaatttgactttggtgcagaaatgacaattcaagaagccaaacaaaccatcatcggtcttgcccatttaatcaggtattagtgagagaaccgagaacctgacaacattgtctaaccataccatatgtttgtaagactgaaaggggtaattctggaagctctgaaaggggtaattctgaaagctcctactgccaagtgcaggtgagaataaatgtgacaactaatggtaaaactaatactaaaatgtttgtcaattaagtattatgacttacgaaataactcgattgaaccactctttcacggcaggtttagaggcctagtgtgtgtccttcagaaggtagggtcacatataagtctgtccaaaactaacactgagcatatgcaatcttccttcagaaggtaggttaagctaatatggctgtcccaaagcaatattgagcaggagctgtgcttacaacgatggcgatggagtaatcacggatgcgctcgtagttgtccacgatccccatacgctgcagcgccatgagcctgctgtagggattgctgtccaccacctccgagctcatatcctgcatcgcatcagttgacacatagactgtaagcttttcacacccaatttccaattcggccattccccccccccccaaccaaggggaggagggaaccaaaaccctagtatttgcgccagatcttcgtaccttgatcttggaccgtgcagcggcggccggggtcaccattcccgccacgcgctctcgcatctaagcaaacaaccacagatccgatccacaggtcaaaaccaccaccagatccacacaggtcagaagaagccaatcgcggcgcgaagtgggcgggcttacccgatcgatggcggcggggtcggggcgctgcttgagcgcgttcaggtcgcggagcagcgcgcgcagctgctcctcgtccatgatggcttggcccggcggcgcgggctcctcctcctcctcctcctcgcgtcaccgccgccggagacggagagagccgcgcttttcctcttgtcactatcgaatcgagtatcgagagaggctgatcgagttgagacttgggattttgagagtccggcggagccgacacggcggcgacgcctgacgtggcggacaaagtggagccttgacgtccccgaatgacgtggcggctgtacacgtcggagcgggtggccacgtcagaataggattagagcaagtttaatagtgtagcccactactagctccaattcatctatagacaatttaatagctcgttcatacaatagttacatactacactattaataactggtcccacctgtcatacacacactacgtcttagagttcgtgctacagctggctataaatctgtaggcccatactcttctctctccttatttatcttcttaaaatatatttacatctgacttatagcctactattgtacctgctcttagagtaagtatagtactagcagattatataaattaggtagaagtatataagcaatactcactccgtgaaaaaaaaatcaaatcctggctatactcgtccaagttcatagcgcaggatttgagttttctttttcttttttcggggtgcttgagctggcgccagcttaggggagtaataacaggattgtgggtgaggatgggccaaaaacagagcagagcaagagcaaggatggggattttaattagttttttattttatttaattgattgaatgaaatttgttttactaaaattattttttgagctctaaaagttcacggaaaatttcagaaaatgctttagggcatggagaatattagaaaaatatttccagccatgatttttaaaggaaattttattacccacgttaattcacttgtttaactcatttaaaatttaatataaattttagaattacattatttaatgatttttaatctccgaaggaaaatcaggacgtgacacttactagtaacacgtgttggacaaaaggaaaacatagataggcactatatgcattttggttttgctcctttataagagaatatattatatgccattgagtttactctaatgctttattggatgcagcataaaaattgagcttttcagtgccatggaaatcggagcaagcaattaacacatgatcaattaattattataaacttgaaaaatgggttcgtttgaatttttaaagaaacttttatacaaaatttttttgaaaaaatacaccgtttagcagtttgggaagcgtgctaacggaaaacgaagaaattgaagtttagatttggagtttaaaacggggcctaattcaacgatttgctatggactttatctccctctataatatgccactatcgagggggcgattcttcggacaacggggagtggagacccctccccgaggttgaagattcaaccaggggttagtggtgaaatacgatggaaaaggctaaacaaagagaaggtttgtggggcccgacttccccgctgagcaagagaaaaaagagtttatacaggtccagaccacccggagatgtaataccctattcctgtgttggttttgttgtttttctcatatcagctaagaacaagagacgcctttccagtctacaaagaagaaggtctgatccaaaaaatccaaccctcaatccgtagcttgtcccattccttttatagaccaaggagtggctcgcaatgttacaaatccactttcttgtgttgtcttatcaaccgtctttgtcgatgttggctggtctcctttcatagtctttgagtaacccactaagatttgaaacctatattgccccgggcacccgggcttctgttcgagacagttgggtcacgctagctaaccctccatgtggggagtggtgggcttggtgagaccgagcctgcttaaaacagtgccacggttccgtttccgcccgtttggctacttcaggtagcgcacggcatgtgcgacacacgtccaggatgccaccgatcctaatgagtcagcgttggcgtcttgtccacgtcttttcggctccggactggacgcgtgttgacggccgttagtgatcagtttcaaccgtcaatattaccaaaatagagaagaactagttatacttgcaatgcatatttaagttagaataataatattccactagtattaggtttactaaccttttgctgaaaataaccataaagtggaggagaatcgacatcaaatcagatgatcaattaatcggacgatgtcgaggatcagacttatacatgaatgggccaagaactcagaattgacacgatgaactgggccaaaattcacaagtctacggagaggagcaacaaagggagccacctgccgaagttaggccaggatggcctagcccatggttcgaccgaacccccctcgcagccgtttgatccagggctttgcctggacggcttggattagctcccaatgacggttggagggtatttccaaccattccaactgtcacaactgtcattgggaggctatataaggagctcactctttccatttcaacacacacttcaaacaagagctctctcatattctctcaagaccattccaactgtcacaaaccgtcattgggaggctatataaggagctcactctctccatttcaacacacacttcaagcaagagctctctcatattctctcaagtttagtttagtagtctcaagctagtggagtaggaatagaatagaaatcagagtccgaaagccttcggaagagttcgggtatggctctagtagctatcctcttctcttttgtaagctttgtactttatttagaatactattctttatgcatttctagtattgaaatactttccgagtatatgaatgacaactttactatatgttcatgttatactgattatactgctagcttatctgggagatgcataggtacgagtataatgtttgctattgcaattactctatgtcatgacgatgatattagagtagtatctggtagtttaggtatggtgtctagattattgggtatcattatttggggttatatgctgcggatgaaaggtgggccgctgatggtgacagctcggtacgagtattcctccacgcgtgtatatagtcctaagttaatttcctgggggatactcctccgtatttagccccggttgtattgtcatgacgggctatggtaaggaactcggcagccagaggtggcttctcgaagtactaggagggcatcggaaagagggtattagctagttaatcttataactagaatgtatgtatactatgtatactagaagtataggaatatattcttttatatttttttccacttagcttagataatttagtatgagaatgagtagttctatgcttgtgtgtcactctaccctatagattatattaacccctgcttagacatgattattacaagtaacatataaactattagtacaattctctctactatgatcttcccacgggattaaataaatatagtacccttggaatactctcggggtgaaatgctacaatggtatatccgtgcgcttgcggatgaactctgtaaccataatataccaggagtatttctgcgccattgctgtgaattatatttctagtaatgtcgttaagaaataccaacaacgcgtaaacctgtttcatttatggctgaggggactgcttcacagcatcccgctgagcacacccctcacccaagctggtcctgaggtcacacccctgcgcattttatggcaattgttcttagacgagcttcttgaagatgtctttgataaagcgatattttatatatctagtatgtttcgacgctcttctttgcaaaagaatgtaaaattataaggactaagatgagcctggatcccaagtcgtggtcggggctaaggcagactttattttatatcttctaatcatccgcacggtgcggagtgggttccggcggcgaaatccgacgggggaggggtggacgaggtggcccgctcgacggcgaacgcgacggcgtcgacggcgcggcttggcgcggcagctagtggcggccagagcaacggcggaggcggcggagaggtgggcgacgacactagggcttaagagagcacgggagcgggtgattgcaaaacgaaaatgagagaggaggaaacgggggtgctttatataggctcacaagggtcgatcgtggccgggatggccgcgatttcgccggcggagtggggagaggtggggaggagagagaggcgggattcgaaattcgaatcccggccgtctcgagcgtgggcgcgggcgggagagagagggagtgggcgcggggaacgcgggggaaggcggcgacgtgggcgatgtggcccgggaggtgagagagcgagtggggcggcggttgcgggatgcggcggcgccagctggaggttggggatgggcccgacaggtggcccccacctgtcggcgaccccgggagagagaggagggggcgcgggcttagctgggcttagcgggcattcggccggcccagcaagggcgcgggagagagatggaaatgggccggcggcccattaggggaaaaaggagggaaaaaggaaaaagaaaaagggaaaagaatttccatggatttaaatatttgcttgtgctcctttttaattggttaaaattatttctagagctctgaaaattccactaaaaatcttgttagcatatttcgacatgtagaactcaagaaaaattccacatgccaattccaattattatttacattaattaattagggtttcactcttgcttttacaccggtattttcttgagaccatttataaatttaatttagtcttgggagaagaacttcagggtgtgacacaatctaaccgcctttaccccactggtctgaccggtccgatgccgtcggtctgaccgtggaacccgagcaaacacaaatcgaagatctctcaaagtaaattgcaactttattacttctcactgtgtatacaaagtgcaacaacagcactcctcacgaaaatctcgactaaactcgaaaccctaactattctctcaactcaactctctctaaaaacgatacagggaggccacaccctccctctctatttatacctgaggtaggcagtctaaagccacgaaccaaacttgtataagaagtcctaatccccctaggaaattaaccttcccgtacaagaaacaaactttacaaactccaattctaccaaatttgggctctctctaaattcgactccacatcccatacacacacaatatctccatcgtatgccatatggaatcttcaccaaccatgtgcatttgatctttagcctaagcatccgcatgatatcctgatcgtccggacgtcatcttctcccaagttgactcccgatccatcaccggcaacaatctctcgaggcatcaaaatcatctatacatgcatcaaccaagaaaccatatccaagtacaagttcttaccaacttgactcattgttagcacatagcagtattacatacgcatagtatctatcttgaagtcataaacatgaattatccacggatatccaacaaaccaacccgaaaccgaaaccgacacagaatcagccggtcagaccataggctagccggtctgactgctcgatacacgctggtctgaccggtagcttttgccctgtcagaccggaccaaacattcagcagtagtctatgttcacctgcaaatccaattatctccaaaaccactttgccgatctgaccgctcgatacacgccggtttgaccggcagctcttgtccggtcagacccgaccaaacattcagcagcagtccctgatcacctgcaaatccaattatcttcaaaaccactttgctgataatctttaaatatcaaaactaatcatcttatatgccaattgttcatcgtagaataagaatcaaagtcactttaattttacatttgcaaccctcgtcattggagcgttggatagggcagggagtctgcgagagagcagcatcgatgattggtgcgccactgtgctgggcgagcccctgcaggtacgggatcatgtgcaggcaggggaggagacacaggcaacagcgtcaagcaacaaacccctctcgttaattctgttgcacttcacttcccgctaatccctatgcagtaattaaaccaaacacacacacccagtggcagcggcaagctgaagtccgattaattaattaattaactatttaagcaaagcatcggttttgaggattagttgagtagggaagacacatacatgcacaaggatatgagatgatccagaggaacaagctaagctatagtactagctaactactctcttggaatgtggcgtgtgcacatacttgcttatcccgagcagcatacgtgcgtgggatcagagtagttaattaacaagggaatttcggctaattccctggctgctctctgatcagggttagttatgatattgatcccaagagaatgaattcagtacatggaacacattttaaaaacagatattctgatcccactttgctgaatttgcttgccttcactggcactctgtctgtcagacttcatgctagtgctactacaaccgtttgtttggtgagagcaggtattagccagctataaacatattttaatgggatagacgatgagaaagaagagcagcgggctacagatttgtagctagctatagcacggactccaagacgcaatgtgtatatgacaggtgggaccatatattaatagtatagtaagctactattatatgaattagctattagatcggctatagatgaattggagctagtagtgggctatactattgaacttgctatgatatctttgcactgaatcactgaatgcggaggtggtgtctctttgccctcaaattcatgaaacatttttttatcgaacaccagtagctgtggagtgtattggtaatttgttttcagcattgggaaaagcagcttaggaatgtactttgatttttttttgttccttaacgaagaaattataatattttggatgaaaacaaatcataaatgaacaggtacaactaggatatatatgtagcttcaacaaatgggtcatgatttggacatgtaataattaatcgtgtatatactacaatttagactattagtttttatatatataaacaagcaccgtgcccattttctcttgtttaagttacattacatgacagtaaatagatatattccttgcaaaataatacaacaaatacattacataattctccttcagtttcatattataagtcattgacttttttctaagtcattttttttatgtttcactagaaaaatatagtaaagtttttaataccaaacaaattacaacatatttgggttagatttgatggaactaatttggtgttacaaaagtcactattttttctataaactcggttaaacttataacttaggaaaaagttataatataaagtggagggagtagattacaaacatcaaaagcacacatcagcttcgatgttcaatgagcttaaatccgttgcaactcagtaaaggaaatttgcacatgcaaaaacatctccatggtccatgcatgtgcattgctcataccggtgaatatatattcgccttccagtaccgtctgatagcgtgaaatgagacgacgaccgtcgtcaagaacaaaccctattttttattctagtaccaatcaatcaactgatcacgagagttacctaccttagcaaccaagccaagtgaaagtagttagttattaattaaacacaatgggcacagcgcgagaggccaagatatagcctaattgctttctgccttctatcgatcgcttcgaatgatgttctttcgtgaacgttcaaatccaatgctagaggcacacactttttccaaccattttttttaaaaaaaacaaatgtcaagtcgtaacattggacacgaatgaagagtttaattgaagggtaaaattttcactatgttactgttttaaaataactgggagattttatatgaaaaattttgaaatagtgatgtaaaactatcgaagctgcagcagttgtgccgctagaactaatagcatcaccaaaagtactccaacagatcccctactcccttgcatgatttttggaatttcctttctcgaaatattcgcttgttgatatgcgggagaaagcggtgccctcgcttattcattcccaatctcgctgctcccaccttcctcatctccttcacacgtgtgggagatcggcacggctttcatgggagcgccaggaggtagtgcgcactgacggaggaaaacaaaaattttgttagtttaatagaaggtccacttttttgtttttttataaaatttaggttttctcttggagagatgagttattgtgtttcctattttcagtttaggaaaacaaaaatattttttttgagggggattatacgtaatctcttagtgatgctctaaagcctaataacaagcacagtgaaaatagtgatatatatgcagacagttgctaaattcaattccctctttaataaaaaaaacatgacactatttttaagggaatatataacgctgttaatttatgaacatgatatttcattttccatcttattatacaaattagtacaaatatataaaaagcttaaattaccattaccgataaaataatttgtaacaaaataaattatagtcccttcagtttttaataattaactgttgttttagatttatgtttgaccatccatttattgaaaaatatttaattatcatttatttttgttataacttgatttatcattagaggtattttaaatatggtttacattttttttacatatttgtattaatttttaataagatgatcggttaaatgtattttcaaaagttaatggttttatatgaaaccggagagaggacttacatatatagtctttttagtaacacgaattggtaaagtgatatgtccaaagttcaatag

SEQ ID NO: 31598 - DNA, 3273 bp, Oryza sativa
atatccgatgtgacacgccaaaactttatacccttggatttaaacaccccttgaagcacttcgagacatcgctccagtaagagttggatcaagattaagtttttcatggcacgcttttcaaactgctaaacggtgagtttcgtgtgaaaactttctatataaaagttgttctaaaatatcatattaatctatttttcaagtttgtaataattaaaactaatcaatcatacgttaataccacctcgttttgcgtaaaaaacttaatctttatcttcaggagaaaagaacaccaatgatgattgtaaaattttagcaagatataagtacaataagctgcaccaatacaatataatgtacgtcgatgcatatacactactgcaaatagaacttgaggaagcttccgtccttcatttatgaagaaatagtcttttgggttgtttcagatatggatcagcatggaggacaactaagctaagtttgtaaactgcttaagcgggaaggtagcattcaagataaacaaaacgaaacatcctcgcaaaatatgaaaaaggataaacgaaatgagcatgtgcaagattatctagtgtacgttaccgattgacctggtagctgttctctcgtccatagctttctcgagctgggtcatatgtcagttatgtctaatccagttggatcagttttatagtagttaccattaaccgtggtttagccaggtccaaataaatccaatatttatcgggcaaaactccctgtccctgcaattgtaactgccaactcactttcacctcacgttttctcttggttttgttttagcccacgcgtagatggatgagccctctcctcttctggttatcatgtgaggttaatttttttttctccctgtgataaaatgatagtgtatagattttcaaagaagcatgagaaatgttgaataaatgtatgcttataaaacccatgaattttcagcatacacatttcaatgcacttctttttgcttaattagaattaatttacaaatataatagatttattttttatcgtgatttttactgaaaatggcgttaaaggccatgactaattttagtaggtgtaataagtaagatcacaaaatttttggacaattacttagacaaagtaaaacaaattaactaatagtacccattttaggttaattacaaatgactacacactaaaaattgacatgatttaatttcctatcgattaaagggaagacgcacacggacaccacgcgtgagaaatgataccgggattgatcgtaagttgatgacaaggtttctgactctgaaattaccttcactatgcatgatcctaacaaattatgggtactttcaaaattcttagcattaaatttaaataaatgtagcttaagaaacaaattaaacatcatatataatgtgtaaagctaaacacatatgaggtagagggttcatggaatttaatgcaaggaaaccgtctaggttaaaagaagaagttcattggtatgcattaattagcttactatctaagactaggcttttggacccaaagaagaagtataaaaatcttatccctaaatttatttccctttactttggtcacgtgtcttctgtttataaactgtaaagatgatttccaagtgaacctataaaaaaattaatatatctttagcaacaaattaaccacctcatataatatgtgaaaagccaaacacactatgaggaagaaggtttctggaattcagtgtcaaggaaactgcctaggatagaaaaaagaggtcatttgtagtatgttttaattagcttaaaggatatattgatctctaatacttccatctttggtgaatgaaaacatatagcgaggaaaaatttggtttattcctagaagtttagatgatacaaccgtcaatatttacagacagtataaaaattcactaatttcacctttcatagaaatacagctagcacctgcaaaattcattaactcagatatgcattgtgcaatcttaaggatacaaatgaagggcacctaaaattgcactgcacccaaaataagcacatatatcctatacatttaagcgatatatgatacgctgcatcaccttccgtccaattaactgcgaccaaatctgggtttatttttacttgccaaattcgaaaacattaaattggaaaaatgtgtgcacggttggttacagcccaagattagaggtgaaaatagatcaccagaatagctggcataatgaattagctccaaataaagctggcttggaagcacgtagtataagaaaggcagcaggtaaagaaggaaggaaactgaaacgggaaaagagatcaggtccttttttgcgaaattgcggatacacccttcccgaagagccccagaacggccggtcaacggcaccgttgaccgtatgagggggggggggcagtttcgtaaattccacgaaacactgtcccactcctcgtcttcttcggattgcctatatataaggccacacctcgtcttctccattctccgtctccaagttttttttttctctctctctttggcgccgttagcttgaggcggcgaggagctcgaccacttggaggacatggtggcgaagcgcggcgccggcgcttgtgccctctcctgggatgagaagggcgaggtgtcccccggcgagaaaaggaagagggcggatggggatggctcgtcggacgttggcggcggcggcggcataggggcgttcgacgcgctgcacgacgagctggtcgtgtccatcctcgccgacgtggccgcctccgccggctcgccggctgacctcgccgccgccatgctcacgtaagcgcccggcccccgccgttgggtgttccgtgttcggtttggatccgcgcgccgtctcgtgtcgtgtccgagtttccgttttggttcccgcgtgtgttgcgaggaatcgggccggttattgattgggattgagattttctgatcggagtttgttcggggattacaggtgcaggagattcagggagctggggaagcacgggctggtgctcgcccgggcctcgccgtcggccgtcgccgtgcgcgccgcggcatggtgcgacgacgcgcaccgcttcctcgtccgttgcgcggaagccggaaacgtcgaagcctcctaccttctcggcatggtgcgttgcgccgcgctgcttgcacacattccatttcttgttgcgttcctcgcgtacgtacatgcgacctctcgattgctcgagtgcgtgctttgattttttttttctttttcttgtt

SEQ ID NO: 31599 - DNA, 12932 bp, Oryza sativa
cgcgctccgcgagctcggccactgcgtctcggacggctacggcgtccgccgctccctctccggcgggcggcgcctcctcatccaggccaacttccgcgagctgtgcgccgcggtggcgaacggcggggccaggttcgccgcggcgctggggcgcagcggcgagtgcaagccgccgggcccgcacatgtgcctcctgagcgactacgggtgccacgtcgccggcgcggcggggcggcgcgcgcacgcggcgaacgcgttcctggccgggtggtacgcgtcgcggccgctggcgtccggcgccggcgccgcggcgctccggatgtgctcgcagcccacctgcgggcggccggagacgcggaagcacgagttccggcggtgctccgtgtgcagcggggtgatctactgctcccgcgcgtgccaggcgatgcactggaaggtggcgcacaagagcgcgtgcgtgccgatggcgcactggctcgtcgccgccaacgccggcgccggcaatgcggtcggggccgcggcggcggcggcggcgcagatggcgatgccgtgacccgcggcgacaccgcgtccgggagcgtgtggtggtcgtagctcgccatctccgggatgctcgcttgtgtttcctctgctccaccgtctttgcgtctttagattatcgctcattaatttactttcctgtacttagttccttgttagtgttttaagttaagccaagcctttttgagagggagagagaactagtagcaactcttatgttaatttcctttttttttagttttgagtattatgtttcttcttgtttttgtacatcggtaatcaagttttcatcaaatctacgatgaaacaaaaaccaaacaagtttttgaactccattctgagaaacgcattcaatctttgatcgaggagcagtagtaaataggatgggatggtcggttcggttcgtatcacgcaaatggggtggtaggaatcataaaagtgaaataaaaatctggaggaaacgagcgggcaagccgtgaaagaaacgatgggggtgaccgcctgcttttctggtaacgcccctacggtctgcgatgcgagtcagcgtacgaagttttttttttgtttttgggggcagtcataaattcaggcaaacaaagtgagcagctggctgctgccaagtgccaagcggttgaaaagcggcacacgggtcgtaaatatttggcctgtagcgtggagtggcacagacagacagaccgcacacggcagcagagagaggagcaagcgtacttttggcgcaggcggaagcgaagcgcctcgcgaggattcgggcggggggcctctgctgtttttcttctgcgcggaaacgggacggggcgaccgtcacgaatctgtggttctgaagtctttggtcctttttttttttttcggggaagggagaaatctttgatccttttatatttataccgtgtcaccgtcctacacttgtagcggtgaaaacgtacggaattgttgcaaatcctcgggagaaaaataaaacaaatacaaacgggacggataggttttgttcgcttaaagacaacggataatcttagtctgcgttctttgttgggagttcccaactcccctcgttttctacgcgtacgtttttcaaactactaaacagacggtgtgttttttacaaaaaatttatatacaaaagttgctaaaaaatcatattaattcatttttttaaaaaatagctagtacttaattaatcacacgttaatgcgaacatcgttttgcgtgccctccttccgaacacagcaaatatagatacaaatacaaatatttttttcctcggaacaaatacgtcggagttttcaacggataccgataataagatggatatccaccgaaggcaagaaacatgaaaatttctttcttaatttacacttcaacttagtactctctccttccaaaaatctgagatctatttctttttcatcaaaaccaagaagcaattaactcactcaacatatggcgaaaccaatgaacatgcaaccaataagtattagaatagcttcttggtttccaatcaacaatttaatttagcacatagtgactataaatatgactcagatttgtagagaaaccaaagaatgaaataggtctcagatttttggaaggagggagtacctatttagattttcttttaaagaaacacagttaaaatgtacacacttacaacgtgtgcacactcacttttattaatactcacgcacacctacacctatgaacaccttcaaaagtttgaaccggtataatattggctagaattttttcctcccatactgttctagtgcatcggcctttccttcaacaaagtggcaagaatgtgatctggctctataatttgtttgtataaaaatgagatagataatagatagtatgcccacttttaatatagaccattataatcttgacccatatattaatctgtggcttattaacatgggaatttgtaggtgtggagactaaacatgaaggcttatttttctattattttattaagttaatagattgcacttggggtaattactattcgttggagggatgagcttgggtagacatttgaaaccatgggtccaagatcgaccaagcgttttgggtgaacctgatgcaccctagagtactcgatagtaataaatacaaagcaactatataggtttgtgctgaaagtgcagttcacacctttgagtccaagtgaatgtgttttgaggattgtcgatgtcacctaagggggagggggtaggtgtttcatgcaattacaaaaactaggaacggaaattagaactaacgggacaatccgatactgctacagacagtccgacaatacacagtattggacaatccgacattagccggacaatctgatcaaacgcagaggaaaataggaagtctcacctactagagtataggcctggacaatccggtaccgagcggacggtcagacaacaccaaatgcacgacaatgtgatcacaacaagacaatccgactttgtatagagagtataaaacctatgataaggtatagcacttcgcacactagttttaaactagttgaaaacctatgacaaggtatagcactttgcacactagaaataggagatgatcaataagatataaatatgcaacaaataagatccccaaatcgttcaacatgaaagcataagtgcaaagtaaaaagctaggaggcactaatttgtttaccaaaatttggatctagccaaccctacatctccattgaggggcttcgaaaagccaaatctctttcaacccttttcctattcaagctaccacctccgatggtgccttggtctcttcaagcaaccaccacagacaagcttgtgctccaagagacccactcagtcccaagcttggactccaagcaacttccctctgatgaagcttattgtaccaagcacccaccgagatgatgctttgcttccactattatctcttctcttatggaggcgatgtatataaccttcacaaacttctcctgggcacaccacactccacttggttgaccgcaggcttccccttctcttaaaaatgctcaagttctccaacttgaaacacaagcctctctttttctctagcagcacacaagctatagcaaactcttgatatgggggagaacaactaccctaaatgtgtaagaactcactatcaaggttaaactatccttgaaaggatcttcaattagctgcttaggctattggacatgcacttggcttgctcaggtagtagagggtccaaaagtcttaaaacaactccacggcactgggtatatatagccctaacccctccaactagttgtttctagttgttgctagaagctgccaaaacctgtatggtgcaggacaatccaccataggtgttggacagtccaccatcggggtggattgtccgccaccataggtggcggacaggtcatcaccgggatggattcccgaataatccggtaccttatctgattgtttggcactactaaactcaatttgtctgcccgtctcagacaaagcttctcttggatagtctgctcgctcctggactgtctggccttcacttctccatcttctggctgactcgaatatgggcttgcccgtacaatccactccatcccaaactgaccagcctttatcttcttccttccaagccttatcccattcacttcttcttcaataaatattggtccttagcaacttgtgacttcttatggccttgaccggtccttcgacatttcaccaagcacttgctccttcaccactacatcgagtccttctcttatgcatggtccattgcgtagctaagtcttgccaaccctttactacatcatgccatcttcgatcacttatagccttgcatcacgatgagacaatattttactccctcttcatcatcatcttcttcatcgagctgatcccctactaatatatcgtttgccatcaattagccaaaagcccaaaacccactaggggcatagatgccctttcacgggcctccgaaggatataacaaccttactcttgtctagatcactataagtaagaattcgtacaaagctaagagctcttgatagtactagtcgatttctggaaagccaacccctcctaatgagcatcggatgggattttacaccctttgactctcatctctctgctgagaggaaaaaaaacctttgaactccatgcctgttttgctgtagctgtagatggtttccaggacgccacgtcgggtccgtcatgcatatctaagctatgtgaaaatgagacttttggatacaccatatcctactacattaatgcaatggaatttggagttaatacgatggacaagctctgcagtcggtgcaccgctcttttagctaacatatcatctagcagaatacactcccatctatcttgcttgtgcgagaacatcacataccctttcccgaggtgacaatgggttctcaaagtaagacacctggagtgcgggagccgtccattgctagacgccgacacacgccgccccttggaaagcaataacccacctactcatcttgactcattttagtcaaagaacacctggcaatcccctagcaacccttagtaatagcgccacatcgtccccgacggttaggcagttggccccatgctacactgcgtgggacatatggttgctccgaggagctttgtggacacaccttcgacccgaagttgattgactctaatagtcttagacattcaaccgttctcgaggtttgtaagtcatataggtggtggacccgaggacctccccgcaagacctcagatccagcctaggctggagaagcgatggtccatgacctgcagggtttttccgacttatttaagcaatctggtaatgtgaggggccccttttggccattacactattccatgttaaacaaactggccatatatacgaagggatccccttggccatgatgctaatatctctttccacaaatataaagatgtagtgtttaaaatttatttgtaaatataagatctctagagtactatttctgctagtacccttaatttgatttttatccaatcttacccctaagtaccctcacatctctttttaatgaagaatcattgccatttatatttcttcttacctatctatcgcaagaatcgtacaagtactcctgccacagcgcgcggtatcactgtcattgttatgttccatcacgcgattcatgaagttaactgtcattgttatgttccatcgcacacgatcgaacgagtgtcgtgcctaacacagaaagggatctatatacttagaacaggtacttaattagggtgctcgatcgtgattaaccgccgtgaatcagcaagccatcgagacaaaaaaaaaagcgaagcctggaatggataacaagtaaagaaatgtcaacccgcaagtagcaaacgcatttgtccaaaccatgaggttgttgcccgtcacatcacatcacacacgtagtagtagtacagcacgtgctgtcgaaacagtagtcggaaaggcattggtttgatgcctccgtgtccttttcttttagctacaagaagagatctaggtgagcttagttagcaaattaatgtatcgaattgggaagattaattagttaatcagtttcccaattagtaaggagcaaggacgtgttcatgtggtccattagccacactgacgtctggctaagctagtttacgtaaggtagcttaatttctaggggcatgcaggacatgattagttggttgcttccttcatactaatcaaacaacgagttaagttgcggcagagaagaaatgtttctgtatttaacaatcgtacgaaattttttgctcgaaaataaccaggaaagcatcactgacaattctcgaccaaattaaagtaggcctttaaagggtcacctgcaacatgtaggtcgcggttaaggtcttaaaatttctctatatatatttatgctatgaactattgatatagatatatatgtgtgtgatatataataaaacgtaggttgaggagagttcttttttcttttgtttatttaaaaaaaaatcaaagtactagcaggtgttacctagtagttgtatattataaaaaaatagataaaaaatttgtgtataaaacagactagaattacaaaagatataaccagcttaagaatagaagagctagctgttaacagaggttgagagagagagagagccatcgtgtcgccctcgcgcggaggctcagggacgaaaccctagccgccgccgcccctcctcctccctcctccctgcttcgccaccgccggagctcagtgccggcaaagccgagcgacgccctgggatggcggcggcggggtcatctccctcggctccatctcgtcctggcgcgggcgtggcgatgacggcggcgggatggcgagattgcggcgacggcgcggtggtggggctctccgcggcgacggcggtcgggctttctacggctccggcgacgggcgacggcgtcgccatatccggtcgtcccgcttccaaatctggccgaggtgaccggcgacaggctcggttgacgccggcaccgctcgggcgtaggcgggtggccggtgacgggcatctccggtgcgggttcgtcggcgacgacggcatcgggtcggtggtggctccaccggccagtggtgctctcggcggagcgcgctccagcaccggctgccgcgtggacctggccgggggcaacaggcctgctgtggtttttgccggcgacagggacggcgcttccatctccctccctcctgttcctccagatccgattctccccttcttcagtggttgttcttttggtgctcacaggcggtgtggcgcccgctcccctcttcttaggtgctcctcccttcttaggctaggctgtttccaatcgatgccgggagctccttggttcggtaggggtgacgtgtggagttggtttccggcgtcctgtcttgctggtcgtcggccgcgccgtaggtttgctatagctaggttcctgcgtgtgaggtggtctctggtcgagttgcagtgtgattgactgttgaggcggagtcggagctgcttgtcttgcaagcttggcaacgatgaccctcaacagacatctcggcaacgcaacaagggttcggaagtggagcattttgagagagcctcgggtgaaaaccttgcctagtgctatcctaggttgatgatatagacgcctgtgggcgccgtttcctccttggaggtatcgtcatgctggctctctctcccttcaggtgaaaaccgggttccgttcagaatgggcgttgacagcatttttgatgttgttcccttgttgaaggcttcgctcagaaggtttctgcaccactagaggacgtttggtggttctggagacctcgttcgcattatgttgtcaaagttgcttgcctttggtaagctcggcaacgacgacttttgtgaggtctcaatagttgctttcttctccttttctgtaaaggtttttatcggtttcccatttaattatccatgtttgttctgtttttgggtccggtttcccttattaactgggccaattctcttcttctataaattctggcaggagaaactcatgccgttggttcctcgaaaaaaaagttgttaatagaagttgtaatcttttgctttggaccatatagcattatagctagcttatttagatgttttttggtgtaagctagccagcgggtatggcttatatccattggaaataagaagtaagcgccatcaagaggtgagtaccataattaacttttaagtactagaaaatttcatatctcctcaaaactaacaactgagagtcatcaaactttacaataaaaattgttaatgtagtactataaaatcacacctagaaaaatatacatgcatatccataagatgccggtggcagatccagaaagaatagtagtaagatctgagcaaactagatagagttatagatagagttacaatcccccttctatctaaatatggtaaaacattttaatggggtcttcgtggggactctcatagtcttcacgccagtagtgggggctcgagaccttgccgctctcttgctggatccgcccttggatgtgggtttagttgacctccaaaaatttttcacgaacacccttgtaagtacattttactccctccatccacaaaaggttatacatatattcacatttgagtttttctaaataagttgtttctatttgtagtctttatacattcaagacttggttgcatgcttaggagtcatggttgcattcaagacttagttaccaataaattaaatgttttattagaacctaaggagtcatctaaatactcattggttgcatgcttgcatccactccttgattttgtaacatctaaggtgatttaatttcttattggtcttggtgttaaaagtaatatgtgtaacttttctagatggagggagtatatgtaagtccaatttacataaatggcctcactaaaatataaattgctactaatcgactctgggttaaaaagttacttcctccgtttcacaatgtaagtgctagaaagtcttacatcgtgaaagggagggagtacagatctgccacgccgtgtatacccttgtcgatgtattaacaaaaaccccaagtgcttattactccctcattttctaaatatttgacgccgttgacttttttaaacatgtttgaccgttcgtcttattcaaaaacttttgtgaaatatgtaaaactatatgtatacataaaagtatatttaccaatgaatgaaatgatatgaaaataattaataactacttaaattttttgaataagacgaactgtcaaacatgttaaaaaaggttaacagtgtcaaagatttagggatggagggagtattaaagatttaatagtagaaactttagttagcaagttgttgagagatcatctatcgatggttcaaaccagtacgtcaatgatgaagcaggcatgcatgctcaaatttttacattttggtcctttctgaaaacttattttacaaatagtcccctagaaaaacttaacccgggaattatcctttttggagcgctagagaggctagtgccgtggtccaacatggcggcgccgcgcccgtgccactgtggcactagggctatcgtggccgtgctgactgggcagaggggggggtgctagccactctggcaccgcccccccatacgacggtgccagcctggctggcgtacccctcctggaagggccgcgcccttaaaccccgtcggccctaccacctttctcctccccacagccatttgcgccaagtcccagcccgagcagcagtagttcttctcccttactctctccccctcacctctgcacctcaaatccactcaatttgaagccgtttttttgcgggattttttgtggaaatcgaagagaaaggtagactcatccattcccccctcttttttttttcatttttatcgattgaatttgtagatcggagggtaaccctagaacccctttcttgcccaaatttgtgatttttagcatatgttcttgggattagcttgttgtagtgctgtatgtgtgcaatgtactcattgctgagttggtacgggaagacttggaggggcaaggagagaagaagagacctttgtttgaaaatgatttatgggaggcaggaccatcaaatagacattgcggtagtgatgatgtggacgaagcgagggagatgaaaagggagttagtacaagaggggcttgatctaagtgaacatttgtcggagagtgtacattggtcgtcgtatggaggcaaccctgaatacccggcgcaagtagcaggccaatatgtgaatccagatgattactttgttgtcgaattgagtggtggtcacgattctgtttcagtagaagtcaatagggaggaggttgatgaggaggcaagtgttgagaaatatgatgttgaatttgctaaagactattatgatgaccgtccattccctccactaattaacaatgacaagttagcattagaggaatgtcgtgcgtttcagaaggtgtttgggagaaagccgaacattcatgagtttagggacctaacacatacccatggtgcaatactagatggcggaatcaacttagatcagttgttagaaccattccaggtggatggtctcaaaaaggatttagagttcccatccatggtaacattgaagctatggctccaggagtacgccatcgtgcaccatcgtccataccgtgttgtcaattctactacaaataggaggtatatgttaaatgtgaaaacccacggtgcaaatggaaggtccatgcaactaagaggtctagtggcacgtggaggatatcacgggttggtaaggcacatagttgtgctactgccgaaggttcagggagacaccggcagctgacatctaagttcatagcaactaggttatgcaatgccataaaattgcaacctacactctgtgcttctgcattagctttgtatatatttgaggttttccagtatagggtgaagtatggcaaggcttggagcgcacgagaggaggctatgaagctcatttatggagaatggggtgaagcgtacgtccgtttgcccactttgctacaagccattaagcagagaaatcctagtatggtctaccacatcgatactcatcctgataggtttgtcaacattggaggagtgaccaagaaaatttttatgcgtgcattctgatgctttggtccttccattgaggcttttaagcattgcaggcctgtactagctatagatgcaaccttcctaactgggaaatacagcggtgccttgatgactgcatatcggctgatgcggaggaccaacttatacctttagcttttgccttagtggagaaagtgaattcacgagactggtgctggtctatcgatcttgtccgacgggttgtggttgggccgcacagggaggttgtattatctcagatcggcatgctggtataatgaatgccatgaggactcctgttccaggattgccaccagttcaccaccgatggtgcatgaggcacttcagtgctaatttccacaaggccggtgtggacaagcatcagacagaagagctcctaaggatatgtcagattgatgagaagtggatatttgagagggatgttgaggcactaagacagcgtattcctgaaggtcctcgtatatggcttgaatatgagttgctggacaaggataagtggtctcgtgcatacgatagaaacggctaccggtggggttacatgacaatcaacatggccgaacagttcaatagcgtgctagttggtgttcgtaagcttccagtgacggccatagtatcatttaccttcatgaagtgcaatgattactttgtgaacagacatgatgaagcagtgaagcgagtccagtcaggggagcgttggtccgccaaggtagctagtaagatgaaggtgcaaaaaagcaaggcgaacaaacacacttcaaggtgtttcgataagtagaaaaagacatacgaggtcacagagaggggtggtataacatgtgatggtgttagattcggcgcaagagccttcaaagttgaagttaaggggaactcatgttcttgccaaaggccattgctctaccatatgccttgctctcatctcatccacgtttatctgattcatgtaattgatgagaaatcttccaaccgaatgccgtatcagttctcttcaagagccgttgtgaacacatgggcaagtcgctttgagccatacctcgaccccacacagtggccaccatacgatggtgaagaatttgttgctaacccagatttgaaggttaaaacaagagggcagaggagatcgaagcgattcaagaacgaaatggactcgggtgttggtggttctagaaggaaactgccttcaggtgttcaacttgatgctgcgccggtgcaaaatagatgctggttatgtcaccaggagggtcacaagaaacctaagtgtcttaagcgtccaaaaaagaagaagtccaaaaaaatagtgttagggaggtaaatcttttgttttcctatttaagtcaatgcatgttttattcttgtctatttagtgtctatttatttattttggattctcgcattcattttctttaaagttatgtcatgcaattcttggtaactaacggtgaatttattcatttttcatgtaggatggccgaggaggaacaaccgccgacttacccagccttggaggagtactacgaggcctgtcatcgcagggctgcgatcgaggcgggaagggtatgaatcggcatcgattcacttatacctaagtattagtagtgtgtgtttgacattatattaactaattgatttacaattgctaatgcatgtacttcaaccgctccgagttagagctcatgcccccctcc

SEQ ID NO: 31600 - DNA, 1810 bp, Oryza sativa
catatcttgatgacgacgctgagccttggcgtgttgagtgctatgcccgtgcatacatcctgcatttgttgggaggggttctgtttccagatgctgggggtgacattgcttctgcgatatggattcctttggtcgccagccttgatgatctaggccgtttcagttggggctcagcagtgttggtgtggacttatagacagctctgtaaggcctgttgtcgtcaggcaccatcatccaacatgagtggttgtgtgctattgattcagatgtggatgtggttaagactaccggttggcaggcctaagtggaggcaaagcttcactccttggccctacaatgagccagatatggagaagacaacggcctacctgtttgagagtactgctactgcacatgctcaccgggatgtggcatacaagcattatgtcaatgagatggactacttacagcctcaacacgtaagtacttccaatatcatttctagttcgacatttacttctataattgagatactaacctacgacatctcttcaacttttctagattgagtggttaccataccacaccaatgaggcttcaagcctgaccctgaactcgttgtgcaatcgagactccgattacttcatgtaccagtgcccattgatttgtttctgggcagttgagtaccaccttccacaccgtgtcatgcgacagttcgggaagaaacaagattggccggttgaggacatctcaacctgagttgaattacacaagtaatatttcttatctctgtttgctttcattatcaatgttcaatttttaccatttgacccttgtcgatgctcactttgctttcatcaccttttacttggcaaggaacaccagggtaagaccaaaaaaggtgaaggactggaggttagagcataccagatccattgataaatggagggcagtgggaaggaccaccgggtccttcaagataatccattaaacccttcttttctcagagtaccttcgttgggtgcataggaaatttagactgttcttacgccctaattggacggaaatcgacatagaggaagaccgcgactccgatgaggggcggaatccctacgacgtccggactagggttggatatcaaatgaagcacgccccacttatagacagagtcgtaagttttcttgaatttgtcaaagtgatttctatttgcaccttacaccctaacaaacatcttctcacgctttcagtcgagagagctcctcaggagtatgaatgaaatggggcatgccctccaatctccgaggggtggtgaggacacggagaacacactccgcaatatcttagaggtaaaattgatttagcactttgcattacttgagttatgcctaacaaacttcttttttttaaatgcagaaagttcatcaaagataccggaaacttgcagcaagattaggttgcaagtcggttagattggacgacgtgtaccaaccgcggagagtaccaccaccactaccacaatccgcgtgtccaagtaccgctcgacactccatcaggatagaagagtgtgaagaagttggtggctagtcgtcatcacgcattccacaagggaggagaaaggggaaggcgtcggctccacctagcgacgacgacgacgaggaggaggatgaggtctacatcacaccagatgctgatgagatagacatgtcgtagttccccgatgcgcctcaggggacgcagcccacccaatacaacttgcgatccactcgggcagcgaaaaagaagtaaaatgagcttaccattcttatgtgttatttgatttctctcagtttgt

SEQ ID NO: 31601 - DNA, 278 bp, Oryza sativa
ccgaggacgcgcgggagtgggggcgccggcagagggagaaggccgcggcggcggtgcgcgtggcggcggcggagctcgacggcgagcggaggtcgcggcggcgcgccgagagggtgaacgccaagctcgggagggcgctggccgacgcggagagggagctggcggcgtcccggagggagctggagagggagaggcggtcgagggagcggctggagaaggtgtgcgacgagctcgtccggggcggcctcgtcgccgccggcggcggcggcaggggaggc

SEQ ID NO: 31602 - DNA, 1964 bp, Oryza sativa
ctatataaaatttgaattttaaaatataagaaattcaaataatttttttgggtagtaaatgatttcaaacagaaaaattgtcaaaaataaaattgtataatttatcaagatctataacttttattttggtcatttctctatatgactttgtttgaatagtttgaatttgaatttaaaaatataacaacttcaaacaacgttttcaaatactaaatgatttcaactgaaaaagtcatcaataaaaaatttatataactcatcaagatctataacttttattttggtcatttcttcatccgataaagtgatagtaacattattcataaaatttacatatatctcatttggttttataaactataagagagatgtaaattttatgaacaatattactatcactttgtcagataaagaaatgaccaaaataaaaattgtatgtcttgatgagttctacaacttttatgttcatgaccttttcaactaaatttatttactacttccaaatattatttgaagttttgaaattcaaatttttaattgataaaacaaagtcaaaaaaaatggcaaaaataatagcagtaaaaatacaataacatgatagagcatgatttagaaatacaaatacacaatagcaaaaatcatttgtgagtagtgaggggttttttattccgataaatattcttcaccgtatccgtttcgcttcgtattcgctccgtatttgtattcgattctgtttttatatccgggtttccgattccgatttcgatcctgaaaagaattatgaaaacgaatatgatagagctaatttcggaccgtattcgatctattttcatccctagcgggaaggaaccgactgatcgatcgagcgcacagggcagggggcggcaccgctcgtcgcgacgcaacgctgatccagccgccagccgtccgtccgatggatcgcacgctgccacgaggccagaacagccgaaatggacgccatctcggaggcttgaggcaatgacaatgaggcggctacagaaaagagaaacgttaacacgagacgatgatgcgatgcgcggccgggtcacgtactgagctgccaaagccatggcatagctgccaggacgatcatgcatatgcttcttggtgatgatctgtgcacgtacatggtgtgcgtagcagctggaaatgctgacttgggtgtatacatacgtacgcatgcgtacagctccctctctctctctctctccctgaggatacggccgtgtccgggattacatccgttatccacatgcatcagaattgaagcggtcaacaaaaaaataaagaagaagagagagagcgcttgtttatccgatggtaaaattcgatttatctgcttcttagaacgacgggtagatgtagatagttgtagtatctgttactaaaaaagagaggtgagaattacatgtgtcaatgtgtgtaggttctggaaccatctacagttattatttcctctctaaaaaatctacagtgttggcacgcgcggaacaccgatgaacaactaaaaagttggctaaaaaaggacgggaccacctatacatttgtcgacaaattttcttctgaaaatttgacagatgtaattatagtacaatcgtagtataattacactgtaacttgtatgtaattactctgtaacttgcatataactacagtgtaacttgtatataagttaaacgtaattttaaatcgttagatctattacaaaatttgttctggtgaggaagaaaaaaaaatcacatcacacatatatgtgaaagaatttattctcacaacctccattttatcgaaataaatgttatggagagatttttgaaagttacatacatattacattatagttacagtgtaattacatgcaagttacaatgtaattacactacgatggtactgtaattacatcagtcaaatttttggtagaaaatttgtcgacaaattaatat

SEQ ID NO: 31603 - DNA, 2011 bp, Oryza sativa
tccgtttcttcccctccctaatgaaaatgtaaaattgataatttgacacactattcggtgtaacacttgtgatggcaatgatatgtgggatcacatgagtgtttgacagtggctatgaatatcaaacaatcgaatcctaattgaaaaggtgtgaaataatctaagcccaactaatgaagtgtaaaaaagaagtgaaatctaacgaatgaaaatgcatcttgaatgtatttcaaaaccggaccaaaagtggaggggagataaagtagagttaacttggaattaacctccctatcaacggaaccaaaggttcaaccactatgcagctgcagtcaactgatgctaccaaggctgatccaattgtatatgttcccaaacagccaaacattgtacattagtttcactaaacgtcaacccgggcattacatggctattgttactttcatggagcgccacgtcggcggtcagccccactcaaacgaaaattggacctactgtgatttgttaaactaacatcatatatatctaaacgtgtaatttttaagtttgcggatgtaggtgacaccaccgcttatgtttaaggactggacatatatattttactctttaaaagtactaaatgagattttttgtgatgtagtcattctaaaattcttaattaataaatatcgtgctgcactcatgttctttttcatgttttgctataagtatgaaatttcaaatcaataaaaagatttgtatacggtttgaagtctcaattcccacaacatgaagaatggataggttcttaatgtagtccacaatgttaaatgcagatactccctctgtcccaaaaaaactcaacttctagagtttaaattttgttaaaaaaacaaacttctaccatcctacgtaccctcagcacgtaaaacgagaagttttattattttaatatcctttacttacctatcacttttattatttttttcaataattaagggcattatagtcattctcactcccacttttcactaattctaccttagaatgctaggaattgctttttttttttaggacggaggagtatattgtcttggtaatactatctaggggtctaatcaatagtcaaatatttctagttaaagtggtctcatgagagcttccataaaaatgttcaattagtatagttatatattacttcaccaaacaattgacatcaaaattggcaaaacgtatacatgagaaatttcattaccaaacagatctctatgtttatttacaaaaacttttgagatatctgatcctagtaccaagtgtggaatgccaacttaaacatcaaaattgaatgcaaatgtggtataaattaaaagacactttcagcagcacaaacacattcctatggaaaagaatgatcgcccaagaagctagcgaccacacaaaactatgcacacggtttgatcgaggaaacagagcaactatgaatcatcacaacatattcttctctcttgtcaagatcttccctgttcaaatctggcgtagtatcaaaggtgacgaagcttgggagggagaagatcgatgtcagtgagctagcattgtccccattcttgcgacacgaggacgaagccatggccggccagcatctgctccctcaggttcttgatcgcctcgtacctctcggcgtcctcctcgtccagatccttgctcctctcgctgcaccctccgtcgtcccaccggtcctcctcgccggcgccttcctgcgatcgccggtcgatggcggcggcgttcttggacctcgccgtcgtcgtcatgtccttggaagccgtggtgtagctccagctgtagtccttgctgttcccgtccacgttcagctcgatggagtgcatctcgctgccgtctgaatcttcggcgacgcactcgccgcggccaccgccgtcgtcttcttcgtcgccgtcgttgtcgtcttcgtgatctccgttcttgtttacggcaacaagaatggactgaaactgatggccgtcgggtcggcggcggcggt

SEQ ID NO: 31604 - DNA, 3113 bp, Oryza sativa
tttctccccctctgcatggtaaagcgcagtcttgagatcgccatgagtgcacctgaaaaaaacacgcagggagagaatttgaaatcgaatatgtcatcttcctcaagagctttctgtcgtgtttttctccttctcaatacattcaggcgaaaaaaataaattattttgaagctttttcacagtacaaactgatcaatgagggttgccggcacttgcaagaaaccagtactctgaataagtacacagtaatcagttatgtttatctgaatcgcttattatcaactaacaaaacttatggttaaacttttatatacgtgtttttagctatttaaaaataaatactgtaaaataaacttcgattggaaagctacaaaatcaactacaaagttaagtcttaaaatttaaatttttgcttataaacataaaaggaacgttaggactgccaatctctcgacattaatcgaacaagtcctaaccagtactccctatgttttatattataagtcgtttcacatttttcttagtcaaacttttaaaagttgaataagtttgtagaaaaatatactaatgttttcgatacaaaacaaatgttttaccaaaatatattaaatgttaaactaaatgaaactaatttagtgttgtagatgttgctattttttttaacttaggtggtgtttgaaactcatgtagataaagatgaagattaagagttttaattattacaaacttgaaaaatatatttatctaatattttagaacaacttccatatagaaagttttcacatgagacacaacgtttagcggtttgaaaagcatgctacgtatatccaaattttcatccaacttttgttagagaaaagaatggggccttagtcaaacttaaaaaactttaactaagaaaaaatcaaacaacttataatataaaatggaaggactagtaatttaaagttagactaggtgtgtgacaaaacggttacacgtaaattttaacatgtagaattcgtacttataaaaaagagtaaaatgcaccaacgaacttgttattaagtttcatttaggttcacgaatttacaaagcaatcgaagtccttaaacttggtttattgtatcatcccggtctaaagacttgtttgaccatggtcttgcctatgtggtacgccatgtgaatgatgacatggcttttttttcctttcccccttctctttttcatcctcttcttttatcttcttcctccgctagagccacctcgagctcctccacgccaactgccaccgacgccaagtgtcactgctgtaagaggaagaggctaaagggcatgatgcctaattggtggtggattggaggggcgaagttgcggccaggacgcagagcgcagcggcaaagccatctatggtggcggcttagcacgatggtagctagggtgtcggcaatgcacggccagagatcggcggtgggcggcggagcctgtgctcgtggtggaggtagggttacggtggtggattgggggagcggagcggcgaccacggtagccctcagagcagtggtgccggcggtgtgagtggagcagcgcggtggcacccagccgaaagatggtggcaagagggagcggcacggaggacgcaatagagggtacgacaggctcggggagttggggaaaatggtggaggggagcacaggggtggaccttatatgcttgggaggttggaatcgtgctcgaggcaagcagatttgaagtaggaggagaaggcggcgacgtcggctcgggcggctcggctcagctgccggtttgcgtacggaagtggggaggtgggcgacgaccgcgtcccccgcacgtgtggatgatgcgggaaggcgcgaggacaatggcgtcgtggggagcgacatgcgcatgaggggtggccatggcggttgccgatcagaggagaaagaaagccctgacaggtgggcctcggccccacctatcggcgcctcggcggcagaagcaagaggagggaggcaaattggagaaaaaaaggagaagaagggaggaaaaaagaaaaaagaagggagaaaaagtaaaaaaaattccatatcgtcatccacgtggtatgccacgttgataaaaccacggtcaaacaagactttggaccgggatgtgttagaataggtgtcgaatatactagtcctatttggttacagttggacttggagttgtaatagatgttgggggtggagttagagtcgaactctgtaacccggcatctctcttaaatagagagagggggcaccacaatgtaactatggcgactacaatgtagcgtagacacgcagggagatgatggcggcgtgccatggactcatagcggctaggtgctatgttggttggggaggagcgcccataattagagccccggggatttaggcttcggctgaaccttgttaacaaatatcgtgtgttcttgtgtcgtcatctggcatgtcttgggtgatcaacgactgaagcgatcgggaaagttagttgtcgttccactatatcgactaacttttataacaagtggtatcagagcagaaggtttcagtattggatcaagaagacatgtggagaaggaaacatgaggtgggatcgcgcatcgacaggagatcgtcagtcgtggcgatgagatcgatggcgacaacgaggacgttgcagaggcgacgacctcactcacgatcagactgacgatggcggagcgtgaccggaagacgaggccgggcgtggccgaaggcgttcggagagatcggaggggtagcgccatggacggcgcgcctgacgcacgcggcgaacacggatccgcggcggcaaggaggccactgacggaagggcaaaaccggctagcgtggcgcggcgcggcgcggcggacgtgcagggccgatgacgatgagatcgtggacggtgaacacgagggttgcgactgcggtgagtgcgagggcacggacagcatgtattgagtacgtgctatacacgcacacatgcacatattgtcatcgggagagcataatcaccacggtacggatgcagagatgtagaagagaaagcagagaggttgggtatgaagttgaacttgactcggagatgggttcacgatgcaaggagga

SEQ ID NO: 31605 - DNA, 33248 bp, Oryza sativa
ctgcagccccttcctgggaagaagcaggaggcagcagcatcaggggttgtgtgggtcagaggagctggccaagcggcgacggattgtctcgaggctcgagtgtcacgtgcacgtggatctggtcaatcaggcaagtttgttggtggttctattctggctcgaggcgagagacagaccgagcaatttacttagctgcaagcagtaaggaattggtagtgcaataattaagctaatgcatggacaatatggatacgtggtagattaattgcatacatgtgtatgtgtatgcatgatggtcaacaggcccaggattggatgcacagcacaaggtgtggcactactaagggatggtcacgtggaaagcaagcaagatgcagtatttgtgcagtggtgtcacaggccattgagcaatgcatggagatcaaagcaagcaacggacttcatcaggggagaattgatatatccatacaatggacgagatggcatgagctaactcggttgcgttggcatggataggagatcatatttacctggagtccagaacttgatgattggtgcaaagcgttggtttggcggcgtggctcacaggcacaagacgggaggcatggtgcagctttgtggtgatcaaggtgatgtggttagtatacggctcgggagaaggtgcgcgaggtgtgcatctatgtcggttaaactggaccggcagggtggtcagaccgacggactggttagactgcggagtttggacggttagaccgggttcaatggacgtgtggtttattgcaagaacttgttaacggatccagaagaaggacaagaaggttctacagatggatagcttacaagtgtgaagggcgagtagactgtcggcaacaggctagtcaggtcacatatggaattatctgacggaaatgtgatatatctgggactcgataaggggttgagatatatggagttatgccagaggtgaagaaaaagtcccgggcaacaacgggtcaaatatcgttgatagggtcgacgatactgtttggcagtacatgatatatccaagatatgcaggttggcatgatggggatatatgaaatctgcgtcactgaagaggaaaagcaagtgctatggtgttaatttcttcaagtgattcaaggcaacggtgaattttctcaaagtattataggttcagtttacggatgcgggaaagcgagaatgttagatttattagatcggttcataagacaacaaggaagaaagggttatcttcaagtctggtgagtttgatttatctatttggtgatgatgcaggttatctgggcatggattagatcaagtcaaatttaagatggaagatggaggtgaacatggtcttcagggagtcaatgatgtgacagctaggaagaaatccaatttcgcttggcaagacgactgagatgataggtgaaaaggtggagcactgttgcaggtggaattaagaggaagaaattacagggatagcggagtctcttgaagacgatgggtctggcgtagactcgtcgggcggcttgcggtgaagctgcaaagaagacaacccaagtctggaggacaggtggatcggtatggtgattctactacttctgggtggcgtatattcgccaaggtggagtttgttaaaataggtgtcaaatatactagtcctatttggttacagttggacttggagttgtaatagatgttagggggtggagttagagtcgtactctgtaacccggtatctctcttaaatagagaggggggcaccacaatgtaactatggcgactacaatgtagcgtagacacgcagggagatgatggcagcgtaccatggactaatagcgactaggtgctatgttggttgcggaggagcacccataatcagagccccggggatgtaggcttcggctgagcctcgttaacaaatatcgtgtgttcttgtgtcgtcatctagcatgtcttgggtgatcaacgactgaagcgatcgggaaggttagtcgtcgtttcactatatcgactaacttttataacaggatgatatattaaaccaagtttagagattttgatgcgcgttttgtaagtttgtgtatctaagtgaaactttgaatccctagtgtgttttactctataaaaaaacacgaagtttttcccgtatcaaatcctagaagggtgcagtagagcagtgatgaatcgatcagacacaagggacggtatgattagagcagtgatgaatcgatcagaccaaagggacggtatgattagatgctgttgacagacacacagtaggagctgaggctgtctctgggccaacatgacatggccctgttcttctacaactgccgcctcaattgaaaaacaagttgcaactaactttgacaaacagccccgaatcttccatctcaaggtctctcaacaggatggctccaatttccagcttgaatttgactagtttactccgccgctcgcataataaatctaaagaatcagcaaccgatctactatgacaaatgcctcgcctaactgcatgcgttatcaggtgaataaactactactaggtgttcttgtaccggccatagctcgtagcttgtggaagagatggacaatgatgcatgtgccaatgagaatgcattctttgaaatgagtgatgtttttctttgacagaatttacaacctatcagttttcaaaaaagaatttgcaacctataataatcaggcaccgaatcgctctgttctgttctgtttttgtgcagagataagcagcacatgagatgctgacaactaaaaataatttccaaataatttgccaatgatgcatgctgacaaacttaatgaggatggtcaagattcttgctcgaaataatttctaaatggagaagttagagaaaaaaatgatactctaaatagagttctgtgcaaatgaggaaaattcagagttaattacctccattgtgctgccattgctgagcatgtctggaaaccagtggccatggccgttgtgccagcttctctgtccatcagcctccgatgccttgctccttgttcttgatctctttgagaactattgcaacgaaaacgaggacgagctcgattagagaaacaaatggatcaggaggattaattagtggaacaaacgatcgcgcgcactcacctccaccgacacgcatcgccggtgagccgagctccggcgagcggcatcttcgtcgtcgggcgagctcagctgccggagcgcgccgacgagcttcctggccgacgccgccgagcgcgtgccgtcgtccgcggcggcggcggcggcgccaccgtggcagcgcctgccgttccacgacgactccgacatcttcctgctcgaccacggcgacaacacgacgccgccgccgccgcccacgcctctccggccgagcaccaccacccctcgcttcttcagcctcagcttcctcagcgggtccgacgcgccggacgacgacagcgcgcaccgcttccggatcttggtcgcgacgaccacctcaccgtctctgtccaccaccaccgcgccgcgcctcagcatcgcggtggccgcctcaacgccgccgccgccgccgccgctcctcctcctcctccttcttggcaagaacaacacgagcagcagcaacaatgtgagctcttgtatggacagtcacagtggcgacagtgacgacacatcaaaagaatcgctacttcttggatttgcattgggatttgggaattgcttttggccaacatggacagcagcaagatcgatcaatgatgggtgtttgtgtggaatgggatggaatcagcaacaactgctgcttcgggcacggctttggatgaatcttgcggacatcgaactgatcaaagggagaaagcaaaaggaggaagaagatgggcagctttagtggaaggaataagaagcagcatcaagaatcccagcaaaagcaagcttacgatgtgaccccctcacatctcttcaagaagagaaaacacttaaagaatgagaagcagcatctctcatgatctccattgatacagagaaagatcctcacgattcacaaatctatgggaactgatgcaccaaaatatccttcaaattgttaatcgatcagcacaccaagaactggaggtacagtgttgaaggaaaccgaggatttatacttgtatccggcgaaagatcgctgggtttctttacagtacgaacagagcagagaagatcactgtaggaccacaagttcaaatggggttcaaactgtccaaatcaaggagagggaaagggaggagtaaaaaagggcagccatgaaaacaaatctacatggaatgttgtgctaggaactgcagaagtatacgccagtatgaccaaaacaaacaaacaaatcatacaaaatgcgcagaacaatgccgaattcaacgaaagaagaacaggttacttaaactaactcacccattaaagcccagaagcagagctgcaggagtaatcaagctagatcgccaaactccgctgatcgtcgcagaactagaatcagttcttgcgcgccatgattgggggactcattttttgcagtttgtgatcgagagggcacacgagtgcgtgcgtgctggggttgaagcaaatgagggggacaagatgatgggtgagtatatgggttgtgggggatgtgaaattgacaaattggtgtccctttgctgcagaatgagctgtctgtccgtccgttgcatatgattggagatttgggtatgcagtgttcggttctgtgtgcgtgagagcatatatatgttcttcagttaaagagggagaggagaggatcacaaaattccaaattggacagatgcttgaggcggcttaatcaggtttgggagatcaatcagagatgaaaattttcgttgcatactttaagggtgggtacaactgtacatattcaatggacgtcagattgctaacgactggatatcagatagtcagcaattataacgtcagatgtggttaaattttctccctcagtttgtacaccgaaagcaatagtttgcccgcgggaaagattttgcttaagtgtgtgttaaagaacgagtgtttagcgtgtacgtgacagtttaattcttttttttttcgtttatattagctgacgcactagcaaagaatgagtatttatgcatccaaataggcagacgtataggttcaggctaaatggcactgataaaatggggtaacagcgttgaaaacacggggggcttgatcattgcttccctaacaatccaaactaggagctcttgtagggtggtaaactagtaatctagtctatataacttaggagagtataggagttggtttctaggtgattcggccaatgtagcagacgacaaccagccacagccagcctaattacctaacctttgagacgatcgacggccggccaagttgagccatccgacattagcagcttcgttaatcctcaggcaccaccaggaacaaactaaacaacccaaaaaaacatagtagtactagccggcgacgcaacgcacatggggaagaagttgttgtttttttttttttttttggaaagaaggaaggataggaggagcagcgagatcaggccggcatgtggtcgcagatctcaaggagatcggagaaaactccccccacaaaagcagagtagagcagagcaagacattcaccgagcaccacacagcccacctcgatggacctcgatcgagtcgtgctcgccacgcgcgcccgcgctcgctcaaccgatcgagagcagcggaagccagccgcctcggcgaacgcggacgcggacgcgggcgctgctgccgcgcgcgacatgccgatcgacgtcgcgcacgtcggggggagcgggaggaccagcggcgccgcggggggcatggcggcatggggtgatgtgggggtggaaggttcagctcagatcgtagcactgtagcagcttgtggcagggttgccgcgtgcatggcacttggcagcatggctgcatggacggatggatggatgcagacaaacagtaggcgggcgcgtgtacccgcgacatgggtgggacggggccgactagcgcgcgggtgcgggctgcggagtggtgtgcgtacgcgtacgcggcagcgcggcgtgtaatgtaacgcctccgtcacaacatggcaacgtgcacggtcgaccatatcatatcgctccacaaatctgtaattatgtatcgtctcccgctgcgctctgacacgatgatctccggtcttaaaaaaaaagaggggaaagagattaagtttagttttcttttgtgctgggctgtggtacgtgctgttgggctgggctagagagtaaagagaggttgggacgtgtcacgctgccatgtgccaagttttggggttcagtgagcccggtcagctagcaggtcgacacctatttgtttgatgagtagacaagttgtgcccaaacctaggattattctaacgagtagcgaaggaattaacaggagtattaaaataccatatttgcattattcacatacatggggtgactactgcgcgcatacgcgccaactaaattgctggcgcgcacgtcagctgccccaccccagccctcccttatcttttttttttctttttgcaccttttttccgattttggtctctccggatgcgtttttctttttctttttcgccgtttcttttccgatttttttcaatctttcgcacacctctttacaaatatataactcaaagtttttaattttgatttgaaatttttcaaatttgagttgagttgaaagtttttaaattttaagttaaaagttttataatttgactcgaaagttttcaaatctgagttgaaagttttaaatttgagttgaaagttttcaaatctgagttgaaagttttaaattcgagttgaaagtttttaaattctggtcaaaagatttgaatattcgagttgaaattttttcaaatttaggtcgaaaggtttcaaattcgggttgaatttttttaaaatttgagatgaaagctttcaaaatttaacttaaaagttcaaaattcgacttaaaagttttcaaaatttacattgaaagttgtagattttcaatttttttgtgctgagaaaaaaaagaaaggttagcttaatataccataattatcgataactaattacgtatacgattttttttcttcaagtcctgcaaggaaaaaaaattcgagtcctgcgcagttcgttgcggaaaaaaagaaaaaggaggttgtagctagtgggccgcgcacgagaatatgggccgaaaacactcgcgacttagctagctggcgcgtctgcgcgcgataggaatctcgcatacatgggcacaagatctggttgttggtaattaacctggtccaagaagaacaactggtgacaaatatgtggaaatatggtcaatatggaatgcgacgaattctatacgccatcgagaaattctgaagagtatcaccgcgaccgttcaatggacatcatttggagattaatgtcatggagagaatgttgcagaaaatggaactataaacttctaactcataataacgctgtaaagattaatgtcgatggtgcctttgtcgaagatggtcattttggagcttcattacggccattagagatgatcggggcatgttcagaatatataacaaatggctgctagtatcgtctgctattgctgaggctatagcagtttgagatggtgttcatatggcatgcgagcatgggtttgacaaggtgatctattgaattttttttctcattcccatcggacagacgtatattcagcatatgttcattcctgggtgaagtatagaacttgtttaattgtttcgatattgattacagttgctactcttgcaaatatatggcagcacacaaatgtgtgctgaatatgtattcggggctagagtctagatatgggcgctggtagcaacaaacaacgaatgtgtgattgtctagtctaagatcctacttaattcgactgagaatgaagctcctaattccaaaaagaaagaaagaaaaaactatgattactcacatataaccaggggcggatccagaaacaaaaaattggaggcttgattatacagtttcttcaacctccagccatctagggacctttagtttattattcatggtgaaaaaattgaaggggtgctccgggggacatccatgggtcttgtgggcacccacgttggatccgcccctgcatataactgtgagggaaactaattgatgaatgctcacgagtgaccaaggtagcaaacatcttatctcatatatttaggcttcgttcgtaacggccagagtttggcatgtaaaacgagacaaatattagtgtattaattaattatacaccggaaagatggctttatttggtttttattcaaaaaacttctatatagaaattctttcagtaaaacgcaatgcttagctgtttggggagtgtgctcacggaaaacgatggaagtagcccagtcaagaatctgatctaaacgtaggcttagtctttatcccatccattggatctctagattaatttcccaccattgctgctccgcatcagttccttcaagccaccacgcacctgatgagcgccactccccctccctcctactagcctcaacgccagccgctagtgagccccgccactcctcctacccccatgttcctccttcctagcgagatgtcgataagctcgggaaccccttcttcatctttcccgtcatgtcacttcccctacatattttcatcctccatggaaaggtgccgacaagcttagatccctttttttttctacctctagagacatcaatgtcctcatcttcctcctcgctgatgagccccttgcctcatcccagggacactgacaaatggcatgcacctccttgttccttggatacagacatgatggtgagctccacacaagttatgggtagaaaacttttgaaattttgagtagaagaactttgattcgaaagttcaagggtttgatataaagtttttgagttttgagataatagtcttaggttcttaattagaagtgttgcgaccaaaatgatactctttccattctaaaatataacaatttatagcatttaaaatttgtcctaaagtataacaaattctccacctatattctcttttcaatcaatcacaaccttattccattcaagtcgacatgcttttttaatacccgtgtccaacctattacgtgtattttgagatgaaggtattactccataggcttcctgctttggtccatggaacccgcagccaaatgcctagcttaaataaacgtgctagatattggactagtccatgattagcatgttatacagaagcctagttgcctagtttttgaactcaaaacttaggttttggttttccggaataagtttactttagtctctcaatttgtcatcaagtctgaatttcttccctaaactgaaataacaggtatagtccatcccacaactcacaatatcgtgtcaactttggtctcttggcagtatagtggccagttttggctgacgtggcgagtgggccccacatgtcagggccatctattcttcctccaacctcccctctatctccatatccgattcttctctcttcctttgagtgtgctaggcgatataggagaggaataggagcgacaaggggcgtcggtgctcgagtggacggaaggcctcgacggcagtagtggagggtgttagagctatgagtagggcatggctcacatgagtagggcagcaaccggtaaagggagtacgggagatgaccggaatggcgatggaaagagctcagctctagtacgtagcaaagtggatgttggaaataaacacgtcatggtgtattcctggcgtggttgagtcagtgtgtgtgtgtcgtgctgctgcatgtgtgcgtcgtgtgcgttctgttagtttggttgagtcgtgatcacgagtgcatggctgctgcatggttgtttgcatggccgttgcagtgttgatcgagtcgtgggtgtgcatggtgtgcgtggcgtcggttcttgcggaggaagccgcgtcgtccgggcgagcgtgtggctcacggcgacgtcgagcgggttctgcggaacgtggcgcaatggccggcatggaggctagctcccggtgtgtcaccggtctataagaggcccctgtactccttcgttgtttctttgcaaggttcagtgagtaataaagccaagatacaggagcgatcggctccgcggcgttcgtcgctgtaaaatccattgttcatcgtctccctcaccggcgtttgtgttcgtgagtgtgagagtgttcctgggctgagccaacagtggagtggcggtggtagcttgtgacagtggctataagagaggggagataggaaaattggattcggtgggttgaggcagtgatgtggtgagaggagaaaggaagagggttaccggcagagaagattgcctggcaatagggattggctggacatggcagacagaggagagctcgaagagattgatgcatagtggggagaagggatgtgatgatgatgaaccgcagcagcagcggtgcctacggggaggaaggagcagagaaggttgcttggtcggctaagctgagcgctcgtgctcagctgtgcgttagagctatgcccgtcgttcatgctcgccgccacgtcgtcacttccgccccttcccccaatagcgatggggaatggaggagagagaggggagatggggaatcgctgaatcagagatggggaatggaggagagagaggggatgtaggccgctgcagtagttgtagcaccggagttatcttcgtcgtcaccgccgccgccaccaccaccaaaccagccctgcctccgctggagaagggagagaaggagatggacgcaaagctacggaggtggcacacgcggacggcgaggatgggcctttcgcagctgacacaaaggggacgatggccaccctcgtaaccgccggcggctccaacacggggattcagttcgctgttcgcgtgcttctctgctatgctcaccttgccttgcttgcaacaccgctgcaccaagctacaaccacttgctcgctaccaagttcactttaggagagagaagagttggctgctaatatatggggtccaagtgcgctccccacgtcagccaaaactagtcactgtactgtcaagggatcaaagttaacatggtattgtaagttgggggatgtgttatacctagtattcggttcaggaatgaattttagacttggcgacaaatttgagggaccgaaagtgaacttattcctggttttccttcccgaacgtccttcctgatgcaactctggataacccagggatcaacaacggttgggccaagccaggccaactccataaacagcccaggcccatcactacaacaaccagcccacaactgttcgtatcgctgtcagtctgtcactcacccaaaaacagaaaaactgattggaatgataactgcggctattcccgagctttctcaatttttaccaaagtttatcaaacccaccgaatctcgttgaactttttacccatttagcgtacccatcgattaggtcgataaccacgaaaccggaggaaggttttcgtcggttttggatcaatccttttattgcaaataaaaacgcaaagatgcatgtaatgatgcaggcaccaaccaaaactgttgacaaagcgatcgatcgatcgacaatcgacaggcaccacctgtcgttctcagggacgaaaagaggccgaaaagctcagcggcgaaatcgaccgcgaatctaaacattctctagcggcaaactgagacatgccttgggtgctcccatgtgcaggtgacaaaagaaaattaagagcagagcaggagctttgatcattagctcacatgcatagatcgatcaagcgaggaacatattcatggtaccttccgtggattcatggccccatatatagaattcgcttacaattttgctatatatttgtcgacaaattttctcccaaaaatttgacagatgtaattacagtacaaccgtagtataattacactgtaactataatataacttgtatgtaactttcaaaaatctctccataacatattattttggtaaaataaaggttgtgggaacaatttttttcagatatgtgtgtactgtgatttttttcttcctcaccaaaataaatctttataatagatctaataatttaaaattacgtgaaacttacatacaaattacactgtagttacatgcaagttacagtgtaagtacatacaagttacagtgtaattacactacgattgtattgtaattacatctgtcaaatttttaggagaaaatttatcgacaaatgtataggtggtcccttcgcttaaattaaaagctgcttctaaaccttacaggatgaacactcagaaacagagttagttttctctccgtctctaaaaagagtgaaaatgaagcaacacgaagtttttagacaagagaaatgaaaatggtacgaagtctcacattagctaagggaaaaggaaaacaaaaataggatgtagagtgagacctagcgccaagatctgaatccaagcctaagagtaagatgtagagagagatctagctccacatgcaaaataaagctactctctccgtttcttaataacgggtaattttgactttttcgtttaaattttgataattaattgcccttaaattgttagcccaaagcgaacaaatattttacttgtatttagggcataccctactttaataacatatggtatcatttttatcgtttgtaaatattaaaaataaattgagtgattaaggtttgaaaaaaaatagtgacttagtgtcacttattatgaaacggactaacggaggatactgcaatgtaagtccatctatacacctgagatggaaggaatctagggtggtgtttgaatctcccgaagatgaagatgaagatgaacattaagtgtttcacgtaaaacgaggtggtaataacgtgtgattaattaagttttaattattacaaacttgaaaaatggattaatctgattttttagaacaactttcatatagaaagtttttacacgaaactcactgtttagcggtttaaaaagtgtgccaccaaaatccaaaacttaatccatcctttttcagaggaaacttaatccaaaacttaaacgcacaaggctgactatcatacattaccagtttaaaaaggaatcaaatcctgactgttttagttgccggagggagtatctgacacaaaaaatcaaattgggtaaaaaatcccatgattgccgactccaaaatttcatatcctcatagaaatggagagaaattttatgttttgtcattgataactatctgatcctacaaattgctaaacttaagttatacaaaataccatcttacaaacaccccccctcctcattttgcaagactaataaaaaaatcatttggacaaatgtcatcatactaattgcccaaactatccttaggaatctcataaataattgaatagtagctggcaaaacaactttctatattctacagagtggtcttaacgaaaggtgggggatggtttttttttataaagggtatgtttagattgtagttaaaataaaccttatcaaattttgttggtattgccaaattttagcaagttgataatattgtaaaaattttagcaggattttttaatgtatttactaaagtttggccacaaactaaacgtagacatatttttgacaactatgccaacaaatggtatggttaaaaatggacctaacggctgtgataaaaaaaaggaaaagaacatttgttcaatcgcatttacatttatcgtttacaatttgcagagtcagtcacttgtcgataaaaaagggtaaaatttctcaatttgtagccctgaactttcatcaaacttctgaaaactaaatataaccgttcaccattcaaccatcaactagatttagggtccatttttataatgtgatacttgtgtggtaatgttagtcttaaatacatttcacaaaactacatatattttgataaaacaaatcacaaaactgatttaacaccacatttatcataaaactatatatttaagacattgtatcataaaattacaaatttagtgataaagttaagaagtacagagtttagagtttagaatccatagcactattatttttacaaagttacaaaatatgtagttttatgatacaataacttaaatccgtagtttcgtgaaaattttagtgttaaatctgtagttttgtgatactcatttttcaatctatagttttatgaaactataatagtttgatcaatgcgttgtcttgtttcaaagtttattatggtttgattttagacgaattccaaaggtactaaagtgaacgtcctttatttccaagtcccattatttcgcttattcgtatacttatacgaatctcttattagcaaataaaaaatatttatgagtaaaacctatatatttgtgtccttagcggcttaaaaaatgcaaaaaaaaatcaaattcaaaatcgagttatataacttaaattttgacttataaccataagaaaatgggttaattggattatgccattacaaatttgcctattcagaaaaatgtcattatcatagccgtgtcatttgtattttacaaaattagaaccgtaccacttccatcacattttccatctatccccttccttttccgtcttcttccttctttctcccatcttcttccctccgccgctagctgcgcctttcctcaccagtggctgtcgcctcccctattgcctaggcatagcgacagcgagagctgaacctggtcccggcccaacctcactggctactgccgcctcccctatttcctaggcacaccggcgctgcgttgctgcaagggggtggatgtagacagcgtgaagccggcggaatccactgagggagagcacaacagccccggagctgctgcttggaaaagccaaggtccgcccactcccgtacgcgcatggcctcctagagccgctcgtcctccacgagctaccgccaccaccagctcacacacaccatggccgctagcatccgcacctccgctcatcgtagcacctcaaacaccaggtcctccccaagatcccagaaccctcggttgctcaccctctcctgcatcctccggaggctactcttgctgctgttgttgttgcaatggcggctacaagtaatgggggtgaaaacagggtgggtatttcccgcccgcccgcccggccacattatttcgagacaaattcggatactcaagacttttctcggacatcgggtccgaatgcgggtcttttttggcggatacgagatcgggttcgggaacatcgtatccgacggatacaaattatccagtaaaaaatccgggtattacctggataattatacagatattacccatattatatttttgtgaggcactttttggtactatttattggttctactatgatgtattgtaccatatttattttctaaggtcataatagcctaatacaattgtattatggatatatggaattgttaaatggttattgtctatgtgatatataagattgttgctttgacttgatatccaaataaatattcgtaactgatagtgtacgtatctattttggtacgtattcgttccgtattttggcccgacattacctgagtttgtatctatattcgatactacccatgtccggctctattccgattataaaatatgggttagtatatgggaagggtgagatccgaccgaacctgacctgttttcacccttagcaaggaagaggaggcctcaccctggctcgaattagaggacggatcagtccactgcctcttggctggctcgtcggagccgccatcaccagcaatcggagcacggggctcatcaccgcctgacgaatcagagcaaaacttcatggtgcctgaggagggaagaagatgggagaaagaatgaagaagatggaaaagaaaggagatgtatggaaaacgtgatggcagtggcacagttctaattttgtaaaatttcagtggcacggctatgaataaataaattggaatggtatttttctgaataaaccaaatttgcacgaattcaaataaaccaaatttgtaatggcatggatccaattaaccctaagaaaattagcccttctgcaattaaggaacagcaacacgcaattgtaagatcgaatcaatggtgctcccgacggaatgtatcagaacaggtcttccagaaagatgcatcatccctccccctaagaagaagaagaagatgatgaagatgcatcagaagaagacaattgccagctgatccgcacaaaagcagcagaaaggaggaaggccgggccgccgtcacaagtcggcaaagctcagctcgtacggcaaacaacaaagagagaatacgtaccttcctatctggtacgagtatttcatgccaatcgttaattatctgctagctaaactaaacaatatattagccccttctgacctacctagtactactactacctcccttgcttttgatcatccgtttaggatctcaagttattcactgacaatataataatccattctctttctgttgttttttttaaaaaaatttacggagtaaagacagaagggaaaaagggaaggagcaggatttggcctacattttggtgtgataggtctttgggtgcatggtggcattggtccctcaagaacacagttgcagggcactatgtggactgtaccctaaggcacagccagcaaaatgcagatggtcactctgcactgtctgtctgatgaagggccaattgaaccttagtggcgaaggcttccaaaaagtgtacctgctgagattcccttaggtttggctatgatgagttaatggaataatcaggggtgcactggttctatcatgagaatttgttaatttgaattttgagggagggaactttgctttatttatttttgtgatagataaacttacccaaatcatatagttgtgttctttcagctggaaatggtgttatgttttcttctgtgagggaggtgctcaatgagtttttatccttaaatgacatttctttttggcaaatattgaataagaatacatatcctatataggtaacacctccttatattaaaattagctcaattcaatacattacatgtcactgagtttgtcacaggtttacaatttgcctctgactttatcacactctatgatatgccatcaacttttatttaacttctacatttaccatcgtcgtccggttagtctccgttaatacttacatacccaaatgaccaaaatacccctaggacgaaaactttcaaaatttggacaaaaattccaaaatatcatattataaacataagattgtaaatatccaaaatttggccaaaaattaaaagtatgatatttcagaatttttgtccaaattttggagttttttattcccaagggtattttaatcatttggataaaattataaaatactaatagaggctaaccgggcatcgatggtaatttgtaaaagttaagcaaaagtcgatggctcattgtataacatgacaaagtcgatggtaaattcagatctatgacaaactcaatggcatataatggattctgtcatcaatgtaacaccaattatatgctagggtaactcaatttttcaacatactccctccgtttcacaatgtaagtcattctatcatttctcacatttatattgatgttaagtattatatatggaaggagaatgtgtcacgacgagagagtatcacatgctagactagtgtggcgcgtgttattgggtgaacatgtcttatttggcatcccatttctatatctcttgtgcaattagtggtagatccaaaaattttctagagcctaggcatgggcgtcattaaactctgaatctctgatggcaaagagtgcctgcttgaatgtatcaggcctacgagctcagcctaatcttcaattccaggttgaaagactcaaattattcatgaaactcgatccgttggaacgtaagaacttacaagattttcataggatttagttcagttcttgtaaagatcatccgaaaatccatgttgatccaaaaagggccttgaagctcttagttaatttccacattattatctaaaaaaaagttaatttccacattagagcttcaaaaaaattactaaagattgatgctttaggcttggtttagttcccaactttttcttcaaacttcgaacttttccatcgcatcaaaactttcctacacatataaacttccaacttttttcttcaaactttcaattttagtcaaactttcaattttaacgtggaactaaacacaccctcagttgaaagtttgaaccagttgttttgagaacaccctaattaaactttctccatttaaaaccaagggtttcaacagaattgaaatttagtgggaaatcatttaaatcgatatatggaagtaacaatttcgggttggagagggtgtgcttccgccactatcatctggcacaaacagtgttgtaaataaaactagcacttgctaagattcaggggctattaattttatcacccagtcctccactgaagaacaatgcaattaagctgaatcatacatacatttcaatatggcgccaccggtgaacatggaaacaaatagtctttgaatagcacaaaagtatcgaacccaatgacaagaaacaaagcaatcactcaaggggagcaacctcaatctagtacagttgcaagttgcaaactctctacaagcacaagatatttttcccacaaaacatcaaaagaaacatgccaatccatgaatagctcagtacaaacttttgcacgagagctagccatgcatgcaatgagacatgcaacctataattgggaccatggcacaactcacagccatcataaacttttagagatgatgttgcattgatgttggtgccacactttagtcatttttgccaattaagcattagatagatcctcctttgctatagatcacttttgctttaatctttcaccagccttttgatgtagtaataagttactttttcctcttccctgtaatcctcctctcctctccttttctctcagtgcccataattctgctagccagctaccatatgcaactttttccatccatgtgatggtgaagcttcatggaagaagaagatagaagccatcacccctatatatacccatgcaaccctacaaaacaaactccatgccaaaacacatagatctccattgcatgcatgcagtacattgctagccacagctataacccactataggagattattagtgcacaatatcatcaacataattgtgtgattttgtgccaagtaaattgatctgagctgcattcaattggtggttcattgttcattttggtttagaagatgaagaaggcgtccaggttcttgaagggtctcttgtcggccatcgtggcggcggtgaaggcgaggtcgcggcggtgcgcgccaagacgagcgccgtgaggacgcgcctcatcgtcttgggcatcctccgcaacaagaagctcctcctcagcgccatcaacaggaagatccacgccatcgtcagcagcggcggcggcggcggcagcagccatggcgagtacggcggcggcggcgagagctatggcggcgagcagcagcagcacctgagtggcatccaccttgtcggcggcggcggttacaggaaggccgccgtgctgcatagcctgccgagcttcgtggtggagcaggagaggagcgccgtcgtgctgctcagcagcctgccgagcttcgccatggacagggacgtctacggcggcggcggcgaggcggaggcggaggaggagcaaggagtgggtgggaagcagcagcagcagtcggtgatcgagctggcgcgcggcgcggccgctgcggaggcaggcggcggcgcggagttcaggctggaggacgaaatcgaccacgtcgccgacgtattcatccggaggttccacgagcagatgaagctgcagaagctcgagtccttcaagaggctctgcgagatgctcgacaggagctaatttaatttaaactaagccatcgatttagtgagaatttgcatggtactaaggcagagtctgagggcgtaattagaataagtgacgatggaactatatgtatgtactcatgctctttcgttttagaggagaattgatgtaccaacacgagtcctaatgaaggaataagagatcagactacttttttttttgggaacgtcaaaatttcacacagaacacttgctcacattcttctaggaatttttctcgcgtgctaaatgggattttagaacatttttagcctgatgacaaaaatgatgtccgagctaatgagctagtattatacagtcgatcacatcaaaggattcttaaagattaggattaactattctgcagaatgatcatggttctaatgattcctttctggatgtgttggctgtgatttttgttctattcgatggtgtttgtaaaaagggatatgtaaaaaagacgccgtctgcttgaccactcagtttacactacagaaatctggacactttaactgttaaggaaaaagaactgaatttggtcggtaaaggggttactcaaacatgcatcccaccacaaaaaagtcttggcttggatagaaacgctttacacaagaaacatatccgcacaaaattttcggtgcctaagttttacaaaattacaaatctcatcaactctaaactgaaatatatcttgattattttgcactaacgcacactgaatcaagagagatggaggactgaaaatctggcatgcgtccgtttcagaatcgggcaaattccatatgccagcagaatcaatccactgattccaaatcccagtccaatcttaataaagttttgctatatttctgaggcagcattacatcagacttctgataatgtagtgaaatcagttacaaaattcaccaggaaacatcactctagtaatatcataagatatccaactgtacataacacagagcggcacaaatgcacaagtacttttttccgggaaaatgcacaagtactacaatgatatgtgcgggtgacgaaaaaaaagatgtcaactctactgtgtttaatagcacaatctgtacgtcctgcaagttagaaatagaagaacggaaatttcagatttcatatctgaaagtaaaatgacatgaactccgtagggatttaaacagaaataaatcagtaaagaggatccttctgaaatttggaaggaaatgtctatacatatgactagcgtgtaccatttgtgtctgactagtgcaaagctgctacatgcctaggcccacatgggaagatgttgagagtgttgattggtggtcggatgtgagtcctacagcttcagtcgtacgtatagcagaactcaatttggaattactgaaggatacagaacacaaaaccaagtattaccagttgtttttctttagtgtcagaaatatcaacgttgcgccatcttattactgtttaaatccacccctttgcttcacttttgaacggttctatcttgaaagagactgcaaatccttcatccattcccagattaacaagaaaaatagcagcagagaaccagaaacagtttagaattttatactgttatgcaaagggaacaaaagagaggttgagaaacacaaaattgcaaaagaataaagccaaaacttcagtttgaaagagaaaatgattgaactgcgtggtgatttctttagcataaaaggagctaaagagaccatttaccattcttctacagccttttatttcggttttgaattgcaatatttacttgcttgagacttacagagaaaatcttatatcaattcagcgatttgcttctccacaaaactacaaaattgaagcagccttcacttataaacatattcaacagaatatgaacatactcataagataaaaaaggccattgtgtttaggttaactgtaaaatagaggggaaatattttgagtaaatcagaactagattattggataaatatagctaaagatagttcacaggaggcataatacagcaagcgtacaaagaaaagtagaataacaatcgaagaagtccaatgataaacagttaagatttgatgaaatatgtaacaaaatagttcatattgattgattttaactaacaacaggagataagtcatctgacatgaaaaatatatatttcagatgaaaatggttttaaaatatacatttactggctggataactaaagcatgtttacttaaatacgaatggcatggaaataaattcagaaacctagcaagaagaaggaaacatgacgctaagaagacacaatcatatatttttcaacatcatatgatgtaagaaagcccaacgatagccaagctcagatgttgcacctttgctctctagttactagagttcaattcccataaatctgttttctttttttcttttgttgattttccactgttgtaagaccttacaagagtacactagccaattgttcccaattcccaccctcagaaaaaataactgtacatgtagaatttgcattggtaagccatggcatatgaaattatcaatcaatgtgtcaataattatagcacgtattcattgggacccccagtatcatttgcatagcagtcttcccttttttttaatctcattttgtcgatttcgataagtgctattcacatgattccaaaagatgtatgtctcggatcttagctaagtagctacttgaaatgtgcattcattcaatcacttttgtttacctggtactaataagtttctacatttatcctgcagacatgacatgtcatattatcgtatccaaatttcagattatgattgcttttggggtacctgctatcaaggttgggaaacatttcaggaacttcgaccattattcagatttttgtagaatttagctccaactgacacatattttctttctctcaccaaaggccattacaatatcaaagttgtaattttaggggacaaaaagggaataaaaaaccatttaactttaataagtaaggtttggccttcaaccaattaagagataatgatgcaagggaatcatacttgtcaatactgtttaaaaaaacattggtggaatttgctgttttaacaggaacaaaaatttcacctagtggtaatataaatacaaaacctcaaaaaattagcagaggcgcaaagcagagatagatgatccacacactagtagtacagtgtgtactaatgaaaaaacaacgtgtagtgcctgttctttatatgaatactagtttgtaagtatgaactatgaacagcataactacaatcagtatctcactatctcctggagcaggtatgaggacatgaacatgcactccaatttcattcaaatattttacttgagcaacatctacaagggaaatcagataccaaaggacgagtaatttacattgtttgtggaatgcactcatgaattcaggtgtgctatgctgagtacgatacttgaatgtcaaaagcctaatatacatgaattcaggtgtgcaaaccaagctttagagaacaagaggtttcagcattgagtgtactgttaacagggaccattgatatttcattgtttgccaagaaacgtgcttattcataagctattgctagagaagattctaagttctaaataaccataaggaagacggcaaactttaggagaacaaataagcaaaaaggtttattttcaagctcattacagtcaagtagttttaatgttcaaatcattaaaggacacttttaagcctgtggttgcagtatcagtgttatatatataatattaaataagtttacaggaacataaattttgtaacagtaaaattcgaccgacaaagtctcgggttgtggtgcatactttagcatggagtttcttccaatgctactgaacatcatatttcttcataacccttaataggttattcctaaatggctgcactagtaatggtaaacccaactctacccaattgaacaagttcttgggccttttgatgtgttaaatagtactgaaaatctagaagagctaacacccagaaaaaaacagcaagagatagaacagaaacaacacatgtacaatattccttagtacacaccttgcaacagtgtgcataacgaaaggtccttgtattgtattatggtgttgcaatgactactaaaggtagcaagaacacacatgaaagaagtgtaaagcaatttacaatccttggacaaaatcatacctttaacagggcttgccaaatatgaactatgttcttcttctagagtggttggctggccccggtgcaccctcaaacaaatcagaaagctgactttcaagtcctctggggtgtattttatatatttccctgaatttcttcccccatccacttggctaccatatcttcccaaaaaagcacgatatgccggaataacattttcagatatggatattttcagctcttctcggagctgaggatctggaactttccaggttgtttggttcctgtatatttcctcaaaggccaggttgaagttcttgaacttctccttgatggacatccgagaacttgaatgcccactgccactgccgctgctgctgccgctcccacttccatgtccatcatccttcagaaaagataaaaccttcatccaggaaatccttaggtagctctttgaatactgccggatcttgccattacgcctttttacccagtgatcacctaaaatcttgccgagctcagagtccctcaccttttgaacaatgtacagcaaattgttcatggaaaatatgcactccagggcgctatcttcatacagcttagatttttcctccaagttagcctccaaataagatatcagcttcaaaaggcgctttccaagaggggtcatgctctccaagtgttcctgatcctgatcctcagctcttgccaaatcaatttggtcatcggcattgtcatccaagagggcatcaagtgtgtcgctgtaaacaaccagaagcctcaaatagttcatgacgtagcgtgtcatggggtggatctcaccagctgtcattgccctccgtgatgactccagctgcaaaaccttcccaaactcgaaaagtgtacccctaatggcatccccaagcctatcaagattcgcctgaacatcgctgatcacaccatccccagaactgcccaagcacaaatccttcatctcagggatcacctctgcaagtgcctcatacatgtcaagaatccgcgagagcttctctggcgagcggggacacacagccacagcatccccaaagctgagaatctgcataatacaacctttggttgattcgatgaagcactcctccctgagctcatcggacacactgagcacctgatcgcagaggcgtcgctcaccagcgagcaggacacgcacgaccgtcttgaccgcctgcacccacttcttcatcttgtcattcaggtgcttccactcgatgcgctgcacctcgtcaatgctgaggcgctcgacgccgagcgcggagaggtactcgtcgagcaggtcacggcggatgccgcagtacgcgtcggcgagctcgcgcgagtacccggcgcgcgccatccggtcggcgatggcgcggaggtcgtcgacggcctcagggcgcacggggtcgaacacctggtcctcgaaggggttgaccaggggcccgccgcgcgcggtctccggcgcgacgtcgatgctgtgcggcgtggcggcgtcgaactcggaggaggtgtcgaggtcgtccatggagccgagcgagaggcggcgcagggagaagaagaggcccgtggggtcgagcggcacggcgtggcggaccatgaggtggcgcagctcctcctcgaggcgcgccatggcgagctgcacggcgaccccggcgcggcccgcggtggaggaggaggaggaccccgcgccgccggcgccgccgccgctgccgcgcgcgaggtgctcgatggccacgtcgaccgcggagaggtactcggcgacctcgtcctcggtggcctcgaagacgagcgcctccggggtgccgtcccagacctggatgagctgctcggcggcgtcgaaggccgcggccgagatctgcccccacagggggttcccccgttcgtcggagtcagcggcgaggtcgggggaggggaagaggtcggaggtgatctgggagaggcggttgtcgaagcccgagaggatgcggatcatgtcgtcggcggcgttcttggatgtcgccagcgacttgacgatgtgctgcgccgcggcgagcaccttgtcgcctccgccggcggcggcggcgaccggggactccggggggggaggcgggggcgccgccgacatcgccgaccaatcggggggattcggtggggaggggagcggaggtaacttgggtgttacgctgctttgcctagttgccttctctgctttgactgctagtgtgctagtgcttggtgttggctggcttggatcgccgaatcgtcgggtcgggtcgggtcgcgtgtccgaccggtcgcactggtggtggactgagaaggcgagctcaacgctcaacagtggcgatgattttttatcttttggggttggggttggagttggacggccgggggagccatgccccaaggtcgtgtacagtggaccgacgaccactgctccactaccaccagcagtggccggccggcgtgttgccccctacccatgttgcgtcttcttctattcttcttgggtctcagtcttaaatatatctctcaactagatataaaacatcctccaacttaataaaccgtgtaaaagaggtccttcaataatattgtacctggttttggctgacttgacgtctgcgtggctcctttgactttgactggttcttcatcgtacgtggtgttgacgtgtcacttagtgacaattgggtccggaaaaacaataaagcatatgggcccacatgtcagttttacatacacaataataataaaaggtttccccacgtggccccacctgtcatcctcactactcccctcttctctctatcctctctctccgggcattggagcggggcggacagtggccggagcgagcgacgggcgggcaggagcagggcgggcggaggccgcatgaacgcagcgtcattctccaccagcaagatggatagcgcgacgctcttgatgcccaacaccctgttgatgttgtgttggatggccttcccgcacacccatgcacgtgtagtcgatccggttgctatcgtcggcaaaggtgaggcgcgcgacaacgacgtccttctcgaacgcgatggcgtggaaggaggagcgggtacagacaagcatataggagatgtcgtcgaggacagcgtcggactacgcctggtcggcgtggactagggagaggacgtgcatggtgatggtggccctccgcgcgatggtgacgttggcaaagggcctcgtggactcacgcttggacgaacgcactgcaattgaggttcggaaaggtagacctagttggagggcaccgcgaaggagaaaccccggcggatggtgacaaccccgtgagcttggatttggagcaggcagaggccagggagcgaagggtggcgaggatggaggcgtcagggcagagctttgagcgaagtgactcggcgtaggacgcatccgtggaggcccgcggcttcttaaaggcggagcatgacgtggtcgcgcctgccccaccacaacgcttcttctccgacatgtcgagagatttggggtcgtagttgcaggggtgtggggatagaagtcgaaggacgatgacgacgacgactgagacccaagtgggcagagccgctctgctccacccatcgccgctccgcccgctccgtgccactgcctcgctccgcccctgtgctctgtcccgtcaccacctgtcgccccactcctcccctctgccccgccccgttgacatcccgctccgctttgccagcctactccgcccactgctgctctagccactgcccgtcctgcccgtcgcctgctccagccactacccaccctattccactgatcggggagagaaagagagagcggatagagagaaagggcggagagaggatagaaagacaagggtagtgaggatgacatgtgggcccactggttttattattttttgggattcaattgccacgtaagcgtcacgtcaatgccacgtgaaacgaagacctaatcaaaggagtcacgtaggtgccacatcagccaaaaccggagataatgttgccgatggacctcgttagcattggttttgtaagttgggggatgcattatatccagttttgtggtctaggcatgaattttgaactcggtgacaaatttgagggacccaaagtgaactttttccttttcttggttccattttttttaggtgcagaaaaggaataagtccatttttccttcctcaactcatgcccctgattgaatcacacccctcaaccgcaaaaccaggtataagacatcccctaactctcgaaaccgtttgcaaatcaactccccggacggttttggaggcggttttgtcctatgtgccgcttatatggcgggttgacttgtcttcatccaatgtggcatcaacgtggtgcttgtgtggcataaaaataaaacaaacataaataggacccacatgtcagtgagcaaaacaataaaaatacatattggcccagagaggtcctaccctgcgcgcagcgcggccagccggcgaggtcctcccccgcgcacggcgctctggccggcgagcgagcgcctcccccgcgcacggcgctccggccggcgagcacctccccccgcccgcagcacagttggcaaggtcctccccccgcacagccgttgttgccgccctgcctctgtgcttatggaagacgagagaagaggaagagatgagagagagagagagagagagatgaggtggaggctgccgacaaatgcgtcccacctatgactcagcgaatcaactatcacatctgatgaaaccgcctacgaaaccgctcagggagtgattcaactaggggcatgagtagagggaggcaaaacagacttattcctacatgaaaaggggcctttgaggctcgggccttgggcctggtatgtcacctacatgtcatctttttaggttaagttcacttttaggtccctccatttgtcgctgagtttaaatgtcgtctccgaaccgcaaaatcgaatacaactgttaacaccaaatttagtaatattctttagcggatttggatatgtaaagaatacaatcagccaatgaaaactttatctaaaagagatcaagttcaagaattaatcgtgaagacacacggcagcttgatttatctattaattaggcagggcttactaattttccttttaatatttaagaaagtgtgtttagtgtcgaatcaggactctaaacagcctatgggcataaatatgtacactggggttattgtaaactatctctcgatcaatacaacttttggcacatcaccaccctctgttccgaggtttttatcaccggctgcatcgtttcgatctccggcgaagggataagtcctaagttccactggctctgttatcggttatattggtgttgttcaagactgcatcgcttcaatatcttggattgctatagttcaattggtatatttgcttacccgatatttcaattctatctttagttgcatcgtgtcagggttatgggtaaggtataccctctacccttcgatatatgtcacatatcgatatggtatacttgcgcgtatacggacgttttcggcatacgttaaggaaattcatcacggagttcacagatggaaggagtcctactcgtacggaactgggtcgtcattgtatcgtgtcgggtccgatgtctccgagtcctacttgaagaccagttgacctgcgatataaaaggaacccccgggaggacctaaggcatcgaatctcatagccaacacatccaccacagcctacggagttgaagcctacaggagccaagtcgccgggagatctaatcgaacatgttcgattatgatctcgtcggtatcatcgagttccgctattccctttgtaatatgtggtttccatcatataatcccatatcaactgaattagggctattacctatcaaggggcctgaaccagtataatttttgttttctgtttgcctgatgtcgtattacgtagatcctcgtaccagcgtaccccagtaccctttatatccggtctacgggtatcccccgtcgacacatcgtgtttagttgggattatctcggttaggtctaatcttctgtcttagccgacatatctctatacaatatctatcactttatacatgatttattgactttattcgatttatttgttgctgtaaacttaatgctgtatcagtttgtggtccgagttcgacctatgactacacgcacctcggccgcccaccggcatactactgcacgcactgtgtgtgtcatgagcctagctagctacggactgggagaaacgtactaccatctcccaggcgcttgctcatcgcactagtcgattgcttacatgctgtgttgaaagatcggttggtgtggtacgcgtatgtgtcgcaggggaaaacattggatcaacgctcgctcgctcgcacgtttctcgtaagaaaaaggtgaggtgtggcactggcaggaaagcggcgtatatatatatgttaggtggagctagctataaggaaagaacagctccatcttttcgtttatacctatacttatcagctaaaatttaaatttttaatcttaaatttaaagttgattttgagatttttttcatcggagtttatttttcagtctttgtttttatatcgctaagaacacatatataaaagttttattcacaaattatgtttcgtttgtaaatatgtcgtttgacttaataagccaaacgatgagaaccaaaattgtcgggaattatttaggttattattttttcgtggccgttttctagttccactgtgtgtttggtgtgggtaccgcgtgcagtgcgtgatgagacactacttcgcaagagttccatctttctgcccttttattttacacgcatatattttctgaaatgctgttatacagtactgttttttaaaagaaatacataaataatcactttaaaaaatcatattaaaacatttaaaaaattttaaactgatatttaattaattatgtgcaaatgagttagttagttttccatcctctgaggaacatcgttccatggactgggcccgatggcgagattaatttttttttctaggctgggatcgagacaagcaggaaaggttatcagcgtgtactcactaaacgcgaggttgattgcgtgatccatctttgcttagggcacccgtaatagttatctataagctctttataaaagatccatgtcaacatatttttctatttggaagagattaaataaagaaagagagtaaagctatttactaacctgaagatagtatatagagaaaaacgagataatggattagagaattgtagaaacccatgtagacatactattgagatgttttactattaatctagtctattgctaagatcatgttttataaagagcaccttactttaacactgcgggtgctcttagggcacccgcaatggttatctatagactctttacaagagatccatgttagcatatcttcctacttggaagagattaaatgaagagagagagagcgcaaaactatctactaatctggagatagtctatagagaaaaacgaggcaatgcatagagagctatagatacccatgtagacatactattgaggtggtttactattaatctagtctattgctgagatatacatgttttatagagagcaccttactttatcattgtgggtgctcttagcagctggagtattcactatccgcagtttgccaattcatatcttccatatagcgtggctgtgttcggattccgtggatgggaaataatctctcccgcacggaaaacggagcgatccattagtgcgtaattaattaagtattagataaatttcttttcaaaaaggattaatttgatttttaagcaacttttgtatagaaacttaaaaaaaatacaccatttagcaatttgaaaaacgtgcgcgcgaaaaaagatggagagtggttgggaaacttgggtgccgaacacacccataacgctgatcaccctctctctctctctcgtctcatctcaaacgcgtatgcgccgtggaccacatttccccttcctcaacagtcaccacacagatacacaatgcctccccccaggttctcctcctccagcaagtacgggcttcaattcgccagttatttccaaccatccatgaaattctcatcaaacaaacagagagaaaaaaaaacagaggagtaaaatggatgaatctaccgaagccattatgtgaaaatgatgctactctattccactttgcttctttttttcccgtaacagttccatcttcatcttcttataatgcctcctcttaaaatagccatcacggctccgctcggctagcacgattaaccgtccagacttaccgtcaaatgtttcattaaaattttaacagttaaaaggattaacaatataatttctataagaaatggttgatatagttaagttatgttcagatttaaaaatctttatgtcttcgcaactatctacaactaaccacactactagaaaacacatttttcccaacgtaagggtctttttttcgcaggcggacatgattcttataaccaaataaccgcctacaaaaatataaatcggggtgaagttcgctgtccacttaaacggcacctacgaaaatcattttcgctggcggactacttaagcggcacatgcgaaaatagattttcgcaggcgaaccttatgtgctccgactgcaaaaatcgtacatacccaaaaaaaaaaaccacccttatcttctcctcccacccctcccaccactcaactctctctctctctccctctccctccactgactcagtctcctctcctctcctctcctctccctcactggctctcctctcctctcatctccggcggcggcggcggcaacaatgcgcgcggggcggcgcggggcgcgcggccggcggcgtctcccctcgccccctccctcccagatctggccggaggagggaggggggaggccggcggg

SEQ ID NO: 31606 - DNA, 16104 bp, Oryza sativa
cccgtggtacggcacaggccagcaggcggcgtctcccctctctccctccctcgcagatctagccggaggaggaagggggaaggccgacggcggcgacgacggcgtgaagcagcggcggcggcggctcccctcccctcccctctcagatccggccgggggaggggggcggcggcggtgcggcgatttttttttcgttcgtttttttgcattttggcaggcgggctgttgcctcgactgcgaaaatcatcgattttcacagtcgttgtattgcaggcggacctctctctcacctgcgaaaataagttttggccgcttgggaaaattggttttctagtagtgccacacatacggtcccaaccccgtaacgacgaagagaatacatatgtatggctataatatactgctctccgtgatcggaaccacgcaacccacgaatatgaattatatgattgagagtggatgaatcttgggccaaatctttgaccagtttcagagatcacacgaaggaaagaatatattgaaaccaatccaatatggatgacgaatccgattggaacggcaggaaagattggagccacggctattgagtattgaagctcgatcagtacgtcccctggttgtgaccttccttagataagagtgatatggggtctgtttgggggagcttataagatttgagacgcaactagttggtagccaatttctgagaatctgtaaaagctgggttttccagatagacccatgatatggtagcactgaactagtaggcagacgcacctggtttctactactactacaactacccaacatatcaacttgctttgtgctgatatcgtcgtgggcatacgggcgtatctaatatcctgatgacccagtggctaggcaggggatcaacgccgtcacacgcacgctacctgctttgctcaacggatccatccagacatcctgtgctgttaattccgcatgagagtgatctacatcgcgtgatatggggtaatttcttcctcctaaaatacaaaagagattttaactgggtagtatattttgaagtgtaaccataggatatatggtattgttttttatagaatcgagcaaagttctttcattcgccttaaaatgttttgattgataacattttgttagttttagggtgagtacgggacggcagttcattcgggatttgtatcccgtttgaatgggatgatacctctgagatatcgcccgatacgtagttaggggtggatagcgagccggctcgactcggctcggtcaagctcgttaggataacgagctggctcggctcggctcgtttgaaagctcgagctagctcgttaggctcgcgagccaacccatccaaaccatccagccggcagaagaggagggacctggcggctggcgatggtggtggtgggcggtggcttgctggcgcggcacgggcggagccctaggctgtgcgggtgcggtggcgaggtggggaggaagatgcggacggaaagggaggagttggggtcgacttggaggtccttggaggcgacgccgtggagaaggccacgcggcaggagaccccgaacgccgccgcgtcgtcttctcctcccgtcgccgcggcgagcgactgaagcttgtggtggaggagcttgaagcaactggagcttgtgcccgaaacgccgtcgcgtcgtcttcccctcccgccgcagatcacccagctccgtcagcgcagtgaggcggcggcagtggccctagcggctggtggtggcgaactggcgatgtgtcgtgtggtgcggccgtgccacgtgcggtggatgaggagtgaggagtaggaccgaggaggactagggttttgcttgcacttttgctgttgtctatttgtcttgggcttgggtctttcttttgtattgggctgggtctttgcggatgtctgatggagtcctagctcgttaaagctcgcgagctagctcgagctggttctttatctctaacgagctaaaatgccagctcaactcgttaggaaattcaaacgagccgagccgagcatgtcacgagtcgagcgagctaacgagccacgagctttctatccatccctatacgtggtaggtatcagctgatatcttgttcggacgggaaggtattacatgatacctatttggtatcggctaatacccaggtatcatcccgttcgaacgggataccgttctgtagcatttccataaatttaaaaataaatttatttgatttttaggaaacttatatagaaaacttttgcatgcatgaattgtattgtttaatgtagattacaaaacgtgctcatggagaataacaaatcaagtagccgtttcgagttgctattagaacttaaccgtagtgttgagctagtagtagatatactgcccgttcttaaattttttagatgatcaagtggattttggacaattgcatataacaaatatattatatattataaataacaagtagcgtaaaaaagttacctaaagcaacattgatgaagaaagtaaaaaagaaacgtcatttagaacggagttgcaaaaaaagatggcggcatattattgcgaaaaaaaatatatgtcggtttcttgacattctatagcccgggattcgtgctataaaacaatagtgaagcagcagcgagcggggaatgaaacccacgaccttaaaccatgtgtaccagggcagccagctcaatttttaacttacatacaatttacttttttttccagataatggaatataatcccggcctttgcttaaatagctacagccaattattacaccaattcaacaaaaactcatacctaaataaacaaaagcacacacaaactaataaaaactcacacaacataaaaaaatcacaaaaattttgaataattctatttgtgaatctacatccaaagttagcgagtagctgataaccattgacttaagattacgacatgcagctttcactgacttgatttcttcaacacactttagtagttgaacccaacatcagagctagtatgttgccttgaaaagaacctacatacaggatatagatggtgatttataaaaaccatatcatttctatacaatcatatagccctatttatagcagatgctccaacatacaattttacatataatgtgatgtaactacactatatttttactataattatatttggcatacatatttttggatatttccaatttaaagcatgacatatataaatgataatctatgaagtaaccacaagctaaaaaagaaaggtctgacgggatgatcacttgatcagctttctgtgtgctctcgtcaaagcatgataagcatatctcagaataatcagtcttttctctatgcgatagctacatcctctagagcctacgatctactagcttgttgaaaatatcaaacctcacaatcgaaggcagctgggtttcaagttaccatgggcgcttgtttggagacaaattgctaccgataatgcggcttgatgacactttgaataatggaacactgacagttatcttattctgtcatgcatatcacactaatcacttacacgtcaggagatatatataactggtctactggcttatattgtcttaccacttattgatgctgcgagctgaagctggtgactcggatacgccgtacgtagcaagcggttatccctccatgtgggctgaaacacgttttaatttgtatgacttttaaccttctaaattatttaaaaccttataaaaaattgtatgagctttctaccactactgcacaaacgattttcttggacagctacccttttaaattgcgtgcggacggtaactcggtccacacaggaaaatcggctcgcgaaaatgagccgattttcctatgcggctctcttaataggtccgcacaggaactttaaaaatttccctttttctctcctctcctttatccgctcagctaagtcccctcactcacgtgcgttcctctctctcacgcctcagtcctctctctctctcatgcttcctctcctctcctcactcctcactcctctctcctcggcggcggaccacggtgacgacgacgcgtggcgcggaggccgacaggaggcgggcagcacggaagccgggagcggcgacagcgacggcggcgcgcgacggcctcttccacgcggcggcagtggaggcgtgggatccgcgggcggcggctgtccccgcacggatccggcagccggccaccctccccccgcgcgggatccggctcccctcccttccccttccttccctccccagatccagtggagggtaggggcgttggcggcgggcggtgggcggcgcggaggccgggagcggcggcgccgatgggggtcttcagccggcgtcggcaacgggagcaggcggcggatccggcgtctgggagaccgccggcgacgggagtgggcggcggcagcgggcctcggctagggcggcggcggcggttggatttggggttttggttttgatttttcttttgtttcatctttttattttcccatgcaagcggctgcccgcgtgcgggtgaggtacccgcatgcaaaaatcgcgattttcgcagacccttcattacagacgggcgaaacaaccgcacgtgaaaatgagtttcgaccgcacggaaaaatagttagtgtagtagtgtactatattgtttcctttacgaaacacaatacagacgcatacatcatataaatgtgtgtacactcacccatatataacacgcgcacacacatctgttgacattttagatcacgactacggtatttgcatgatatggggatcattggtaacatggtatatgcgagattgagataaaagaggcagagacaaggatttttatacaacttcgggccccttattcatcagaatcaggtaatagccctgcttctattggccgaagccggtgttgctcttattcatcataatcaaacaagtacagcatttagcataacctatttagtcatcgttgacttggcggcatggaaaaccaacacgtagttgacgacggggtagtctttctccttgaatatgtactcgtcgagatcagagatagtgctaaattcctcttattggcctctgtaggcgccagattgggtatatctaggattatctctaatatcaatatttggaggcgtgcattggtgtccacgtcccctctcctcttatgaggtcttgtatttatacccatagatgtacccttgtccaagtagaactagggagaacaatatggatataatccgagtagtccttatagtttccaatagaactctttttgtaattttttatccggaactccttctatataagagatatgattccgtataagacttggtatatggtggtctcgccgagtttagtcgattactattgggtatgtgtgtatccataaccctgataacatcctacccctataaatgcctccaagaaccaggccctacgaacgcctacacgtacaccttaactttatgaggacatgccaatatattttgagattcatggagtcgccatggctgtaccttaaaaaatatagcagacatatcttgagattcgagagacattcgaggactagactgacataccttgagattcacgaagtcactatagataccttgttatcgacagatatatttacaactagtggtaaatgtaaacatccttgtcaagtctaaaatttaaatcatgatagcaggtttcatcatcagaaatctaacaagttgacactctcttgtagcaactattttaattccctttactttatgaattagtttgttaacaaagggtggggcatttattcaagtgaaatggccggtggttagtgaaagataaaaggatttttataatgactatacaaagttaattaaattaattaatataaacgagattagtctacctagaaaccttttaaaaaactgtttgttttcatacacgataacgtggaaaacatacttagggcttgctcagattgatgtcatttcaaatcatatcgttttttttagagttgtcaaatatgttcatccattattttctggccaaactttaataaatagataagaaatcctgctaaaattttagcaatttggcaatattgccaaaattttgtaaagtttattttagctacaatctgaacaaccacttagaaatcaatgaaactactcttttttttatcatatttcatatttgacctattttttttaaaaaaatcaacgattataacacatgggttcaaatttcttgaatggtggggaagcatcagtggtagttcaataattaagaatgtatgatccaaactaaaattaatatgtgattctacttcttatacagctactatataacgttttgaagtcctcactatcaacatgtgagataggcgcacaagtagggacggatctaaaaaaaatagtagtgaggctgaataaactacatcaatataaaccgaacctccagtcccatatcctatgaatctatggaaaaaaatttaatgggagcttaggaggatctccactgtcccgaggacggtagtccgcccccattgtgaatccgccgctgcgcacgaggaggtcaacataacttatttctttacaagaaaaaagaattgcaaaaggagtgagcaatgatttgtggcccgttgtccacgttgctgccgagtgtgaaaacaaaaccacaggggtagtacaatataaacaacacgtcagagatcagacacccacctctccacctccctcctctcctctcctatcgtccccacgcgcactccaacttgcgggcgatttgttttcccccgatttcctctcgtccgatccctccccatcacgaggccggagcgccaccccacactgcctccgctgctcccaaggtatccctcccctgccctgccctgccccctccacctccgccggatttctcagccggcgtagagcggagatccatcagtggtggctcggatttgttttttttttcctttttgggtggtgatttgactccaactttctcggaccgtgtcgagagctttgctccgatcttctttttgaatcgctttgggcgatctaagcgtagactgttctctctgtctagtccgcccattttgtttcggattggtttggttcgtgcctgcgtggtggtggtggtgggggtaggtgtggctatttgtttccaggagaattgggggtggttcggctgaatccccaagctctatgataggtggcgcccctgactggatgtccactaattcgcagtattcggatgcccgctaatttgttcgatggaatcacacaatgggtttttttacccactatcatgttgcttgttttggcacctggcaacgtttgttcttatcccttctgatttgtagactagagatccaaacattgtggttggtcagtggtcaccacacaaatatcaaagccctgtttttcaactcctccttgatcggtacagatttatgtctcctgctatttattaccaatacaaaaactacttcagtgattgtatttctctttgaactggtattacttcgggttaataagaagtatcatgtaatttttaggaattccaattcctgcttgataagaatcagtgattgtgctaaggctccagtgttgactgcaggtgattaaaaacacagaaaatggatggaactgctggctaacagtcgtcaaaatttatatggccataggtaatgcatatcgctggcatatttgtgcttgttaattatgatttttttggcttatttagcaaatatattgatatgtttcccattgtttctgtagataattgtgcgatgtgtgtgggaggtaaaggtttctacctcaacagtaaggagacttccgacccttcaaggaaaaaccattccaaagtctctcagtatcggatggcatttgatgcaccaagaattactaaaacagagacatcaaagttgaagaacctcatttcagcatcattcaaacccttgtctcttaccatccccataggcgacggtttccatgaattgtttcctgtgggtcactgtcatttatagcagataaagtcttatagataagccaaagtttttcatttctgttggctaacaaggggaggcaaaaattgagttgcgctctcaagagtgtacaatgcttacacttgttggcacaagagattcttttgctcagtcacaggcacaactttgtgctggcatgcagctcaaggctccaacaagggcgaaatattcccaaggctttatgcccataggagaatccgacgcatactgtgctctaatacctggcttacctgaagatctcgcaaagatatgtcttgctcttgttcctcggagccagttccctgttatgggttcagtgtccaagaggtggatgtcattcctcgagagtaaggaattcattgctgtaaggaaagaggttgggaagcttgaggagtgggtgtatgtcctgactgctgatgctggatcaaaggggtcccattgggaagttttggggtgttcagggcaaaagcacagccctcttccacccatgcctgggccaaccaaagctggttttggtgtggttgttctagatggaaagcttttcgttattgctggctatgctgctgatcatgggaaggagtgtgtttctgatgaggtttaccgatacgattcttgcctaaacaggtattgttggcttttcataggcatcaataagtctatgcgcagacaatagattttgctaatttaaagacaatcattgcaatttgcgaagactttaaggcttatattaacatgctccttgtaatctgaatacaaacagtacttatttacagaccatgaaatgttcaaatgcaggataataaccagggttttgatatttcgaaatattggactgacccatttgtgttatttgtaggtgggttgagctttctaagatgaatgtggctcgttgtgactttgcttgtgcagaggtcaacggtatgatatatgttgctggtgggtttggtcccaatggtgatagtttatctagtgttgaagtttatgacgcagaacagaataagtggacattgattgagagccttcgccgtccaaggtggggctgctttgcgtgcagctttgaaggcaaattgtatgtcatgggcggtcgttcgcgcttcacaattggtaacacgcgttttgttgacgtgtacaatcctaatgacaactcctggggtgaggtgaagaatggttgtgtaatggtcacagcccatgctgttcttgacaaaaagctcttctgcatcgagtggaagaaccagaggtcactcgcagtcttcaacccggctgataattcttggcagaaagtcccagtgccactcacaggtagttctagtactcgtttttgtttcggcatacatgatgggaagctgctgctgttctctctggatgaagagccctgctataagacactgatgtatgatcccgctgcaccaacgggatcagagtggttcacatctgagctcaagccaccaggattatgtctgtgcagtgtgaccatcagagcctgatgctttctggcttgtatcgccttaccatcatccttgtaggatgccatccgataccactatttactgcttacaatcagagttgaactctcatttccagtgtcgtttgctcaggtattttgatatcaaataatgctccagggtgcttatgctgcattcattcgattgcagcgttgtgccaggatgcactttgtttcatgtattttactgctagttgtagttcacatggttgttgtcgttgtactggacgatgaatagctgataggctgatatgcaactgtagtgtttgtggcgggcaaagaggctaattgtcagaaaagatttgtcagctcttgctgtatgtaaaccttgttgtctgaaacattgtcattcgctatttctgatgctctgtttttccatatgaaaagtgggttcttgcttctgtttgcttgaggaatccttggacctcatttgaacgccttctgcatatcctctagcctttgaggatccaaatgactaactttcaattttttccatgggctgcttgtaccattcacgcaagtttactgctagtggagttcaataaaaataagttaaatttctttctgcaaaaaacaaaaagaacacccttcaagtgtgcagctgcagagcgtacaatacaatgatactgtaccatctacactctttctgtttgaatgaaaggtattagctgcctttgagctgctttattagtgtataaatcaaaaacgacttctattttatgaatcagagtatctctttcttcccaaagaagaaccctatatataaatgtgacagcatcatgcgttcttcgtgaaagcagataaccacgggccacaccaatttcagtaggcggacggttgaccatttctagcttctcaggcactgtaaccacgggccacaccatttcagtgatgccgtcccaataatctggctaatcagttccccgtttgaacatcaaatttggcacttcataaattcatagtagctacgtttgttcattcatcaaatagtaatactacaagtctaccgtagaattttgtaggaattgcagtaccttagcggtatatatttttcaatgatcgatctggtactaactgtggtagttttaataagcatttcggtttcaaacgtttcgaatgttagacagcacagatttttaacatcaaaagaaagaatgctctctccgagttgacctgtgcttgacaatacagcagacagtaaaaaaaaggatagtactctctctgtttcacaatgtaagtcattctagtatttctcacgttcacattgatgctaataaatctagacatacatatatatatatatataatattcattagcatcaatataaatgtgggtagtgttagaatgattgtgtccccgaaaaaaaaaagacttacactatgaaacggagaaagtatatctgtaaaattggaaacctctggaacctccgggacaaacaggatgtcgaagtcaggtgaaccagaaaatttgcctgacaggtcgaagccaaaaacagaagcaatactgctcctcttctactctgcttcactatagtccattcagtattcctcttactctgcaagcgcgtgcaagcaagaagagaagaagaagaagaaggaaggtagcggcggccatgtctctcacgggatgcctccctcctcggccgccatgctcgatgaggaggagaaccagtggaggaggagcctctgtctctcctgtcgtggcgatggcgtccacggcagggtgcgctttgatccatttcattttcattttcctttctgtcgaccttgatctcgcctcgaattttgccgggtttgattaggctaaagggattaattaatttgctgcatgttcttcatcttgtatgttgaaaattgttgattgggagtttcacttcaaacaatttcggccattcgcccgtgctatagttgttgaactgcccccctgatctcgtcatctacattgtgtcatcctttgtttcgttctgaatttttcttgatcgtttttactggttgccttgcgcctttgttcgtcataggggcattggtcgtttttagcttcaagctgttctctctcttttctttttcctttttgcatgttttccttcttattgtttggttctgttcttttatattttcatgtgtacactagtaataatactggtcaattgcattatataaccaaaaaagttcttcacttcttcttatgcgcctttcctagataaaataaaatactgttcgcttgttctacctacttttagattataagactttttagcattatctatatttatatagatactaatgaatgtggataatgctagaaagtcttataatatgaaacgaatgaagtagtttgtttgattatgctagtttgtttgtcacagttcttctagtgttcaggacacccgcctgtagcatccgaaaagcatgaagtcctagagatacagttcagtaaagtgccactgccttcagactggcacaccttcctttaatttagttctagaaggggaaaaaaatagatttcacaattactgttgatttccacggccaatataaagtactacctctgtttcaagacaattgtatttctaccatttaaattttgttctaaaaaagttgtatttgtacaaaggtagaacccagccaattaatttgtgaatgctaatcaagtgagctaattgcttcggatcaccacattaaatatgtctgaaatttagttgaaatataattattttaggatgaaggtagtaaataaaatacagatggagtcagatgttcatatttagcctagtcatgccaatttaggtgataatttgaccagcttatcttacccaaaaaaaaaaaagtaaaaacgtgttactctctcatatagttccttttcactgcaagtgtaccccttcgtaaaaaaaaaccctaatcctagctacgaacctggacatatgcatatccagattcatagctaaggtttatctttttttttaacagagtagtatgcagccgtgctttgaagagagtacttgcttagcatctcaaccagggtttacgttaccaccggtaactgcgcggttaccgtgggggtacggtaatataaatgccacggttactgggcttaaattcaaataaatttaaaaaataaattttgcatggtttttcacggttaccgtggtaaccgtgcttaccgccgggacgcggtaaccccggactcagcagtttggaaaaccgtgatctcaacatgacaatgatttatttacagaaagattacctcgttgccatcatttctgtacgttctacttcgttttatatcatatgttgctttttacttttctctagtcgattttcttttaaaatttaatcaaatttataaaaaaactataacaatatttccaacccaaaacaaatatattatcaaaatatataaaatgttagttttgataaaactaattaacttggtattgtagatgttactatatttgttataaacttaatcaatcataaaagaagtttgaatggaaaaagtcaaaacaactaaaagtatgtaacgaagcgagcaatgattagtatcatctgtactgcatttaatttatcgtaaaattcactgatgtttcaacaatccaatcccacatatccagatgcaaaacattcggttcatatatcatcttgaccatacagtcgccatttctgaatattcttcctcctctgaacctgaagagttggcggcatcggcaaccccaccccgagaggcaagaagcccttcgccccgtggcgcgaggtgccaccccaggtgacccacacgctgccgccggagaagaaggaggtcttcgactccctggaggggtgggcggcggacaccatcctcccctacctcaagcccgtggaggagtcgtggcagccgcaggaccacctcccggacccgcgctcgccgtcgttcggcgacgaggtggcggcgctgcgggagcgcgcggcggggctccccgacgaccacctggtgtgcctcgtcggcgacatggtcaccgaggaggcgctccccacgtaccagacgatgctcaacaccatggacggcggggtgcgcgacgagaccggcgccggcggcagcgcctgggccgtgtggaccagggcgtgggccgccgaggagaaccggcacggcgacctgatgaacaagtacctctacctcaccggcagggtcgacatgaggcaggtcgagaagacgatacagtacctcattggctccggcatggtaagcatttgctccctccgtttcaccttacaagtcgctttgattttctttttctatttaaactttttaaagtttaattaagattatagaaaatattagcaatatgccaatatcaataacatccattgaatctgatattgaatatgttaaatctgatgttgaatatatattgataatatgtttgttttgtgttaaaaatattattatatttttttataaacttggtcaaacttaaaatagtttgattaagataaaagtcaaagcaacttacgatatacaacggagggaatattacatattgtatatactactataagattgctggtttacatttacagatttgttaataggacatgacattcagatgagatttggcggcatgtgattttttttcctctacaatttgctttgcgattcgtggtttagttagctgacatccatccgtgaaagccctgtaacctttaaagtggttaagttttagggttgagatcgaaaagttggaggagttcccttatttagagggcgatcacaatgataaagaaacaacagcggatatcagcagtggagaggttgcgaggttataatagcgtcaccgaagccatgtatggggaggaggatagtggaggcagcgagggtgtcaaggaattagttggttatgtagtggtccggtgtcgacggccgtaaaagatggagaagggcagttacatggaacattagagctagagaagatggagaagaagcaataacataaggctacagggaggatataggtatgaggagaggggtgtcatggtcttgcatgtctctttagcgcaagaggtgatgccggttgtgacaaagggtagtggggtgctaggtgacggagacaatatcttgatgtaatggtgtcaggtcgttggtagggccttgttaacgggtgttttaaaattcttagaagctgtaagttggtagctagcttataaaaatatagaaaaacttggtttttctagttttagttttcaaagtcgttttttgaattctataaatatatattttcagaatctaggtaagaatatgattgtttgaaggagttagagattttgggagaattatttctactagaagcttcttcaaacaaactaggttgagcaagcaaggtagaaggggataagaaaaataggggagttatccgaacagttcaatttagatcgtgatgtctaatggttagaatttcgtgaaattctcatgatccctaaaaagttcgaatattgcgtaggcattctggttcatttgtttactccctccggtttcattttaattgacattttggataatgacacggtctacgaaatatatctttgaccttatttttctattataatatatacaataaataaatgcatgtttacttttattatagtgctttgaaagataaatctataaatgttgttttagtttctttaaaccaaatatttttaaagttatttatggtcaaagttataaaagtttgacctcaaccttgtccaaagcatcaattattatagaaccgtagttagtactcttgtagctcatttgttttgttagttgagaaagggtcttttttttttctttcaacaaatgaaactgtggtagacatgaaaagcgatcactcacacattttttaagaagaaattatacatacatttttttaacaaataaaactgtggtagacatggaaaatgttcactgacacatctttcaaacctaaattatgagcgtgttaagaattaaacccgagacctcaggttaaaaccacaccactcgctgcagtgcatctagaaagttttactcaacacacccaaaatgtttggctagatttcaattcaatgttgtttgcttggttttggttgcaacttgcaaggatccacgaacggagaacgacccgtacatggggttcatctacacgacgttccaggagcgcgccacctccatctcccacggcaacacggcgcgccacgcggggcgccacggcgacgccgccctggcccgcgtctgcggcaccgtcgccgccgacgagaagcgccacgaggccgcctacgccgccatcgtcgccaagctcttcgaggtggacccggactacacggtcagggccttcgcccgcatgatgcgccgcaaggtcgccatgccggcgcgcctcatgtacgacggcgccgacgaccgcctcttcgcccgcttcgccgccgtcgcgcagcgcctcggcgtgtacaccgccgccgactacgccgggatcatcgagttcctcgtcgcgaggtggggcgtccccggcctcgccgcggggctttccggcgaagggcggcgcgcgcaggacttcgtctgcagcctcgggccgaggttcaggaggatgga

SEQ ID NO: 31607 - DNA, 3211 bp, Oryza sativa
aatgtgtatactttgtcctttgttgataacttgatatggtacatgaaagaaaaaaaatcatgcatgtggtgttggtttctttgatcactcttcattagcctccatgaatttctgaagtttcttcatcatgaagacaatactcatttctcacaaagtatcttacaactggcaaatttatgactgaaaattgtcgccagtgacacgatataaatagatacatgagtgagaatcaaaagccagattacaggtaaaacatcatcagcattcttcatggactagtgcaggatgctgagaaacaaagccaagataggaaagggaaactgtagaagctgatttatatacttagatatatatatgttacagacctgtatcgcattctatattttctatgcacctatattcaagcaaaggcaaagtatttccattatatgaatctcttcaaatattcaaatgtgcctttatatgtcaccaagaagaacaaaagggcaggtccagtgcaggatgtccagctcttaatctcgtcacaggatgcagcatgagcaggcctgagagggaaagagatcagtgattacattttcattatagtgttgcactgaaaattctgctgatgaattcagatttcccaactcagttgtatcaatctagtttatcactttgaaagacccaatgatataactaatcaaaagaatttaaaagcagaaaactgaaattgttcagattttaatctgccaagtacataagaaagcatcaaatattaagacttgttaggcaaaacatttcttttttagataatggaagcaaaccacttctggcatctacacccaaaggtgtacatagccaaaggtcaaacattccatggatatacaaactgcataactcaatttgcatctcttgtatatacctctgttatgacttctgggtgatcaaatattcaaatgaatttttgcatgttttgtagtgtcgatagtaattcatggctttgtgagaaacagagttgaactagaacaggggacaatgcataactccagaagtgcaatcgaaaagtaaaaccatgatatataaaattttcactatgttcattggtccttattatattccattagtgggacagcagaattacttactgagggactgcctaatgcatctttaagttacttcgctatatatctgtacacataaatctagcatattacaaaacaaatgcacctaaagatgccaagaaaaaatcaccatagtcgccgggagaattgaccataactccataagtaatcttataacctgagcaagaatcatactacaaagtaatgctcccatatggattatgtgggataagtcacaaaagatttgtcgtatagttagggacagcacacagatacctgttgcactttatgttcctgtcttctgccaccagaaggagaagatggtggttgctgcttgacagaagagtttggggtcagcttatcacgcctaaccctgttaaaaatgccggtgtacttctccccagatgccgcattagcatcatcccaatcaccaaatggaggtacagtcacttcatctaaagcctgaaaaagaaaaaaaactcagaatgcaaatgcactttattcagaaaacctctaacacacaatgtgcacatcatttctgaatttgcaaatggagatcgagatgaggtgaagaactgtacaggttcaaagcctctgcctccttgcttcaacctgctccttcctggagtcactgggacacggccatcagatgaagaggccttcctatctggagtctgcatcccagctgacctgtacctggaccttggagaggcagcagcagcagctgcaacttctctgtaagggcttctgggtgagccaccatagccaccatggtccagatgatgctgctgcagcggattggcgtgccgtctcgccacggtttcgcggtggagaggcgatccggcaggccggggatggccggtttcgggctttctttcatacctctgcctttggttcagggcatcatgagaggatggatgcagtggtgacctgagaggaggaggaggctcgatcaggtgtttcagtgatcacttcatttgggttggagtaaacaccggtagcagttttcttgctccttctcaggttctcaaacttctgcgtgtacggggtgtcgcctgcggctgaccagttcccgaatgtaggaactcctccttgctgtttggagaaatgaattagcaaacatttgtcatctaaccaaatcatggctgatacattgtcacagattctaaaaaaatgtacagttgattatagaattatacatttcaaattgataagtatataccccataggttgaataactttttgaagagttatcagtagtaacaaactaacaatactaaatcggtgagaaaacaaaagtctgaagggaaattactggaacaacaaaagggaaaaaaaatgatatgagaacaatactattccagtattctatcattaagaagcatgtgcaaacagttgtctccttgataataaatacacaatctattttacgaccccctgattttatcattatcctgtgttgtcaacttgtcatcatgattcatggatgtgccatttgcctttcatccatatcaagccaataaatccgtcgaattctttacaaagaaaaaaaaaacccaagaacatgaggtaatccagaattacattatactacctcccaaacacctgaaatttctgtcatagatctattgtgcaataatatatgtgttctaaataaaaccccagcaacaagaagatcgtttggttcaatactgtgatcgggtttaactaaccaatatgaataagatcccctgctttcctctgtaactactaaatcaatcgtcggtggagtaagaaacatcaagtaaaattaaattgcatcatgctacaagccaaaatcctcaataccagcatcatgaatattttaattccgggagcaaaaatcggaaataagcaactcaccgacgtcatccacttcaagtttgatccgaacactgatccagtaggagaaaactgctggtgctgaaggatgcaaaattttctgtccaagaactgctaatcaatagtatttctctcacaaggcactaacaaattgcaccttctctcccaatcatccagagctaccaaaatcaactgtagcgatatggcaaacaaacactaaggtatctttcattcaaaagaaaactactcaa

SEQ ID NO: 31608 - DNA, 7630 bp, Oryza sativa
acaaaaaaagaataagctccggcaagactaaaactacaattctcacaagaaagaagcaaaatttggggagaaagcaaactgaaacgcccgagagccagtggaagcaggctgcttcactcttgagacctagactgctagaacagctccaagaaaaagaaagaactcaaatttcttcaggaaaacacaaaaccactccccacaaaaagatcaaaccccctcaagaaaacggccacaatcttctcccttggaagaaaccaaaattgaacggtggtcttgcctgtgcaaatccctcaagaaaggacccaaagggccaaaaccaccttaaaatcaatcagagaaggcacatttctgctccattccgcagcacccgcaagtggtatatatacaaatacgctcataagtagtaagagaggaggaaggagaaggtcttgccgttgacaatgagacaacgccattgttttatttgaagccttcaaagtcccctcatcattttatttttttcttttttatttagtttagtttagaccaagctaatgtttctggttttatttaactgtaataggtgttaaattaatgagtaattggtttgcttttttttttttagtaaaggaaagatactaaaagattggttggaaggcagagttctagtctgcaaaattaatttggagacaactccattatcatgagaatatagacttttcaagcagactgcatatagtacataattaatttggcaatggcgtcatcttgaaatttagtttcgcgaatgtacctgtatgcaattctctccctgtttcattttcaattgttgttgtatttgtgttgaactttattggccccttgtctcagtttgatttcttaattggtagattatgcaacttaacaagaaatcagtttagtgcatgcaaactcaatattgcgtacttaggctgtgtttgataaaagaagaaagacgaaaattgagaagatacgtaaaatgagctgagccattaatgcatgactagttgagtattaattatttcaaacttgaaaaatagattaatatgatttttaaagcaaattttctacaaaatttttttttaaaaaaaacacaccgtttagtagcttggaaagcgtgtgcataaaaaacgatgcactttatctctttctctcgcatgaatgaacacaaccttacttactttagtactcttttcggtcaaaattgtttgacattttcacctttcccttgtctttgaggtgcgatttttaccataattttgtttctttatagatgtagtttttaatgcaaacttatatatgcttagctttatgtgttttcaaactaaacattttattagaagccattgaaaatataagcttacaccattaacaaggtgtgtagaaactatgacatgtacaaaaattaatatgtatacatacaattaatacatacttcccttagttaaaaagaatgaaataatctaggtattatcactccaatgtaacctttccatatatatattgacagttgaaagaagtagttcagattcatcatttttctgttttatatttatacacctcaaaatggttactgtgctttccccttatacaccccgaaacaaatagatatatatttctttgagtaaaaaatatagatattttgaaatgagctaagtattttaattgttgtctatatgcagttgggatgatttgtgctacttgactttactgatcgtccactcgcattaatttagctcatctttattttctactccacttgtgacctaatctaggttgcctgtgctctaacgtaacgtgacttgatctaagtagaaagcaaagaaagagacagcacgttacctgagcctgcatgcatgccaatatatagctaactactactactataactaattctcaaaaaaaaaaaaactactactataacttaccgtatgctatgtgtttgctggattctcctctgactttccttgctagaggtttttaaattaaccagagctggttccaggctgcatcattaattgggtcttgttttcttgttttgctcagaaactgaaactgtgtctcatttttttataacaactttcttagtctcaacggatatgattataatactatctagggtgatgaatattatgagtactagaactgatttcaactgttgatttataagttttacgtactatcagtagaaaaaaaaatgctactactagtagttgaggtggtagtataaatatacacaatccattaaactagcaaatatgagcagtctaaattgatttctaatagagaccattgtaaaaacacttgattgtgttgtcgttacttgattgcttatttggtcgaaaatcttggtttctttctgtcatttctgaaagttttatgcaagcttacaataatgcggctatatatgtgccccatcagattgatgcagatgccatgagggacttttggtggaaaatctctataacaagactaaatgtaagataaatttaatagatacacacgcgcgcgcgcgcgcacacacacacacacacatatatatatatatatatatatgaatatctatttgaaaaaatatttggctttgtaccttcaatttagttaatttggaggtagaggccgggttttaatctattttctaaaaacatctaatttgaaaaaaatgaaaaactataattatctttcaattatgtattatgtttcttatatctagctagtattctttttttctctagaactcaataatatatgaagggtttggccaagggggcttaggcccacatttgcccctgttgggattgtcataattataaatggataggataaatcaaacattacatattctaaacctagaaaaatagcctacaacaagttatatatctaaaaattttatgtatactacctctattaaaaaaatataagcatttctagaattcaaatgttttactataatataagcatttctatattgatccccattattcgaaagccaattagatgcttagaaatggaatctctagccattcaaaatttaaaaattgacaattaaaatgaacaaaaggaatcttttgacataatcttaatatttgctaaacaacgcctaattgttatcctaaaataaatcaacttttatacgacattaatctaaacaaagtgatttgcttcaagatatagggagtaaaaatccttatattttagaacggatggagtatatgagtagactgacctggcgtcagcttatatacctgggtttgggtcttgatcatagtggtatgcaggttaatttagagcacgtggtccacatgagaaaaatgctttacttccttattgtcagtgtcttcgtttggtcaatgcaagccatagcagggaaaattacacaggagtgtacttaagtcatatatatatgcatgtgattgaaaagctgaaactataatatatcagtcggtgtcatactgtcatgcatgcattgtagaattaaatctgctatccgtggattagttcaaaaggccgcagcgcacagttagggattaattaattttagtattcatggctgatgttgacaagttagaagacatgcttataatgcgcgcactagaagtactactcctacttgtgttttggtctcgtgtctgtttgttactggagtaaaacttatttagcaactataacaacccatgctatgtgcaagagaggggatgatttcttttgtttttaacaatgaaaatagtttgaacgatactactgtgttttctattggtagtattataataccaatagaaatgatttatccatattaaggataaattagtaatttattaatataataattatgggtaactttaacattatgttttttcccgtttagatcgatctgtggtcattatattgcgctggcatcatttatattccatcgaaaaagccaaaaaaggagaaaaggaagtgtagtcactacttaatgacaattataccctatcgcatctttttttaacaatagtacctctctatgtttttactaccgttaactgaggtggtggtagtacgaatagatttgcatccttccatctattaaatgagatcaatggttcaaattgtttcctattaccagtagagaccaccgtagtggggctcaaatagtttacaccgttagcctctactggctggcatagaatcaataagtgttaaagttgagaatgacaaaaatatattgagtgataggataaatccttagctcctctaaaaagatgatcacttgaataaaaaggtaagacatatcacacatattctacctagtagttctattgtatcgatgaactaactagatgttccgtgttatttccttttttttttcttcgatattatactcacccttaagctctaagacatggtatttgatcccttccagctttcaaatatttggttttcaagtttggagatgagttttagacaaagcgaagagtttagaggtcaaatggatttatgattatgccatatttttttcaagttgcatgcatgtatggaaattaaacctcatgatcattgttttattgatcgaattgtggttagataaattatgtttttaagtctctctctctctctctccctctccctctctcaattgtttgatagtttcatgccataaataatattatccttaccaaagtacattagaacgtaaacaattcaatttggcaaaccacataacaatgttaaaacgttttcaccaaacaaagttatcataaccaatgcaatataataccaaaccaaggctaaaacatccttataattaaccccagctcccaggtagagctaggtcttggctaattaatttaggggaggaaaaaagaagtataccgtccaaatgtaatgggactttaattcttccagaaaatcaaacaagcatgtgataattaatatgtcgtgacgacgagtcgacgatgtgcaacatacgtgttcctatgtactatacgtttcagacaaacatgataatttgcacgtttctatatcgtcaacccatcttaatatataattaaccagtaaaaacacacatgactgaaacgatcgaaatcgagcacaaagtcttccggtaattaataaactgtcattttcatgctggaccaaaatttctccatgacatttatgatctccaaaacgttaggcaaaaaccaacgcttaactgatcttcgatctccaaaacgtggtcaattgttgagagctgcaactcaattgcgaccgtagggtgacttgctactgcagtcatgcatgtgtgtgtcatcgttggtggtgctgtcgaactacatgctccccaaactcctacagatgttattgagttacatgtaccagctagttagtcaaaagattaagttgatgagtgaggaagaatataatgagtcaattcaattcaaacttatattgatgtgaaggaggacagcacatttatatttcaatcaacaacttttcttgtgtgtccattcaacccaaagttataagtcgataaggaaagattttggcccatgtaggagccggttcaacccaaaagttcaagtagattttataattcagtagattttatacgctggttaactggctatatatttacaactctagtggacctaggggcctaaccgccctaggaagctacttagactcactggcatactacctctatcacataaaaagttcatttttcagtatttggatacaacgtttgatttttcgtcttatttaaaaattttatgattaatattttattgttattggatgataaaatatgaatagtactttatgtgtgtgactattttttttaaattttcttcttaaatttttcaaataagaaggcttaaaaataaatttattttgggacggaggtagaagcaaaatggtaggcatatatgttgttggtggtccgatcgatgtagtgagctttgcttcagttttggaaatttcctgtgttgatttagacaccaaaatacaaaagtacagtaaagctctactattttgcatccttcgctataatccacagtttaacaatgacctgaaatagcttgccaattttcaagattctaagccaaatttgttaaaattgaccacgtgttttaaatggagtcgtgccgaggttcatacatgtttgaacactgatgcaaagtggaagagatcgagtgacgtactagtgtcgccaaccctaccgagaaaatttcaaccacacagaatcgatgaatcactggatcactctcatgaatatatttttgaaacattcagtaatactccgtatgttctactcatcgatcgaattatgaaggcactataacacatcgatcgagatacggatagccaacgatagcttaaaatatttgactgtaaatcagcacatgtcacaaaccagacgagaataatgattcaaactaatggacagatcaatgatggggcctaagaacaattaatcaagctcgatcaggtcaagtagctagtggtcagtaatgcacagaagttcgtgagttcatcttgttagacacggcctcgagagtaaaatttcggtaactaattaactatatttcctcagctcaagatatgactactttttttatataaaagatatggctagttggctacttatagaaattaagatttgttctaaaatataaaaatataaaatataaggacttgtagagtattattcatctaatttactcaatcttacttctaaccatccttaaaatttccaatcaacccttatttaataaagggcgtggagtaattcataatgttgcctgattaaaattacaagctactctatccattttatatatattataagtcaaacctttttaagctcgaacatatttacagaaaaaacagcaataattacaacaccaaattagtttcgttaaaattagcatttaatatattttgatattatatttgttttgtattgaaaatatatctatatttttctataaatttggtcaaacctgaaaatttgactaaaaaaagtcaaaacgatttgtagtaactcataagtcaaaacgattaggacagtaatttacaaaaagatggagtagtctataactattaggaaagaatcttgagaaaaaaattacaaatataatacttcctctgtttcaaattacttgtcaatataggttttacataactcataagtcaaacattttaatttttaaccataaatttctgtaaacccatattgttcaacattataagatttaggtttttagatttaccatgaaaataattttcataacatgtaattctcatgttaaactacacggatttataaaagttaacggtaaaagatacatattttaagtaatttgaaacggatggagtatcattggtttgttattttgagaatacacatgacctttatatgcagtcgcagagagagatattggagagcccaaagctgcttaaaatatttgattgtatctgcatcaaaacaacactaacatccccacacacacaagggacaattgctcatttgaccatgttatgaagtgtaactactaatttgaccttactttttaaactttgctcatttgaccctactttccaaaatcgaaactgccgtccgaccctctttccactccaccattagggtttttttaaaggagacaaaaaa

SEQ ID NO: 31609 - DNA, 5962 bp, Oryza sativa
ggcggcatagctagggttcggcggaggcggtgcacggtgaggacggcggcggcggctcgtgatgggagctgtggtccagcggcatcgacgctcggtgggggctgcggtggcggcgcacagagaaggcttcggctgtggcggtggcggcgggagttgcggtggtggcacgcggcggggctgcaacggcgggcgccgcgcggtagggactgcggagatagcgcttggcgcgagctgcggaggcggcgcacacagagggcttcggcggcgacggcgcgcaagagctgtggtggcggcatacgggtgctacagtggcggcatgtgagagtggcggacgaaagggcttcggcaacgacagtgcacgggtgcagaaatggcggcatgcaggagttgcagcgacgcgtaggtgcggcaccgacgacgacacgcgagtgagtgctcccgcggcggcgcgtaggagctgctcagctgcagcagcgacggcatgcgggagatggccatcgagctccatctggttagcctcctgggttttttttttttaagcctgcggggataccttaactacgttttgtgtttttcttggatatttgtacagtttgagattgatctactatctacttctacttatatatatatattactacttaaaattaaaatttttaagaaacgtttccttcgtccctttaataaataaaaaaaccgaaaaaaaaaaacaaaacagaaagagtccgattcccttggaaaaaaaagatcggatcccttaaaagggaaaaaatgtccgagaaaaaataccgtttaaataaaaaaaagcgaaaaaacataaaaaaaaatccgactcccccgatggaaaataaaaaggagagaaaaaacaaaaaaaaagaagagaaaaaaatctgtcgcaaaaaaaaagaaaaataaaagggcgttcgagtcttaaaaaagtccgactccccgactccccgttgagaaaaagaaggcgacaaaaaaaaggaaaaaaaacttaaccctaaaaaaagaaaaaaaaacgtccgactccttaaaaaaagtccgactccctcgaaaaagacttctcgaaaaattgaaaatatttttgccggtattttggtacgtcatctgtatatgggtcggtttttaaatgttcgcttttggactggtactttggtacgtcatccgtatatgggtcagttttaaattcgttcgcttttggaaatacaaatccgcaattgagttagtttttaatttcgttcgcttttgaaaatatagaaggaatcgtataagaattctctttaaaagaactcacatgctaatttgagacgatcggactcctaattgcagctcatgattttcaagatgtttttgccggtaccttggtacgtcatccgtgtatgggttggtttttaaattcgctcgcttttaaaaatacaaaaggagtcatataagaaatctctttaaaaaattcgcatgctaatttgagacgttcggactcctaattacagttcatgatttccaagatgtttttgatggtactttggtacgtcatcgtgtatgggttagtttttaaattcttccgcttttagaaatacaattccatatttgagttagtttttgaattcgttcgcttttgaaaatacagaaggaatcatataagaaatctctttaaaaaactcgcatactaatttaatacgatcggactcctaattgctgcttatgattttctaacaaaatatatatccaagcgaatttaacacagtgaatttcattttaactaaaccatataacaataataagattaaaatagtcttcacccgttgcaacacacggatactacttaaaaaataagaggtgcttccatcgtccgtctaaataaaaaatagaaaaaaacctaaaataaaaaagtccgattccccataagaaagtggcgaaaataaaaaaaaactaccgtatccgattcccatctaattttgttcgttttctttttttttgtttttttccgttttattttctttcacccattttccggttttctttgtccgttttcttttcccctttttgcatattttcttttcaccgttttttctttcaccaatttttctgtttatttcttttatcgctatatttttttttgcggttttttcatcgggccaaacccagcgttgccgccacgttgattttcctcctcatatgcttactcctcctacttactgcaataaccgatttcccactactctctcattattttccctatgaattctcctttcgattcagctttaattcaccagattgaatctccatttaatcatccttatttttttatctcaagttttgcagattgcttcgattttgatgaaccatttaatcgtcgtcattttttatcccgagttttgctgattgctttaattttgataaaaaaaagggaaaagcgagatcaagtggataaaaatccctcaataattttggatatggagaaagattcgaccggatttgatggagaggatcagcttcgttagtcatcgtacgggtacggaactatgcgagctcgagcggattaccgtatttgatgggaggatcggctctgtcatggtataagactatgggagctcgagcggattaccggatttgatgggaggatcggctttataatggtacggacacgatactgttcgacttgggcctacaactccatttgtggactgagccacagagagatagaccgagcagagggagatagcagactatactaggactagaggtgaaaaggacggaaggaatgtgcgttcgtttggtccaaaacgcatgggcattaaagggagtatagtgcgtaggataaaatatatttttacctattgcaacgcacgggtattttttctagataaaacgctaaattgatggacgcttgagtcagataggatccatcgattttttgccatctattacacggcttttatttcgtcatatattctcatgtattgggaaaaaaagcaaaaaaagaaaattaaaaaaacaagcaaaaaatgcgtgagaaaagaaaagcaaaaaagggagaaaaatatggtttttgtcgtcagtaaaaaaaataaaaaaaaaacatgctagaaagaaactgttagaaagaaatgcgccgtttataaaaaaataagccgctcattaaaatacaaacattatcattgacatgattatgcatgaaaaacgtatattatcattagaatttattcacccgttgcaacgcatggatatttttgctagtgttgtaaaaaatttatcaaatctgtgaataagttaactttgtcaaaaatatatcaaatttatgtcaaaattatcgaaatttatcaaacgtatgttaaatttatcaaacccatatcaaaatttctcaaatataacaccgctttgtcaaacctggataaataaacaaaaataataaaagtagggtcaaatgagcaagggcataaacaatatttttgtcatgaacaacgccgttagattgccttcagagaatagggtcaagtctgatctttattatttttgaaaaagagggtcaaatgaacaaacttaaaaaaacaaggccatcaaaacagggtaaaaacacaattcccccccccccccccccccacaaaaaaaaaaacgatgcaaatgcggaggcgtagcgtagggaggggggggggggaagaataatcaggttcgtggtcaactatatattggccagtaaacggaaacgtgaaaattgcacttagaagaacggctcatgcgtgtgagtaaatctttagtcccgtcatcccacgaaatcgctaataaatgaaaatgacagcgacgacgacatctctacggccagattattttgggaatttacagggaacttaggaaaataccttaagtgatcatgacatatttaatttatatattattgtccgagggattgaaagaaatatatcggcaaattgtttggaagaaagattgtaagtgatcccatgaatatatgatggagaactctttatagaaattttataccaccttaccctatcatgtcacttgactcttctcacgacgactatgaactcgcgaagatgatgctaccccttgttgaatgaaccatgctagcagatagtactgttttgcttactaaaatttaatactctccgtgtccttagccaaacttgtttagttttgactaagtttatagaaaactttagcaatatctataaaaccaaattagttttactaaatgtaatattgaatatgttttaataatatgtttgttttgtgttggaaatatgataatttttttataaacttgatcaaacccataaaagactaaacagaggaaagaagtgggaagtaaagagaatttttccaaaggatttaaatactccaaattttctatgtttttcatttaaaaactgtggaagagagtggagcgacattgtatggagagagaaggtaggtgtacattttttttaattcatgtaggtgccttaagcttaagagatctaccttaaggcgggcttaccttctattgtcaacattgaagatgccataaggccttcaaaatacaaattaacctataacttggctctgaaatactatgccagatcgagcaacagatttggaaatatgcaacagatttggaaatatatggacataattcgaagacatggagattggtagacatactcatttttaactagtaccctgtaatccccctactgactccctctactggagcatgcccaagcagcatcaggacccaacagtagctaggctacaatcagcttgaaaattgcatacgatggaactgttcatgcacgaagctgactcgagtcctgtcaaactaagttgcagaaaaattaggaaaaagcttaaagttcatgtgggtatttatgttttattgctttaatcgttggaagaaatatattgggaaattctttccaagatccttccatctcgtgcaatctggcgaccagaagtgagcgcagtgaaagatcattcgctcaatatcaatatttctgtgcatttgtgcttcaagcaaaggtgaaacagagaggttcaagtgtacatggaaattctatacgatttaaaggactccaaagaaaggattagtgatagcagaattcagctcggctccagcagtgttcaggacggccttgtcaaccttgtcccttgccaagaacaagaactcgttgccttcaagtttctcaaatccacagagctggagaaactctatgcctccatgcagattgccaaccctctcctgcattgtaccgaaacagattataagtagcgtgttgttcttgaaaggataacagcggatcattttaccaggtcaatatgtacagtaattattttcacctgaaatgtagcgttggtcagtctgatcttcctgaatttctcctcgtcaggatttttagctacattgccaatgtaggtaaggagtgtttgaaaagccctcttcactttagcatcgtcatcctgttgcaaaaacggcccataattgggtcaaattgaataccaaacatataatatgattatatcagcattgaatgattccactctaaaactacagggagaacacaatttttggtatagtttcaacaaacaatagaattctcaagtctttacagttgcatctgtattcacatgcaatgaaggatatgtgtcaatctgcctgacaaatatgagtaacatagaagatgatttcaagttaaaactacatgctaccttgttctgctgcttaagatttcttaagcaatccctcatgcgctcggcctttgtggctggcctgacaggtaatgccctctggaaatccatagaacagagttagatggcaataatgatttcaaaacattgtttatttatacaatctgcaattatattctttggcctactaagttcggatctaaaggcctctacaaaagctgttccaacaagaaatccattgactgatgtaaggcataagatctgaatgtttcctgag

SEQ ID NO: 31610 - DNA, 13921 bp, Oryza sativa
  unsure (1)..(13921): unsure at all n locations
actgcacagaagaaaccagatatataaatgtgctgcaggtaatcttgattcatacatttctaaatacattaaataaggtaaaaagaagttgagaacaaaccttctccctttctctttccatccttctctttcttcttctttctttttacgagcacgttccctacaaatcgagtgagtaaactcaatagtttagtaacaaaaagttaaaatcagaatcataacgccagatctgtggttgttccagtgttaatatgacaaacggagagcaaatattgaacaaagttcctgtttaaggcggtacgataaaaaagtgcacaatctgcatattgggggttatcatgtgcaaagaaaatacgtagggaatgtaataaaagtatagaacttcagggattaaatatgagaattctattgtcatttatattgagtttcaagtccaataaaaattatcatttttaaagcagtgaaaaaaattgtcgtaccaatgcatgcgattacaaagcccaaccacatacgacaaagcatacaagtacttaaatgtcaattgaactgatttcaacgaggaaaaggtagtgctacagacagacacaagtcaatgcaattttctgaagatatatataaaaccatcaactcattaaagataataagaaagcaataagttcatgaacacaccttaattcctgagctttaatcttcatttcctcaggagacaaagagggtttattagcctcagttattgtattagccggtacctgagagatgaaagaaggtaagtgtaaagttatgtactggagagcaaaaattttctggacaagtataggtataacacagaaagaattcatctattactcccattggacacaattaattgaacctctgaagtgggaggttagatatattcaaatgtgcaagtttggtcctagatacatgggcatacgcaggggaaaaaaaaccaaaatggacaacctatgccaatttttcaaatgtttgaaatgcgttttcattgttacagtaaatacattgagctgcacaaataataaataaatatagtaaaagttttgggtattactgaaactccatggatagaatgtcagaggtcagacagtgcaattcagtgtagcactacacaagcacgatgaaaataataccaaaataaccacttaatatccaaaacatattattttttcagcaaggggcaatttagcacaccagcataccaaaacaaataaaggtataatcaattaatcagcaacaaaaaatataaattcatcataccagaagcggttcgtcaatatctggatcttcttggtgctcggaaagccagttaatggcaccttcaatagtgctattacctagaggaaaattaaatgggtgcaaacaaagttatgaattaatcatggtttgcttactgaaggtgttatgtttatttaactaatatagatgagacaatcataatatataagtaagactgcaaaacgtagtcttattgacttctggtccactgagacagttttgtccaaaagcacagcaaatagttcagctttcaatgcatatataatgccttgttttttctgtcatattgtaaatttcggtccacaggcactacaatgcagaatgtatgtctaattttgcactcataatgtatcttgttgcaatgcacaagcactagcattatttgatctgcaagactcaatagcaaagcatatactttccaatcgaggtcgttcctttattcaccatatgctgaaatccttggtccagaatttactgtgataaaaagccttctagccgagactttcttagatcaaagtctcaaatagctcagtcgcacgagcgaacatatatacacttgaacagttaatacttttctactgcatctgcagtctactcctctgtcccataaaaaaccgaatcttagggatgaatctggacactaagattcggttttttatgggaaggagggagtactctagtaataatttgctaataaataaaatctaagttggagaaagaacttgacagcatggtacaaatgttgaactaagacatactatcttgctacaccataccagaaaaatgaagtgccctagtggcacgcgccgtcgtgaaccccatcgcctcgaggtccgccagcatctccttgttaacctccggcgccaccatctctgccggaagcaaaaagccaccaagattcaacactctttgccacccaaaggcggccacagatcataaccctttcgatcatctcaacaacaaccacctcaccttgtggtcggcgcttgccgaggcatcgacatccatggcctcgccggccggcttcggcggcgccgcctcgagatcaattggcttggccgcctccatggtcttgtcagtgaactccgtgtggcccgtgcgcttggtgtgcaggtccacctcctgcgccgcgcaagatcagagatccacacaaccaaccaggtgagactaaaatcggatcgagaaccaccgaatccggcggaattcgatcgagaaagtgaaaaccaaagggaaggtggggagggggatggggggatctcacggtctgggagcggcagggcttgccgcaggcggcgcagacgaggttgaggacggcctcggtggactcggagaagttggcgtggttggtggcctcggcgtgcgcctgcgcctcctccacgctccgcagcagcacgccgcagtcgccgcaccgcagcgacagccccgccattgccggcgggcggcggcgaagagggaggtgcttttgcttcgccgcggcggcgaggtttagacggagagagggggattccgctcgcggcggcggcgagaagacgaggagacgagaccaagtcgctcaggtagtccagatcaggtaattattaagcggaattttttatatttcttatagagaggaaattaattaacctgatttgttacggagtatacgtatgtacgtactgtattccgaacgggaagggctcatcttctcctcggattgaaggatctggtttattgatcaacggttgggattactgtttttaataagaaacatgatataaatcatgtatgcgctcacaatatacgtacactcaaccttataaacgcacgtaactatatttttttatactaaaaagagatcgatatatctagaaaatgttgaatttagtaagtttgatttcagtgttgacataaagtcacaatcatggtaatgaacacccaaatttcatggataatatttttttccttgtccaaaatttattacaggtttgttaagattgtactagtataaatggacaacaatatgatcatgcatttggctaaaaaggttatgcttttgatcagttccttgcaacaagttaagaatattccataccttttacagtgtttttttccttattctacgttgtgagagataggagtatttgatatgttttgcttcgtgtgaacaccttttagctagtgcttgggtgttttttttaaaagaaaggcaaaagctttgcctcgcctcagagctagtgcttggttggggcacaagaagaaattgaattagcatatttctgaaaagcaaaaatggattatcagcttgtttggtttattagatgacttgaaaaaaaatacacgtatgtagcaacgagtgaaggctaatttaatcatattattgttgaacggtttaactaaggtaaaattcacggtgggaactgcaattataagtttgatcatgtcaagttagtatgcaagtttataaaagagatttcttatacgtctccttctccttctttatttgtaaaagcgaacgaattcaaataccgactcaaacacggatttgtatttccaaatgcaaataatgaacttaaaaagcgactcatacacggataacgtaccaaaataccggtaaaaacatcttcaatttttataatagtagagactagctaaatgcatgtgtgttgcaacgggaaaaaaaataaaattacgctaaatattaaattatggtttaatttttttatctaagtcatattttttttattaaactcaaacaaatctgaacgtagggagcagtgttacgtaggaggagaagatgggctttgtattcatcgagagtatccatgcatctttcaaaagatttttatgatcatatgtcacggtctaagattatgtggagatgaatcgagatgaatgaggatagattggattatagtagatgaaataacaagaaacggttctgaacctaaacagcgcgacgctctctgtctcactgagaaggcaggccgatgggcactaagataaatcttgatctaatgcctaactgatctggaatagggtccctccttatatagatggaggactccttaatctaatcctaacaaaccctatctaatcctaacaaaccctaactctatccaataggcctaggattcccggcccaaagcccatgacattactcccctctttttaagcagctcgaggcacaccccgctagactcaaacaaagtaccatagcctaaacaaagattcacaagccttttacatctcggctgaaatatatactcctatataattaatactactgttgtgaacaaccctacttttacttttatgttgtcatcatagatatggacaggtggaccccacccagaagccttgaaaggaaagtgaggcccatgccagaatccaaacatatctaggccaacatggatcagctgcagatcgaagcccagcccaccagtctagcccatttaaattgcccagatgaggagaaaagaggagaaacccttgctcctcccgtagatagcgctgcctccaacaacatgcgcgtgaggagcgccgtccgcgagaagagaagttgggccacgccaaaagaaatcgcccccaacttcgacttgaagtccttgcacaactgccgcgtccacagttctcaacgcgcacatgccgccaggaacgactcagccgtggtcgagccgcaaacttcgtgaaccagctcgcggacccggcgcgatctgcgccatcacgacaagcgaatgccgcgcccacccgtcgcgctagtgaatcgcgccgccatacgccggctggctctgctccaaccgtcgccgtgttgtgtcgccatcgaagtggaactcaccgtcgtcttctctgactccgttgagggcgccaacagcgacggcaccatcgctaggcccagcggcgaggccgaggttgctcgcccacctgccgttcccgcaattcacgccgcatgtatgtcgctatcttcccgcgccaaattgtacctgccactctcggaacttgcgccgccgctcgaggaagcgtgagcgcctcgccgtgagtcacgccacccccgcatggttgcagaacgccattgccgacgaccccggacggtgggctgggctgcgcatgcgtgagtggcggaggcaagaggcatcaccgatgctaatcctagcagcgcaccacccagttgcgccatagttggtcgccgatggaacctgcagccgatcccgccctatggtcgacgaaatgacgtaaaggaggttgtcggcgatggcctgccatggagtggcgtcaccgccgattactgccaccatccgtgccgcttgaagacgcgccctcgtggtcgcaaggacgctacatgccagtatgatgattcggcatcctcaaggaaggccgccggctcggctgactgggctgccaaggcctagagttgcgccaccaagtccatcatcttcttcgagatctcggcaaggccttcgctaatgttgagaaccacagcgatctcggcacccatgggcacggaaccgaagctctgataccaagttatcacgtgttaggattatttgggatgaaaagggacgaagggaaatagattggattatagtaaatgaaataacaaggaacggtcctgaacgtaaacggcgagacgctctttgtcgcactgagaaggcaggccgatgggcactaagataaattttgatctaatgccaatctggaataggatccctacttatatagatggaggactccttaatctaatcctaacaaaccctaactctatccaatgggtctaggattcccggcccaaagcccatgacatcatatcacacagatttttaatctttagattaaaatccaatagacacagcaaaaagacaaaaagcaactaagaaacaccataatggatactaattgccatatcttcaagaaaaagaccaaacccaatataaatttcaaaacttacatacgaagattcaaaaattacactgtaacttacaaaagttacaatgtaagttttataaattacactgtaaattacaagaaaatacactgtatatttaagtgggaaaatcaagtgagagataagaaaaaaaatatttcgattgagatgtagcaaaatcgatcacaaaatagggagctgccaatctcgcgttacatctacaacgttctgaatcaatcacgcgcccatcatgttctcgcggactgagtcggacatctaccacgtgtgcattgcgaacccatatagatagagtcggataacaaacgaaagaataatgagtagataatcattattattattattattttaaaaaaagtataggtaaagatctagaaatcgtaaaaggattcggatgacaattaccaaaatcttgacaaaaacatctttaatttttataatagtagagatagagatagagaagaaatagaggtatggaacatagtctggttccaacctcttcctccatcaaaaatattaatttctatggataattctagatattctaagagtcttttttatggaggatgtacggaatctcttcaagatgcggtatgaagctataccgatttttcactgacaaaactgtctcctaagtcctaaccaaacgctagagagatcaattcggttctcaaaaaaaaaaaagagagatcaattccattccctcaatcaaatacccggcaagtatgaccaacttgtccaatggaatagccttcttactaccagggtttcccttaccgtttttagcgcggttaccgcacccccgcggtaaggtggttaccgcggtaactgcgcagttaccacgaaaatcacgtggtaaccgcaagacataccgtgatttcaaaaactgaaaaggttactgtggtaaccgcgcggttttgtaaaccctgtgttggcaacttttttgacaagttgacaagcacgatcgcagcaccttaagccttacggtgatcctagagtcgccaaccacctcgatctagcaaagagctaaacctagatgggttttgataactaaaccggctagcggagccgatttctagataactacccgcctcgtgggcaaaacggaaggttttcaggacaaacctacaaagagatgtcgcactctcgcagcggcggcggatggtttacggtgcaaaccgacaaagatggacaaactaagagaaaactaaaagcaatatgaaaaacgatttgattgattgattgtagattgatttttacaatgaaccggccatgtcccttatataggggttggtcttgccctctacaggcccttctccacgtccaactcggggtagaaactaaaggaaacccgaaacatgccttctcgagcaaggaaacctcgagacccgacgaaacacagtcggactcggacctgccagtcagatcggccacacaccgccgatctgaccggccctgaaccggcggtctgaccacccaacacacggcggtcagaccggcccactcggaggaaaccggcaaacttccaaatttcggcaatctttcctattttaattctaggtgccaaatttgggagtaaacacatgcccccctgcctttttgatgaacaacgtgaatctaaaagcatagaacatgttttggtcttaggacgataatccaattaccgaccatagtacctcctaagcgtcttgccaaacgctcgggaagtatttctttaagtatttcccgttgattactcactgaaaacgctcctcttgaagtgtgtccaaaaaatatgcgtttcctcgaacaataccgcatactcgataaggaccctccaactagaagaccacttaccgaactcctggatcgagtacccaaaggcaaaattgtcttcccaaccagatctccaacttgaaacaactttgctttcacccttatgttgtacgccttggccaccttcttcttctctatctctatttcttccaatgccttcaatcacttgtcgatgacttcatcaaggttgtctcccatcaatgtcttgtaatcttcacttggaaatcatcttgcttgatataacgaagagaaccaagatttacctccactggtaaaacggcttcttgaccataaaccaactcanaaggagtgactttagtggcaccatgtttaatatcctatgtgcccacaatgcttcagaaagcatctcatgccacttctttgggtattcctcaatcttctttttcactaacttcaacaacgttttattactcgactcggcttgtccattagcctgagcgtagtaaggagaagaactcaacaatttaataccataagattcggcaaaactcttcacttctttagatataaaagaagcaccttgatccgtagttaatgtttgtggaataccgaatctatggataatatgcttcaaaataaagtcaattacctccgtatgagtcatattcttcaacggcacggcttcggcccacttggtgaagtaatccgtagcaactagcacgaacctatgcccctttgatgacgaaggataaatttgaccaatgaaatccaaagcccatcctcggaacggccatggtttgattatagggttcaacacggtggcgggcgccaattgaacattaccgaaccgttgacaagcctcgcatcctctataatatttgaagcaatcatcaatcatcttcggccatagaaccccgctctcctaagcaaccaattcatcttgtgggctgattgatgagttccacaaatcccttcatgtacctctcccatagtcactttagattgatcttcatctaagcacttcaacaagacaccatctatatttcggcgatataaatcctcatcaagcaatgtgtatttgaacgcttgtcgccgaattttccgatcaaccttaagcgtgggatctttcaaatatcgaatcaaaggaattctccaatcttcttctgcttcctaggcacaaatgtccgaattcacaattaattcggcctctaaattgattgaaacgtgccccccagcgctctgcccagaactggtcagaccgaccatacagggccggtcagaccgctcggggtcgccggtcagaccggcggcatgtggccggtcagaccgcccctggtcaccggtcagaccggccacgcaatgccggtcagaccgcccctggtccccagtttcccaatttcgcacaaagatttaaaagcaagcaccggctcctctaatatcagaaataatcccttcttcacattatagctagatgcttgttgtgccaagtcatttgctctagaattatcacacctagcaatatgtctaatagcaaaattatcaaaattggcaataatatccaaacatgaatcgaggtacctatttagtgatccgtccaagcatttgtagactccggcgacttgttgcaccaccaattccgaatcaccaaaagcatccacgtacttagctccaaccatctccataacttgtaagccgaataatagagcattgtattcggcttgattatttgtacaataatactccaaacgaaccgatgcttcataacacatgccattaagtgaaaacaaaactacccctatgccttgaccttctttgcaagaagaaccatcaaaataaatctttcaaggtataacttcaactaagcaaaccctttcctcataagcaatatctacatgatggtccactataaaatcacatacaatttggcctttcatagatttcaatggttcataagccaaatcatattctatcaaagcatatgcccacttgccaattctcccacttagaattggcctttgcaacatgtgtctaataacatcggcttgacaagcaactatgcatgtactagataacaagtaatgcctccatttggtacaagcatagaataagcatagacaaagtctctctataaagacatacctcgtttcggcatccaaaagacagcggctcaaatatgtaatgatatattccttgccatcttcctcttgcgtcaaaacggcaccaatgactttgtcttcggaggtaatatataaccgaaaaggctttccggctttaggcgctcacacaacgggtggagtagacaaatatctcttcaactcctcaaacgcctctttttgttttgccccccgggtaaaatcggcttcctttttcaagcgaagtataggaacaaaagcatcgattttactcgctagattagaaataaacctcctcaaataattcaccttccctagcaacttctgaacctccttcttgcatgtcggcgctttgaaatcacgaatcttttctatcttcttaggatcaatctcaacccctctctcatgcaccatgaatcctaagaacttccctgccgacacaccaaaagcacacttaagtgggttcatctttaaaccataccggcgcatcctctcaaaagctaacctcaaatcggctatgtgtccttccattctatccgatttgacaacaatatcatcaatgtagatctctaagataatacctagcaaatcatgaaagatcaaattcattgccctttaatatgttgcaccggcgttcttcaatccaaaagtcatgacaacccactcaaataaaccaacaaatcccgggcacctagaagccgttttgtacatatcctcttccgtcataaagatttgattgtagccggcattaccatctagaaagctaatcaccttatgacccgaggcatcattaatcatcatgtcggctataggcataagatactcatctttgggagtggctttatttaaatctctaaaatctatgcaaactctaatcttaccactccccttcttctccaccgggactatgctagaaacccactccgtataacgacatggcctaataaaccccgccttcaacaaccgatcaatctcctctttgactcggtcatatagcaaaggattaaaacgacgaggtggttgcttataaggcctaaaacccggtttaattggaagccgatgctcaacaagctcacggctaagacccggcatctcatgatattcccatgcaaagcaatcaacatattctttaagtagctcgattatcttaaccttaattataatcggctctcatatttttgtttacaaaagtcggccttggtttggttccatcacctatgtctacttccttcaatggatcggccgatgtaaacccttgtccaagcttctccacttcatcaaaatcttcaatggtttcaccaatatcgttctttgtagaccgatattcttgcaccctcttttgtaaccactctaaattagcctccttactcattatacaaatttatatggcttagccgtgctacactagccagctttatagagataggtacaaatttgccatcggagatactaataaaatcatagttagaaagatccctccccgataaacattagatattcccatgacgccactcaaaagtagcatcggccattgcaacctcagccgatgtatccgcttgaacaatttcaacatcatcgccgtcccattgaattaaacattgatgcaaggtagaaggcacacaacaattggcatgaacccaacaacgacccaaaataacattgtagttaccttgcacatcgacgatgaagaaagcggttggtagcatcttatttcccacggtgagctccgccgaaaagataccctttgcctccgttggtttaccattgaagccattgagaatcatgttggtcttcttcaactcatcatcctcacgcctcaacttcttgagtaatgaatacgacatcaagttcacagcggcacctccatccactaacatcctagagaccggcttcccatcaacatggcctttgagataaagaggcttcatgtgacggtttgactcatcgggcttctcaaaaaccgcgtctttaggacctaatgagaattgagcaaccccggcttcatccatagcacaaaactccataggcaacatacataccatgttgatatccatatcttcttttggagatgattcacctttattaaccgattattcctccttctcctctacaacaaccgatttttccttctctacggacttacgcctccataccggtggtggtcgcaactcattaaacctcttatctctttgttcttcggcctttttctctctcatttcttggagatatttaaccatttgccacatttagatgtggcaattaactttttgccactggacccacatgtcatagatacatgtggacccacatgtcattgagataggggtggcaaatagttatttgccaaatctaaaagtggcaaatagttaaaagcccccatttcttgagcccgaagacgttgcaaccttctcttttgagtagccgtcaaatccttaggcatccacctaggattcggctctgttccaggagataaataatgtcctctattaaccttgcttgaagacgatgaatccaatatcgccctttgcaaacctcctatcaaaccggcgctggagcccggtcaggccggacgtataccaccggtcaaactggccagatgcgccggtcagaccgacatttggcgcacggttagaccggcctgaggcgtcggttggaccgctatcgggtcggtggtcagaccggcctgatggcccggtcagaccggccgtatggctgcggtcagaccggccagaaggcctggtcagaccggccgactgcgatgagctggtaccggcttcggaccttttgcttgaggactctccaacatcatctctagaaggtattggcacatcatgaaaccccactttgatggtaattacttccgaagtccttgcctccaccttgatgcgctttccttccctcttttcttcattggcccggttcctaccataaaaccggccattgtgtggtgaagacaaacgctcatgaattggccttcttggtcctccccacccttggttgaattgcattggaggcatatggttgaacattggcggtgttgccccccatggtatataataaggataaggataacccggtggcggcattgaataagaaccccatgacatgtcttgtagatgatgatatggaggtgaatgcgatcgtctcggtgaatgaccaaatcactccctaggaggtgatcttggtctttttcctttgttgtgagccttctcaccaccttgcttctcatacttctccaaaagcatatcaaaagtcactttggtcttcctaggggctttagaagttgaagcttcactcttattctccttccaaacgccaatctccggcttctttggcactatcatcttaggtcttggctcgccaatgaccactccttttcccttagtagattcggcttgctccggccggatcaacaccttcttatcattgaaattaatcgtattcactggaaaaggatcatgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 31611 - DNA, 479 bp, Oryza sativa
ttttttctcggctcgtgctagaaatggatgcatgcaaaacacatagtcagaaaatgacagctcgatctttgtttattctggtgcttgatcaacaaagttttccgagtgcttatctatcgacttggcgtatacggatcttaattttttttccgagtgcgcatcaatcgacttggcgtgtacggatcttaattttttgatgctacacctagagatcaggagggtgttgaaacttttagtctaaggtggtgttcttttctcattaagatgaagattaagatgaatattaagttttttacgcaaacgaggtggtattaacgtatgattgattgagttttaattattacaaacttgaaaaatagattaatgtgatattttagaacaacttttatatagaaagttttcgcacgaaacgcactatttaacagtttgaaaagcgtgccacgaaaatcttaatgtttatccaactcttggttggagaa

SEQ ID NO: 31612 - DNA, 3527 bp, Oryza sativa
  unsure (1)..(3527): unsure at all n locations
ataggtgtcggtacctttacctttatggctttattgggactagcaagtatgcgcgcattgcagcggtcatagacaagccacgaccagatgtcgcagtggtacccgagtcctctgtgggggttatggtcgttaaccgaggcaaaccgaaggtggttataagcgactgcttcttccagaatacaccggtttaccaaaatttcccatggccttgtgcacttgggtagccgttttgtcgggtgtgcccctttaattaaaagggaggagaagtgtggggagggggggcgactttgtgtctctttcgtgccattgcggcaggtggagggtgagtggaggcagtgtanctcaaatgagggggaggatggagcagcggtctggcgttgggggcgatggcgatggcagtgagcggggaactggtgaccacggcgctggtagcggaacggagcaaggcgctactgagccgggcgtcgcgggcaggggcgagcttcgtcggtgcccggtgttggcggttgtggatctcggcatgtggcggcgagcttccttgccggcgagggcgacaagcgaagacatcgtcgtcgatggtgcttgaatggcggcggtgccgaggagagttggccgcgacgacaactttttagatagagtatccgccatttggcgatgggtgtgggcaagggtgtggtcccttggagtggccacttgtgccttcttggcttggttgattgtcaatttctgtgatcagcaatatattttatggggtgcgcaagatcaaggagagatggtgacgcaggggtttatcctggctcaggccctcaatatgaggtaatatcctacgtccagtgtgtttttctctgtatctgggtggaaaattaaccgagaggccaagaagccgggttgttgagatgatccaacctcgcgggacccctgccccctgttatataggatgaggggggagggttacaaggaaagtatgtgatggattgcaactagatcattctattctatctatgaagatatgcatgatccctaagatttatatcttattctgggaatctctcttcctctatttacaagtatgccgcatgggcctaggacactcggcccacaccatgcggtccggcccaaggcttgtcgttgggtacccgggtatagtgtaccccacattgatgtacctggtggcttctctctggggttatggcgcaagctgacagatgatggccattctgactacctttgggtggcggtccttttccttaccttgctagcgcccatagtctttctcaacttcatgggtgcactgtaggctagttgtttggtgttctagttgtaagatcctggctggtatcctttcttgtacagatctggcgattctctatgtggaacatggttaatcttaggtttggacttgtgccgggataaccttatacgctgggtttagcttgccgacagtgttgtaaggagtggtttcggccgccaagattggtgctttcactctggcttgtatctcttgcaacaacaaacacctagatcttgtctagaagttcaagttagaccagaatggttacaagtgaagcactgctaaattagcaataagatccatgaagttttgctccctaacatttcaatttgtccaaacaagtccttaaactatcatctagctcaatgcagccatttaaccctcccaaaaaacacaatttgggcatgccatatcatcctcgcatgcaaataaaataatatatcaaatgaacattatatcgttatatatatatatatatatatatatatatgtatatgtgtatgtatatgtgtgtgtgtgtatatatatatatatagggagcgtatcttatgcacacaggccctcgcgtgtacaccaactaaaaattatcacaaaaaattctaggaaaattcatacatgtactttcaatagtattacatctacgtgcaaagtcgcatcttcaaattcattctacaaacgatggtaattgccatatatatatgtgcgtgtatatatatatagtatgttacagaaaatagaaaaaaaataaaattaaaatataacaacgcacaaattcataatagaaacaatgttgggctggcccgatatttttaatttgattttgttttttctttctttttctttattatgatatttgtaagggtagaatgattattaaattattgcccttgcatgtgtggatgatgtggtaagtccacgtggtgtttcctgtgggtccaaggactatagatttcaaggatttgtttgacaaattgaattgtcaaggactaaactgactacggagtaaaacttcaaagaccatattagctattcacccaatatattcttaataatattaagatcatagtttttttttaagtatgaaaccattgtatatatcattccttatttgaaaatagtgtaacaaacgatggtaattgacttcaaatgcatggtaatgaataatccttatcacactttaggtatgactttatttgcttggtatttttaattaaaacaattagatattatttagaggtagtatttggctatgtgcatcatagatacggatgtcagggatgtaactcatcttacttttttttgtgaaaagtactactaggacctagtagtatttttcacaaaatatatgaagaaaagaaatacgggctgtgcttctgtcctcttcaaagaacaaactgcacggattttaaaggagatgagatggtaattttgtctctagagagaaataccccggatcccaagcccatatgcatccattcagtcgctggccatcctcctctctccctcgttcttctccgcctctgatgccgtccagcctacataggcctatacgcctagcacaccaattgtgcctccttgttgtcgttgtaggatcgaatcacaataactaagccaactagagggggctgaatggttggtatacccaaaaaccaaaaacttttagcggaaataaaagttacccttaaattcgacggagatcggtctgaccgaaactgtcctgccggtctgaccgcgcctgtgccgtcggtcttaccggtgtagatcaatcggtctgactgccctgagatcgcctgccacgcctgttgacttcgccggtctgaccgcaggtcacctgccggtctgaccgtcgtaatgctgccggtgtgtcgccggtgagaccgccgaaacccggtgaaacacaaatcgaagaactcttaaagtagatgacaactttattgcttctctctgtgtttacaaagtgcaacaacatcactccttacaaaaatttcgactaaactcgaaactctaactcaactatcaactcaattcctctcaaaagcgataccgagaagcctcacgctccccctctatttatacccgaggaaagcagcctaaagccacgaaccaaactcatactagaagtcctaatcaccctaggaaaccctctagtacaagaaacaaactttacgtaaccactcataccaaatttggactccttctaaattcgactccgcatcccatacgcacacaatacctc

SEQ ID NO: 31613 - DNA, 4085 bp, Oryza sativa
tgtaaaagcattaatcatgaaacaatcacggatatccaaacaaacaacccgaaaccgaaaccgacacagagtcggccggtcagaccgcgggctgcgccggtctaaccgcgcgatacacgccggtctgaccggacccaaatccagcactacctgtagattcacctgtgaaatccaattatctccaaaaccacttcgtaaataaattccaaatatcaaaaccaataatctctaatgccaattgtttatcacagaataataatcaaaaacacctttgattttacagttgtttcttgaatagtagtggcaggctatcagcgaccatggggcaaattttctgccaagatcagtgatataagccgtcgcaacatcaatgcattgctccatatggatgaaaagctaatgaactcattgatgcttgcttctcggtcacatggtgcagtgccaacaaaaactggatgattgtacgcgagaatgattggagttttggatgcatctttcttttttatgtttgtttgtaaaactgaagtgctcaatacggccatgtttttgtagcgcgaaccaaatgccatggccaggtgccaggcgttcatcattgtgatggcgacgagcagcaacacttgccggtgctttggtgtttgatccggactgataggatcagagattaactccctcatcgatgaaattaattaccctttataaatgatggttaggctcttaactaacactttatctgggtctctcattttctttaaaatctgtgcagtgttttttctttgaagagcagcgcaaccattctaacatatactccctccgtcccacaatataagagattttgagtttttgcttgcaattcgtcttattcaaatcctttttgcaaatataaaaaacgaaaagttgtgcttaaagtactgtagataataatgtaagtcacaaataaaataaataataattttaaaaatttttgaataagacgagtagtcaaactttacaagcaaaaactcaaaatcccttatattatgggatggagggagtatattaataacatgcatcatgcaaggtttcggatcagtcatcacattgggcaacaatttaccaccttgaaattaatttcacacttagaacgtcctatctgataggcaactatatatgtgtcttatcctacaaggctatcgtttactacaccaaatactgcatcatggccttctgcatcagcatgcaaaatgcacagcaaacaaactcaagcattattacgtacctagaacctcaagatggtagaatagaagatcgatctaatctgtttttctgttttgagagataatgtttgcaacccactacagaaaactatacattgatttaactctaattataaccaacagcagaagaaatgcgtcaaaaagcatatattgactctacaggtgctgccactcccttataaatcgagtatagcaagcttgtaatgaatcaataaaatttcgctccaagtatttacagtgccggtaagaatttgcttacagtatctatgcttgctccttagtccttagcaatgttatctcacaagtagtataccttggctagtacatatatcttaatgtttcctcaaagataattgatatacctttttatatatatgttaaacttatccgttgtccatgaaagatctatatagcacaagtagtcgatattctgaagacgcataaactttgtgattgcacgaattaattaatctcactgtgaatgcgtaggttgaaaaaaaaagatctccaagatatcaagcaatgaagcttgtggtgtgtgcaatgctcatgctcgtgatcatcagctcttgcactgctgcaacgtccaaggagaagaaaggtgcagaaatgaatcaactgaaggacgccgtcgatcaggcactggccaaagctggtcaggtgaactatgcacactcaacaaatactgataataatggaaaaagaactccctgcccactcccttgctaagctgtatactgcaccgccatgaaagaatgccttggctatacaaaatccggatatagatatgtatcgtaatactgatcgacgtaatggtatcatgcatcagccctgatcatgatgtttatgtatgtgatggaagatataactaaataaaaaaggatgtaaaacaaggtcctgtctttctataccgagaagcatttctaagtgtgttcagcaattaatggggtcaagttaattatctgagcaatgatcttgggatgtaatatttaatttcgtggtgcttggatttcatatcagcgagatcctcctgtatattatttacattgaaggtgtcatgttctatgtggacaccatgttgtcagggtgattagcaggcagaaacttttgtaaattcgtaattatttattcaaattttgcaatgaaaataaatattatggatgcttgaacctacaacaatgaaataaattgttaccagcaaagccatgcatacacccttgcatcctttcaagttttaatatgtttaattaatttcagcatgcaatatatgttggtctctgccatctctacacgtccgtgagaaaattgcaatatttggactgcaaacattggtcagacaatagattcacatagacatgactatatatgtacaaacaacaccacatacacccgtgaatgcgcttagtatatatgttcaaacaaacagaatccagcagcaatctctaacctcaataaaaccctgttaaaaatgcacctgcatttgcgtagtattcatgagtagatttaaaccctaattgattgaatcatacaatcacgactctattaatattccagtagaggagcgttaccaattgttctaggattccactacatttacaaaggcactataataatttcattttacttgtatctttaaaatctgttggttcactttttcctcgttcaatgagcgttgccttgtaagaggggcaactttttaaatctcccatttcctttctcctctacctccatctcctccatgatctatgtgccttaattcttagagctagaaattcaggtcttattgcacctgcaataagggtgctgctattctctagtttgggcataggcacatttgcaatgggtcgaatgattggctgtctggtcctggggatcaggtgtttcggcttttcggtcttgcgcagccgcactgaacagtgagggaggggcagggtggaaacggtagaggtaattaccggccgaccgggctaccgctaccgaatttgactgatcggacgctccggaaacagtaaatgtcagaaacagaaacggtaaaaaaatacggaaatgatatcggaaatggtttggtaatttacggaccgttttgtgaggttacactacaccagatcctcacatctctgacgggatacctgtgacgggcaaacgaaatggtcactgatgaccgtcacctctgacgggtcatacgggatgccgtcatcggtgaggcatccggctacgacccgtcataggtaactagtcacctgtgacgggttgaaaatagaacccgtcacaggtaaggttacctcacctcaaacgggtttaagtcctaatccgtcacaggtgattagtacctgtgacgggtcacaaccggatagcccgttagaggtgaggtttactcacctcaaacggctttaagtccggcccgtttgagatgacttctgccactgtatatatatgtctcctctcccagcggggcccacatgaggagataaggccggccggctccctcttctccacttctcctctatctcttccacttcttctctatctctcctctctttctctgtgccgtggcgaggggaggcgcggcggcgccgggccggctggggcggcggcggcccggccgccggatccggcaggggcaggaggggaggcgcggcggtggcccagccggcagatctggcaggggcgggaggggaggtgcgtcgccgagccggcgggggcagcggcggtggcccggccgccagatccggcaggggcgggaggggaggcgcggtggtggtctggctaccagatccggcaagggcgaggggaggggcagtggcggacgacggatctggagccgtggcgcgg

SEQ ID NO: 31614 - DNA, 3878 bp, Oryza sativa
tccctcccgcccctgcaggatgcgggagatctccagcggatcttcttcgtccctgaggatcggtggtggttgccggtggtcgcctcgaggtggtgggtgccagatctggtctgcaggtggttcgggatcaccggatctggaacccccgggctcctaccactgcctccttcaccgtccgagctccttcaccggtcgcctccccccgtaaccttcttgacgccagatgcgccgcctccatccacgtacgagctcagatccattgccagcaagtcctctttcacccatgtattttgtcttgtgttgtttatattgttccaattgttgctactgtgattgatgattctgagtcctatggtgattgagattcttgtgattttgttttttgattgggacaactgcgatggaacaaagaagaattgtgatgaattttttgatttgtgaatgccaaatgcaatcggacgaaatgaatgtgatggtaacctaggaggatggtgtttctcttcttttttccccctttttttcacaccagtgacggtcccaattagttgggccgtttgaagtgactctcacctgtgacgggttttggttgggaccagtcagaggtgactctcacctgtgacgggttttagttgggggccgtttgaggtggctcttacttctgataggtcttcactcgtcacaggtgactcaagtcatcagtgatcactaatctctgaccgggagctaaacccgtcaaagttgagggtttgagcccgtcagtgctgacctgatccagtgtagtgttaccgtattatcccggtaattaccgtttatatattccggtaaattaccgtttttacaaacatcactggccggctggcccaagttatttttctttggcccattttctcggcccaacaaaaaccgtaaatccctaaccctagagctgcttggctgctctacccaatcccccagtcaacctgtcctaagtcgcaaccagcgtcgtcgtactcttacgcggtggcacggcggcgccagcacagtgacagctctggtccgttccccagcgatgattgcgctagccggctaagcttcctcacgacgtcgcctcctattgcggccgcccccaccacctcacggcagcaatgccctctagcatgccgtccgggagcttgccggccggctcagcaaatattgtagccggtgatgatacagttgtcgaagaaaatgatgaccatgatgagttgcatccggtccaacaatgttgctgttgctctgtggagtataagagaacttgctatgtgcctgtgtttatgtatctcgtattattatgctttatctttatgaacttggggaataattaccgtcagatttatagttatcgtcgaatacgatacatttataattatcgtcaaatatttataaccattctagattgctagctaaatatgtgttgttaattatcgacttccgatcgataccgatatatttccgattgaataattctattttagatttactgatatttccgatatcgtttccgttaccgggttatcgttatcgattccgtttccgaaaaataatatggttgcggtaatggtttagggtgtttcctgatcgtttccaacctttttcatccctagcgtttccaacctttttcacccctagggaggggtacaaggatttctctgcttttacaattatagatacatggattattctatgcacagtttactctaacataataaacggtatgtttttttcccaaaaacattcatattgatattttctagagaaatccattcgacttcatattatttagatctcgttcgtttgtgcccttaaacgttacttgataacatccgaagaccctactagttatcgatcgttgtctttaatttgcacacatgtaccatcctcaacctcgtgctggacaacagcagcatcccatccagcatgcagtctaagatagggttcaatattttagttttaaatttcggaaacttttcccagcagaaaactgatttcagggtccggacataaaattatttcttccgactatttcgtttcttttatgaatttaacaaaatttattcaaatggcacaatgccatcttgaccttgtctggacaggttgtggccttttaatttccagctcttctcgaaagctatacctgggtagcttccaaccttcatcacagcagacatcatatcttcatgggaggtcaatttttatcaagaaaattgtccattttactccgaaatttttcacaggagtacttaaccccctaaataatttctcagcttattttacacccgaatttttataaatggtttactttactccctaacgatatttttttccttttcatttctctctatattgatcatgttttcaaatttgggagattagtgtatgcattataattatctcttcattatttttttggaattttttaaacgttgtttacattgtttggaagcactgagatcaatttaaacatcaaggttttaaattttaagcaaatagtcatgaaaaattttgaaaagattttagaactttgataattctgtcactatggctcttcaaaatttaagattaaaatacgactcatataaagagaacaattttaatagtttacaaggtaaaaggagtcgaaaaaatagtttaagagttaagtgatccaatgaaatagtttaggagagtacattggattttcttaattccttttatcattgaacgatagaaatctggcctttatgtctgcatgtggatatatataaaaccaaaaccaaaacctgcagtgagcttactactccctaatctcgtcaatcaaatttaatttccatgacctgcattcacaattttttgttaggatttaatctttctattctccattttgttatcactgcaatactcaaaacttaatggttgagaaaatatctcaaataccaacacttagtcatttttgggcatccaaattaatcacttcacatggttgtagttcaacggtcttacaaattctatgataccacttattataacggatacagaaggtttgatggttttgataacctttttataatcatctgtgacgaagtagtatttacttaaaaggttcaaattggaaccatgaagaactgatgaatgactggatagaacctagaaggaacgcagagggagtaatttagtacaccatattacttctcagttttttcaaaaagatgataatccctccttttttaagtatatggtattgctaacttttatacataagtttggccatttgtcttacaaagaaaatttacataattattatttgttttgtcattacaggtagtctatctataagcatcacttatattttttcatatttgcacaaaacctttgaataacataaataataaaaacgtatgtccaaaatttagcggcgacaaatatgttaaaaatggagggagtattacctcccaagtcacaacttatgcaattacttttttaattaaactgatagcatactgatcaatccaatgtcctaaaacgtatactgcaaaacgtaataatttgatgaggtgttgcttcttcatcatcttgcacatgcacagtaccctatcacctaatttgctctttagcccatcaaatgtaggtagagaaatactccatccactaattttccgtcatttctgcagtttgtccacttgatattgtcgatcgtgcatgatcttttttccaatgagtagtgattacaatgccatgaacagcatcgcatactccaggcattgcctagaatacagcattgttaacctcctataaatatcataaaaatatcctgagtaatatacaaattaagacttggcgatatatatgcacttcaaattcgtaggtgtgtgattcttacatag

SEQ ID NO: 31615 - DNA, 8018 bp, Oryza sativa
atatgtgcatcatggatagagagtaaggaatcgaattggggttaattatcttcaacaaaagaaaaaacaatacaattaatactcaaaccacaaaaaatagaaagaaaagattacatgaaacagaaaattgttacaggtagtattgtagccgagatgaatgaaaaccttctggctctattagagagaaggtttattcattgaagcatgcaagatagataggttgcaattttgcgcagttatttggattaaccacttgactagcaatccttggtacacatgcagcggcgccggaagccgctgcacttgcctccggagaagccctcagtcaggcacacgttggcgcagttggccaccatcatgcagatccccttgaactcgttgcttggcgtctcgcactcccttgcctgtgcagctggtaccatctcaaacaacaaaatattaacatggctaaaacatgaaatcatggtttttcatccatatataccagaccagataagtcgtcctaataatacaccatgtcaactgaatatgtgttatagtatttctaccactagcggaagtcacaaaattgaaatttaatgatgttggaatgtatgtgacactgacgcaaaaagttagaagccaaaaaatattaggccaaaaatcctttcaatttttggtagacgaaagaaaacaaaatctggtattatgatctatacacatgaatatatggattgtcccaccaaaaatttcaatcgaaaggaaggggtcaaattaggtagttggttctaaatatatgtgatttcggacttaaccagatcatatttagaataataactcgcaaactgaatttcataaagtgctatacatataggatgacatgacagaatggaactattggttgttctattgtttattcagcaaagttcagtggtttctcccaaactaattatgtcgtctctttatatttcttcagtatcaaaacttattaggtatgtgccaaacataaagaggcagcagatggtgtaaacaatttccgttatctaagaaaatgaacaaaaagctggaacatggaaaaggatgtaaaccacatgtagctaactcagatatgtatatatatactcctactgtacctgtggtgacaacgagcaggaggagaactacaattgttgggaagaacttgcgtgatgtctccattttgatcgatttgtctttgtgttgatgatcaaatttggcactagtattgaatcccttgtaactatgataattgaagtgattgtggcgaggtttatatataaagagagccaatatcatgcaagtaacgagaaccttaggaaatttataaattgtatgtatatttttttaactgagcactctatatatagttttccggttattattagtaaaaaggtgggtggcattgcgacttttgctgtgaatcgcacattcttttcaccatgcacacagaggttttttcataattaaatgttttgatttctagatatagattaagtatgtatatatatatatatatatatatatatatatagcgagatactatactacacctagggtgtagtacagctaaaacacacccacaccccctcccccacagccctcgatcgagtgttagattgcgcaattagttggtgttttattttgctacatgatctgtctgctcgattgatctctatagactatagcttctgcctttttttggaggaagcacagctgctgtgtttggtcaactaattgcagcttatttgccggcgccagatatgtgttgattgcttgtgttccttcgtgagtttgtataatgtacatgcatgtcccattgatccatcgtggatcaatttgttcctgtttggctagttgcatcttccttgctgcactttaatttgcactgggttaaattaagctatacacttcaattaacccaaagttcaacccagtgatgttttagcacctgtgcagtgatgttttagcatctggaaacaccttttcctatttttattgtgtgactgagctgaacataataatttcacaaatttgttgagtcaggcctgttgaaaacatatagttgctggctgttttgcttccagttccataatcattttgtttccgttcatatccttgtgcatttttaatacatagcatctgcaattattgaggaaatcaagtgcaattttcagttttgtttcattctacctgtaattctggatccgtttttgttcagatatttaagtgggaaacaaacttactatgagaaattatactcctttcttttacgtgctccctctagctgttgatgtgccattcagactaatctttctgtttgtgttgtcatgctctgtgatttcaatttcctagcaacaacatgatgaattaggagcgtacctgatatttcagttttataactacacattattcttgagcaaaagcataacatgattaggaggctctctgaattttttttctcatccggagaggcagaaagtggtgtcctcctgttaactgcgttggtgcatgtcaggtctagggaggagtgacggcgaggatggcttcacggtggtgacgacgataatgaggcaaagcacagattctggggagacttggcacagcaagccaaagtttgcgcatgtttcaaacggaatgttgagaagcatcgatttaatagtaattttgctactaagagacaatatgttgttgaactatcagtgtaatagtaacttggttactatgataaactttgtggcaagatcaatatgttatattgagaaccatcggtgtaagagtaatttatttactaagagaaatctcgtggcgataccaataagtcaattctaagtaatttatttactaagagaaggtatatgaatcaattaggaatactactatcgtaagtaatttatttactaagtgaagagttgagaacgacctgagactctgagagtgattcatttactgagaggaggaaccaaattagactctcagagtgattcatttactgagagaaggaaccaaattgagaagggccgaaaataacctcggagtaatccatttactgagggaaggaatcaatttgggagcattggagtgttagtaactcattttctgagtggctgataaacttagtaatcttgttactgatgggataatcacgaaaaaaagtgcgagaggaaataaaaaaaaagaggaaagaaaaaaaggtgcggcctagttctgcaggattgatggtgtggagaacttgatagtaactcgtttacttatcgaactaaaactacggatagtaactgatttacttaacgaaagaactttttgtgtgggctgatgggtgagtgtttgtgcgggctgcatggggtgggggggtgggtgggtgagggtgggggtgtacgtgaggggaccgttttagttatagcgcatcctgggtgcggtttagcgtgtgtgtgtgtatatatatatatatatatatatatatatatatcttttacgttttacccacaaacaaaacttttagcaggatgagagataagtccaacacaactgcacatcaactggtctatcgaaatatgcatgacaatgaaatttgatattagctgataatgtagttcagctttggtatacatcgattgaaagatcattgtctgcttgcaaagaccaaagatcgaatttctgcagttattggggcttactgaacaaccaatcttataagctaagctggcctctcaagtctaaagtcctaaacagagagaaatgcgaaaaaactgaacaagaaagggtgacactataccacaaatacgtggccaggtgagcgtcagcaaaattatttactgaaaatggcttggcgtcatatctgtggtgccacaggttgagggcttgtttagctggtaccgatcgacacattgccacattaatttgaatatataccaagctctgccacaagtgtgtccaataatttgctagctacatcttaggtaagttttgccaaataatttaaacaggtgatgcacaaggttcagggcatgtacaacggcatttaataacacccacaaaaaaaaaacggcatttaataacaggttctgttcgttgtcatgaaagtaaatttggtgatgtgaaaaaggagagagagaaaaggaaaacatggttgttatacatgacaacggtttaaagtcgactcttatcatttaccatagaaaattttgttgcatgggatggacacaagaaaaaaaatagtaataagaaattattttagtgcattaattaatggttaagagatattgttgtctgtattacgataggaggatagtttataagcaatatgtattatatgttaactaaaagcccacaccgggttctatctctctttatacatgccctaagggtaacatgttaaaattgtgacggcaaactatatgttcacctaagaaaccgtgacaacgtaagacatggaaccaattcaactgaccttagatgctcccgtatatttcgattctagtgtggtcaatgaaaacaagacttagtaaattactccgtacaattatataattacaagaaatcagataattagggaccaatcttaaaaatttcttgtcacattgcctgtgattatgactggtgtagtgtgaaaaatccctttttttcgttaatagtggcattccttggttcccttgaaatagattggcattcagcaactccacgcaaggaccataaacccaactccaaacgatgtctctcacgctgatcgtgttggaaaggtagacactcatgcacgatctctcgcacatattccttccccaatagcgcaagctgtccaattccaccagccctgccggtgctattgggtatcggccactgcatgcctctcactcaacactggcctctcctgcgcccaatttcagctgttgtatatccccgctagcccaactcttgtctcaaatcctgtcgctcatacattatatgatgaaacgcctcctcactatccaatgcaagtgctttaatttgtacaggatcactatttccaatctttcttatagttgcttccacatatcgggttggttttttatgaattggcacatatgtgtcctttcccacacaaccacctgatggctcaaggctaaaacaggcactaatggacatgactatatcaatgttgtttataagtattgatgaggcactcatcactatgggcatgtgtctgaacttttcaaatttaggtcaaagtgaccagtgctgagtctggctatggaccaatgctaataagcaccttatttgtgccgctgctaactaccaattggcactgaccatatttgtaccggttttagatatgagcataactttctcattcaatctcggattagaagaaactttatatgaaaattgtagctctctgtttgatcaactattttgttgttgacaacttattggttcaagttacttaaatgttcaaatccatgatttaaatatcacatataaatggtcaaaagacggaaaatatagccgctactataccgtgtatatcttttttccttcacatttaccactttttttttcatcaagtaacttggccatatattgcaatggttttcttcacttgttacgtgttttttcttcatctagtaacttgtccaaatattgcaacggcatagacccataaaacagaggatgggttgggagtgtaatactctgttggccatgtactgcttggtttttctcgatagggtggtgtttcgttctctgcacgaggctaggaggagtagacagaccactctgtttttaaggggataagtccattttacacccccaaactcctgtctttgtctaaaattcaccctaaattataaaactggctattcaacaccctctaactattaaaaccgttcaatttatccccatattgttgactaggcggtttttgcctacgtggcatggcagtccaatcaaaaatatatatgtaaaaaacatgaggcccacatgtcagataagctttctcctcttcctctcttcttctctcgatccatcctctgccttctctcaccggtgctgggggagttggagctcaaccttgccgatgcatgcagcaggaggcactcggggaggtggagggctgctagagctcgagctcgccggtccatgcaagggaggtggacggcagccagaggtcgagctcgccggcaacatgggctccagcgtcgcctgctcctccactatctccacctttgcctcaggcttgggctccgccaccgcccccatcgccgctcccgcctcctcttccgctgccactgacaaagataagagaggagagagacaggcagagagaaagggtccctcgacgcggcggcggcctcactgagttcaccttgcagctacggcggcagagcctagatggagcatggataggagcccgagctgcgtgcttggctccagcgatctccacgttgccgacacctcaacccttagatctagaccacgtcaagctcgataccgaaccgggcttcttcgagctcggccgagaggggctggctccgtcgtcctcgttagtacaagaaaggagagagcgtgaggaaagggacggcgcaacgatggaagtcggccggcagcgtaacggcaaaagggaccgagaactggggacaggtcgagtagcttgccaactgctccggctcctccaccgtgtttgtcgttgccagccgccccgtcatcgagtcatgcatcgtcgatgatgtccttgctacggcgctcatggagacggaagcgatgtgcttctatccagcttcttcccgggtatgatgaattggagaaagagaacagagagattgaagaggtggttctgacatatggggccatttttttacaatttttaacttctttttacacgcggcatcctacatggcatcaaaaccaggttacaaaccaccaagggatgtaatgtgcccggtattaatagctggagtgtgttaaatacccggctttaaagtttgagggtgtattttatacaaaatgaataattaagggggttaaaatagacttatcccttttttttaagtcataaggatttttatccaattatttttcttctttacatgtattgtccaattctttctctcttcatctgcttttaactttgttttctaaaaaaaaggatttaagcaattaacatttattttaaaccatacaagtttttaaattgtagaaaatagacaatattaataatttgccataatatattatctacagttgttttcgtttcatgtaaaaatatttgtcatttttactactaccagtaatactttgcttaagataaggctttgtaagtgtgccaattagccatcctaaaatttttgcctcaacgagtggcgcgcggcactagccttgttcacgagtggcagccatttgtcatggccattgtgagggaaatgacaattattacccaacatacctcttatatggtctatgtgtcgatttcgatggagctccttccatcaagatcgttggtcttcccttcttactctatgcgctctcatcaactactcagatgtacgaaggatgagagcacattagatgacggtaacaacaagacgtgcacaacaatagtgatgagcagcgtggcagcgatgagtagatggtgcaccatgtctgcattttccttttgcatattattcatatctggtatataatgtgtgaaccgacagagatcatgctatctctaatggttcttgagccgttacagacgactcacagggataaaggaactgtcacatgatttatacccttttcaaccgcaattgatgttgtattaatgtattgtgttatctgagactgaacttttcttacttccaaacatgaatatatacttccattgaaacattacacaaacatagagtacaacatacagttgactggaccatactaagatcccaaaaaataattaaaaaaaaactgagagaaagaattgattagtacgtcctcgtattattctgacatatataattagaagggcaaaaaaaaaaagctactccacgcattaagcttgaaaaattattcaa

SEQ ID NO: 31616 - DNA, 2213 bp, Oryza sativa
tgcaggaaaagactgctgcagaactttggctcaaactagaatcgatctgcatgtgtaaagatctaaccagtaagatgcatatcaagatgaagttgttctcgcacaagtttcaggagagtggttctgtgttgaaccacatatcggtcttcaaggagatcgttgccgacctaatgtcgatggaggtacagtttgatgatgaagatttaggtcttttactgttatgctcattgcctagttcatatacaaatttttgtgacaccatacttttaagccgtgatgaagtaaccctagcggaagtttatgaggcgctccaaaacagggagaagatgaaaggtatggttcagtctgatgcatcgtcctctaagggcgaagcattgctggtcaaaggcagatctgagcagagaacctacaacgatagcaatgatcgtgacaagagtcagagtagaggccgttctaaatccagaggtaaaaagttttgtaagtattgcaaaaagaaaaatcacttcattgaagaatgttggaagctgcagaataaggacaataggaaatcagatggtaaggcctctgttgttaccagtgctgaaaactctaattcaggagattgtcttgttgtttttgctggttgtgttgctagtcatgatgaatggatacttgatactgcatgttcttttcatatctgcattaacagagattggtttagttcttacaagtctgtgcagaatggagatgttgtgtgcatgggagatgataacccacgtgagattgtaggcattggctccgtttagatcaagactcatgatggcatgacacgcacgctgaaagatgtgagacacataccagggatggcgagaaatctcatctccctcagcacacttgatgcagaaggatacaaatactccggttcaggtggagttgtaaaggtatcgaaaggttctcttgtttacatgattggtgatatgaattctgcaaacttatatgtccttagaggaagtacattacatggttctgttaccgctgctgctgtttctaaagatgaacctagtaagactaacctgtggcacatgcgtcttggacatatgagtgaacttggtatggcagaattgatgaagaggaacctgctagatggctgcactcagggtaacatgaagttctgtgagcactgtgtttttggtaagcacaagagggtaaaattcaatacctcagttcatcgcaccaaaggtatacttgattatgtacatgctgatttatgggggccctctcgtaagccctctcttggtggtgctcgttatatgcttaccattattgatgattactctagaaaagtgtggccttatttcctgaaacattaagatgatacatttgctgcttttaaagagtggaaagtcatgatagaaaggcaaactgaaaaggaggtaaaagtacttcgcactgacaatggtggtaaattctgttcggatgcttttgatgattattgtaggaaggatggcatcgttaggcatcacaccatcccgtacactccacagcagaatggtgtggctgagcgcatgaacagaaccatcatctccaaggctcgttgtatgctgtccaacacgcgcatgaacaagcgtttttgggcagaggctgctaacaccgcctactacttaatcaacaggtcgccttctatctaacttaataagaaaactcccattgaggtatggattggtatgcctgctgattattcacaattgagagtttttggatgcactgcttatgctcatgttgataatggaaaattagagcctagagctattaggtgtctgtttcttggttatggttcaggagtaaaaggatataagttatggaatcctgaaactaataagaccttcatgagcaggagtgttgttttcaatgaatctgttatgtttaatgacagcttgcccacagatgtcatatgtcacaccccgaagttctcctcccaagcctaaaatttaatttataaatgaccctaagaaaatgccggtgcaaatcatgagaaaaccctaaggaagtaatacaaataataatcgaatctgacatgtggaatttttcttgagttctacatgtcgaaattcattaacaggatttttagtggaattttcagagccctagaaataattttgaccaattaaaattgagcacaagcaatatttaaatccctgaaaattcctttcttcctttttcttttttttcttttt

SEQ ID NO: 31617 - DNA, 571 bp, Oryza sativa
agcgccgccgccttcgtgtcgcctttgcgccgtcgcctccgccgccagttgccgtcgccggcaacgcgttcgcacgcgcgcgccgtcgccatcgccgtggccgacgggccggccttgagccaagccgagccgggtcgccgccgcccgtccgatcaaccccgggggcgatctgggccgtcggtcccgtggaccggcggtggaccacccgcgtggtcccggtccacagtgaaccgttccccccttgagtcgctgccgagtgggcccgctcgccggcgcccctttcctccctctcccgagccgctgaccggtgggccccgcatgtcggcgccgcgcctcctccccctcccgtgctgacgccagccctgggatttattgcacaataaatgatttaaggactttttgttatagtaataaacacagtgaatcttctaaaattcatatctaattcatccgagctccgtttaagcccattcaggtctcagtaaatcaagaaaaatgtgtagaatccattaaaaatggttttgttctctgtttcagtagtcttatagcctgtttgcaatgtttgccttgt

SEQ ID NO: 31618 - DNA, 137 bp, Oryza sativa
ccgtttcttctttcgctccccctcgggctgcggcgtcggcgcggcaccctccgggcgcctgctgctggcatgcaccgccccgccccctcggggaggagatgggagaggggtaccctcctgcttcctcttcccccggg

SEQ ID NO: 31619 - DNA, 705 bp, Oryza sativa
cttgtgagccgccgcgcggcgttgtaatctcactccagagatagtgaaaatattttgctggctggtgcccgtggttttttctctcctgttttaggagggtgttccacgttaaatctcgtgtcttctgtgattgatctattattttttatcgtttgttcgctcatcgtttcctaacaaaactgattcatccttgcggcatgcagcgacgatccaacgacgattggtcgccatttcgatcgatcgatcggctggtgatgtatatgaaaggcgttcgttaattataattaagttgggcgcctagcttagcattgggtcctgcacatgcagcggcgacggaatcccctgcagtcgtcgccgcccatgcagatgtggtcgcagttggcttgtatcatgcacatcccgctgaacttgctgctttccgtctcgcattccctcgcctgcgctggcgccatctctgatcgatatgatcatcacaaaaaatatatatatattccatacattaattaacaccactgaattaatttcccaatattgatggttgatctctttgtccgctatcgaaaataactgcctgaatatcacaccgtccggtgttggtcgttaaaaaaggaaataactgcttgaatactaactagatcccacgcacatagtacagatgataaaaaagagagtaaactgtactttggactatgttttattaccgaa

SEQ ID NO: 31620 - DNA, 6581 bp, Oryza sativa
tcagtcttgctctattttttttcccaaccccagagttcgggtatgtgtcagatggaggtttctccgaggagtaggcttcgtccgtgccatcgagggtgcctgtggagtggtgttcccgctgcagttctagtcaaggcttagctcctgttgtcttcctttttccgctgcatttatgtaagacttttatgatgtttgtaagacgtggatctgaatgtcaacattgtcgtttgtgtaccccggccggtcctggacggggattttaatgcacattctgcttggaattctattcgggaatttctgggcgtgacatcataccaggtggttcagatgaggagcagcaatatgttagcgtgcaggtggagcacgtggatgatcaggaaactgaaattgttagtaatgatgttaatgatactgttcagcactcacctcctgttttgcagccacaagatcaacctattgcacatcgcagaacaaaaaggagttgtggagctccaattcgccttattgaggaatgtgatatggtttattatgcttttagttgtgttgaacaagtggagaatactcttgagccagccacatacactgaagctgttgtttctggagaccgtgagaactggatctcagctatgcaggaggagatgcagtctcttgagaagaatggcacatggaagcttgtgcacttgccaaaacagaagaaacctgttcattgtaaatggatcttcaagagaaaggagggtttatctcctagcgagcctccgaggtttaaggcaaggttagtagcaaaaggtttcagtcaaattgctggtgttgattataatgatgtgttctctccagttgtaaagcatagttcaattcgcacattcttcagtattgttgctatggatgatcttgagcttaagcagttagatgtgaagacaacatttttacatggagagcttgaggacgagatatacatggaccagccagaagggttcatagtacctggtaaggaggattatgtttgcaagttgaaaagatctttgtatggtttgaaacagtctcctcgtcaatggtataaaaggtttgattcatttatgttgtcacatggctttaagtggtctgaatttgatagctgtgtgtatattaaatttgttaatggatcacctatatacttgctattatatgttgatgatatgctgattgctgccaagagcaaggaacaaatcactacattgaagaaacagttgagtagtgagtttgatatgaaggatcttggtgctgctaagaaaattctaggtatggaaatcactagagacataaattttggtttgttatttcttagtcagcaaagctacattaagaaggttcttgagcattttaacatgcatgatgcaaagcctattagtactcctattgcagctcattttaaattatcagctttacaatgtgctagtactgatgaggatgtaggatacatgtctagagttccatattctagtgctgttggttctttgatgtatgccatgatttgctcccgtcccgatttatctcatgctatgagtttagttagtagatacatggctaatcctggtaaagaacactggaaagctgttcagtggtttttcaggtacctcagaggcacaactgatgcttgctcgaagtttggcaggactgataaggggcttgttggatatgtggattctgattttgctgcaaatttggataagagaaggtcattcacaggttatgtgtttaccattggtagttgtgctatgagttggaaggcaacattatagcctgttgttgcccagtctaccactgaagcagaatacatggctattgttgaagcatgtgaagaatcagtttggttgaaaggattgtttgctgagttttgtggagttgattcttgcattaacttgttttgtgacagtcaaagtgctatatgccttactaaagatcagatgttttatgaggacaaagtacattgatatcaagtaccattatgttcgcgatgtagtcgcgcaaggtaagccaaaggtatgtaagataagtactcatgataatcctgctgatatgatgataaaatctgttcatgttgctaagtttgagctttgctcaagcttagatggtatagtggtttaggccaagaggctatttggcgccgaaagtgtttttttgtctttgttgtgttcagggtgaaggattgtttcatactacaagaaggaatttgtctcaaggtggtttgttgagttgtgatccaaattcatttgcacttaataaaggccagcttctgccgtagtggagcggaggcccgtcgccgggaggcttgggccggagcatagcagggacgcttggggtgcgggggcggagccaccgcgaaacggatcgtcatcccttttagggttccaccatatatatatatatacctcttgtaagccgctgtgtggcgttgtaacctcaccccagatatagtaaagatattttgttggctggcgcccgtggttttttctctcctgttttgggagggtgtttcacgtcaaatctcgtgtcttctatgattgatctattgttttttatcgtttgttcgctcatcgtttcctaacaaaactgattcatccttgcgcatgcagcgacgatccaacgacgattggtcgccatttcgatcgatcgatcggctggtgatgtatatgaaaggcgttcgttaattataattaagttgggcgcctagcttagcattgggtcctgcacatgcagcggcgacggaatcccctgcagtcgtcgccgcccatgcagatgtggtcgcagttggcttgtatcatgcacatcccgctgaacttgctgctttccgtctcgcattccctcgcctgcgctggcgccatctctgatcgatatgatcatcacaaaaaatatatatatattccatacattaattaacaccactgaattaatttcccaatattgatggttgatctctttgtccgctatcgaaaataactgcctgaatatcacaccgtccggtgttggtcgttaaaaaaggaaataactgcttgaatactaactagatcccacgcacatagtacagatgataaaaaagagagtaaactttactttggactatgttttattaccgaagttttgctagcttttataccacctttaactaaggaaaaatattggataaaggatgatacaaagtgaaatgtacattggtaataaaagatagcccaaagacaattctactcagaataaatcattatgtatatattaattgtctcctattgtacctgtgttgataacaagcaggaggaggacagcaatggccgggaagaacttgcgtgatgactccattgtttgttgttttttttctttttgtgttgaactgttgattcttgtctctagtttttctgttactgatgattgttgtctggaggcagaagtgtcatgcttatatatgcagatcactgcaggctgcgtcatgcgagcgataatgaccataggaatttttccaactctaataaaatagaactggctaatattagtcgatggctactattgctttgcattgtaatgagtaatgctagagactgtcgctcccaaaatatcgcagccattgttaattagttaacatataaaataaacaaatagatactcaaagcaatcggattggttaattggaattatttttaggataatgcatttcttgtattccagtaaattcaaagcttatcgaaatttaaatatatttttgaagtgaaataaatcatggtgcacatataatttggcaaggatcatttcagagctttccctaattcatgcataacaaattagtatatgaaaccaaagaaactggtaaccctgaaaattactgtattaagttctatataaaattcaagactcaccagatatatatcaacttttagttataatgtatgctacttaaaaaaactccatctcataatataaggcacaacatatttcatgaaaatttttaattttatttaggctaatataaattaaatttcatttgaagaaaataaaattgttgaattggcatttgaatttattttaactaaatgttaaagataagtggtagacaccatgacggagcgtggggctcctcaccgggagaccgcgcaggcccccctttgccgtttcggccgggggcgctaagttaggttcttcgccctcgatctgaggaacgtcaacgggagaggaagtgcacaagacacgggcgacgtagacaggttcgggccgctgagaagcgtaacaccctactcctgtgttctggtggatctgtgcgtgaaggaatacagagacccggagagcgagagtgagttcaggctctagaaccccttccccagagtcccaaccccctttctcctaggcctgggcctcctttttatctggtcaggggtcaccacatgggcctctagctgcctaagaagggaaacatgctttttacaatgagggctagtctacagccggaagtgacctctgacaagcagagcacacgcctcctgccccgctcgcccgctttcccggtggacgcccatttcaaccttcatttaatggccagcgacttccttgccatacttgcgctgaagcctggaatggatctgaccgggactgacataccaactccaggagttagcacgccggctccggctagggacgagagccaggaagctctcatcattccgacgggacggggcgaggcgtgtgacaggccgcctgttgccacctaacccgcgatctgaccggtctgtgaccggtcacacaccgcgaccggtcacggaccggataagcgtgcgctgcgcagcattaaatgcggcgtggcgcgctcgtccaacctgctataaatgcggttaggtgagccccgctgtgctcacctaacccacacacgtggcgccaaaaccacagggggtcggggcgccccagccctcggggccgaaacgggggcgccccagccctcggggccgaaacgggagtggcccgacccctcggggagacagagggaggggtggccacgtcaccctcgggaccgaccccccctacccccgagggggtcaggccacgtgggtgaccgcggctacccaagcctctagtcacgatacccccggccccatgtcaccgacagtagcccccggcgttacgccagggcgatcgccccctcgagggaagcgctcgggcgtgacgccactccttaggcccggtgacaggtggggccggtccctacaggcgggcagaaacccagcagtcacaaatcgcgcgcatcggcaagggaaaaacgaccgacgataatgagcggcctctttaagaccgctacattactcgagcagcgcgcgaatcgggacgagccggttcgtttcgcctggagacatgatgatggcgcttttcacggttagcgagcgtagttaatgcgcgcacgatctgccccatctcaaccgccatggccgcacatctgccgcgtgcgccgcaaacgggcgagtggggttagtggaggcgtgggcgcgagaaacgagggggcgaggtagtgggcgcgggaagcgaggagccgggcatagcgttggcaagggtgtaaagacgccgaggaagggattcgtttctttcctctcgccactcttccccttgccttcgccacttgcgctctaactcttcgtttcctgtgccctacccttgccgcactcgctcgctctcaagctcctcctccgccggcgtcatggcacggggctccgcaccgctcgatggtagcgtgctgccgccttcccgcatcgtgagcgagaggcaggccgggctaccgcgccgattcatgccggaatctgccaccggccgggaggtggtcgcgctgggcgagggacgcccggcgccacactacccggggcggtccgtcttcttcctctctttcgcaatggcggggctggtcccgccattctctatttttttcatggatattctggagttttatgatctccagatggcgcacctcacccccaacgcgataatgacgttggccatcttcgcgcacctgtgcgagatgtttatcggggtgcgcccatctctccggctgttccggtggttcttcaccgtacagccggtgtcgccgccgacggtagtcggtggctgcaacttccagccgcgggggcaggtgctgaaccgctacattccctgcgtcctccgcaaaaagtgggacgactggaagagcgattggttctacacccccctcgccgacgaagcgcgcctccgacttctgagccagcccccggcgcaggcctccagctggcgggcggcggtagatctgggagacggctacaacgccgttcttgaccgcctggcgggtctgcgatcccaggggctcacggggtccatggtgttcggcgactaccttcgtcgccgaatcgcgccgctccagcggcgcgcccggggcgcctaggagtacaccgggcccgaggactacgtgaggacccaccaggggcgcaaatgggactgggaccctgaggacttcaggatggtggtccaacgggtgctgaatctcagctccggggaggcatccctcatcccccaaggggtcctccccctctgctacgatccagagcgcgccaaga

SEQ ID NO: 31621 - DNA, 8582 bp, Oryza sativa
gccccccccccccccccccccgccattccaagtccggccggtctgaggccgaggagacggcgaccgcggaggcccggaggcgggaagctgaccggcgagaagccgcggaccgcctccgggaagccgaggaggctacccaggaggccgtccgggttcgccaggctgaggaggccgctcgggaggaggccagactccgctgggccggggagtccgtccgggaggcagaggcggcgcgcgcacgtcaggcggcctgccaaacccccgacccgactccgcccgaggcgacgacgacttccgaggccacccacgatgaggccgcgggcgcgccgctcgggcccgacccctcgggcgacgcttgggacgagccagcttcgggggacgcccccgagtccggcacgtcgatcggtgggccgagccgcgtggcacccacaccgaggcggctctcccctcggccttccgctgccccactgagcgtggagcccctcctgcaggccttggccgccgtgaacagcatggtgctggacgggttaagtgcccatatggaggccgtgcaggcggagagggcggagctcgacgcggagtgggcgcgcgtcgaggaggggcggcgctcggtggaggccatggtggaggcgggccgcaaggcacaccgccggcacgcctcacagctcgaggcccgtcgtagggacctggcggagatcgccagggaggtggaggaggagcgggagactgccctcatcgccaccgccgtgctcgacgaggcgcgggacgacctccgcctccaatacgggagccgggctgcggagctagagcagaagctcgacgccgcccagggagtccttgacgccgccgctgcttgggaacggcgggcggcggagaacgaggcggcgtcccggcagcgcgaagaggcccttgaggctcgcgccacggcgccggatgagcgcgcccgcgccttggacgcgaaggagagagacctggcggaccgcgaggccgccgtcgccacccgggaggcaacactggcggcgcacgaggccgcctgcgccgaataggagtccgcactccgcctccgcgaggacgcgctcaccgagcgggggcgagctctcgaggaggccgagcccgcggcgcagcggctggcggacagcctgttcctccgcgaggcagcgcgggaggagcaggcgcgccgcaatctggaaggcgcccgcgccgagagggccgcactagatcagcgggccgctgagctcgaggcgcgggcgaaggagctggacgcgagagcgcacagcgccagggcggccgcgggccacggcgacctagccgcccgcctcgcagccaccgaacacaccatcgccgagctgcagggcgcgctggactcgtccgccggggaggtcgaggccctccgcttggcgagcgaggtagggtctggcatgcttcgggacgccgtctcccgtctagaccgcgccgggcggcaggcgggcctctggccgggcggtacgcgaagtacgccgccaaccaggggggcctcgcccagcgcctctcagagatggccggggccctcgagcggctccccgaggagctcgaggagacgatcaagtcatcctcgagggacctcgcccggggggcggtggagctcgtactggcaagctaccaggccagggaccctgacttctccccgtgggcagcgctggaagagttccctcccggaaccgaggacggcgcgcgtgcgcaggtccgggacgccgccgaccacatcgtccacagcttcgagggtacggcccctcggctcgcgttcgcgctcgactccgacgaggagggcggtgacgacggtgcggatgacagcgacgatgaggccggcaacccgggcgcgtcggagtgagcccccaggctcccgccaatcttaataacttttccttcttcttccgaggcctttcgggcccccttcttgtatagactgatttaatctgcaatcaagtaaagaggaaatttctacgtcagttctgtttgttgtgtgtatgagatgaggatggtctgtgccgcggtccttctgtgtcttggcttgaacaagggctcgtgcccaggtcccagcctcaaacggcgtgggtcggggctagtgcctggggagatcctcgtgtcgagactggccaggccgggagcgcggtgaccgagggttatggatgacccgattgtgggcctttgccgattcccccccggagttcaccacgccccggggcacggctcggttctgggccccgtttggcgattttagccggcccgggccaccgagggcagggtcaagcacgagcgtgctaattcaagccaagattctacaaaaggaaacgatggtacagacacagtcctcaggaaatcgaaaatgcttttattgagatacggaagagaaaaaaggtaagtatatgcatatggtagcccccggccaaccctgcacgcccgggggggtgcggggttggcccgagcccgagacatgacactcgacccccactaggggtagaagcgacgaaggtgctcgatgttccacgggttaggcagctctgtgccgtcgcccgtgaccagccgaacggagcccggccgggggacgccgatcactcgatacggaccctcccacattggtgagagcttgctcagtccagcacgcatttggacgcggcgtaggacgaggtcgtcgacgcagagtgatcgggcccggacgtggcgctgatggtagcaccgcaggctctgctggtagcgcgcggctcggagggccgcgcgccgccttcgctcttccaaatagtcgaggtcgtctcggcgaagctgatcttgatcagcctcgcaatacatgctgacccgaggggacctcagggtgagctcagatgggaggaccgcctccgcgccgtagacgaggaagaaaggcgtttccccggttgctcggcttggcgtggttcggttcgcccagagcaccgctggcagctcctcgatccacaagtcgccgtgcttcttgaggatgttgaaggtcttggttttgaggcccttgaggatttccgcgttggcgcgctccacatggccattgcttctggggtgggcgggggaggcgaagcagagcttgatgcccatgtcttcgcagtagtcaccgaagagctcactagtgaactgggtgccgttatccgtaatgatacggttaggcaccccaaaccgagcagtgatgcccctgatgaatttaagcgcggagtgcttatcgatcttgatgaccggataagcctcgggccacttagtgaacttgtcgacagcgacatacagatactcgaacccgcccggggcccgcctgaacggacccaggatattgagcccccagacagcaaacagccacgaaagaggtatggtctgcagggcctgggccagctgatgggtttgcctggcgtggaactggcacgccctgcaccgccggaccaggtcgaccgcattgttgacagccgtcggccaatagaaaccctggcgaaaggccttgccaaccaaggtgcgtgaggcggagtgggctccgcactcgccttcatggacatcggcgagaagctcgacgccttgttcccgaggaatgcacttcaggaggactccgttagccgcgtgccgatagagggtcccttccaccaacacgtagcgcttggagatgcgccggacgcgttcactcccttcgcggtcctcgggtagagtcttatctgcgaggtacgcctggatctcagtgatccaagcaatcaatctaggggagctgggagcgctcccctcgggtcccgaggccaggactccgacgggcctcgggggccgtccaggcgcgtccgtctcccctagggggtcgggtcgcgccgacggctgggcaagcctttcttcaaaggcgcccggtggggtctgggctcgcgaggaagcgagccttgagagttcgtcggcgaccgcgttatcccgtctgggcacgtgccgaagctctatcccgtcgaaatggcgctccatacgccgcacctggcgcacgtaagcgtccatctgcgggtcagagcactggtactccttacagacctggttagcgaccaactgggagtcgcctaacaccaggaggcggcggatccccagtccagctgccactctgagtcccgcaaggagtccctcgtactccgccatattattggtcgcccgaaagtcaaggcggaccaggtatctaaggacgtctccgctcggcgaggtcaacgtgacccccgcaccggcgccctgaagagacagggagccgtcgaactgcatcacccagtaggcggtgtgaggcagctgcgaggggcccgagctggcctcgggggcggagacaggctcgggagctggggtccactccgccacaaagtcggcgagggcctggctcttgatcgcgtggcgtggttcaaagcgcaaatcgaattcagagagttcgattgcccatctcaccacccgtccagtaccctttcggttatgcaagatttggccgagggggtaagacgtaaccaccgtgacccgatgcgcctagaaataatggcgcaacttcctcgaagccatcagaatagcgtaaagcatcttctgggcctgaaggtatcgggtcttgacgtcccggagggcctcgctaacgaagtagacgggccgctgcacctttcggcggggccgatcctcttcgccaggggccgcatctccagggcgctcttcgtccgagaggccacgcggggcacactcggcttctgtgccgacgacctcggggtcagagggcgacaggcacagccttcccgcagtggccccggggccatcctgggggtcgggggcgcctggcaccgtcggacaagcaggcggagggccagctccggccgtcgggggcctcgggccgccgttcggctcgggggcctctcctccctgctctctcccgggtcgagtcgacacagggtggggatgcgcggagtgagggttgtcctcgtcgcgctccacgaccaacgccgcgctgaccacctgcggggttgccgccaggtagagtagcaacggctcatctggctccggggcgaccaggactgggggagaactgaggtacgccttcaactgagtgaaggcccgctcagcctcctccgtccaggtaaacggcccggagcgtttgaggagcttaaataggggtagtgccttctctcctagcctcgatatgaaccgacttagggcggccatgcagccggtgacgcactgcacatccctaagcttgctaggggggcgcatccgctctatagctcgtatcttctcggggttggcctcgatgcctcgggcagagaccaagaacccgggaagcttgcccgcaggcacgccgaacacgcacttatcggggttcagctttatgcaggcggagcggagactttcgaaagtttccgctagatccgagagtaaggtctcttggttgcgcgtcttcacaaccaattcatcaacataggcctcaacattgcgtcctatctggctacccaaagaaattcgagtagtacgttgaaaagtaggacctgcattctttaacccgaaaggcattgtcgtataacaataaattcctatgggggtaatgaatgcagttttttcctcatcctccctagccatgcgaatctgatgataaccagagtatgcatctagaaaacacaaaaggtcgcaccccgcggtggagtcgacaatctgatctatacgtggcagggggtaagggtccttaggacatgccttgttaaggtcggtgtagtcgatgcacatccgaagcttgccgttcgccttgggaacgacgaccgggttcgccagccactccggatggatgacctcacggatgaatccggcctccagaagttgcgccaccttctcgcggatgaaggcttgacgttccggggcctgccgccgcactttctgccggaccggccttgcgcccggccgcacggcgagacgatgctcaatcacctccctggggaccccgggcatgtccgccggtctccaagcgaagacgtcggcgtttgcccgcaggaaggagacgagcgcgtcttcctatttgtcgtccagaagaccaccgattcgtgtggtcttggacgggccgtcgcccagggcaacctccttgaccgggacctcgtcgcacgtgaccatccgctgccttggggcggccgggacggaggtgctgagcctctcgtcgccacccgtgggcttggacgccgcggcgaggtggtccgcgcgctgctccatacaagcaagcgcgactttgaggtcgccatggacggtgatggggccaccggggcccggcatcttcatctggagataggcgtagtggaccgccgccatgaacttcaccaacgcgggcctccccaggaccgcgttgtagggcagactgaggtccgccacatcgaagtccacccactccatgcggaagttggcggaaccaccgaaggtgaccgggaggtcgatatgacccagcggccaggtgttccccggcgtcacaccgatgatcggctgggacggccggagcaccatccccggggccttgatggcgtcaaaggctagaggggaaaggatgttgagggctgcacccccgtctatgaggacacgacccaacttcacattgcaaacggtgggggaaaccaccatcgcgatctgtcctccccgggcaacgcacggcgggtggtcggtctggtcaaaggtgagggcaacctccgaccaccgcgcccgccgcgtcgcctcatgggtaggggccgcggccagaagctctcgcttcatggccttgaggctccggcgagaagcgtgagcgcacgctcccccatcgacggtggcgacggtggcctcaggctcctggaaccccaggtcatcgtcgccatcgtcgatgtcctcggcggtggccttctgcttggcctcacctcgccggttgccggcgggagccgccggggtcttgccctcacagcgctcctgcctcttctcctcctcccacttcctcgtccgctcagccaaacttttgaccgcgcggcagtcagcgaggtcgtggagagaggtgttgtgcacggtacaccacttgccggtcgggcgctccctgctgggagcgccggcctccttctttttgtcgctcgcaggcctcccctttcggggggcccgcgaagcgccctcgacggcgaggacatgaccctcgtcgtcggaacgggccgaccccttcttcctcctcctgtcccgccgccctgaccgagcggcggacccaggggcggccggagctgccacaccagaaccggagaagttccaggtccaggcctcctccttgcgagccacacgttccgcgagctcaaaaagttgcgcggtggtctagggctccttggaggcgatcttctcgagcatgcggttgtgccgcacgccccccctgaacgcgtagatcaccgcgtgtgcggggatgcacggtatggtgttgcggacttgacagaaccgctgaatgtacgagcgaagagactcatcgtcccttcgctgtaccgcatgcaagtccgcctcttcgcctgggcgcggatatatgccctggaagttcgtggtgaactgctggcacaaatcctcccaagagtggaccgacgcgggtggcaagttcattagccaaccccgcgcctgacccttcagggccatggggaagaaattcgccatgaccctgtcgtcacccccggcagcctcgatcccggtcgtgtagatctggagaaacttggcggggttgacgcttccgtcgtatttttcggtgatggtgggccggaaccttgggagccaacggacgttccgaaggctcgccacaaaggctcgacagccggcaccgccaaccggggacacggggggccggcccccgtgcccggaccgaagtggcgctccggacgaggaagcgccctccgttgcgtgggcggcgcgacgagcgtcgcaccggcgctcgatatcgaggcgggcatccgttcccccacgcacatcttcttgggtcggaggcgttgacgagggaatggcggacgaacggcgggtaacggccgccgctcgccgcgtcctccgcctcgacgacatggagccggcggcggcagcgccagaggcctcggtggcggaggaccgcccgccggcgcctaggcgctgctgtgccgtcatgaccaagtcggccacgtcatccagccaacgtcgggctggagtctctggatcggggacgacgggcgggtgacgcaggagcgcgcccgcagcctggagcgtgccctggggcgtgccgccatcgccgtaggcgaggcggcgacgcgccccgtctcgccgtcctcccccgtcgcccgcgggcggcgaagtcgcggatcgttcgacctccccgagcgcctccccccgcccaagatttcggcgagagggggacggtggggtgcgagcccgacggcgcgggttctgctccccgtcgtcaccgctagcgttcggagagaggctgtgcgccactgcccgttcggccattgggctgagcgggagaagcttggcgcacacgaaagaggacgagggcttaggaagacacgcgcgccccgtacctggcgcgccagatgacggagcgtggggctcctcaccgggagaccgcgcaggcccccctt

SEQ ID NO: 31622 - DNA, 7142 bp, Oryza sativa
ccccccccccccccccccgagggggtcaggccacgtgggtgaccgcggctacccaagcctctagtcacgatacccccggccccatgtcaccgacacaccgcgtatggtttaatgacttacaacatgggatggagggagtcgtggaatctaatatttaaaatttagctctggttctgtaacgtacctgaattctaggattaaggaatttccatcaaaactagttgaaagggaagttcttcaattttataaaccaaaaatttctattttaaacctaggtggagttgatccaactcttgcaagaataaaatttgagaacaaattaaagactttttcacctttaacctaggacttggatgcaacccaagtgaaagcatgcatacttgcataaatcatattttgacttgagtccttcatatgcatttggattttcgatttgcatttcataataggtctcatgaatataattgcaatctagacaaacaactaaaccattagggcctagtgctaactaatggaaaataatacacagaaaccatacaccttaaaaaaaatcaacatggctaatgtcaagcctcacaaaactaatttggacatccatctgaagacatgtcatgaacatgaaagtgaacaaataaattatatcatatagggtatattctatcttaatcatctctataagcattctcttaatttaatactaaagtaaacttatgcataaatagggaaggagcttatgacatgtgtaaggtaaactgtaattctaacatatcaacatcacctcatgttaatgagagtccaaatataacttttataaacattttcatgcatttaggaaagggaaacacatataagacataagtcctgcgaattatctaaaataattcatgcaagataaaatcatgggaaaattcatgtaggctctactcaacacatacaactcactgtaattttggtataatttaataactaaatttggtacctcaaataaattagtcaaactaataaaaactagattaactgtagttcttaatcggctaaaaccatactttgtctaaaagtgcatttcattgcataaaagtgtataagtaaaataatttattcaaatactaggtaatttatcatgaataaaaataatttttccagaatttatcttctctgtttaggtctcctaaaaattcgaactagtttccaaagaacccatattcctctaatttctgtgagtaatctatccataatttttgagtgcaaccaaagaaaatggaatctaggtatcttcatctaccttgagaaaaatccacactaaattattctacccacaaattaaataattgaaatactaaagtgggagagagaaataatccttaaaatcattcaaaccttttgttcacccacgtttctgcccaaccctctcaccctagcttagtttgccacgacctggacccacttggcagccactctggctcgtcctcaccctgtgcaaatcttccagccggaccaaagacagccgagagagagagattggcgccgactgtgtacgacgcgtggcctcgacgtggcagcgccgaaccgaggcttcacctccacccagctgcgtcgccattcttcacccaccatcccagtgccgatccaaccgagggaggaagctccagctctccctctccacctctctttcgtcgccggccgccaagaagagggacatcgccaaccgttgtcgagccctcttcatctctaactcatactcgttccattctcatctcaccatgacgaacaactttggttttgatcccattccatttcatcttctacagcagcgggaacgcggccatgtcatggtcgctctagagcgcgctctgtgcaccgccgcagcgacatcatcgccgttcccgcttatctggaccaagccgggccaagctgtcgcgccagcgtcttcgcctcgacctcctctccatttcccctcaagaatctcgaaggatggtgctacgagtgtggagatcgtccaccatcttctccacctccagtcaccgtcgccgttgccgaatccaccccctccggtgagtaccaacctaattccatgcatcagtagcatctatggggcctctctaacctcatggacacacatgcatgatagttcttggagctgattgagccatcgccgttcacccggaggttcttgccgccgccgagccgttacacgagccaccgtcataaacctagctaccccagccatgtctaccatctcggtgagcacccttcagcctatagaacatacatgcatgcacccaattaaccaatacatgattgtagaagcacatgcatcaccacccgaaaacatcctcctttcggactcgccgccggcgttactccgatgtccactgaccgagaaaagtagaggaatggaatcgcaataacatgatcttcattttgtattttggttgcacccccaaacgagccatcgtttgtcgccggtgagctcgagatcgagctcagccatggctgttctgcctctgtgcgtgagaaaagaagtcagggaccttgtttcgagaatttaaacaactataaggtttaatgtgcaacttttcaactcactgacatatgaggctaggtctgcgtgttgattcttagaaacctcagggatctttttgtatattgatctttcactgacagtggaccccttggaaacaaaaatctgaaattataaaaggaaagtacctaaaacttgtaaaatccatataaaattaaatatagctcattttaagatgatacaaatttctgtcaactcaccaaattgtgaactttagtgttatggaataaaaacttgcactcacagtacaaatttagcctctaaaatttatccaagttaaatcacacataaagcatgcacaaatttataaaatgcatacaaaattcatttcaactcatcttggagcaaactcagtttctacagatccaccaacttatgttctactataaagcaaaatgaaatagtatacatactatacatcgaatgcctctaaaactattacctttaaaatgactagttttacataagctgaactttagaagtttatataaaattcatcttagatcctttttgagtaaacccaaattcagtagaatcatagggttgtgcacttcaatgttataaaataaaaagacatacttacagtataatgaaaacccctaagtatttaagtaaggaataagcaacatggagcataccttaaattgtaacatttgtagaaaattcatctatagtctaaatgaagtgaaccaaattttctatagaaccagcaagtaatatacttcaacctaatagagtgaattatagcaccctcttacagaccatggctctgaaccttaatttggtagaataggtactaaacacatagtaatggttaaacaatacatatgaaaaagtatatatatgcttggtagctccaaataaatccaaataaaacttgttgaaccagtgaaggcatagatccatccccttccaccaaaacttagtatccttaacttatataataatctccagattgatatgttaagtttctaacatagaacatcccctagcttataaaatgtgaagtaaagtaatttgaacactaaaattttataaactaagattagattagttaactaaaatactcattttatacaacactagcaagttagagcaagttctggacctaaatctcgaaagccatgtacacatagggaatatatgcctagaacacgttaaaacttgtaaaatacataaataattcatattaactctaaaaattatgaaaccaaatgtgttagtcttagaaaacaaatatcttcaccccagcaaacataaacttaataagaatcaccttacaacagcatttcacaatagtaactaagtaaatcctacactataccgacgaaacttctaaaattcataactcccaaataaaatgagataaaatagaaattctttcacctaaattaattttagaccagtacctattcactgtgcacaaatcatccattttagagcattttggatttttcgcatatttcggtgtttaattgcataacgtgtactttgtatagatgattgcttaatcggtgaagaagtgatttaggtgctgacattttccagttgcaaggcaagtcccacctccctctctttgatcactttgaacctatcttttggaggttattgaaaatgtttgcaaatcttgcatgtcgattgtacactaataaattaaaattttgttaaacttgttagataaactcctattatttgcattatcaccttaactccacatatatccatattcctcattcctaaccttaggaacaatatggctataccactttatatatgagttttggtgacactaggttactataaagcatagccatgcttagaatggtcttccttgtcattatgggctcatttcaaacatgaaaattgatttttaattaatctggacagaactttaatacttgtgattttgataaataaaatggtggaaagcatagattttaggtttgggcctcaagtggtgtacatatggtgattagttgtgtaccgatagggggagagtgcgcccaaaccgacctaaggacttcactcaatgtcagttcatttcgtatacagtacaaccacatgtgctagtatgggatagtccaagcttagtaaattatttatggtttagccttacattctggtaggccggtgtgtatgagttcggataactcagaggaacttcctatttaccccgacgtggtagtttaggtgactaagtctgtccaatacaacggtattgtgccacgtgggtgggttcccgttgtgtccgccaccacggcgttaagttcaaggcgtgggcccgccacttaacggttctaggtcatatttccagtatgactaggatggaggaacacgtatcgtgctggtgtaaggctaaatcatgaattttggaaaagctttgttgcgggtaataaatcgggtacttatgtatcgcgtgccatgctcttgcatgattattatttcgcatcatgtgggtaaagtgtacaaactctacagagttaaaactaatcgattagccgtgctcgcggtcatgagcggcgtgtggatatgtattgagtatagacttgtgtttattctcctaaatgctgaaatttaccttcaaattctgatgagatttgaaaatgatctccttgctgccatggatggcaatgaggtgaatatttatacatgattaatgcctactttgatgcccatatgctaagtactagcttgctgaaattttatttgaaagcaaatccgttttgaatgtgttttatgcaaataaaacttgctttatgctaaaaagaaccatactatgccttccttgattatataccttgcaagtagggtgttaggcttgtcttggtgcttgccagtacattatttctaataatgtactgactcttgctgttgaattaacttttgcttgcaggatttagacttagtctttgagtgatgcgggttatcgactgcttcttctaggacttgaacataatgggtaaacccctagtcggtgtgcttgtggattgggtagacaagtttccgctgttctattatttatttggccggtcggccaatgtaactaaagtagatgtagtttataatcgctttcatcttatttgtgtttgctatgtataatcatgcttgagatgaaagtgtgaatctagtgcacatcctgggaactagattcacatgagtatgagttaggaatatttgagatgttgtagaactttagccatttttgtcaagtctcctgaatgtgtaacacatctggtcgccgccttcgagtggtttgacgggcacgtctcaggctgaagttgactggcaggctaaaggcctagcaatatctccaatattcctctctcgaggcgtcggatatttcattatgcttgtttgatgacttgaattattcacttcatctctcaattataatggaaggtccggagagcctacgacaggttctttcactgccatcctcccaaaatgacagtgctcaaatgccactcccccaaaatttcattctcaaatgccactcggcccacatgtcagcctcttttctcattcaaacaaaagtgatgtgggcccgggtgatgtgtaaggctgacatgtgggctaatcaggtgacatttggaattaaatttttaaagagtggcattttgagcactactattttaagaggatggcaaaaagtaaattctatgtatagctcctggtcatagcagtgtttacagggtgagacggactgaaattgatggggatcatgaaaaacatatctcaattactggctgaaaatgtccatttggactgatttcttctacatgatcgtggagtggagatgctagtccgcccatctgctgtagtacgtgctatataatatcggttgagctatttcctatattttgttttcataacagagacgagagctagatggattccaaattattgtgaagtgtatttaaggaaggcggcaaaacaaagctggctacaagaaacaacccatcacaaacacaataaaaagggacaaggttcctttttattgttagaaaaatttatttccctagatcaacatgggttagaaaaatttgttctttcccttgaaaatcatcttggtcgatgtgccgctgagcaagaatcacttcagtcggagagtcgataaaggttgttgggctgcttaaattgaagcaaagctggtttgtgcatgctgttgaggctatattcagttgcactaatggagatggggctgtttggttggctcctaaaggttgccatgccaaaccttaggcatgcaacaattttttagtatagtgtttggttggctgttataattgtgtgatgcctcacattactagtcattggacctacacgtcatagactcaaattcttgccaaacttagccacatttatggctaacaaattgctagcctcactttgtgtggcatgacatatttgtggcaaacaaccccttaagtattgacatgcaaaacgagaagtcatttgcccttacgtatataagacagcctagagactaaggataggaccaagcaatagctggcattcaatttttttatacatctgcagctccaagaaaagaattaaaaaa

SEQ ID NO: 31623 - DNA, 2731 bp, Oryza sativa
  unsure (1)..(2731): unsure at all n locations
tctttgagcaggccactaagcggcacctgaagcgacgggtggcgggaataagggaggccaagcaaccaaacccacccccccccccttacgccaccccgaatcccacaacgtgaaacctccgtgaagccaagaagaatttcagtgccctaatccatggtcgtcgacgtgctcgtcgtggcagcgtaggcgggtgctacaaagccagctgatcgatcgtgaacgtgctgtggaacacatagcctgtgatggcccacgccatgacatgaaagctgtcgaggccaaccaggctgtcgtcggccatcgcggacacgtactgcagcgcctggcccgagcaagagccaaccaggctgtctacgccatcaactacctgcacatcgaccaagagcatccacatcagccatggtgtgattagtccaccgcagatgttgtaagaaaaaaaaattaaatacagtaatatcaacaaaaagggtaaattcgtacaaacatgggaatgaaagacataattaccctaaactcatgaaaccatgtgacaccagatcaagaataaactcaaaggtgaatcaccacaaaaggtcggttaatctcaatgcgaacatatttggatgaatggaatagagatggcagatcagacagacaaggggagaaaaagagatggttcttgctgcttgggaggcagtggcggacgcaggatttcagtgatgggggtacgatgttaaaagaaaatatcgctcaacataaatgatggaggcctatgtaaaaaagaactaacatggacatagttaaaagtaaagtgattttagtgtatagtaaattactaaaattaaacaaaattaagttataattgatcagaatttttttggaaataggatatgatgtctttgtcacgaacatgtagaaaaagttgtttcttaagaatgtaaccaagcaattatttaagtatttttttatgttcccgatatttcttaatttatttgtatagaataatcaattgcaatgtttgtgggaaaaaatttaaatagcccttgggcaagtcgatagagttttgaaggttcaacaaactaatattttcatcgattttgattatttgaacgctccacaaacaaaaatattcataaaatatcctatgaattttttgttggccagtagtcatctcagctagccatcgacaagtatgtatatatagcctacagagtaggaaggattgagattaactgaactggaatgccaatctaagtgcaaatataacccttttaacccaattacacatatgtaatacaccataatatgtagtgttctttttgcaaaaattttgggggtacagctgtacccccatgtccctatactgcgtccctatactgtagtttgagatgagcttgccaactatcagtgaggagcggttgagtggtagaatgagggtagagcggacaaaaggactgcgcgaggctgtgagttggaggcgaggcaagctgatgtcttcgttatgtggccttgggacgcccacctcaactgtgctgctccaaaagcctgtgcgtcgaggccaatggcggcaagaggcccagtggtcgacaaaattagactagctgcgggactagaagggccatcgcccgtgccactcgggagggagcagtcgaggcggctactcgaggtcggtgacgcccctgcccagcttctctcttgttgcccagtgacagatggggaagagaggggagagaagaaggatggcggttcattgacatgtgaggcactataatgccttgggagctcaggtagatcaatattcgatgtcaacatgaaggacctgagtgcttagcatatgagcatggggaagttgaggaacgtgttatgtcttgtgtacggttcaaggacacaattcaaattcgatgtcaacatgaaggacctagtgtgaacttattctctgaaataaaagatctacgtggtatgtgggctgggctaaatgattcaaggttcttgaaaggaatccagccatttgcgttgttatcactactagaaaaaaaagtttttccaggtggtcaaaacacattttcgcaggcggcaaaaccttccgcctgtatccaaatgacggtaaaaatccccagtttttgcaggcagacctcatttttgcaggcagccgttccaatcttcccaggagcctcaagtgctacactaaccctgccttcaaaaataccctcggcgccaaaaaaaaattcccgccagccccacccctccctagggtttcaaatcacaaatcacaaattctcacaaatctcatccaagaaataaaatccaatcacagacattgtatacttgcaacacaaaagcattagattcaaattcacaacaagttaacatcaatgaacttgtaaactaaaaaaaacacgtcgtcgtcgtcagcgaactcctctattgcatggggtggccgccaccacctccctccctccttcggtcagatctgggaggggagggccagtgacgcggctggcactattcgtcatcatcatgcggtagggccgtcgttgtctggtagtcttcgtcgtcgtggccgacgccctccgcccataccatcgccgacccatccgccttgcgacaacaccaacacccatcccctccatcagatctaagtggggaggggtcgaagggaggggcantaacccaaccaactgtanttatcatcattactcataagtaccatcactaaccccttccacccaaacctccacaaccccctctaccc

SEQ ID NO: 31624 - DNA, 6321 bp, Oryza sativa
aaaaaaattgcccctacgtaggtggtatttatattccgagtctatgttcacaggtggactggtccgcctgtaaaaataaagggtatttttgcaggcggacctgtaaaaatgaagggtatttttgcaggcagacctcatttttgcaggcagccgttccaatcttcccagacgcctcaagtgctacagtaaccctgcctgcaaaaataccctcggcaccaaaaaaaaattcccgccagccccacccctccctagggtttcaaatcacaaatcacaaattctcacaaatctcatccaagaaacaaaatccaatcacagacattgtatacttgcaacacaaaagcattagattcaaattcacaacaagttaacatcaatgaacttgtaagctaaaaaaaacacgtcgtcgtcgtcagcgaacttctctattgcatggggtggccgccgccacctccctccctcctccggtcggatctgggaggggagggccagtgacgcggctggcactattcgtcatcatcatgcggtagggccgtcgttgtctggtagtcttcgtcgtcgtggccgacgccctctgcccaagccgtcgccgacccatccgccttgcgccgccgccgacacccatcccctccatcggatctgggtggggaagggtcgaggggaggggcagtgacgcggccgactgtagtcgtcgtcgttgctcgtaggtgccatagctggccccttccgcccgggcctccaccggccccctctgcccgcgctaacgccacccgcccgtgcctctgccggccccctctggccagatctgggagggagggagggaggggccgcgccgcctgccgctggtagccgccgctgcctccggccggtggccggggagaggaggggaggggaggtgaggggaggatagggggaaggggagggaccgagggacgtgggagaggagtggtgagggagaagatgatagaaaaaaattgcccctacgtaggtggtatttatattccgagtctattttcccaggcggactagtccgcctgtaaaaataaagggtattttgcaggcggacctgtaaaaatgaagagtatttttgcaggcggaccgcttaaggcgtccgcttgcgaaaatgaatttttgcaggcggacaacgagctttaccccggtttacatttttgtaggcggctatgtggttccgagggccatgtccgcggtccgcctacgaaaataaatacccaacatcggtgaaaatgctttttctagtgtattaattagaatctgaagcactatgtacagtattaacatgtgaaatcctataaacgtacctcaacatcaggtcctatggacttcgggaacatcgaccatgcctactctacgtaaggctctcagtagtgagtgtaactctcaaaatgagagtcgtattgatgagaatatgagtgtggttgagtgcttcatgaagacgctatgttggtgatattattgtctagtgctaccgacgccgaatggaagattttcacacctaaagcaggtttcacatactcgacatggtgtgtgtgtttacgggattttgcttttcctgtgtgctcaagcagtctctaggacaccatggaagacatcatggaaacagacgccatcaaaaccactctgagaacacaatatacagcactgaggagatcattgatacattgtaggagtgagacatgaatgtgttttcatgaagtacaatgcatggaaaaagagtcacaacattatatcaaaattaatcaatcatattaattgaacaattaccaaacattcacaacaaaatactaatacaaatacacacccaatattacacaaccacatatccgacaataattaatggttatgacttctccttacaatggaaaacaacatacatgtaagtaaaaaacagagagaaacacatatgcatgcttgactctgttgtacaattaattagtcgagctagcaagaaaacgccatgcattaagcgagctggtgttttattctagctgaatttgccatgcatgcagaatcgtacatctgcttgcaaaaaaaaaaagaaaagaaagaaagtaaaaaaagaaagaaattaatagctccatgcagacccttgtttgcatggtcaattaattagttgccaagtgaccacatgagataatgatggacaaccttagcatggcttgatgcagatacagtttcgcacgaaggtgctgcacctgccgtcgacgaacccctccgtccgacacacgtttgcgcaattatcttccaccatgcaaaacccctcgaatcggaggctcttcgtctcgcacggcctgactgatgattgcgctggcgccaacgcctctgccaacaactcacacataatattagtccttacggtcgcaaaaataatcggtttagacttttcggatcgaagtataaaacataaatgtaagaagatggttttttttttgcataaacctaaaaaatatagtagttacacgtgtaataatataatgaatgttcatgttccctttgctaccaactcaagcatagtattactcgttatagttggtttagacttttcggatcaaataataagacagaaatgtaaaaactggtttttttttcataaacttaaaaaagatagcagtttaacaagtgtaatataatgaaagtgcatgttataacaaacttagctaagtcattttaatatataaaaaaaacctatcgtcaaacaataaataatatatgatgatcaaggagaacacacataccagtggcaacaacaagaagtaggaggacggcgattgctgggaagaatttacgcattgtctccattacaattattatgttagtactaaccacacacttctcagaaaattaatatatattttcaaattattcagtcttttgtttgggagggaagggatggcaccctgcttatatatgcaaggggcagcggcatgcacgggattaactagaaccacatatgccctcgttggctaggagtacaaacaggaaaatgtccctgccatatatagccactggctaatattgcaggcactctactggccacaaaatgcttgcgcgcgtccttccagtcgcaccaactggttccaatttgattcatcccacgtttcccacctactcaatgcctcatctatctattacgagttcattctcaatcctgcaatccttcagatccactatcacgtgggacccacctgtgatcgcccaaagaaacctcatcgtgggcagaccacttcgcgcacgaaaaaacaacgaaaaaaaagaacgccaaaaaaaaggcgcatctaacctccgcccctcagccatccccacgccgttacttccgcccgcccgcgcgcccttccctccccacgccgcaccggcgaccctgaccttgacgcggccaaggtccccctcggcgccatctcccaggtcactctcgcgttgcagccgctatttaagctgtcggttgcgtttgtgaaccgcaacgactcggacatcgccgagatggtcgccatgtggggcggcctccacgagttcggcgacgtggcgtcgctgccgcggcggcgcatggtcgtgtaccgcgagcacggccgcgccgccgaccacgcgggcttcctcgacgccgtcgaccctttcctgaatctcttttttttttactgaatcacccacatacgaatcaatttagagatttacctccattgttgcatccattaactgatgagttaggagatttactaaatctgatttctgcctgttcagtagataaggctccaagagagacatatgctggctattactcggtgcggtgaattatacaatgttagtatcaagtattagtttaattagcgagattaacaaaccacgctaccagctcaacattgttcctcaatcattgtctgttgtcactgccttatcgacttggcaatgggaaacaatatatcaaaagtattttgagttgtacatattttcttaatcgttatagattatgaattaccaggacttacatatatattctagacctaggtcatatttacacaatacacgtaaataaacagattcttgtacttataatatgctcaatttaatttatattgatcataacgtgtactacacgtgcacgattgctagtttactatcaatagaagcagctattctagaaattaaccgttcactctcagcattttttggatcttaccaaaccgagcggcgccaggatgggctcctcgacgtcgacggcaaccgccggccagccggccaccgcgacctcctcagcgtcaacaccgtacaccagcaacgggaggactgctgcgagcctgcagatcagcaggcgtcaggcggcgtcgcgacaagcatcagccaccagcagataagctagcagagcaggctaccgagatactgtctggtgagtcactgagtatctgaaattgaatgttagtcttgctgcctatattggctatctctcttcattgactgcaaattattaatctgtaacctattgaatgagtaattgagaatatccaagactttagcctcatgttttatagttctgaattattcgtagatttgcaatggataagaaaacaaaatttttaaattatttaccttccatttgtcaccgattttgatatatttatttattgtatgaccaaaataaaagttttagatcttgatgagttattcaactttgttgttgataatttttcagttgaaatcatttagtatttgaaaatattgtttgaagttgtcatattttcaaattcaaattcaaactgttcaaaaaatgttatatagaaaaatgaccaaaataaaagttatagatgttgatgagttatacaactttgttgttgatgacttttccatttgatatcatttactaggtgtaaaattgatttgattaataaattgaattactatactgcaagttaattattttgctatagttcaacatacaaatataaacatttcatatgtaaaatggaaaaatgctcatcggtgacgggctttagttaatgcccaatagagattaagtcatgtcaaccggggattaatatatagtccgtcattgatgagtcatctatgacgggcctcaagttggtgtacgtcacggatgatggtcatctgtgacgggccccaacttaaggcccgtttgagatatggaatgttatctcaattgggtctaaagttggtgcccgtcacggatgatggtcatctgtgacgggccctaacttcaggcccgtttgagatatggaatattatctcaatcggacctaaactacggcccgtcactgataggtgtcatctgtgacgggcttaagttttactgtaacgaaatctatctactaatagaaggtgtaatttgtttactgtaacgaaatctatctactaatagaaggtgtaatttgtttactgtaacgaaatctatctactaataaaaggggagggagagttatgcaagtaattttgttactacaaacgtaatccatcgaataatatgagtgaatgggagtagttataatttatttacaacagcttatctagacaagtgaagcgcagtaaatgtaatattttactacatcttaatctgtctatctagagaacgggggatgagcctgggaccgtggggaaaaaggggtaataattttactgtgtccacgggagcggggacaacgggaaaaaaaaacattgagtaattcttttaaggattaatttgtgcagggagccagaaaaacagggaaataagtggaacagatagcaaaggggaacggaaaaaaggagcgtgggagccaaacagaaaactaaattcaggggtaacggaaaaacggaaaattcggggggagggggtggcgcagtaggggctaactgcggcgtgcggattacaattccgagcgcagggagtggattagcgctaccataattttatggtatttttctagaatttaattcactaatagtagtctaacttgtaaagttatatatgatttacttaattatggatcacactcttgtttaattccacgggtacaagtcttaagtagaccggtcgctatcatgttggacgctatactagcctaatatttgaaatttcgtgaattctaaagaaaacttatattggtttctatcacattctcccacattacatactacctccgttttttaatagatgacgccgttgactttttctcatatgtttgaccattcgtcttattcaaaaaatttacgtaattataatttattttgttatgagttgttttatcactcatagtactttaagtgtgatttatatcttatacatttgcataaaatttttgaataagacgaatggtcacacatgtg

SEQ ID NO: 31625 - DNA, 8071 bp, Oryza sativa
  unsure (1)..(8071): unsure at all n locations
tctttctaatctaatcatattgcaattttagatagatttattatatcaaacatgtttgcgtagatctatcagctaagtaagtttttcttattatcttcaatcttataatgtctcggtaaggtcccattcattagattgctactaataagtttaattctagtaagcgatatgtttttatgtaatgttttattggagttctagctgatgagctatcattattatgagctttagctatcagatgtatcggctaactagccgatatacacgtgaatctacttgcgtcggattaatagacgatgtatgctttaaccatcagatctacatcctccacactatatcaggccgattggttcgttggttcaattctttctgtcgtccttgttagttgcaagatcaaactaactggcccaaccaaagcctgattgatagtacctatactagagctaagcaaatctccttggccttcgtgtagatgacgaatttcacgtcaacagggtcacaaccatgtcccttcataaattgcatgccatctatgatgagtgtagtggtatgaaccgtcacacataagtggtgatgtgatcccgtatctatcacaggtcgtaattgccacacgtcacagattgtaacacgccaggtaaacatgtacttagaatgccacacctaaatatactcaaaaccattaactctcaaaattattagaaattttggcagagtatcccctataaatatggacatctacaatatacagttataggattaaactaatgataatataattcccacagtgctatccatccatataatccatcgaaagaaactaatagacagctaaaagattattacaagaccaaactaggatataattcaagtgtcattatggcactacaagagatcttataatagatgacgctccatttacgtcacaatcgttgaatttttcgtcacgtttcgtaatctgtgacgctcgtgtggcgaaaattcattcgtcacctatcatgcatctctaagggcgttctatcacgaaaccttaatttttcgtcattaatctagtgatgatccttctgtcgttataactttgtgacgcacatattcgtcattatctagctaaaaaatgtcataaaatatcatgtgccttttaaggcccatgtagtgagcaacctatttttgggctaggccttgttaaggcccatgtagtgagaaatctatttatgggctaggcctattggaagtctaattagattttaataaattcagcccaattatactatatccatctatattgaattaaatattgagtgggctctatatattcaaatggcccagtaagctcaagcattacaatgaaattgcatctgggccatgcatactcaagaggcccatatatcaaacagattccaagttaaaatccaatataaaacccaattaacatccacacatctgacatctacagcagtatgaattaacacgtgggccaacccagccacatgtccaaatacaaccacaatcgctgaccaaattaaaatacatcataggctcattatctaaacaagttcaattacatgacagcttcactgaccaaaaattacatcacatgtccagttacatcaggtcctgaatagcaaaatnnnnnnnnnnnnnnnnnnnnngtactaatcgagtcacaactcaatcaccgtccaaaacaaagtcacatgtccaaataatcattcaaattcactaacctgaacaagtcacatgtcaaagtcgcaccaaccaaaacactacaaccatctcatcatgaatcagcataggcccaaagacaagctgcgggctgaggaagggatagagtaatacttgggtcgaaaaagcccaaagacagagagaggaattttaatttattttccatttattttaataggttaaataaactttgtggtattaaaattagttcttgagcaccgaaaattcacaagaattatttagaccacgtagaatattacaaaaatatttccggccatgatttataaaggaaaattttagtttcctcattaattcacttgatgaaattgctttaagttttaatatatttttctataaatgcattatataaatttatgacgtttgctttgtgccccttatgataaattaatattcgtcacgatgtcccattgaaatactttattacgatttctagttggtattaacgatgaacacctttttttcgtcactaagccaccccatctcatactaatcgtcataaaatggaatgtgctagtgacgaattgctccaacatcacgaggaattcgtcacagaaggtcatatttcttgaagtggtcctcctaagcaatatagtttgatatagtttgatagtgtgcagatagatgtgtaaataagggtcctacttcctgcccatacatgttgatctcaatgtgtatctaaaaccaaataaacacaagagtgagtacagaaatactcaacaactacaatatggaacaagaaaacacatatacacatcattggcaataaagcctaaatagataactttctttctttgaaaagaaaaacattttcaaacaccaagttaaagaaaatagtagttcccatcctgggcaaacatgaattgacatagtagttttccgtcccagacaattgtaaatacatcctagcatttcccggcaaagcagagtaagcgtgatcagcgcttacatacaggaacatgaatgaaaaaacagacagcatatccatgactcgcatggaacatgaataattaggaaacaaagaaccaaattgaaatcatattgcacatccatggcaagtgttggtatttcttacggtcacagataaaatctgcaagcgcacggatataccgaggtagcacttccaatacggagtattccaagggtatcgaatccaagggaacgtgtgtgatcagatcttcctccagtttatccaaggacaccaagcaaatgataggccaggatagagaggatttactagtgagaaacagtgtctccctactacgtacccggacagggaggacttcagtgatctcgagggctgtcaccacctctacacccacctcaaacgtactgtgggctacacagcaattactggataataatcaccaaaacaccacgtctaagcaattactatctactttagtgtttataactcaacaaagcaaccactatattttagttgattatagtgaacaataatcctgtatgctacttaggaactaaccaagagttaattctcacaagataaatctaaattactcaagaagaatattatattgaattcagagtaataaacagaataaaagaaataggagaagattaccaacaactccagaattcttccaactccttctactctactctcttcctattctagtatacaatatagtacaatagagtctcttataattcagctcaagcttggaactgtgtgtgtgaagtgagggagtgatgtccttttatagggcagttatgacggttgtgagaaggggaaatgtccgaactgccccgcaaccatcattgggagagcatctggagcgtccacgccaaaccccaggatcaacagcgaccaggggggttcggccgatccagggggttcgggcgaacctatgatgggctctcctggcctggccttcggactgcggactccctaggctctcctctatccatttctcggagttttggattgattcgctgatgtttttatgaagttcacaacccctccttgtatggatacataattctcctcactttagtctagatttcctcccaacgtcagggtttatcatctgcatacaaatatacaccaacacttgtgaaatatgtgagattaagcacctatcactatgttggttgttttattatctgaactttatgcatatgttggcggtatagaatcgacatttaacagccgccaacagcaagcatggaacttaaattatttaaccagaatcagaatctgaaatattgaaaacaagaataacgttgtaaacattagataaacttgaaatctaaatggcatgaacaatcgcatgaacataagagtcacatatcacatagaaaataatgaaaataaatagatagagcaaacaatccatgaatcacataattagtttgtcgtgcacttgcctttaaccttgacggtaactcgaggcaacactctccacaccagatctctacacacatgtggagtaaagctacaactaaacatctatatttgactaactatagttacaaaggacatttactaaaataaacacctaaaatatatattttatcgattaatattaaacaatctatagcagtttcattattgttttatgcgtaactcaccaaccgcataacaaaattttgcaagtaatagaactcaggacatccaaacaaaattttctacaattttcatgttgggagcaaaatcagattaagcctctgtgaatcccagattaaggaaaacaaattgttgtcccagattaagcctccataaaaaactaattaagcctctgtttctgttgtttctcctaaaccgtttatcggaatcgagagaaaccagtggcgttaaaaagatcttgacgatgactacaaactttatttaggacaactaacttgaatcccgattgtttaataccagattggaaaatattactttcgacccataaacaacaactaaaaaaacacacaacaggctaagagaagttacccttgcagaggataaaaattgaacttccatggactaagagaagttacccttgcagaggataaaaatcatatttgaggtgaatttatggaatcccagaaaaatccccaactttgcctctcttccctttttccttcttttcccctcctgctttctctgccctctgaaccatttcctcgctgatcgttgtagcagcagcagcaacagaccacccagtagcagcagcagcagctaggaacgttgatagcagcagtagcgagcaaatcacacagcggcaacagatcagattgacagcagcaagaactcaccggaaaggagcagaatagtaagaaaccaccgataacgaaggaggatgatggctgcagcaaccggcaacagtcggggcggtggtggtgacgcagaagcggcggcgacagtgatagtaacggcagcagcggcggcaggggcgcaagagtagcagtggctagggcttcaaggtatcgatctctcctgttcctttttttcttttttttctgttgtttatatagagagaggttaaagaaaatcgaacggcccacattaattcgatcaccggaaatacctcgggactctgattataccacaaacttatagtctattttgcaatactcagcgagctctatgcatccacggttcctgatcgcctatttgaacaacggttaaaaagttgaacttttacacgtttgttctaatattttccgaaatacactattttcatttgagatagcttacatgtccgaatattcattataagacgactcatttgtgataggtgttcaccatcagagataagattttattatcactgaccactcatctgtgatgaggcctatacacgtcaatgaccctgggtcctatgggctgtgatgaggcctatacacgtcaatgacccggggtcctatgggtatcatagttctagaaaccaagcaacattaatactcactctgtatcaaaatataagcatttataaaatagcgcatatctttttattaatgttactactgataacaaaaaaaatagaaaagatcaattatgttactatatttatcatgaaacaaactatcatgatatgcatatatttttatttaaagcatattaagtttatagatattgttaggtaaagtatcatatcaaaaattgtgttgaaataaaaaaatgattatattatgagacggagtgagtatctaatatgccacataataaaaatagttataatgcaaactttgccacaggacacgcaaaaaatatgtaattggctgggagacaccgcaaaaacgtaacacgactgatggactctaaaaaccgtataattggccataggacaccaattgtattattttattatttccggataaaaaaggtgagatatttttctaaatgtccggattgtcccttctctttgcttctttttctccttctctttatttcttttccccttcccattgacttcgccgggaatggcacggcgacctcggaggcgcggtggggcgaggcaggccagcatggcgagcagcaagcaaccgacgcctgcgctgcgcgaggcagagaggagcgcccatcgagcagcagcaggcggaggtggtgtacggcggagcggagtatgtagcgactcgggcggcagcatgcgagattgggagaaggaggcggtgtcgcagtgcagcgcacgtgcaggcggctgctccacacggcagcgcgcgagcagggaccggacgtggaggcaagcaggcaacggccacgacgggagcttgtgacaaggagccgcctacggtggagcttcgagcagtcgctagctcgtgctcctccacctcctgtccctccccaaccaggtccgcttctgcgccagctaccttgccaatagctacaaaacttctgtgatttcgggtgagggaagatggcgccagggacaatctcgttattttgaaaaattctcacatctaaaataatgtgactggtgccctatagccaattatataatttttgtaatgaccatcagccgtgtcatgtttttacgatatttcccagccaattacacttttttaaatgtccattagcaaattttgcctagttataaagatgtgccaatgaaatgtttatcaaaatataaactagaaaggccaaaattaacctccaaaaccacatcttgcctaaattgattttcttagaaaagattgcaaatcacttagtaaaaaggtcacgtaaatatgtatctacaataagattttgaaaatttacatttcaagatggtctttaaggtctctaactgacaaaatactgcattgttggtaattttcatcaattattttttctcaaatatagcaaataacacaatccctcaagtgtatcaccagtgcaattgtgtaaatatgtcttcacaattatcatggccaaaaaaacatcttccaattgtacttagcagtcatagcgggcattatatagttcctatatgcaatatataattttacatttggcaagacaagcacttatctaccaggaaaacagaattagggaaggagaaaacactactacagaatacctaaatagcgtcggttgggaaacctccttcggtgccggttttcccaaccggcaccatgaaggcggcacagatcagggaactcatcagtgccggttgtaaacggacacctataacaaatataggtgcaggttgaggggttcccaaccggtacctaagatgtttccacgagccaaatagaaacagctagacgcatcggctcgattcgagccgatgcaccgaggagctcccaatcacctaagaacacatccatcaacaccccaaatccaagaacacatctatcacatcatccccatcctagatcaccaccccaaattttttccgtcttctccaccaccaccatcccagatcacatcatccccatccaaaactaagtatcaaacaactcaagaactcaacaggttggaaatggaggaggagaaaagaaagaaataactcaacaagtctcttgtcgaccggtcgccgcctcgcccgggccagcctcctccacaagtagcgccaccgttgtcgccggatccggcggctgccattggccgccacctcgcctgcgccagtctccaccaccactgccgacacggctacccacggccgccgccgccgggtcaccgcctcccctccccccgggatctggtggaggggagcgtgcggtcgctgctgccgccttcaccggagggcgccgcagcctactgtagcgcccgttccgtcgtggcacctagcgggaaaattatctccgaaaaaccctaattgcgaaatttgtttctttgattgttgtctagtgtccgtgccatctcaagatctcaatccccgatctatcatcgagttcttttccg

SEQ ID NO: 31626 - DNA, 10259 bp, Oryza sativa
ttaaacacttatttcccctggcttgctgagtactcccatactcacccttgctctatataaataactcctccccagttgctgaagaagatgaagcggatcctgctgatgaggagttcttccaggagcaagccggctacgatgagttttagggtttcggcctagttcccaagtcgcgcctgtgttgattggtccaagtcctggcttccgttttccttttgtaatgcagttgtgagctcgggatctgtccgcagcccaacatgactgtactcctactctataataaagagacttctgttgctgtgatattctgtcttcctgtgataccagcactgtttcctgggactggtatcgattaacaggttaatttggagtgtcacgggctagttccagtcggggctagctcggggcgtgacaagagatggtatcatagcacaggcttggccctagggcgaaacccgacgcttaggacgaccctaaggatactaagttcaaaactacttgcgaaaagctaaggtctcttttgttttctttattttcaatagtttgtttctaaaatggttactgatctttctccctctttcaaaattgtagatggcagtgaacgccagcttcagttcccacggttttagtgagggtcaccacgtcgctcagcttcgtgacctcgcccgtttccttggcttctcgtgtcctgagtacacggggtactccgtggaccgtgttccccctcactgtgagctctctgtgtacctttacccccgtggaggtatacacggagctggccttcgcccccaccacttcactgtggccaggcccactctccagatcgcgtaccaggacctctcctggactgcacttcgtcgcctggcccacgactacaaccaccgtctcggaggttccgccttccggcagcttccacgccttccttctggccactcagacgccaggtacccttgtccgtacagcgagtctcagccagtgctgactcgcatggttgagctttcggaggctcaggccactcagcacgacatactccttgaggcttaccgctcccttgcccgccgctacgccgctttggaggcccgtctggccgaggagggtgtcaccttagttgacactatctcttgggactcaggccgcctctgccacgccagccacctgtcctcccacagctcccgcggctctgctcgcactcccagtggcccgcgctcccccagctcgcgtgcgccgtactcaccagtgtactccccctacccacacccagttagcccttcctacacccctggacacaccccagttgcttcctcccgccgtggcccacgctttatccgcaccgcgcggaagcgtgttgttggttcttccaccgtgttccgtttccactacccagctcccccaccgccagcggcccgtgctgctgccggccctcgacaggttccgccggtcccttcgcgtcagccgatcgacgtttcttcgactgaggagccgactacaggaggcagccaggccgacgaggagtagaggaggcagtcttcagcagccgtccgtgtgataggctcttttgttccgccgccaactcttttggagtcgtggcgaggtagtgcgtgcgtgggtttgttgtgggtgttgtttggtagtctggttctcctaggtggtgtgcgcacagtcaagctcggcgtagctctgtgacttgtccacacccgttgtatcaggtgtttttatgatttgaaaaatccagtttatgcctagtgtgtgctatctgtgttgctatttgctttgctccttgccctcctaagtgcttatctgactcttaccccgcccttttctgggagtttagatggctagccgcccccgccgtgcagctcgtgcaccagcccgctttggttttgaagatggtagagttgaagcagaagcaaatcatgaatcagctaatgagcagtctcaccacagcaaccgttcgcaccgtactgtttcccgcaacgcagaggttgagcaaccccgccgcagcaaccgctcgcatcgcatagttttccgtaatgcagagatggaacagtctcaccgctctcaccacactgccagtcacaattctggagaagaacgcctcccttccccacctcatgtggaaaacaacatgcaacacataatggcagttcagacacaaatcttgcaaggaataaccacagccatagccggttttcagcataatgcgcatggaaatggccaccctcacgtgggcaacaatagatccaagctcacagactttctgaggtcacgtccgccagagttctctcagaccgtcgagcccgtcgaggctgacgattggttgaaagatgttgatagaaaactcaacttagtgcagtgtactcctgttgagaagacgctctacgcctctcaccagctaagaggacctgctgcagattggtgggagaattactgcaatgcacatcctgaacccactaacattgcttgggatgagtttgctatggctttccatgcagctcatgtgcctgaaagcactattgacatgaagaaagaagaattcaacagacttaagcaaggcaacagcagtgtcaatgagtacctaagtcagttcaacaagttggctcggtacgcccctgaggaagtagacacagataagaagaagatcaggaaattcttgaagggaatcgcagttggaatgagactccagttgcttgctcatgacttccccacttggaatgagactccaagtcagttcaatccagttggaatgagactccagttggaatgagactccagtgtactcctgttgagaagacgctctacgcctctcaccagctaagaggacctgctgcagattggtgggagaattactgcaatgcacatcctgaacccactaacattgcttgggatgagtttgctatggctttccatgcagctcatgtgcctgaaagcactattgacatgaagaaagaagaattcaacagacttaagcaaggcaacagcagtgtcaatgagtacctaagtcagttcaacaagttggctcggtacgcccctgaggaagtagacacagataagaagaagatcaggaaattcttgaagggaatcgcagttggaatgagactccagttgcttgctcatgacttccccacttttcaacatatgatcaacaaggcacttctgcttgaggatgccagaaaagaggctaccgaagaatacaagaaacgcaagtcgcaagtctaaccatcagggaaattcttcccgaggcgcacctcgccctcgctacggtcaacccatgcaataccaccagtcggtcactcaggctaaccgacagccaggctacgcccctcgtgtcacgcccggaaattcactagtaatttccgaacttatttgtgcataaaatcctcgtccaggaatcagccgaggtacacaaactgacaattttaatatacaaacccatcataataataacgttacatacttacaaaagaaaagaaaaacagcagcggaattaacggtctaacgatggcttcagctccactcccacaggcagctcaactggggtataagccaaacgtcttctccttctggatcctttatcttcaactgaggtttgatgattattgcaagaatgagcatatgacatactcaacaagccacacagcaaatatgcaagtacacaaggataccaaaggatggcataatataggctcatttgcgaaagcagcatttagcaaagagttaagagtagtaaaacagtagagtaattaatcagaaattttaatcaacactgaacagcacacccatgctgtacaggcccaaccatcctgaacaaccatacccggctgtacagatctaactccaaaccaggagctaagcaaattattaccagatattaacatccataattattgtgagaggtgtgagactaatcacgaaaaacattgctcaactcgcccataaccgcgggcacggctattcgaatagattaaactctgatcagaggtgtaccactgtacccacaagacacaaccccacatcatgtcacgatgtgcctcaataccaccacggtacctcggaaaggagttgtgacaataccccttgcacaacataacccattacagcgcacctttcctggatcataatcacccccttataaataaggcatggactccccagcgacccccgtgaacttctcgccacttctcagtctggcgcactataatgaatcacgctatacaaaagataaagccgttgcccacgctggcttgtggttggcatgataaatgtttcacaacagtagctcgcgaaccggtccttaattgtcatgagcacaaccatcaaaaccatatgctcacaacccaccttaaccaggttttaattatcaattaattaacaccacacgattaaccatcgtgagctaccatttaatgtaaccataaaaataataatgtaacatagtttataattaatccctttagttagctaatgtttctaagcatggctaagcaaacttacatatagcatttagctgaaccaatccaatatataaggttcacgctaatcaaattataacccataggaaaataagatcatcttcggccattaattaattgggaaaggttcaccacccgatgacattcgaaaataatgcatagttgaaataaaataatagctttaaacgggttcaacatgctcaaagggttatttgggatctgtgtgacttgccttgagcttccgcaaacacttccgaaccttgctcaacgagaacgctctcctccggaacgtcggaaactaaagcgaaagaacaaaaatcaacaaaacagtacaaaaacaagcataaacagtacatgtgaatatttttaacatgtagatcttgattttagaaaaatttagcaacttgaaccacctgaaacggatctacggttatttagttatgattttccgaagatttaatctattagaaaaacgggaaaaagaaaaaccgatgatgtcatgatgacgtcatcaatggcggccgaaccaacatgacgacctcgccggagattggatggtcggctgcgactttggaggacatgtacacgtagaggacgacgagacgaacccaacggtactcaccctcgaaccaaacgacgaacgacgacggccggcgacgagatgaacggcggcggcggctcggacctcgccggagatggagctccggtggccggcgacgaaaggggacgggtggccgagcttccccacggcttggcgcatctaaaggcgatggcggcaagcggcagcgacggcggaggcggcggctcggcgcggctgcaacccggccggcggcggcggcggactatgcggcgtcgacggcgagctacggtgcacgggagaggacgggaaagggggcaaacgaaagaggaggactagggggtcctatttatagccttggattgaagagatcggactcctcccgctagaaatcgatccgggaaatcaaaaactcggttttggagataaactcaaaaacgagttcgattcggataagatactcaaccatttgctccgattcttgggggaaaggatagaggaggataagaggaatatttcccctcaactaattttgcaaacgaagcacgggatgcggcggattcaacggaggaagcggcagcacagagctcagcacgggcggctggagcttgaagaagaacagtaacgcggggacgcgaattagacttttctgtgtggtttcctatgctaggcccgattgaaggagggaccacaaatggactttggaggagggataaggccagccgaaaggaagggagaatgggcggaggagtgaagctgaacttttcctatttcggcccgaaaaggagaaggggattttaaatacttttccaactaaattaatcacggaaatgatctttgaattgttaaaaatacttccaatgctcaaataattccaagaaaaatcttgaaaatacttggacactcaaagtacttaacaaaattataattagaccatttaatgattaatttaatatgtgggtaattactgaaatgctctttgtatgattaaaattaggaattgagctccgaaaaatccgagaaaattccagagagtataattaaccatggagaatttaataaaaattaaatccatccatgctttatatttaggaaattttatttcccacatttaacttcacttgtaaattaatgaacatttaatataaattctaataataatttattaaataatttatgaatcctgaaacaaaaatcaggatgtgacacctcgccctcagatgaaccgtccggcacctccgccacagcagcgtgcccctagtggcaacactgcgccaaacagtgttacctccttcaagtcaccacagggaccgtcagcagttcagtgtttccggtgcaaccagatgggtcactatgctagacagtgccctcagaatcctaccaacaccaactcagggcatgctaatggcagcaccgccagaactcctactccagcggcagctcagtctcgtcctagctctcaggcaagtggataaggttctcgtgcttccaaccactttggtcgaggacgtgtgaatcacattcaagctgaaaccgctcaggatgctccagacgttgtgatgggtatgttctctgtcaactccgtacccgcaatagttctatttgattcaggagcttcccattctttcatatcacaagcttttgtgaaaagaaatggttggaaaacccaaaatttgcgtgtaccaatgatagtacattcccctgggaggaatataagggcaactcaaatatgcccggaagttaaccttagaattgaggaagttgactttctagccaaaccgataatcctagactcgcaaagcttggacatcatcctagggatggattggttggctaagcacaaaggacagatagattgtgccgaaaagtccatcactttgcaaggacctggaggaaagcaagtccgctttacccctaacacccctaccgcaagtcggtctatcctaacctgtttacaagtcacctccttggagtcggtgcccatagtctgtgaatatcccgacgtatttccagaagaattaacgagtatgccaccagaccgagagattgagttcgccatagaactggcaccaggcacagctccaattgcaaaaagaccctaccgaatggcagctaatgagttagcagaagtcaaaagacaaatcgaagagttggagagtaaaggttatgtgcgacctagctcatctccttggggagccctagtgcttctggttaagaaaaaggatggctctgagagaatggtaatcgactatagagccctgaatgaagtaactataaagaacaagtacccgttgccacggattgacgatttattcgatcaacttaaaggagcaagagttttctcaaaaattgacttgaggtcaggttaccaccaactgaaaatcagatctgaagatatcccgaagaccgctttctcaacgcgttatggtctatatgagttcacagttatgtccttcggactcaccaatgctccagcattcttcatgaacttaatgaaccaaatcttcttggaatacctggaccagtttgtcgtggtgttcatcgatgacatcctgatatactccaagaacgaggaagaacatactgaacacctgaggctgataatggaaaagctcagagatcatcaactattcgctaaattctcgaaatgcgaattctggttggaccgagtagcatttcttggacacgtgatttcctccaacggtgtcgaagtagatcccagcaaggttgaagctgtacttgcttggaacccgcccaagaacgtgtcagaaatccgcagcttccttggcttagcgggatattatcgaagattcattgaaggattctctaagctagccagacctatgaccgaactgttaaagaaggaaaagaaatttcaatggtctgcagcctgtgaagacagctttcaagaaatgaagaaaaggttgaccactgcaccagttctcaccttgccagatatccgaaaagatttcgagatcttctgtgacgcatcaagacaaggcttaggatgtgtcctaatgcaagaacgaaaggttgtggcctatgcatccaggcagctcaggcctcatgaagtcaattatcccacccatgatctcgaattggcagccgtggttcatgctcttaagatctggaggcattatttaatcgggaacagatgtgaagtatacaccgatcacaaaagtcttaaatatatcttcacacagaccgagttaaatatgaggcagagaagatggttggaactaatcaaggattacgatcttggaatccactatcatcctggtaaagccaacgtggtcgctgatgcgctaagtcgcaaggcctattgcaatgtagctcaatacggcctgaccaagagcatttgtgcagagaattggagaagttaaggctgaccgtggtacagtcaggagtccctgccagcttgacagtacagcctaccctagaatcgcaaatccgggaggctcagaaagatgacgaagggataaaagagttaataaaaagaatacaggagaagaaagacaccaatttctccatagacgatcaaggcacagtttggtgcggtccacgcatctgtgtaccggccaagaaggagttaagagatctcatcctaaaggaagctcatgagtccgcttactccattcatccaggaagtacgaagatgtaccaagatatcaaggcatacttttggtgggctggaatgaagcgagatgtcgcagaatatgtagccttgtgtgacatttgccaaagagtcaaggcagagcatcagaggccagctggtatgctgcaacccctaccgattcccgagtggaaatgggaagagatcggaatggatttcatcaccggtttgccaagaacccccaacgggtacgactccatttgggtaatcgtggaccgactcacgaaatcagctcatttcgtgccagtgaaaaccacctatgatggaaagaaactagcagaactctacatgacccatgtcatgtagatttggctgtcccaagaaaattgtgtcagaccgaggcactcagttcacctcaaggttctggaagcagttgcatgaagccctcggaactgatctgaattttagtacagcctaccatccgtagaccgatggtcagaccgaaagggtaaaccaaatcctagaagacatgctacgtgcgtgtgccttggatttcgaaggcacttgggatcgttgtttgccgtatgccgagttctcatacaacaacagttatcaggccagcattcagatgtcgccgaatgaggcaatgttcggaagaaagtgccgcacccccttgtgctggaatgaggtgggcgaagcactggtattcggtcctgacatactcaagtcagcagaagaacaagttaagctgatacgagaacgtttgaagacagcacagaaccgttagaagaattacgctgacaatcggaggcgtgaccttgagttcgaaaaaggagatcatgtgtacctgcgggtatcacccctccgtggtatgagaaggtttgggatgtccggcaagttagcaccccgctacatcggcccctacctcataacggccagacgtggcgaagtggcttatcagcttgagctacctgaaggtctcgcagatgtgcacaacgtgttccacgtatcccagttaaagaaatgtcttcgagttccagaagagcaagttcccctgggtaatatcgagctggaaaagaatctgacctacaaggaaagaccgatcaaggttcttgaagaggcagaacatcagactcgaaggaagaccatcaagttctacaaagtccaatggagcaatcattctgaagatgaggcaacctgggaacgagaagatcttctccgcgccgagtttccggagctgttcccttaggtgctgaatctcggggtcgagattcttgttaggggggttggtatgtagcgcccgttccgtcgtggcgcctagcgggaaaattatctccgaaaaaccctaattgcgaaatttgtttctttgattgttgtctagtgtccgtgccatctcaagatctcaatccccgatctatcatcgagttcttttccgaatccaattccttccaaatcgaatccctctgcaaaagtctagtttgcctccccgggttcgatgggccgaattccgctcggcccatctcttccccggccctctctctcccgggcgtctccctctctctctctctctctctcgctccctccccaccccggcgcgttt

SEQ ID NO: 31627 - DNA, 14324 bp, Oryza sativa
  unsure (1)..(14324): unsure at all n locations
ccgcgcgctagcctccaaggggcagaggcagagagcccctctccctctgccgagtcgccctgctccctcctccttttcccaaatcggcaaaggggcgagccccctttctctccctccttttcctctttttctcccctttttcccctctcgccggcgtcacctcctgtcgccgctttggacgctagccggagcgccagctcgccggcttgaccgcccatgtcggttcccctctctcaaaccgacattgccgcccatttaaacccgtcttccccctcccttcctttcctcccccattcgcctcctcaccgttgccgccactcccgtgctctgcctcgcctccgccgtccatcgccaagcgccgggagagccggtgcgttcgtggacgcggaaggggactccgggcgcgccctcttcttcctcttcctcggcccgaggccggagagatcactcccgcgccgttggcctctcgtcacagcgcccctcctcaccacggtagtgcctctctccgttcctcctcctcgctccatctcctccccctagctttcggtagtagcttgagtagcctccccgtagttagtcggcgccgccccgaccgttgccgtcgctcgccgtgtgctcgccgccgtcgccgcccgagctccgtagcacccgctcgtcgccggcctcgctcggcgtagttccgcccaatccgacgctagcgtcgagttcccgaagccgcgtagatgctctcaccgccgggaattgacctctcgtgacctcgtcgccatttccctcttctcccgccaccggttgccaccgccgcaatcctccgccgtcgagcaacctccggcgaatccgagccgttggctcgcctccccttgtcacgtgcaaccgcccggtgtgctcgctgttgcccgtatcgccgtggttcgctccgccgctcgccgccgccgcccgccgtccattcgcggccgggtcgtcgtctacctcccgccggcccgcgtggcagccacgtaggcgccacgtcggcgccagctcagccagaccgggtcgggccgaccccggtcggtccctccgcgtgcgcgcgatccaccgcgagccgtgaggctgcgcgtgggcccgccgcacctgcgtccaccgcggaccgcgcgcatgcaccgcgtcccttctccgcccgcgcgcgtgcgtcgcgtgctccttccgcacggtgagccgagccgctgacaagcgggtcccacccgggaccgcgtgtggtgagcccggtccaccggactctctgtcctccctcccgcgcgcgcgcgcgcttgggccgtcttgggccggccggcccgttaagatcggccggtccgctccatttcccttgggccgcgccctagccgcccgagagaagtctacttctcctccctcttccttttctttctcaaaatggatttaatttaatccttttaactttagaccaaaaatccaataatcttagaaattcaatatcttcccaaccgtaaatccgtttgactccgttcaacttccaaaattccccaaatctcgagatctatctaatggcacgcttagaggtcattaatagggctttattttcgccgtttgttgagttgtcccatttcgcgtgtagtttcgaagcccgaagacccgcagtgcgaggatttcgaggatcaagctccagatctcgagcaaggcaagccacctttgaacatcttgagcctatatttgaaatttaattatattgcttgcaaaatattatgcattgataggatcgcacttaatcttttgtcccatctgcaaggcagattggcggacctaccagacttgttgcatttgatccttccattgttaattgctatactatgtccctttgtaaccacccagttgcgcctcgataatcgtgcactctgtgcgagaatcgacggtcgccttcaaacttaaaatctgagtaacaacttgggtaaaactggagttttacaaaagacttggaaaaaacccgacacctgggtcggtgcttgtgaactaaatgaattcccaaaaccgcggaccggggaacgtaccgggtgtacgattacccgctcttgcacctaaggaccgtttccttggaatttcatccgaacataagacaagtacgaccacatgggtggaatgggacacccttggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccacgggctggatgatccgggttagtaatgtcatgtgggtaaagtgtaccccctctgcagaggttaacaaactgttcgaacagccgtgcccacggtcatgggcggatgtgaggtgattcctagcgtagttttgtttgactactgctcgtgaaattgctgttgtgaaaatgggttcgatgtttgaaaaatcagcagctgacgggatcagctaggcccgggtggccgtttggaaagttgttggcccgggtggccgtttgaaaagttgttggctcgggtggccgtttaaaaagctgttggtcgggtgccaaccttgtttcaagatctaaagactgacacattgcacatactccgaccggacgagacgcactgtctcatccgtgtcgtttgagaagcactcacttagttgcttttagaaaagagttcaaataaaatcaattgctaaaacaatagcctttccttgaagcctgcattaaacacttatttcccctggcttgctgagtactcccgtattcacccttgctctatataaataactcccccccagttgctgaagaagatgaagcggatcctgctgatgaggagttcttccaggagcaagctggctacgatgagttttagggtttcggcctagttcccaagtcgcgcctgtgttgattggtccaagtcctggcttccgttttccttttgtaatgcagttgtgagctcgggatctgtccgcagcccaacatgactgtactcctactctataataaagagacttctgttgctgtgatattctgtcttcctgtgataccagcactgtttcctgggactggtatcgattaacaggttaatttggagcgtcactgtaacatacccgaaattttaggacttaaaatttcttgtcaaaatagttagaggttaacttctccaattttgagagagagccaaaaatttccattttaatttaggtgaagatcaacttaaaccattgcatgattaaaatttgagaacaaaataaaatcttttcattcccaacattagactagaaatgtcaccaagcatacatgtacataatgcatgcctaggctcgagttctttgtgcatttggagttttggtcttgcattccataatagatcccatgagcataatctaaaagaattacttcactaaacaaacctatagttaatctgttaatcttgggtgataacatgtggacttaatattaaactcaaatatcatcttcttagtctaaaagaaatttaatgtaatccctataataatattagatgcaattatgaagtgggaatacatatacaaacaaaggtcatcctaattctctaaaatattttgtgcaagataaaatcatggaaaaatttatgtggacagtgattagcacaaacttatcctctgtaattttggtaacatgttaacactcaagttgaaatctcaaattaatcggtcgaagcagacaactaaaagaaatcaaattaaatttaatcggctaaaaccatatttcatccaaaagtacatttaactgcacataagtgaacatgggaaataatttattcaaatattagattagttatcatgaataaatgtaatttttctagatttttcctcctctgtttaagcctcctaaaaattcaatctagctttctaatagcccatctttgtttaatttctgtgagcagtccacccattatttttgagtgcaaccaaagaaaatggaatctaggtgtaatcatctaccaccagtaaaatctacactaattcttctggtctacacattaagttatgtagttacaaagttagaggagaaaataattccgaaaattaatctaaaaatcaagtttaccagtcttctacccatatctctctccctggcctagtttccatcgagttggccccacttgtcagtgccttaggctaggttcagccctgtccaacacttcctccttctacacctctctcttgcctagtgggaccccattgtcagcctcacatccctctccacacgggcccacgactcagaccccgcgcgccacgcgtgtgagcacgcgttgagcgcggaagagggcgagctcctcctccccatctccgccggcgaccgtacttaacccgaccggccgaccaactcactctctctcgcccctgtctcgtttcgcggaagaaccgaggtaccccgcctcggattcgccgggaacgggggtgccaactccggcgccggtgagagaagtcctcgacgccgtcgcaatccggtgagctccatttccgttcaataagcgttctgtatttccctctcaatgccgtctctaacgccaccaagaacgcctcttttggtgcagccaatctccgggaacgcgaccgcatcaactcggaacaccgtcgcgctctggacgccgctgcttcgcctttgctcgtcgcccagcttccacggttcgtgacaagctgagccacttcgccacgagcttcatcaacctctgtagatcaagaatcccgaaggaatcgacgcgaggtggaccacggtgggagatcctcttctttttcttccaactctggccgccgacgccattcctttctttctccttctctggtgagcttcggcgcaatctttttcgcctagagctaccttgtgctgatctaaaccgaagcatgcaccctctatatgcagtagaagcccgggagtacaccgtcgacgacgaccgtagcagttgcgccgtcgccgaaccagtacaccgtcgccaagacttcgccgagccgcgtttgattcttggtgagcctcctagtagtccctagagtccttatcgtacgcatgcacgattaaatcgagcctcaaaacccacatgcatgtgcaagccgagctgagccaccgcctctaacaccctaacagccgctatagagcaccaaatcttgccagaaagccaccaataggttcgcacggttgttctctacactttttgttttgggagcttaagctgaatcgccgttgttcgccactggtgatgctgtgaagctcgcggctgtgctgctgctctgctctgtccagagcaagggcatggcttttgaaatttaaagactcccagggatgtattaacaactggaacagtcacttacaagtaggaccagtaataatctgtaaataaactaaaactcaagcatcgttttgcatacaaacctaaaactaggggactgcaggatctatttcccgagaaaccaggggtttttgcgcaaaatgttagtaactgacatatgggcctaggactgcgggttgattcctagaaaactcaagggcctttgtgcatattggtccctcacagccatgtagacccatcctttaaaatctgaagaaaaattaggaaaatgcccaaacaaatatatgtttaacagaaaaatgcacaaagttgtaaaatctatataaaatcaaatatagctcattttgaagtgattccagttgctgtagattcttgaagttatgaactttattccaggaatataaaacttgacactcactgtacaaataatgtctctaagatttatctaagataagtcatgcataaaacatgtacaaacttataaaatacatagaaaattcatttcaactcattttgaaacaaactcaaaaactgcagattcatcatcagacacactctgattaggttaaataaaagtaatgacttactttgcatcaaatggctctaaaactattatctctataatgattagttttagataagctaaactttagaaattcatgtagaacccaatttagcttcaatttgaataaacttaagttatgtaggatcactaaaacatgtatttccaagttatgaaataagattatatacttgctgtgtagtaaaagtctctaaatattcatataaggatttactaacatagagcagccattaatttgtaaaacttgtagaaaatttatttttagtccaaatgaaatgaacaaagtttctatagaaccagcaaatagttatcttcaacatagtaaaataaaatttgtcaccttttgtagagaacattgatcaaaaccttaacttagtgaaataagaatttaaacacatagggttgtttaagtaatacataaacatgtataagtatatatatacactttaggtctaattaaacctaaataaaaacttgattgaccagtgaagccatagttccattcccatccactaaaattagaagaacttagctcatataacaatttctaggttaatataatatattgctagtttagattagagcatctctagtttataaaatatgaaccatagtagtaaagaccataaacatgtgaactaaaaatgttttagttaagcgaattattccttttattcaacttaaacaggaagtagcatgttctgaacctataactcaaaagtcatgaacatataaaacactatatgcctaaaacacgttgtaacttgtaaaatctataagaaaatcattataattccaaaaattgtaaaaccaaatgtgttagtcttagaaaacacatctccacacccctgtgaagtctaatctaataaaaatcactttacaaaagtatttcataacactacctaagactatactattgtaaaccgataaaacttctaaaattcataactcctaaatggaataaaataaaataggaattatttcacctaaattcattttagatcatttccaacccactgtgcataaatcatgcattttagagcattttggattttcagctctttcggtgtttaattgcatatcgtgtcctttatctagataattgcataatcggtgaagaagtggattaggtgctaacaattctctgatcaaggcaagttttctcctcccatcctttgaacacattgaatcccatgatttgaggaatgaaaatatttgtttgcaaagttgcatgtgaacttagactatatcggtatttgaaattgggttaaggtagttatgacctatttgctgcatattccaccttgaataattgatcctcttgctgtttgaacccctagaaatgattagagtacattcattgtactcaaatgggtttatatatgctctatgtgcaactacttgcttagccatgcttagaaatatgcaaatgctcattccatctataattaaaatgtgaattttgatacatgaacccttgctggaataaaatgaatatgatgggtatttgcgaactaaaatgtgtaaaatgtgattttatacttgggcggcaagtggtgtgcatatggtgttagttgcataccgataggggaagtgtttgcccaagcccataaggaccgaacttgtgtcacccatttaaagttatccgtacatccacatgtgctagtatgggatggcctaagctgattaatctatttaggactagccttgcattctggtaggccggtgtgtatgagttagtcgataattctgaggaattagtcgatgattcagaggaacttcctatttgccccgacgtggtagtttatgtgactaagtctgtccaatacaacggtattgtgccacgtggtgggttcccatcgtgtccgccaccacggcgttaagtttaaggcgtgggcccgccacttaacggttctaggtatattccaagtatgcctaggatggaggaacacgtatcgtactggtgcaaggctaggctctaagtagtgtaaaggcttcgttatgacctctagatcacattcaacatgaagagtgtggtggagtcttgcaaactcaaaacaaactagagagttcatatcatgtgggtaaacctgtacaaactctgcagagttctttaaactaatcgattagccgtgctcacggtcatgagcgctttggtgatgtgtcatgagtatagactatgttttaaaaatgtgatcatgtgacattggtttgaaattgataaatgtgttgagttgtgtatgtggtgatacattatgacttattgttaagtatggcaataagagattgtttatgatggaattatgaagaagttaataatgaaacttaaaacttgtctttgttaattgaagcatcaactcctttacaaaagaattgcaaaacaaaacttgctttatgctgaaattgaactacatattgccttcctttgaatatatgccttacatgtagtatagtaggattgacttgtgcttgccagtacattaacttgtttaatgtactgactcttgctgttgatataaccttttgtttgcaggtttagtcttagtctttgagtgatgcgggttccgattgcttcttctaggatgagaacttaatggggtatacccctagtcggtgtgcttgtgtttgggtagtcaagcttccgctgttctctaataagtctatttggccggtcggcctatgtaattattaagttgttgtaagtcttaagtttctttcatcttagttgtgtttgctatgtgtaatcatgcttaagatgaaagtgtgaatctagtgcacatcctgggaactagattcacatgagtatgagttaggaatatttgagaggttgtagatctttagccatttttgtcaagtctcctgaatgtgtaacacatctggtcgccgccttcgagtggtttgacgggcacatctcaggctgaagttgactggcaggctaagggcccagcaatgtctccaatattcctctctcgaggtgtcggatgtttcattatgcttgtttgatgacttgaattattcacttcatctctcaaatataatggaaggtccggagagcctacgacagtcacgggctagttccagtcggggctagctcggggcgtgacacctaccatcccgccgccacccttctgccactgctaccttcaacagaggccgcctcccgccgcctgccacctccgcacgccgctactaccggtgggtcgccgtcaggtcggttgagaggaagaaggggagatgaatgaggaggaagagaaacagagaagaagagatgagaacgagaggaaaagaaagagagaagaagagataagaacgagagagaggtgggtggtgggccccaccggctcgactggttttttttaaaaaccgacacctataataaatttttattataggtgtcggtttgaaaaatcaacaactatattataggtgttggttttttttatagaactgacacctataatcactgaaatgcgctggtttttgtattttcggaccgtggagttgagaaaaggtctaaagataccggttttaacactttccggtacctatagtggtgacacctatttgatgttttacgtagtgaaaacacgtgttggcagacatattgataaggagctggggagggaaaaagaccttgctgcataagtgcagagtgcagactttgctgccgccctgccggaggacgagccacagcggtggcttccatcacccgccgcggcctgcatcgacccttcatctcgaccaggcagacatggaagagagcaggaagaaagactaggaagaggaacaaccaaacatcagcgctacaagtgcgctctactccagatcgatggagcagtggaaacgtcgatttccccctcggcctgcttctctggcccatgtcacgtgtgacgtgttgttgtttagcatttgattgggccaggaccaggggtccaatacaatttcctaggggtgtcccacgttgtatacatacacaggctatacttggagcgtgggttataagctctcgagcggacattccctcatcggcttcttgtctattgcatattatctaaatagtcataaaaaatatgaaaaaatttatgaagatagattaatatgtgatatatcactacacaaacatacaaattaaaatatgacttctacaatccataacaaaaataacaaattaaattgtgaatagtatacacatactcacaatcatatatttgttatttttgctatggattatagaagtcatattttaactttcatgttttttatgactatttggatagcatgcaatagacgaggggacgtcccctcgagagtttaaaacagtttccgctatacttgccttgatcctgttggttcgatggccagaaattaaagtctcttttggccttccctttttagccaaatttagtatccaacagcagagtgcttctccaataccatctaccaagagacaccacttaataagtattcaactagttttaaagtaacagacaagatggtgttaggaattaatataccacatgcatgttgagaaccacttccattccaccttcgatcggacttatttcgcaaaactataaaaaacttgtaatgatcccgtactatcaagaatatatatacttaaatgtacaacggcagatccagaaattagttcgttggtgtcataacgtgcctattggtatcatagtatactaattgtacttaatcatagtgttataatatatagacaagcagtttaaccataggttttaccgaatatcatcggtgacgtctgacaccggtgtttacactgtagatccacccctgaatgcacacacatctcatataaaatttctaattaatcaaatccattttaaaaaaactggaataaagtttgcatgaaattttccataccgtcagtatagagcagctcacgttaatcattaattgatacggtacatctatctatactaatataaaaaggagttgcccccgtccaatcctacaggccaaatcacccacatcaatctctaccgtccatctgcatatcttgtgatccgtaccgtccatctgaatatcctctagaaacgtacagtctacgcgggcgaagaccacgcgcgatgactacgcgccggtgcgagtgtgacacgcgctcctcttttctcatcctcctcctcgcgtgtgctgccgccgccgcctcgcaccaccactgtccccaccggcgcatctcgctcctcctcctccaccaccacgtgccgctcctcctccaccaccacgacgtgccgctcctcctcagtactcctccttgcatgtgctgttgctaccgcctcgtgcgaccgttgccctcgccggagccgagttcttccccttccgctgccgccgtcggagccaaggtcgtccccttccgccgccgccgtcggagccgaggtcatccccttccaccgccaagctgaggtcttccccatcagctgttgtcgccgcactccacatcaatatgagtgtacacgtagggtcttgacccatcacgcacgcgcaatccccaccgccgcggcaaatcctcctcactgacgcgctctccccaccacaacgcatcgatacatccgcacaaaccctaccgcgacgcaatcctcgccaagacccctcctccgatgacaacgctgctgtgccgctgctttgcctacatgccgaggttgttcctgcaaaagtcctcggctgtccacgaccgtacctattctgtcacgcctccagtgttctcggtgacaacggcagtaagcggaggcgttcggctctacttgctggatggcaggggaggggagatggtgtccgtgcgtactgtcctccatgtggtgctcaacttcgccttccttccgcggacctccctccgacgtggtgcgcgtgcttgccgcatcgtcgtcccccatcacaagagggtggcgatcaacctcaccgccctccttggacctctcgccagcatggtgcgtggactcgctcgccaaccaccccagctctccctaagccgtggaattgcagtctctccaccacgcctgacgattccacggcctccctttgtcgcgcgaagggaagtctgtgagggacttcccagtcatcgagggacctccttgtctagcatttggaaacatcggttcgttcaatctctcctctccagttcaccccttttcttggttcaatttgaacaatcaaccaatgaagtaaactattttctgtatgtacgtgaagaatctatcggtgtattgtgccctgtaggtgttcgatgaattgctgttgaggaagggataatcagttcacacccattaatttggttgttcacttgctttcagatgacataaaactatcgacattgtggcctacttgcatgtcccatttttcaggtatttagaattcaccacaaatggaatgtattcaaggggacatcacgaatacgagcgatatgctcttcttccatggatagatcttaaattatcccgctgaagttggagatggatatgttcttgacatggaaggcagcaaaataggcctatcattttcaagatcaagggcagctactgttaggactctctaggatcacctaggtttagatctagtcgggtggttctatttgggttgatgtttgaacaacaatggatgagggagagggtttagagagaccgaccggttgaggtgttggaggatgaagatgtgccgaacatcgtcgttgtcgtcgcgggcttgatgtggacggcggcgacggtggtcgtgacggtgacggcggtcgtggcagtggcggttgcacgcgatcccggcgaggtcgtggcgctgcagtggcgtttcccgtcactggttgcgcccccttgatcggattagggtttgtggggtggagtggcggtagcgacgaaccttgtgttgtgagccgccccggcctccaccccttttatatggcgcagtgtgacgggggccaaccagccattgggctgggcgcccccaatcagggcgagggtcaaggcccccttgtgccgttgggctcaaggggagggagatccatctaacattctcccccttgatcttactatttcttttagcctttttctattccatcacagatttacacatagagcatgcttcatcgtcacagtgaatcaccgatggattcgacagccactatacacatatctattcagaaatagatactttaacttttcggccctatagtccaggattcataaggcttcccttaaacccatgccggctacatgttccttgaacacgttgggcggtaggcctttcatgagcaaatccgcgagcatcatttctgttctaatgtgctcgagactgattgtttgatctcggactttgtccttcacaacatagtaatttatgtcaatgtgtttggcagcaccacttgactgattgttgtgacattacattaccacgggttcgttatcacagtataactttagtggtttctcaatactgttaaccacctttaaatccggtatgaacttctttagcaagttcacctgccccgtggcctcatagcatgctataaactcggcatacatagtagaccctgcagtgatagcctgttttgagcttttccatgaaagagctcctcctgccagggtaaacacgtatcccgatattgactttgtattatcttttgcaaagtcagaatctgaatacccactatctggagcgattctgacagcatgaggccttttgttccttgcaaataatgcaagactttctttaccaatttctaatgctctgggcctggattactctgaaatctgccaagtaacccggtaacaaatgccaagtcagggcgtgtgcacaacagcgcgtactgtaggcttcccacagctgacgcatacggctttttttttcatttcgttgagctcatactgatttgtgggactttgccatgccccatacctttcccctttaactatacgagcaggtgaagcactgcatctgtacatgttgaatttcttcaacacattttctatatatgccttttgagaaagtcccaatacatactttgttctatcttggtgaatctctatgcccaaaacatatgaagcctcaccgaggtctttcatgtcaaagtttgaggacaagaatttctttgtttcctgcagtagactgacattaatactagccagtagaatgtcatccacatacaaaattaggaaaataaatctcccattcttaaactttgaataaatacagttgtcctcaatattctcttaaaacccaaatttctttattgttccatcaaacttcaagtaccactatctcannnnnnnnnnnnnnnnnnnnnnnnnnnnnnnnnnnnnn

SEQ ID NO: 31628 - DNA, 20111 bp, Oryza sativa
  unsure (1)..(20111): unsure at all n locations
tcgtgaacatattttgccaatcaaggatccgaccgcctagaacatccgtataagtagtaattaacggacagtcccttatttcttagggatgtggctaagttatttcttaatgatgtggctaagttattctcttaatgatgtggctaattaagtaatttgcaggaagagtttcacctttcagttatttagatatatcttattcagtgtttgcccaagtgtatatatgcttatatatagcatccctctgacgtgtttgcatgcgtggcatcctaataacattcaattcagcaagactggccatggtgtctctttttccccctggattgcgtacgcatcaaattccccctgatttgcgtatgcatcgatcaaacaagttcatacaatagaaggagttctttgaaagtttatatactagattgcacacgtccaataaattcatgtacaacacatgacgcaccaacacaatttaatatgaggaaaccgactcaacattcaacttttaatataaatacagttttatagtttgttcggtgcaaagtagaatgaaaaaaatattgaagtaattacgacatatattgtactaatgagtgtgaaacaaaagaaagttgaatgaactgtaagtgctctgattattaggaatagtgaacattgccttgcaaacaggtccagccttgaggggggtcgagctgtgccaccgcactgggccctacaagtcaaggggaccaaccccatattcgtatgcggattgttggcggatggcatgaggcccttcgaccaaacctgccgaaacccatggcgaaggctatggagcaagagcggcgcaaggcgaagagtagcgccaggccagaggcgtctcaggcgaagggtgcaaggcgaagactgtctgccgaaggaggatgacttcgccttgacaagttcgcccccgcgaggaccgaggaagcctctccggcccatcaggccggtgatcgccagacggctcatcaggggcccatgagcccctataacattatgtacccctgtaaatgccctttttgtaagggtaatcatgtaaattcccctgtacaacctaaacgctggtagtaaggacctgtaatggggctataaatagtcccctagggccatgtaatggggggatccaagaaaaattaaaaatttagtacacttcattttcccaaccactgttgagtaaccacgtcctccgacgtatgcagttgtcgtttcgacaacagctggcgccgaccgtggggactccgagcgaaaccactgagagcgaatgccatcgaagagggtcgtgaaggagaaggttgtcaggcgaaaggagagcgacgccggaccggaaatggccgccgaggaatgagcagagccttcggcgtccgtggctgaagatggagaagcacaagcgccatcacagccgccttcggcccccgcgccatcacaaccgtcttcggccccagcaacctcagtgcaagtgccgaacacggcagacgtggcgacaagggcactccagaccagggcggagatcctttcgacaaaccaactggtggtgcctcaagccgccacatcgcagccggcggcgccaactgcgctcgccgttgtactggcccaaatcagcctggaccccaaagcgcaagccgaagccgacatggaagccatgcggtagaacatgacatggctccaagacatgcttcgccaaatgcaagaacaacaacaagcatacgaggcgacaaggcggaccaaggccacgtcggctccaatccttcagtattcggcaggctatgccccacctcaagtccggccgcaagtggtgacccagccctctccgccactagccgcacagccgccggtgtacttcgctgggcagcatcaaccacctggccaagcgacaaaaacggtggcggaaggggcttcggctctgcaggcgcaactccaagcccactacatttcaagtacaaccccatcggctcacccggtggggaatacaagtcaaggtgcgcctaattggttgccaccgattcagcaaggctcgggaccttcgccgtggagtcaaggacagcagttcgacttcggcaacactgctcaggtgccaaccgttcggcagcaagttccaaccccaggcttcggaacaaaccaagcaccaatccaagctgccatgacgtggtcgcagccaatttttgacccatccatggcggctcagcaagtgcctccagttggagccgggcagccgaacgccatggcccaacttcacgcacaagctgcgatttcacccttcgccacaccgtacccgcagcaaggtgcggtaaagagggcgggaggcgaaaaggggctaccgctgagtgggggaatcaagactcgtccaatcccaccccagttcaagttcccacccgtcccgcgctattcaggcgaaactgacccgaaggagttcctctccatctatgagtcagcgatcgaagcggctcatggtgacgaaaataccaaggcgaaggtaatacatctcactctagacggcatcgcccgttcttggtatttcaatttaccagccaatagcatttactcatgggagcaattgcgcgatgttttttgtccttaactttcgaggcacctacgaggagccgaagacgcaacaacacctactcggcatttgccaaaggccgggtgagttgataagggagtacatgcgtcgcttctcgcaagcccggtgccaagttcaagacataactgaggcgtcggtcataaacgccgcatcggctggtctgcttgagggcgaactaacaagaaaaatcaccaacaaggagccgcagacgctcgagcacctactttgcatcattgacggtttcgcaaggggtgagaaggattctaagcgacgacaagctatacaagctgagtacgataaagcctccgtcgccactgcccaagctcaagcgcaagttcaaattgccgaaccacctcccctctctgttcgccagtctcagccggcgatccagggacagccgccaaggcaaggccaagcccgcatgacttggagaaagttcagaacggattgggcgggcaaggctgtgatggctgtcgaagaagtgcaagccctccgcaaggagttcgacgcccagcaagcaagcaaccatcagcagccagcccgcagacttctactgcgcctttcacggacgctcttcgcacaccacagagcaatgccgaaacattaggcaacgtgggaacacgcaagacccaaggccgtagcagggaacaactgtcgaagcaccccgcgaagcagttcaagaacaaacacccccggtcgaacaacgtcaagacgtgcaacgaaaggtaatccaagtgattacgagggccgacccgccaggccaattatctaaaaggcagaaaaagatgcagatccgagcggtccacagcatcacttcagcgggtgagggggcgccacagtacgtgaaccagctgatctctttcgggccagaagacgccgaaggagtcctgttcccgcatcaagatccattggtaatctcagctgagatagccagttttgaagtccgacgaatcctggtcgatggagggagttcggccgacgtgatcttcgccgaagcatatgctaagatgggcttgccaacccaagctcttacaccggcaccaatgtcgctctgggggttcggcggagaggcagtgcaagttcttggccaaacacttttgctgatagctttcggctcgggagaaaacaggcgcgaagagcaaatactgttcgacgtcgtcaacatcccatacaactagaacgccatcttcggccgtgcaaccctgaacaagttcgaagccatttcccaccacaattatctcaagctcaagatacctggcccaacaggggtgatagtagtcaaggggcttcagcctgcggccgcttcaaaacgcgatctggccgtaatcaatagagcagtgcacaatgttgagaccgaaccgcatgagcggccgaagcacacgccgaagcccacccctcacggcaaggtaacgaaagtgcagattgatgatgccgactccacaaagctcgtatcactggggggcgacatgggcgaagaagaagttgagagcatactagaggtgctcaaaaagaacatcgatatcttcgcctggagccctgacgaggtgggggggcgtcccggcgaatctcatcatgcatcacctagcagtcaagccggatattaagccaagaaaacaaaagttgcgcaagatgtctgcgttcgccaagaaacggcgaaggccgaagtacaaaaattactccgggcgggggttatccaagagattgaccatacggagtggttggcgaatccagtgctggtgcggaagtcaaacggcaaatggcgcatgtgtgtcgatttcacagatctgaacaaggcgtgtccgaaagacgatttccccttgccgcgaatcgaccagctcgtggattcaacagctggatgtgagctcatgagtttcctggatgcatattccggttaccaccagatctacatgaacccgctcgacatccccaaaacgtccttcatcacttcattcggcacattttgtcacctcaggatgcctttcggcttaaggaatgcaggagcaactttcaccaggctggtgtacaaggtccttggcaagcagttggggcagaatgtggaagcttacgtcgatgacatcgtcgtaaaaagccgcaaggctttcgaccatgcgatcgacctgcaggagacgttcgacagcttgcgcgcggcaggcataaagctgaatccggagaagtgtgttttcggcgtccgcgcaggcaagttgttgggattccttgtttccgaaagaggcatcgaggcgaatcccgagaaaattgatgccatccaacaaatgaagcctccgtcaagcactcagtcgattcctctcaaaggcggccgaaagaggtttgcccttcttcaagaccctccggggcgcgggaaagtttaattggacaccagagtgccaagcagcattcgacgagctaaagcaatacttgcaaagcccaccagctctgataagcccacccccaggaagcgaactactattatacttggcagcttcgctagtggcagtcagtgctgcactcgtccaagaaacagagtccggacagaaaccagtctactttgtctccgaagcactgcaaggagcgaagacaaggtacattgaaatggaaaagcttgcttacgctctagtaatggcttcacgtaagctcaagcactacttccaggcccacaaagtcatagtcccatcacagtaccccttgggcggaatactccgaggcaagaaagtcactggccggcttagcaagtgggcggtagagctgtccccgttcgacttgcattttgttgcacgctctgctatcaagtctcaagtgctagctgacttcgtagctgaatggacaccggtacttgcccccaaccccgagcccgaagaccagttctgggtgatgtgctctgacggttcgtggtcgcacaagggggcaggcgttgcggcagtcctcttttggccgaatggtgtgccgattcggtacacagcgaaattgcagttcgacacaaccaacaatgcagcagaatacaaagccgttctcctgggcctaagaaaggcgaaagcactgggagtccggcgcctgctaattcgaactgactccaagttggtagcaggccatgttgacaaatccttcgaggcaaaagaagaaggaatgaacaggtatctggaggccgttcggtccacggaaaaatgcttcaccggcataacagtcgaacacttgcctagagaccagaacgaggaagcagacgccttggcgaagtccgctgcttgtggtggcccacatttgcctggcatctttttcgaagtcctacatgctccaagtgtgcccgtagacagcccggaagtcatggcaatcgatcaagagaaactgggccaatacccatatgactggcgaactccatttgtgaaacaccttgaaactggctggcttccggtagacgaagcagaagcgaagcgtttgcaactcagagccacgaagtataagatggtctcgggtcagctttaccgctctggggtacttcaacccttacttcgttgcatctcttttgccgcaggcgaacaaatggcaaaggagatacaccaggggctatgtggcgcacaccaggctgcaagaacagtggcttccaaagtatttagacaaggagtttattggcccactgtgttgaaagtctgtgttgagcaaatcaagaagtgcgaaaattgctagcgtcatggccgaagccaagccacgccctagtatgatctgcagcccattgcgccagtatggcccttcgccagatggggactagacatcattgggccattcccggtggcgtgaaacgggtataaattcgcaattgtagctgtggaatatttctctcgatggattgaagccgaaccccttggggcaatcacttcggcagcagtacagaaatttgtatggaaaaacattgtttgccgtttcggaatgccaaaggagttcattactgacaacggcaagcagtttgactctgataagttcagagaaatgtgcgaagggcttaacttggaaatcaggttcgcgtcgatcgcgcacccgcagtcaaatggggcggccgaacgtacaaatggcaagatcctagaagcactgaagaaaagacttgagggggggggggcgaaaggcaaatggccagaggaattgctatcggttctctgggcccttcggacgacccccacaagaccaaccaagtttagcccatttatgcttctttatggcgatgaggcaatgaccccaacggagctaggggctaactcaccaatggttatgttctctgggggcgaagcggggcgcgaggtatcgctcgaactcttggaaggtgtaagggtcgaagcgctcgagcacatgcgcaagtacgccacaagcacttcggcaacttacaacaaaaaagtccgacccagggagctgatgcttggtcagctcgtcctaagaaaaaaggcgaacccagtagcagttggcaagcttgaatcaaagtgggaaggaccatacctcatcaagcgcaagtccaggacgggatcttttcgtctagcgacactcgaaggcgaggagttcgatcattcctggaacgccgcctgcctcaagcgcttctatgtctagaatgggtggcacccaaatcgccaacttgtaaaaatgtacatattttcatgtaagcctttcggcactatgtaagcctttcggcaagaaaaaaaaagaaaagaggagaaaaagaagagaagagagaaaaaagaaaaaaaaactggatgtagggctattatccaccatggaggcccgaaccggtataaaatctctgtgtcctccgccttcttcttacttttcgtgtgattgataatttgtggaaaaaccccaaggcaaactcctgatcagcgaaaaaggccaggggggcgaaacgaatcggctgaagcattgctcgccgaacgttgaaaccgcaacagcttgtctcggaaaataaatagccgaacgacgttacgaccgatcagcataaaagcaaaagcgtttctctcgacatagaacgctacagatcgaaaacgaacgacgaaaagctgaaaagtcactacacctatttcgctaatgttctgacctaacaaaagcacaaagtttgacgatgcgaaaaatagtgaaaaggaaataaagcacgttctttattagcttcgaaaaaaataatcgaagaatacaaggtttacaacccgatacaattcattttacaagtaaattacatttccgccccagtaatcattatccctacttaaggaatggtcggacgaactaggtttgtcatcactactaatatcatacacaattttaagaggagtagggggcgaaacacagactaaactataacgacgctgaaagatcgattcctggcgtttactcttctgatggtttcgccaaaagcgagccatatcctccaaacatcttgaatgaacaagatcgtaatcttctaaggttcgcccggggtgcgcccgcagccagttggcaaccttgaaaactttatagctgcgaccgtttatttccatttcgcgataaacaggccgaaatagacatcgcaccatcagcaaacccttcaatgccacaaatttctcgttttgacttcgccagctcccagaagggggccgaatgcatgattttcgacagaccccctggtagacagtgcagaaaaggcaaaacacatcttgcatggtaagaataagcgaaagaaggggaaggtatggcataatgcaaaatgagcgaaataataatatgccaaagactttgatcattaaaaagtggttaaaattatcatacagtccaagtatgcaaaaaagccttttttaaggtttagcggcagtttgccgaatatacaatggttgccacatctagcaaacaccaaaagaaaactatgaaaatctaagagaagggcggagggcctcacacctctgggtgatcctgggcatcgcctccaccccctccggccactgcgccctcctcttcacaaatgtccgccgcctccgctttcgccagctgctccaaaaggcgcgccttagcggcggagcggccatccttctgccaaaattgttttcaccacgcacgaagtgcaggcgaaatgtcttgcgcactgatttcccaatcccccttcgcgtacttggggaactcggcgatgtgctcgcagccgaactgctgcaggaggcccatggtaaaggccgctgacacgcgtgcacagcaatcgccgtatgcggtggcgcagtccgaaaccgaaccaccagcctgttgggtccattcggagaagtcgaaggctgaggcatcttcagaggggacaccccgcaccttcgcgcccatatcggtaagggcaaggcgaagcgtttggcacgctgtccgcgcggactcggtggatttcaccatctcccgcgaaaaccgccgcgactcctctgcagcgcttgcttcggccttgcgaacctcctgccgaagagcctccatcttcggctcggtgaggttataataatctatgagcacggcggtgtgggccttctctttctccagttcggcctttaagcgatcgacttcggccctagcttccttccctttctctagttccgattggagctgcttgttttcggccttcgcctccttaagggtgttggcaagggcctccatctccaaatttttgcggcctagttcgtcatccttggcccgaagacagcttttgaacccatcaagtcgagctcgcacggttcactccgttgagcagtgagccgcgaggatctgggcgcagaatacgagcggcaaagagaacaagtatcaattgtaaaaacaagatagaggaagagtaaagataaaaaggggggaaaaaacgtacccgaacagccaggctttttatagcagagcactcctcgtcgaactcattcagttcggtgaacaagctcggggcgctggcgggcagtacaagattgcttaccccctccacaaaagaaaggaggtccgctcgcatctcgaagtcgccaggggcgaagcggggtaccgagagcgaatattccgaagcggatgtctcagcgaccgctctctttcccttcgcctccatcagcggcgaggcaaccggctgatgcggaggactgccgaatactttcgccgcggccatcacaatcctttccgcagaagccgaagccccagcggtggtactaccgtccactccagtggcgccaagtggaggaatgggggcggccgaaagatccaggctgcgaccagcgggtgaagtcggagtcctgtcggaggactcgtcatcgctaaaaacgcgagcgacatcgacgagccctttctttttagccacctttttgacaagacctcccttcgccgacgcgcccgaagagaacgcaactagggccttcgccacttccaaatccttccgacgaaggggggagctgttcgggtgtcggcgcggtcttcgactgcctcacccgcggccttatcagccacaacctccacctcctcctcttcctctccttcctcctcgccgtcacgttcttcggcatcatcctcgtcgtcggcgtcagagtcagacgaagcaggaacccttcgcttcttgggggcaagcttcacttgtccacgcatccgctttcgcgaaggccctgcctcgtcgtcgaccttttggggattcgcccggggaggcagttcgccattgtaaacccggttcgcccgcccagtcgcttgacgtgttaacagctgactatactcgacgaccgaaacatcgccgatcatcctgcgggctttgtctttgggcctggtcgagggtcaacactgtaaaagtagcgcgtgaagctacgtcaaaagacaaataaggcgaaataacaaagcacagcagtatatagcaaaagaagtcttactgttcgccccctcagggagtatcaggttcggcaaaccgtcgacttcttcgccttgctcaaccgcgacttgccatgactgggagaggggaaaaatgcgaagcatacaaaattcctccaccaagtcacggtagctaaggcaggagcaaaccttccgcagtagaacgaaccgcgcctccatggcgccgtccacagcgatcttggatctccggttcagcgcaatcgccctacgccggcaccggagggctttcgctgattcagaaccagcctcgaaggggatggtgtggtagaaccacctcgccatccaatggcggtcccacttcgacatagtagcgttcactggccagagatcggaccgctcggggcgaacgttgaagttcacgctcccgaacacggtttttttcgttccagccggggtgatcactgtcttcgagttcacggtggcgaaaaatatggcccaaagagctcggcgttgggctcaaacccggaagtccggaacgcccagtcgaagatagcgatccgaacaagcgccgacgggctcagctgcggaagttccacctcaaagaggcgaaggatctccggcaacaacacgttgcagggaaaccgtagccctgcctcaaaaaatacggcgaacaccaccgtccggttgtcgacaggtttcggcaccacggttttccctggggcgaaagcctgcccctcaaccaacgctccggagctgaccagcttcgccagctcgacgtcgtccacaagagagacccccagaaaagcggtgctgtcgtcatcgactcagccgggatctggccctttcgccgaagtagggtttggcttacgtggagccatggcgaacggtgcatttgcggtggcaaaaaaagatattcggcgaaacgcctgaggggtcgaaagatgctgtgaaaggaagagacggagaaagagagcgcgcacggtaaaatggcaagtgtggcagtgtaaaggaaagagcaacgggaatatatagcccacccaagcgaccgttcgcctacccaccagtaataaagcgccacgtgtcgcaagggtaggcgaaacggtaaattcccatcgaccgagcggcacagtaaaaagtccaaagataggaaggcccaatactgttccgttcggcccaggaaaaaataatatatataagcatcaatctcacgaggcgaagcgcggcaaaataataccagccgcacaaataacaaacttcattcgcaggaataatgttgatttcggcaggagcatcggtcgaaagggggcgccgcataccataccacatggtttgcacggtctcggccgaagctccagtctcacccttgcccatgaggggcttgttggcggatggcatgaggcccttcgaccaaacctgccgaaacccatggcgaaggctatggagcaagaacggcgcaaggcgaagagtagcgccaggccagaggcgtctcaggcgaagggtgcaaggcgaagactgtctgccgaaggaagatgacttcgccttgacaagctcgcccccgcgagggccgaggaagccttttcggcccatcaggccggcgatcgccagacggcccatcaggggcccatgagcccctataacattatgtacccctgtaaatgccccttttgtaagggtaatcatgtaaattcccctgtataacctaaaccctggtagtaaggacctgtattggggctataaatagtcccctagggctatgtaatgggggatccaagaaaaattcaaaatttagtacacttcattttcccaaccactgttgagtaaccacgtccttcgacgaatgcttttgtcgtttcgacaacacggatataggagcccataggccatatataggaacttagatttacgaaacccaggagagaaagatatacaatttgtttgataagaaagtttattttatgctttacatttgttagaaacattcttatactttcaaagttgtattgaaggcccatcattctagcttcactccgggccactatattgacaggaccaggcctgcttgcaaaacaactagctcctaggaacatggaaatcaaggtaataaatttggtcctagttaattaaaaatggcatgacaagttagtgtgcaagaaacgaaagttcatcacaaactcgatcgagtggtgcatacaaacgacagaactatatcttgtcgtgtcatccgaaaccccatgatttgatatgcccagtcgtccagccgtatgacactgttagcgtgttggtttgtttggcatgtgccgcttattatgtttatgtcgtatctcccgatatctctaggttctattccaatatgtcggttgagcagatatgggaaggttcgggcgcatatgtactccatatcattgtcaataatcaatatatttcgttgaggcatatatcagacaccattgagagttgatgacagacagacggcacaaagtttcaaaaattatgatgcacacatatatactgttaaataactagtggcctattcgctgatccggagtagaagacgacatcttatgcacacaatcatatagtagatgaacacggatatagagagaggcatcacagctttattgctttctcatatatggatacatcaaccaacctctcaagccctctctctcagtatatatacccataataggaagagtcctattaggatacgttttcatatatttggtatgagcccatatttatctctggtaggagataatagtttcataacactccccctttgacgaataccgcgctatacacatgtcttattaaaaactccatctaaaaacccagtgggagaaaaggataggggaaaagagtacattgtacacgctagttatattgcacttgttgcctcgttaaaaaccttgcgtgagaaatattcaagtaaaaactcactaaggaaaaagagtacaacacacgatcttcttgatcgcataatctttaagatcgactattcttcgtaaatagctaatgatctatatgctttattatattaatcaacttggattaacacaacaatatagcagtagtaaccttcaaggtaaattatcaaaacaatgattaatgtgattaattgttggcaaatcaaatataagttccaagtcttaagtatgataatcaatgtttagcatatatgctccccctcaataagacatccgttgaaacttcatgttccaatgtcataaccacatttttattaatgtgtaaaacaatgataataaaattaccacaatgtttaatctttcgtttacttatttcataagttttactatgaacatgagaaataaatcaacgtataggagcaatatgtataaccacttattcaaatgtgcaatacaaacaaagtttaatccttacggaggattatgggaaaataagttgcaacaatacacatatgtggtatgtataaaataattagctcaatacaagaggttaaatattatgcaactttctcttagtggatttatcaatcattatcaatttgattgtttcactaatcttcaacaattagcttaaaccacttagagtgacataaaccggtctatattttggcattaggagaattaataatattgccaaataccatcaataagtatatcttcgagatatataaattcttacaccttcatagtatgtagaaaactaccgatccacttgcatgctagtggatgtgattttccaattcattcgtttgaacgggtctgtccacttcatgggtgtacgagttatcggtgttatatggagattaaccggtaattcatacattagcgtagtcctacagggattaacttattcttccggaagccattttctctgctatgagaaatattctcacttctaggagaaaaactcttcgtgagtcatcataaactcttctacgagtcttgcaattctcttcatgagaatatagtgtgcttcatgacactaattagtatgagatttacacatatgttacgaaattgttttctttctagtgaaagcttcatatggattttcataacccataaactgcatatcatttatttattcatgccttttgccagcgatatatatatagcggaatttaatacattcatagtaggagaatattagtcttttccatgaccatatgaaccgttgcttttcaccacttcatttcctattaagtctgaactttcatgttcacatagacttatttagcgactatggttcaacctcgttgctttcttcaatagactcgatatgagtgctactatgcaactctgccatggactttggttccggatccagattctcattagagaaatattaccaatcatagaggcgatgttgtcaacaactattcttttctccacatactcattccgtgaggttaattcattataaaccatatcttagtcatttcccaaacataagatgtatggttgttccgcatcccataattagatagatatgtgcactttaattctgggttttcatcttcatgatgaacctcttcatgaggcaattcaccttcatggtgattactccgtagattttagaacattgacttacatgtcactctgcatttgtggatatactattcaaaacccggggtataccactgttagcagaaagtttactacaagtaaacataacttctgattactcctttaattcataattatctagcaagctcccgcttctggcttacaggagaataaactaaatcttctagttcagattggcttgtgcattattcttacttataatgatccttttcttcttgaaaatataaggcatctttaacacatgggcttttctccccctgatgccgatattcaatctttatctaatagcatattacaaaaatcccctatcataggcaatggattaatggaattcggtccatttgtatccccaacttcatgtggaggcccatatatatatgctatggtggtgatatatgagggaaatgttcattcattgaacatgcacttatacaaaataaagggggtaaagatattatatgcagtgagctaacataaaaattgatgcaatagcatgaaaaattgcacatccctaatactgtaggttatcccaattcatagagggttattattctgtgacaatggtgcccaaacaaatatccactactcgacaaaattactctattttctagctttttttttatttgcccaagacttgatccaattactcatactatattcaattcttgaattaagttggatcaataaacttcatgtttatatttatgcaacatagatatgatcataagatgatgagttagtattatataacttaatgatgtcttcaagaacataactataacactaaaacattaatctatgaacatagtttaaccatcatggaacttttcaaatcacccaaacattattctacgagaatatttattcttcttgaatatgccaataaattaattgggtgacatgtctaacttttatttattacgccaaagtaaatgtggtgtcatttgatcattcagaatcattcgaatccaaaaggtcattaattatttaggatattgtttactacaaataaaccaatagctttcaaatagctatatgcaatttcatacttccttgatgaagatgcaattttcaatggccaataaataacacaattcgttgtgtgacaataattcataatgatcccaaataagattcgctaatagtttgggctatttttgcttctagcattttgacctataacacaccaatttgcctgccacgtatccacaatttcttatgcttctttattgcaaatattttaaaattaatttgcaaaatacacatattcctcccccttttcacgccaatcataagaaaacttacaaaacagttgtcgtgaaacccacatatttgttgtaacttcatgatacaacttttctaaaagaaataatgtggttacatatggatatatttaagcttcaatgcttaaatataaatattctaattgttcatgtgcataagtaaacaactttacatgtatgccaatgtggcgtcaatgcacttagaactatcaacctacatggttgattgaggcttagtggataataagaatacattcaccaaaaatacttcaaataacaggcaagacaaatatttacattcaatgttagacatacaattcacaattttattccacaaaagattaaagaattactacaggtaaaagaaaggcaatataggtaaggtgagatgacctatataaaaaaaatattctgtaatctaatgctgaagcttctatgcctaaagcaaaagataaagatactctacatgagcttaaccatgttcttcaaattgaacttaatctaaactataatgtaactcgtgtattgtaaaatactatctcaaaagaacgaatgcaagattactgtcattactattcgtctccccttgagttgaacatcaaattcaaatacaccaaattcctttccttccacaaattttgagttcttcatgaacatattaatagtacaagtcatatatgtgcgtgcaaatgcacatgttgacagtaatacaacttcttgtgtatcaattctaacaactaaacatgttgcatctaggccaaaattgcttcaaatacaaatgaccaatttactcaaaataatttgcatacatccataaaaacaatacttcatttgtaaattcatttatacatagaagatggacataacattatcaatcaaattaactatagacactgcataggtacatagtattttgatagataattttggtgcagggcatattggcatatagacttcttgtctatatattcgcaaattcgatgacattgtatctacttggacacaattaatataaattagttgtagcttatcttctctgatagtcatgcactaataaatatctctaagtcaataatatactctcttcatgatgagtgtatacatttattctatacggagaatatataattgtgcgttctgcaaatgtggcgtcaattagacaaagagaagatatatgaataattttattactcatttgcccaataaatgtatttgctacatgcaactacttacatgatgtccttttatgcaactttctaccggtttacttcttgtaaataaagtgcacaaaacgagtacaaaatagtaaagaatggttttctatacacaccttttattacaatcctagcaattaacatgattttctaatattcaaaggtatgtgtaatttacagaactactaacccacagaacaatcaattatcccaaacaaacaattgccaggaaataaaccataaaatattatgcttccaaaaggggtgctaaaacaaaggtttcacaagttcatggaagctcttttgcctaaaaacaatgtttctaggattaattatggttattcaagaaactaactaaatagttaaagcaaatacatagaaatacgggactaaggaataaatccttaattcttctctatttggcgtaaacccaattcatgaaggttcaaagtataaatggcgaatgtatatttcccttagtttctaatgtctcataggacttttccgcataatttccgagttccgcataatgccttggaaaccaaggacttttgaaataaaataccattttcggaccaaaatcacggttcgtgcccgactccttttaataggccaatttctacttggcccacctccttatactggctagctttaaaacctggccagcccatctcatatgtcgcctaatgggctattacgaccttcccccacaagaagtgggtgaggtatgatccaattgccattcttcaatggagacaatggatggaaccaatggcaaacgtgctagtgagccctcggtagagatggacgtctatggaaagttgccatggtcagaggcgaagcggcgatgcaacatctagtagcaccgacactggcattcgttggcatcaggccgtgtccggcgtccgacaatcatagctccatgttacgtgtcgatgaaactcagctcggcatataggccggcatggcggacggctatcgacggcgggtgctcacggcggcttcgaccctcgtcccggccgcgtgcggtagcgtgggaggcaagccgtgcgtactggcggcgaggggaggcgggcgtgctccttggcgtcactacgggcggcgaccgtcaattgcgttgtggatggcctcgaaaggccgtcgagtcggcatttcagatggcggatcgacgagggaaagtctctggattgattcggcaaccgttgacaaaggggaagacgtcatgcggtggcgtccgggtgtcgctacgtgcaggcagcggcggtggcgcctgcaggtgccgatgactcggatttgttaccatctacttcatacagatagcaatatgatggattattaacatacaagtcacaaccgacagagtatcccaagcgcgctgatccataagatcagcgatgacgagtgtgttaatatattcatagattaatgactatgttagccagaaagacgacaacttctaggtggtgtcgtgtgttactgagtgttaggtgtcgtcgttcgggacaacactccgtcgttcaattcaacggattatgtatgtgcaccttcctgtgtgcatggtaagcgcattcgggcgcgtggtgccaaacttcgtggtcggcgatataacaagggaagagtcggcgcaaatgccggataaatacatctattcatgcgagaaaataaaacgactagaggcatgatctagcatattactctcgctactgcaaagtattagaatagataaaaccgatactgtcgaaacatgatttcggcaataataaaagggggtagcgcacgagacctaaaagtggatggatgcggagacaaaggatttagacaggttcaggccctctcaatgagaggtaataccctactcctgtttggggatttgaatccgccgggtgtagtatagatctgacgatcaggttgtctcatcatgcccctagaggggctccctgccctccttatataggttggggggcagggttacaagatagaaaccttaaccaatacggtatcggtttcctaaatctactttacaatcttatcaaaccaggactttaggctgttccataatatacagggaaacgtaatacccaagtcatgatctgttacatatttcatatatataagttatcccctataactagtcggataaccatgccgtgtgggtatggggtacccataatctccacagtagcccctgagaccttcacagtcggaaagataatcttctctcgaactagattactccaaagccgagtgcttcaatcatcttcgccatgatctcccgagtactttttccaagtcagaagactgtggagggctgaaaaaataaagtcagatgcatcgactagatgcacctaataggtgtaacccccgactatgtggttaattgaacaaaccaaacatatagtcaaggaataagtcatccaattaaccgagtggtttttgataattatagtcaaccaagtgacttgataccaatatatagcatatgcggtgtgaatccccgaataatatgatccaagtgatataccgactgcttggcaaaatatgatgagtgatatagcaaaatagctataaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 31629 - DNA, 12241 bp, Oryza sativa
cctcgctccgctcctgcgaaagacggttaattaccaaaattctaaattagcgttcggtcaaaggaaaaaaaaaaccttctctcctccccacgaataatcctcctagcaacctcccacctcatcgatctacaacacccgaactccgttgcacgtcgcgcgtcacccagatctcggcgtcagggtcgtggacgtcgatttcgctcccggccctatcggcgtcacaatcaccggcgatgatgcatcggccaccacggatcaccgccgacaagagcagcatccccgtccagatcgtcagccggcagcaaggtgattgggttggtttttcttttatttggttggattctgcattttgaacgaaagctgtcaaattcttctttctttgatttggttggattcagaattgacaattcatcataaatctgagtaaaattgttaagcgatattacattctccataatttaattattgcaattgctaatcatgctctaaacaaccataatgttaatcgtgctcagccataatgcaagcaactaataataattcctaaactgacagtagtacctttgggtggcaaaggtctcattgatcactgatgactttattagaaagccgctatgctgctgaacaagtataaagaacaaaatagacacatcatcaaaaaacaaagaatctaggaaacacagtgaaaatctgaattcgagtgtagttccaagtcataatgcaccgttcctctacagagttaccccaacatcaaattaaaagtccttcaaactatctaactatatgcagtatattaccttgacgatagatcaccaaaacaatcacgaaatctgaaaaagtgtggaatctaatttaataattacaacattcttaattaacatttttttataccctcaattagtgttttgttagtttaactaggaagcaagcccacccagtaggcgaacaatttatttactgtttatacgtaaactcgcctatcaccattcttcgtaaatatacgagttaacatgggctagattatacatctaatttacttatgcccatgcattgtgtaatatacaaaggaataattgtcaaaagatgatatcactaatgacgcaaccctcataggtgccggttgggaacgggccttaggtgtcggtttcccagctgacaccaatttgatggcaccttttccccgggcataaccgatacttatagagatttaaggtgtcggttcatatcccacaacgattcctatagtattcaatgaataaaaatcagctcgatggagccgccatcaccgaatctaggcagcagaagaagaagtagaaccaataaagcaaagtccaattacgcatctagtgccacggtggcgtagtccgacgtggctcaccggccagtgccaccaccattgttctcgacatgtgacgagcggtggcaggcgaagacctggtcgtggaacttttcgaggcgggtgtgcttggctgctcactgctccgccaacttctgctacttgacatccccatcgcgacgaaggacggacatttttttctcgttactctgcctcctccctcggtgccctcatcttcgcctcaaactcctctgcgcctcttgccaccgacacgccctctccgtctccagctgcatctctactctcttcaccctccacattgcttccttctaatactctctgcatctctgccgcacatgccctttgcttttcctccatctccaccatcacctccccacccgccatccacggtgtcaccgctatcgccgtaggtgccataggtggtgtcgtggtgaccgtcgacgcgaagctaagggtcactgacggtgagggtggtggtgccacctgagatgatgatatctagggcggtaacatcggggaggccatgagcagcgacacgacatcggggtgcccttccttgactagcttcccagtgcaattatcgagcaactagccggcctgccacacactactatgtcaaatggacaggaagatggggagggagatgcaaaggagggaggaggggagaggcgaatggagaagagtgtgagagagagagagagagaaagagagaagggcacgggggtgggccaggggagtggataaggtggatggggtggggtgctggctcgactcgggaaccgacacctctagtaaaaaagataacataactatacttacggtttttatttagaattggtacctacaagataagtatgatgggtcctataggtgtttaatcaatacctataatataagtacggtatcttaaagatattagagcgttatgttggaacggtctactctgactattctttcactacttggggcgttgggccgttacgatccatgatgacttatttgtatggttcctggtcttatgctttacatggtagattattattatgttatgatagcctacccataacccagtgacaagtgaggtggttattacaagtgaggtggttatttggcaaagtcggcgttagctaggggtggatatcgagccggctcggctcggctcagctcgcatcagctcgttaagataacgagctaactcggatcggctcgataaggaaacgagccaaaactacagctcggctcggctcgtcaggaaactcgagctagcttgtttggctcgcgagctggacactgctagttgagaaccttgaggtgggaggaaagagggacatcaaaatcaaattaagaacaccacgagaaaagaagcattgaaatcttcaagaacacaaggtcaaagaaacgttgaaatggattcttacagggagaaacgatacagtaaaagcaagattcaggctgacatctcgacaacatgcatgagcacaacaacttttcagaaccttaattaaatccttaatcgttttgatggacagcgcaatctcaatgacgcgccatggatggcaaggcccgcgctgcttccatttcggccgctgatgaggtgagattccgtgtcgacgagagcggcgccgcgccggaggggatgagtgcgacgtgcagccggcggcaacgacgatgcagcggggcttcgagagaacgagagaaggcggactgacggaggagacggcgcgtgcgacaactgattacatggataatggagtcggagagcttccactactggcggcggcggcactaccgctcgatttaggaataggttgagaggatgagagtacgacacaaatacttagggttagtcaatgtctgttggagatgggccaaatgggctttctttcacttgcggctgctgctgcttgctagctaaatgggctgctgcttcctacttgccactatttcgttgcttccatgcggctcgtagctcgagctgactcgttatgtctaatgagctaaaagcttagctcggctcgttaacaaactcaaacgagtcgagccgagccgagccgagcttctcgttcagcactagagccatcagcgccatagtgcgagcttgaggacaaagaaaggcggaaagaagctgacgtgctcgagagcgcagcagccacgaaggaggtcgagagagggcgtcgtcgcgacgaccacacatgagcttgccccatgtgttggccggccaacctcctactggctactactctacagctatgccatggaactcgccttctgttgagaaaaaaatggagaagaagaggggaaaaaaaacagaggggcaagatgggagagaagcactttggatggaatgctaaaatgagatattttgacagtttagtgttgacaccgaatttcggcccactcgttccaaatcccagaacatccttgaatggaacgggcgcccctcgccgttccccgtcatgcagtgctccggccagtttcccggtgtcagtagccataacgagtgaccaacaagtcaacaaccatatcagtacgactgagagtgtcacgtcacgtgggatctgggtgtgtttagttcacgctaaaattagaaatttggttgaaattgaaacgatatgacagatggaagtttatgtgtgtaggaaagttttgatgtgataaaaaagtaaaagtttaaagaaaaaatttggaactaaacaagccttatgtgtctgtcttttattccatagattttttttcttttgcgatgatattttccgtacaagttgtaggtttgtaactaaggcatcgctcctgctacatatatactccctccgttttattcaaaaaaatttgcttgcagtgtttgaccactcgtcttattcaaaaaatttgtgcaaatataaaaaacgaaaagttgtgcttaaagtactttggataataaagtaagtcaaaaaaataaataataatttcaaaattttttaaataagacgagtggtcaaatagtgcaaacaaaaactcaaaatcccttatattatgggacggagggagtatacattttctacgttgtgggatatcagggattttttttacggagttgctagaaatatggcgccatatgctacagtcaattttttttcagccacttacatattagttacatctcatttacaccccacttacatatgtaattagtatgtaattttcgaatttacatatgtcattttagttacttacatatgtaattttgagacttatattgtaaatacactaaaattacatatgtaatttagggcttacaatgtaaatacatgccgactattttttgatgaaaaacatggcgccataaatatagctacacccttttatttttatgtacctacgtgagtataaaatcccttatatattcaggatagaatatatagttctccgtatatatgacaaattgacaatctatttgtttgataaatgatttttgaggaaaagaattttcctttatttctgacctttttttatatgttagatacatgtccatgcggtacgatggaacataattacatcagtagaagctattgtctttttaatctgttatatgggaagaaataagtagtaatgtcttctcggccaattataatgcacgataacgtgtgctagctctagccggaaggttgatattaaaaggtgggatgaaaatcttctcaaacccacgaagggacttgagcaagccagtaccgatttgcattcaaaggctgccaaattgagtggagaagtgggactgctcttggattgtctgaagaattatcgatcacccaattagacgtctatttcatcattagttactttggagcttaatttacttcatatttattgagtggagcagtgaatgtttaaaagtgaataattatttctgggaatgctgagaaccttttatcaaacagtcacttctgaactttctatttatttttgtaaacgtcggatgcttatgtctaaaatactttttgtattattatttttgtaacctgataatcttatattattactttttatttattcccctgttctgatcatcctctaaaggtgagtactctacagctgcaaatttctttgctatgtatttcaggactttgtggaatgttattacttttattaatatttgcacacgtacacgttattttctagtacaccatacaccaaatacatgaggatctagagagttttatcgtgttaacttattaattatcaatatttgttgtcatttcaagaatgtacaattttaggctagtaaggtctttacgttccccctccccccccacacacacacatatatatatatatatatattaagatgtttttgccaggaatttcgtaagtcacccatatcaagtcggtttggtattccgcacacgctacgccgtatcgtggaacgagcgtgggacgtcggattttcgtgggccggctgggcctcctgcatgcctcctgaatgcctgctgcccgtatggctgggcctcctggttgcctcggacgatcatgccccacctgggctggatcggtctattgtctccaaatcgagcaagtgcaagttgatgagatgttgttgagttgataatttctcctattttgattatacatgagtatttctatctcttctcttctctactatttgtttcagttagcaaaaaattacattagcactttctgttgattgactttcttttgatcttgtttccgtaacaactatttgtatgggagaggagacacgcgaatcacgctagctagctatttctgtgatatatatatatatatatatatatgtttcttccatctccgtctttcattgatctgacggctacagatgtagcccgcgccatagctccgtcaccctctcaacgctgcacggcgcgtaaaggcctgattgctgcgtgcggcaagggatacgtgaaaaaggagcgggcccaattaaatcgcgcagtccgcttgcgagtcatgacttttcaatgaatgttacgcgtgacgaaaatcggatacggacaacgtacaatagctttaataaaaacatcttcaatttttaaatcgcggacgagggcaacgcagtccgaatcagacatgcggcaagggcaaatcgcccgcgcgagggcgtcacaggcccaatcgggcatgcagaaaattgcacgcgcgagagcattgagggcccaatcgcggtggcgcgtcaaggcgcgtgtggaaaacgtacttaggcatgggcccaatcattgcgtgcggcaagaggcgcgtgaaaaagaatgggcctaattaatttgtgcatgtcttggataagagggacactctggcgtaagaaaaaagaaaagaatttgacaaaaacataaaattaaaaccgattcaaacatagatgatgtaccaaaattctggcgaaaacattttcaattttttaaattggttctacccgttgcaacgcacgggcatcttttatagtatatatacatatgtatatatatatacatatgtataatatacatatatgtatgtataatatacatatatgtatacatatatatatatatgtatatatatatatatatatgtatacatatatatatatatatatatatatatatatatatacatatatatatgtatacatatatatatatacatatatatatacatatatatatatatatatatgtatatatatatagtaaatttgtttggtgctccatggtgcccggacaccatgattgaaattgagtatataccaaattcaaatgagtatgaatttgtgtatgccccatatgggtgtcatatatatatatgcatgtgtacggctttttgtccgcctacagtttaagctcatgcagtggtggagcatatttagccttatctttcgcttctatacgtactttacaatctttatattgcacagtttaggcacttgagtgttggtgcatggtttcatcttggttcaccttgttgtgatcagtgcatgatgtagacgttatactcgacgatggcgtcgtttttcttgaggtctaaggtgtgcgtcttcaactgggcgtagcctcgggagaaacggaaagtgccggtgccgccgatcactggcatctcccggacattgccaaagggaccattgcggccgagcacggtgaccacgctgccgttgtaggggccatgggtgaacaccaggttcatgacctgaagcaagccaagcttggcgaggcccgtgctcatgtacatcccttgggcccggcccacgggctgggactcaggttcaggcccctcggtcagcgcgtcatccatgacatacaactacccaaataatgactctgaaattgggtccaccgagtccaccacccttacagatgttggggacggcttgctcaccttgtcgttgaagtaaaagtgtaggtgcgtcatcggctcagacgccaatccacggcgggtcaaacccatcgtggtttctttcgggcgggccgcacctgcagccgctgcaagggagagcacaagggtgatcaccactactcccttggcttccattgttgtgcttaattagtgtgtggaagctaggttctttctatatcttgtgacttgcgagtatcacttggagtgtgtgattcaagtggagctcatgagctacatatagtggtggcatgagcactcagcgtgcaatggaaagcggcatgtggcaagcggcgatcgctcaatcggcctcaaaggctggtgttctttctttttgtgagaacaggctgatgatccatatggccgtgtagtggaagcaagtgaccacaggtggtaggtttgatgggcacagattagggttgatcggcacagatacaatggtttgactctggatgggcaaactgtgaaaaaggaggaagatcgaagtggcatcgattggtaggttatggttgtgaagcaaacactggaaaagtattggctggtcggctcctagattgtgtcagagaaactcatcaccagttagctagattgttgatcatatggatgctactaccactggtggagaaatcatcttttgtcggtcggccgaattctataatagtcccagttgcaattaaaaccgggactaaagatgatctttagtatcggttcaaatgcagtcaggacttgtcaggcccccctgagatctttagtcccggttggtaagtcccacccctatatatatatatgtcttcttcctccttcagcccgagcaagctttaaaatttcttcaaaaaagaggggaggtcatgccaaaatttctagtgaatttattttggtgattatatacaaatcggaggtgcgtagaaggttagcaacttcatactccaatgttttttttgtcatattacatttggagctatgttttgcacacttttttgtctccaaaattttgttgtaagttgatgagagagaaaatttatgtagggaagaaagaatatattaatttagtgaaagttattcttaaataatagaaaacaaactaaaatgaaaactaaaagaagtacaacacattaatactagtttaaaactttagaaatagtaaataagaattatttggtgtaatattttataatttttgtatgaataatgatatgccaatactgtacgagtgttgaaagagtttgtaattgttttatcattattgtatgactgtcattactgtacgaataattatttgtgtacgatttttttttatttcatgtagatggatcggcaatggatgtacgctgaccggcggtccaaagagtttattgacggcgtgcattattttttgagagtggccaaagctaacaggcataagggttttatttgttgtccatacaataagtgtaagaatcagaaggagtattctgcatccaggattattcatttctacttgtttgagtcggggttcatgccaagctataactgttggacatcccatagagagcaaggggttgaaatggaagaagatgaagtggaagacgacaatattacggactttgctcagtacgctggattttaaggaaatcaaatggatgaggaggaaagggatgctgatggtaacgacattgtggatgatcttggtcagatgttgcaggacgccaaggaggattgcgaaagtgaaaagggggccataaattggtgttaccaaccgggactaaagatcgatctttagtcctggttatttcacctaggactaaagatagcgatctttagtcccggttggacaaccgggactaaaggggggttacgaaccgggaggaaaaagggtttctccaccagtgtacatccgtttcatatcataagtcattttgatttttttctagttaagtctttttaatgtttgatcaagttcataaaaaatatatcaatatttcaaataaaccaaacataatattgaaatatattaaagtttatatatttaatgaatctaatttagtgttgtagatattgctaaatttttctataaatttgatcaaacgttaagaagtttcactaaaagaaaacttaaaacaacttctagtatagcacggaaggagtattttacacgtgatttttttttccgagagaacatactgcgagggctttgcctagctttacaagtgaaatttcagtaccactaattgcagagggaccagatgatatggatgcagctactgtcgtacgaatgtacgaatgaaataaaatcagattggtacttttttcttgttgatggggacattggacatattgtgctccttatggtaggggtgaaaacggatcggataatatcctgtccgatccgctccgaattcgtctgaatcgaggatatagtataggattttagaaatccaacgtatatagtataggatatggtatctctaaaatccggtggatacggattatccgataggcgttttccagataatccgaaatagccaacacatgtgacctatctattgcatataacaaaagttggtctatccaatggcctaattcatcatttaattaacctatatttcttagtctgaggctttaccgtctcatgtcacacttgcgtagctgtatttttatattatggatatcatgtattcatgttgtttagcacttaaacacataattattacaacggagacctgttttataggtgtcggtttattttaaaccgacacatatatgccttttcccatcttcacacggtggaaaaataataaccggcactttttctaagatgcataggtaccggttcttattataggtactggcttttaaaaataaaaaccggtactagttgcaacgagactcttttaagaactgtttcccttttataagattggtaccgatgtttcttctttttttctctcgttggtgcaattttttattaaaactcatagatttactttcggcataatttttttttattgtctatagtaaggtgattgtgtgttgtgacagaattgagtggtgacgactcaatgctcctagactaaggccgagtcgtagggagaagcttacaacgacaactttctcgttctacgtgagtacgttttccaaatctctaaacagtgtgtttcatataaaaattttctatatataaatttctttgaaaaattcaagtcgatctttttttttcaattttataataattaaatactcgattaatcatatgttaacggctctatcgtgaaaaaaaaacactcccgtaatttacctttgattacatttgtacaaattttatcttcttctaatataattaatatgcaaagctgttacgggttcgaaaaaaactcggtgttttacctttgacaaatgcttatcaacctttgagaaatatatcttgacatgagccgtatatacgtttgaattggcatccattgagaatgtgtattctcatggagaaatcccatcagcctggttgttaggggcagttcatatatgtacggattattttttttagataatggaataaaacatcccggcttttgttcatcagagttacagccaattattacagaagtaacacccaaacactgagtgtagttcaaatgaattaaacacacccaccaaaataaaagatcaaactaagataaggagagcatatttattctagtctatttatgaatctccatccatagtttgcaaagagctgcatgaccgttgtctcaaacttacgacatgcaactttcataagctctcgatcatcttcacacatttgcagctgtgcccaaaatcggagccaatatgttgccctgaaaattacctgcatatatgagatagatggtgatttgttaaaaaccatatcattcatagtcaatcacagagcccaacatatggcagaagctcttacaagtatgagtttactcagcttcttgtctatccccaaaagccaaccatcaaacatattagatatggtagtaggaaggtataaatcaagagagaactgtactgctctctaaacaaattttgcataatgacactctaaaaaaagatgttgaatagtctcatttttcatacaaaaataacatcttaaattgccattttaatttcgtcttgccaaattatccttggttagcacaatctctttaagcaagtaccacataaaaatcttaatcttaagtggcatcttaagcttctaaataatcttatttctctcactataaccattattaattaaagctagatacatcgacacaatatttcaacatatatctatcaaatatcaaatcttatatctcttcttcattcagtttgatttagaattgtatttttttagaaaaacattaattgaatagtaattcattagttcttttattgcattttgtgctctaatatctgtcggtttatttttttttcccttacaaatgttgtcatatattagtttccctattggactatgtgatattgccctttgcattacttctactaatcttataaagttgaacgcaaaaaatg

SEQ ID NO: 31630 - DNA, 9442 bp, Oryza sativa
cacaggtgactcatctctgacggccctttaaataaagccgtcagaggttgaggtctccgtagttagaagctgtcacaggtgatctacctgtgacggccccaaaagtaaaggcccgtcacaggtaggtcacctctgacgggcctttatttgctagtccgtcataggttatgttacctttgacggatttttgtcccgacccgtcacggatgagttaattccagaaaaaaaataaatgctaaatattggctagcctcaggatttgctagccatgccctctgaaaaatagaaacatcacagatatattctagtcacagatccatcacagatacatcaccccccaatataacatcacagatccccaacaacacatatatgcagttcaaatgccacaattttgcacagcaaattcacaccccttgaaagccacaatttcggtcgttgctcatagaaccgcatatatacttaccaaatggattaaagccataatgtcatcgacctgcacaacctgtcaataaggaaaaaaaaaaggagaaaacagatgaatagtacaacataaatcgtagttgatcaaatgtgatgacaatttagtaaagtaccataaatattgcacatatgaaagtaaattacattgcactctataaaaacataattttttacatcgccagaaattataaaaacatcttttttacatcacaataaattatctagccaagttcatgagtctatttggcatgaaaacgtccttttttgttcattatttctgcaagaataaaggcgcacaattcgcctctgatagcgggggggttgatgggtgagatcttgaagccagctctatatttctgtttaataaataagaggttaattagcacgttttgaatagcaatgtagatattgaaatgagcttatgtcgccattagcaacaacctcagggtcgaaatctttcacctctcttagaagtgttgacatgttgtggcacacgtggaaaccacattggtctccgatctgttgtgcgcatgcaaacttggtgtcatgataaagttcattcttgccctccttgtgcctaccacctttttccacatatgggccccaagccatatttaaggccttggtgatttcactgaaatcataatctttggacttattggagttaaggtaggtaaccctactccacttaggtacgatgactaggagaatccaatgtcgcctgcgcagtggttatgtagcgttagtactaagaaccttaacttcaaaaacaatatacacgaagggtattgtcctcttactcttggttgtgtgcgcacatgatgtactccttgtcttgatgggcccataaacaccggttgacatagtcaaccacctcagtgaagctctgtcgtaaattaacctcattcaccatggatggatcaaggaacccaacctgattaccatagcgacgactctcgatccaacacaaccttaaaatatttacgtattagaactaatttaattaggagatatagtccagtcatatcacaagtatagaagatatgcacttacaaggagtagcattttagaagaccagtgtccaacttccggatcctgaaaaggtcgaagaggtcatcaaagcctatagttatataggcaggcgacgataggaacggctggtggtcgtgatgtccaactatggatgactccctcattttccgcttagcattgcttagctccatgtattgcttatgtagctctcggcaagcaatacccatcacagctaacacattgtcctccaccaatggcatgcctagctcaaattgggctggcgccctcacgaccttccccgatttgctcaccggcatcgacgtcgcagccttgcccctttttggctccggcgccaactccccgaccttccccttgccgcgttcacgcttctggcccttgacaagtggtggggagctatcggcctttcttgtggtctttattggagccaagctttgagctatatctgccaagtccatatcagctccaccgggagaatgagctactgacaatgccggtccacggggagcctcaattgatagcttacacttgggaggtgtaagctccgtcggtcgacttggacgaggagtcatcttcacaactgtcttctttgggccattgtatgaacgtcttgcgcgcatcgcccaaagtcatgatttcatcatttgggggcacgggcagcggatagcctgaccaggtgtcctttactgtatcgatggacaccttggcatacccagctagcaggtctgcgccgtggaccttgtctgtaaccgagggcttgaaagccatgccctcagcgacttcaggagcgaaagttgggtggactctcgctagtaggacacactgtgctgcgccctgcataaggtgaaagtttgaatttaatattggaatgtgtaaatgtcttttattagatatggatcggataacaacaattacctcgatgtggtccactgcagctagtggtgcgatcgggagaccaggggccggcacctctgtggatgcacaactactcctatgctgtgacggactcgcgtcgtgttgtacacgaggagttggttgcacagcaggtgttgtgactcggggtatattcatgtcggcgagcaccttgttaaccctttcttccacccttgcattcatgctagcttctagttcttgaatgacctcaaccttaagttcggccttcaaacgagcgtccctctcttccttggagactttccgtttcctgtattgggagctgtactgagggagtccatgcttctagggcacatcgctaccaattccccgagttcggctaggatgttctttggttccgagcgcctttgtgaggatgtcatcttcgcgcctcttcggcgcggactcaacctcgctttgtgaagcttgttcagcaaccaagcccaactagaaaagaagatagtagtttatacgaacttgtactttatacgaacggaaattagttaggttaagtagtgaactcaccagttcctgatagacgacggcatcacttttgttctcaaatgtgacagagccgtccgggttgaccttaccccttgcccgcgcccagttgcgagctctttgttcagggatgtctgaaaacggggcagggacattcgctgctgcagcggctgcatcttcttgggcccatattgcctccttgccgatgtaccctgcggtgcccagccgatgcgggtgctcattccgctgttgcagtacgcgatgtgcctcgctggattccctaaactcttgggtggtcttgagagagcagaattcctcccacaccgcttcggttatttgagggtattcatcgaacggcgtatgattgccgggcgggttgacatactcggtgaagagcttcgacttccaattcttccaagctttgcccatcttttggaatgccttccgcttgagcctatcctttgcttcggctggaaatgtgaaccatttctccattgccgtccaagctcgctctttctcggcttctgtgaccttcccgatatctttatggaggatcccgaagttctcacgtgccgctagcccgcagcagttagaccatcttccaatgacagtcctgggcgccgtgggcctaccactagcgtcaacctctcttataacttgcactgtggtcggccatatattttgtgaccgcggatttctactagacctacttgcacttgtctcgcccgacatcgacgtatgttgttcctgcggcaattctgcagcacaaacagaaggcaatatttgctaaggggtgctagctaaaatttatgtggtcatgtggtgaaaatttatcctataaattaccatgaatttcgggttgttggaccgccgttgtcgcgggatgaccttcggcaactgcctctgtggctgggtttgcttcttcctggatcctcgcaggtgttggggagggcgggtttgcgccgggcgttgacatggtttaactttcgcgaaaaagattatgaatggttatatgtccaaatggctcttaaatccacatccaagttgcaaactagctacacattcaagttttaactaacagttgcaaccataggcagcagcatgggcaaacatagacagcaaggggcaagtgtagataataaaacagcccacaataatttatgtggcagcagcagcaggggtatataaatcatgtatataaacaacaattcaactattcatagacaacaagggtatataaatcaataagtgtagataatctgttcttatccataaagaaaagaacatccactgcagcaaaattcatgctaagatcctctattgatgctaagattcactgcaccaaaatcatgtatataaaatctagcccctacattcatccaaaacatccacagacaacaaatcacatttaattcatctatacagcagcaccaataatcgaaacaacaaatcacatttcattcatctaaacaatgcaattcatccatcggaaaaaaggaggaatgggggagggtggcggcatacttggagaagcggcgtacttggagacggcggcgcaggccgtagtcgtcctggatcctggtggcggcggcggagaggcagtggtgaagaggtcgaggcggtcggcggtggtcggggatcccggcgtcggggaggtcagggtcggggaggtcggggaagtcgatggacggacggcggagaggacgaccggcggcgagggcggcggtggagacggcggcggagatggtggtggagaggacggcggagatggcggcagagagggcagcggagatggcggcggagagggcggaggagaggttgaggcggcgacggtggagatggcggtggagaggacggcggcggtcgagagagtgagtgaggaggcggcggtggagaaggaggcggcgagggcggcggagagggcggagatggcggcagagagggcggcggcgaggagggcagcggagatggcgacggtggagatggcggtggagatggatggtggcggtcgagagagtgagtgcggcggcggtggtgcaggccggcgtcgggaaggtcggcggagagggtgagcggcagtgaggtcggcagtggagaggtcgaggcggtggtggggaggtcgaggcagcggtggagaggagggcgtagagggtggcggagaggtcgagagggcggcggatttggccgcgggaagacggcggtggagaggcgaggcggcggtcgagagagtgagtgagtgagagtgggcgccggatctggatcgatctagaagatgtccaaccctaggtcaaccctagtcaaactcacctgtgacgggctccaactatgtggccgtcacaggtggcctcacctgtgacgggcgccaaccgtggagccgtcacaggtaagaccacctgtgacgggcccaacactctgggccgtcacaggtgaggtcacttgtgacggccctacagatagagcccgtcacaggtgagtttgcctagagcaattttattttattttattttacttagttcttttattttccttaacatattttcacatacactacatattttttatacttaattattttatttcactaacagtagtaattgcacttcattattatactactttaattattttatttccaatgcttatacttgcttaattattttatttcacttctagtgggtgcttcacttaattattttatttgactatttcataagcaatatactattgatcattgcgaacatattagagtcatacagataacagacatgtagacataaactacgtacataaattacaaaaataatccttcctcatggtcgacacgtgcatattgaacttcatcttcttcctcctcctcttctagaggtatttcttgacctatgccgtggacgtgctggttgtaatcatcctcgtctgcaatattgtccaatccaacaattctccttttcccttcacgaacaacatgtagtttcttgttacacgggtcaactatgtagaacacttgaacaacttgtttggcgagaacgaacggttcatccttgtacgcgttgttagccaagttgacagtggtgaaaccttcattgtcaacttttacattgcgaagatcgacccatcgacaacgaaacaacgggactttgaacttcaagtaatctagctccaatatttgctcaactctaccatagtattgatcacgacgaccaccgtcactagcagcctcgatgcgtaacccactgttctgcactgtgcatttgctgtcttgctttaccgtgtgaaaggtgtatccatttatgtcatatccttgctaggtggtggcactccattcaggaccctgtgacaaccactgaagtgtttcactaggcaagttctgcaacctggcaattcggttcttcagccactcgttgaaagaagacatgtgcttattcctgacccaactctctgatcggcctgggttctcttgtcggataactgcaaggtgttcgtcaacgtacggcaccacctcagtcatatgttgtagtaccgtgaaatgagctttatcgtacaccttccgatccaacctaatagtctttcttccaacagtaccaacaccgtcaagcctcccttcgtgatgagatcgtggtaatccaattgaagatgtttctgacatgtagtccacacaaaattcgatggcctcttcggtggtgtaactctcgatgatactcccctcggggtgtgaacggttccgtacataacccttaaggatccccaggtacctttcgcaaggatacatctgcgtcatgaatgctggaccacagcactttgtttgcctcacaaggtgcaccggaagatgttccattatgtcaaagaaagttggaggaaagtacatctcaagatgacatagggttctcacaagttctgcctgtagttcatctagtccctcgggatcaatgatcttctggccgattgcatggaagaaggaacacaaccgctggatcgtgtgtcgcaccttaggaggcaaaatattccttattgcaacgggcaacagctgtgtgataagaacgtggcaatcatgcgacttcattccaaccaacttaagatcttgcagtgaaacgaacctactgattcttgatgagtaaccagatggaacctttataccactcaaacatgttagcaaatcaattttttcttctttcgagagagtgtagcaggctggaggaaggtaaaccctgccggattccgtggttatgggatgtagctccgaccgaacacccatatcttccagatctcgtcgggcgttgagaccatcctttgagtacctgggttaagcagtaatcccattaaactctcgcatacattcttctcgacatgcatcaaatctatgcagtggcgaacttcaagatccttccagtatggtagtctccagaatattgacttctttttccacatgctcctctcttttgtcttttgtttttccacatgctcctctgttttttccttcgatgtgctcttctcttttcgctttccaactttcctcttttttccaaactcgttggttattcccatcactaagttgtgcacctctgtccctgttagctctgtcgggggtccggctgtatctctgtgtccattgaaattctttctcatattcctatacgggtgataccttgggagaaatctcctgtgacccatgtagaccgtcttgtgtgaatgcttcaaccatttgcttcttgtttcctccatacactccgaacacgcccatttccctttcacagtttggccagaaaggttgccaagggccggataatcgttgatggtacaaaacagcatcgcatggaggttgaaatactcttgtgcatatgcgtcccatgttcgtgtgccctgattccatagcctttcgaaggcatcgattatcggttcaaggaacacatcgatatccgtgccaggtgttcggtccttgaatgagcatggcaagcataatgtactttcttttgaaacacaaccaggggggaagggtatatttaacaagcaaactgaccatgtactgggacgactggtcaaatcaccaaaaggattaatgccggccgtacacattgggaaacgcatgtttcttgggtcatttgagaattcctgggtaaaatcctatcgattgtcctccactgcactgaatctgctgggtgcctcagcatagtatcgactttccgttcttcggcatgccagcgcacaagcttagcttgttccttgttcgcaaacattctcttcatgcgctccgcaattgggagataccacaccacctttgctgggcctcccctctttgacttacttccttcaccttcactctttgctcgtttgtatcttgatcccccacagatagggcagacatccaagtcagcgtattccttgtaatacaaaatgcagtcgttcggacatgcatgaattcttctgacctccgggcccaacggacataatacttgcttcgcttcatatgtcgtctgaggtaaattgttcccctctggcaacagatcctttaacagctcaaggagttctgtaaaactcttgtccgaccagccattactagccttaagcttcatcagttccaacacgcatgacaacttgctgtgcttcgacttgcatccatcatacaacggcatctggcaatcttccaccaacttactaaacttctcataatctctgtcgttgtcctctgcgtcttcaatgtcatgcaacattgtagatagacattgagtgtccaaatctatggtctctccacctaaaggagaaggtacgaacatgccttctcgagctgcggcggtgttctctacatcctgatccaacacttcttcagctgcgacatcaggcgcctcttgctctccatgcttggtccagcaggtatatttcttcatgaatccattcattatcaaatgagcatgcacttcatccttgtcttcgatcatctgttcattcttacagtccctacatgggcacaacatgtgcatgctcatcctactttttctgtcattatccgcaaatgtgacaaattcagtgaccccctctctatactcggtagacgaacgatgcgcatagtacatccatctacgatccatctgaaatcaacaacatacgaagaaaaataaatgatgatcgatatgttgagaatgaatggagaataatgtgttttttaccttgaattttagcaaaaaatcgccccccttgccctcccaaccgatttgtgaacagtacaatggtcgggatggaaagcagttggcagtttgggggtatttatagacccaacacacctcaaacgggttagataaaaaaagcccgtcaaaggtattgctcatacctttgacgggcttctattcaacggcccatcactggtatccgctcacctgtgacgggctaaaaatgaaagccgtcacaggtggcggcccatcacctctgacggcttctaatgtatcggcccgtcacaggtgaggggataccagtgacgggttggaagaaaaac

SEQ ID NO: 31631 - DNA, 2649 bp, Oryza sativa
ccatgcggttcataagtggaaccgtacggaaaaataaggggaccggcgcggggcggtcgcccacaagggaaaatcgattttcccgtgcagacctcctaatccgaccgcacgagataatcatcattatcccgtgcgatcgatctaagtggaccgtacggaaaaatcgattttcccgtgcgggctttttaagtgaaccgcacaggaaaataccacctcgtttccctcccatccacttcaaatttttcccatcctctctcttactttttcccttttagtctccctcaactacccccctttctatctaccttatctcttcctttctctaccttatctcttccgccacttaactccctccacaccatcccctcctccccttcctctctgtcgggccggcgagacgtcgagcggaccgcggcgacggccgggcgaggcggcggctgggcgaggcggcgagcaggcgaggttacggccgagcgaggcggcggccgggcgcggcggcgagctggcgaggcggaagctgggcgaggcaacgagcgggcgcggcggcgagccgggctcggcgacggccgggcacggaggcaagcaggcgaggcggcaagccgggcgcggcggcggacctcctcctggtggttgtccttgacgtgcacgtcgaccgcttcctcccatcccgtgcggcgacgaggcgggcgcggcggcgagcgagcgagcgaggcggtggccgggcaagacggcggccctcctcctggtggtcgtccttgtcatgcatgtcaaccgctgcttccattcccgtgcggcggcgagcgggcgggcccccgcccagatccggccggcggcgattttcgcattttttttagttttttttttgttccgtgcgggcggtataacacgaccgcacaggataatcgattatcctgtacggtcgacccgcccgcatgagaaaatgccgattttcccaaacacccggttacagacgggccgaactaccgcacgggataatcaaaacgcccacatagaaaaatgggtattgtagtagtgtactagcctctaactaggtcctgaagcttcctgcatgtcggtttatcaagcctataaataggaagccagtgtatgcatatcgactgatgtattcatccatcacttgaggaaagcaaaacaagcaagctagtagtaaagagctgtccaatcttgcatcacatttgctcctcttccagtacttcctctgcttcagaacgtgctgaacaaatattgcagcaccaacacgatggagcttgatgtggatttgcggagaaagaagctgaggagagttgtcctcattagagctgtcccaacccatagtgtctataagtagtttctatggtgccatatcaacaagacatcacaatagaaactacactctacaacccatggttttcttaaagtgggccattaataaatatatcatccctcttctctaccaatcatatttattcttcatctattatgaagacactattctctcccaatgcaaaacttgatagtgtctagtgcataggttctcgtgttaaagctgtgtcttgcatgagacccagtttcttcctctcttcactctctctcttaattaatatagtgccacataagttaaaagttctacatggcaatgtagttaataccatagacaccatactaggtggagggttgggactgcccttatgtcttcatgtcagccatctaggctgctcgttggtggatgtcggcggattccgtttcctgcccttgagagcaggtacaatagcaagctataagccaactaaaatcacatatcgagaagaaaattgaagagagagaagaaagcggctatagatttgtagccggctgcaacacagactccaagacgttaagtgtgtatgagaggtgggaccaggtcttaatggtgtagtatatttttatagttaactattgtatgaatgagctattagatttgtcagggttatggataccatatacctaatagtagttgactaaatctcggtaggatccaccacataccatgtcttatacggaaactgacctcgagggagtttcggataaggaaagacaaccagagttctacatggaaacgacaaggactactcggattgtatccatattagtttccctagttctacttggacaaggggacacctatgggtataaatacaagcccccctaggaggagaggggagacgaacaatcgacgttcaacacgatcaacacggacaacacagacgaccacctcaatcaacacacctaccacaatatacggaacaacagaagccagaacatacaagccaacatactccaagacaagacgccggatatcgacttcagggatagccatggctattcccctacggtgtctccggataccgtcaggagagacaaaagcgctatctctaatctcgccggacacggattcgaggaggagggctaccctgttgtcgactacaagtcagaacttcagaccgccatgtcgacaacagttagataggctatcccacatattgtactggtgtgattacggtgaataaaagcaataccggctccggccaacaggatgtagggttattacctgacaattcaggggcctaaacctgtataaaaatccctgtctccatctcttttacctcagtc

SEQ ID NO: 31632 - DNA, 3574 bp, Oryza sativa
  unsure (1)..(3574): unsure at all n locations
ccggccatcgaggaaccaaaatcaacatgtcgatctattcactagattcttgtgggactcggatcgttctcacaccccgattaggatccaaatttttgacccctgacgcatactgagaacatccatcccgacatcatgtgttccagggattattgatcacggatgtctccaaaggtatcgagagaacaacaagacaaagatccaagtaatatgcttgctcctgacgtgtacacatgcatatgcatggactcagtacgtgcttaggcatgcatgcattagttggccgacgtgtaccttgcaaagaagaccaacatggctgtataagttgcaacgtgttgactattcagataaatcaacggccgcccgtgatcaggaatttagtagattgattttttaaaatcggtctactaatttcgtagatacattcggcatgtatctacaaaggtacgcaatattttatatgcaatttatcgtacctatttagatcatacagcattatcagatctataatttattatgtttacgtagagcatgtttttatccaatatctattgtgtgagtgtttctgatgttaagtcaactatggtctaacgctgggggctcgctctattttcttctgtataaattatgctcgtttacggtttacataatgcctgatacttacatctgctcgttatatcctgatagtactagaagatccacgcagtttttgagtacatactcaatattctctactatatgtcttgccttctagaaaatatttttcaggaacatttgagcactcgagtaggttgtagtcgagtacaccccactatcgagaacattctcgacaaatgcggagttgtcgcacccaacttaccaacgaagaccgacgacctatctcatagcaccggccatcgctggactactcgagaaaaggttgttaacggataaatcctcgcgaacgccgtcggcttgatcacccgacatgattgcgaacagacatccggttataccacgagttgggtgtgtgagtcatgctggccacatgagacacacatgtaataaaccaactttagcacttccattggtgctcgagagataatcctactcgctcgctggttctcgcaccaagacgtagcaatctctcgcaccgcaacttccattggtgctcgagagataattctactcgctcgctggttctcacaccagtacgtagcaatctctcacaccacaacttccattggtgctcaagagataattctactcgctcgctcgctggttctcgcaccaagacgtagcaatctctcgcaccgcaacttccattggtgctcgagagataattctactcgctcactggttctcacaccagtacgtagcaatctctcacaccacaacttccattagtgctcgagagaaaattctactctcgctagttctcgaaccagtacatagcaatctctcgcgccttaacttcagatggtcgaggtacgattacggcggcgtagcgggcctcgcaccatgacttcagatggttgaggaacagctacgactggtcttcgaccggcagggtagcggtcctggtgccatggctccaaatgatccagagacacgtattcaccagttctcgaccagttgatgtaagtgttctctcatccatntgnttctagtggtcaagttaggattactgcatggtcatcgaccagcgatgtagcgtctctcccactacttcacttttaagtggtcgagttacgactactgcctggtccttaaccagcgatgtagcgtttttcccactagttccactttaagtggtcgagttacgactactgcctggtcctcgaccagcgatgtagcgtctctcccactacttcaactttaagtggtcgagttacgactactggctgatcctcgaccagcgatgtagcgtttctcccaccagcggtgtagcgactctcctactacatctatttcagcaaagttgataacaggtacacaatatctccaagtgttttacccagagatcacttaccacgacgacacctagcgttgaaacctatcctactgtccctttacgccgtcttgataaggcctccgaggaacctaagggatattcggtggggacgcccagagccgataaggccttgtcagatcctgtagagacaaaataccatgtaagatctgatcgtgtaagagttctcgccgtgcgtattaaccaagccgtgtaatcggaaactgagctttccaacttcacggctgggggctaggatcagtgcttattcaaccaaggcaggtcaagggtccaagagccttatcccctgagaacaattctccgacgacaaggttgggggctagggagagtgtatgactctataaactgactgatcgaagtcggtaagagagaagacgctcatacacaaaacattggtcggtaaatttaattcattttcaatttaccatacatattataacattgtcaccctttgagcgttcgcttaggggctatttctatttgatattcttttctgagcgttgatttcaggaaaattctattcaacattgtggaagactccatgtccactatggttctacaccaagatcgactaagacgagtacgacaaatgtcgacaaagctccgtcgcagactctacgccttctcgatcgctcgagaacgcttgctggatctcgacaaggaatatggaatgaagaaatggtgtacacctagacatatagcacatataagcttagctaatagcagagaataacaggagctacattattataataaaacaagggcatctgtataaagaaaaaagtaccatgtcttgaagtcttgattgtgagcacgataatagaacaaatatattagttgtcatactgccaaagcatcgataatgaactgcttcgaatcttcatcaacatgtctccagtcatcatgattgagagggaaacccttagttcttacaagtgtaccaacaacatgtggaaactctttagcagctttccctactgctgatcaaattcgttgaactccatcttgatcagtggctcgtcttcttctctaaaccatatgttatcctttctagtgaattttcttccttctcgtttctttggttgtgctctgttggaatctgaaatttgcaagtcagttaattagtcaatcaaatatatgaattgctcatatttataaaaataaaagaaaaccatacccccattctgttcagcagccacaggttgaggaccttcatcttgtccttcaggaccattagtacttccatttcttggtagcctagggtgcagatcactatgtcctacatgctcatttgttgtatcaattcttgctagtctggggcgtagatttcgaggttcaattggcacagagctaatgcattttctcttctacaatatcaaaaaacttgttaaaccactatgattttgttaatagcaatgcatcacaaaaaaaataaaaacatatcagccataccttgctagttttcttagcttgctgtgaagagctagctccttcagtccttatagactttagcatagattctagatttagaacttgtatcctgcgcttgttctcagcaacatt

SEQ ID NO: 31633 - DNA, 1846 bp, Oryza sativa
catgtcaaagcttttatcactccatcctcctagaaattttgtatgcagcaaacagactaagaaatttagtttagagaaggtcttgcaaccagggtacagctcctgacttgcatcatctactaatctataaaaatcatcgacatcattattggcatcccctgaactgccatcagcagcacccccctcccccatttgatctaaaccatatgccatatctctaagcatttcaggaatttcatcacgatcaactgccctctgttctacttgaacttgttcatgtgtagtgcaatgtgcagaagatgatgcttccccatgaaaaatccacagccggtacccatgcttaaatccatcacatatcaggtgttcaattacaatgtttgcttccaaccatgaacaattaacacacttcttgcaaggacacagtattttatttccttttgctgaatgagtaaaagcaaattctatgaagttattgacaccacgtctgtactcagttgtgctcctgaaatactatattattagagtttggacaaatgaagatagtgaggctaaacaattccatgctagtaattgtgtgtttgtacctaggcagatccatccatctcttatccatgcttgccttttataatgaaatactaaatgtctgaatataaaatgcaaatatttgttatgatactgcaaaaacacaaatggttgccatagctctcaagctcaacaagcattctagtcatacattcaaaaggcaaaacatcgtgtaaaaaaaaactaaagtatgtaaaagtagttagtaaaccacatagaagtaagaaaaactgatgtcaaagagtaagggaaacacatgtaccttttagttgtgcgtttgcttgttaatttgttctggtttgcttccaaccttgttggtgtctctgattactcagcaagaccttctacatttttggataataaatacaaaattttaaatgcaacctctgcgatatattttgctcttgtgcaatgcaattgaaaaattaaataatctgagtgacaatcctcaggttcagaaaagagcatctgtatttctttttacttaagccactgaacatttgtattttcagatgaaataccataaacaaaatcaagtagtcaccctgtttatatgcagtacaatgggttagttagataccatatcacttaaggtaaattttgttaattgttagcacaaataaaaaggcagctatacacctaaatccagacaaagaatggatgctcgcatttgatggtctgctgctttacttacataattagaggagccccctagtcataaactaataaacagagaaggagttccacttccatacctagctaaatatgtcagggaggtcaagtagacaagaattaagcaaattccaccataactactgaagatagatctgcaatggaaaaggtagaaaattggttatgccagggtgaaataagcacacatgagtagtaacatctcagaagggatgggacaacaaccaattggaaaaatattccttttacaaagacagtaagaaccatcatctatcatttctaccccattagtaaaattaaaaatcttagcacaagactgaacataaaacagaactgttggtaaaatttatttttaccaacagactgtgtgacaggatattttccgacagacaaagtgacatctaaatttttttctactgacagacgactgtcttctttttagtgttgtggtgtagtgtgtactcaccgagataaaatttcttgacttcaatcaaattctcgattacagcaagacgggagacttagtcgtacgctctgtactttctcggtcgacatcaaagattgacttagacaa

SEQ ID NO: 31634 - DNA, 5907 bp, Oryza sativa
ttgcatcgaagtcgggggctactgtcagggttatggataccacatacctaatagtagttgactaaatctcggcaggatccaccacataccatgtcttatacggaaactgacctcgagggagttctgaataaggaaagacaaccatagttctacatggaaacgacaaggactactcggattatatccatattagtttccctaattctacttggacaagttgacacctatgggtataaatacaagcccccctaggaggagaggggagacgaacaattgacgatcaacacgatcaacacggacaacacagacgaccacctcaatcaacacacctaccacaatatacggaacaacacaagtcacaacatacaagccaacatactccaagacaagtcgccagatatcaacttcagggataggcatggctattcccctacggtatctccggatactgtcaggagagacgaaagcgctatctctaatctcgccggacacggattcgaggaggagggctaccttgttgtcgactatgagtcagaacttcataccgccatgtcgacaacagttagataggctaccccacatattgcactggtgtgattatggtgaataaaagcaataccggctccggccaacaggatgtagggttattacctgacaattcaggggcctgaacctgtataaaaatccctgtctccatctcttttacctcagtctcgtgtatatcctagcaccaacgatccccatactgtccaaataccgtagtcgtgacatcaaacgtcgacaagattagctatagatgatttggagccatcaatgggctatactattaaacttgctctcaaaaggcgagcagcctaggaggtagtgccgagccaaggagagggagcggagcggccaggcaaggaatcgtcgggggaggaggttgaggaatcgctgggcaggggagacggcgcggctgaaacgggccttgcggcgcacgcgcacgcgtcgggaggtctgtgaagagggtgggcgaaaggtggcgggatggcagcgagaagtggtgcaagaggagggccaccccgtgcatgcgcgtgggcatgcggcgcggccgagacgtgcgcctgtgttcggcgtgcagtgtgacgcgttggctcagagaaaacgatcgatgctttggcttggagtagtgacagggagaaaaacaatctaatgggcttttggcacatggatatgggtctctccgggatggctctatcgtttcgctccgtgtcgcttcagcgttggtacgataggcaacatggatgaccatccagagctgatcaaacggctgtaaatcaagtagatggtgtggcttatccacagctcagtaaattgataataactggactaagtagggatcacttgtataatattataggattcaaggcgtgctgggtgcctatatatggtagcgcccttaccagctccctgctatgccaattgctaataaagaatgaagaatagtacaactccaaaatatgtcaacaaccttcaacacaatctctattttatttggaagttggaactagtagtatacttggtcgttcctcggccgtgtacatattgattatagatctagaggccaggttttaatcccttattaaaaaatatatagcaggatatttaacactgtgtagtttttggaatttatagttctgtgattctgatcacttcaaccaaaactattcacataaacaatcttttgggcacacgtttttttttcttgtggaaaaatttgcccaataatacaatccatttcaaactactgaagtaatatgaccagaaacatgttgacctggtcatccctggagcatgccatacatgcatggcagtatttctagacatgacagggctttcttggtagccacctgcatgagacacacaagcaagtctgcatcagacatccgagcttgctctacttatccctaataaggtgaaagtggagacaacatttagctccatttcacaattttcactcagggaactccagatgcctccaactcccagtcatacatgccacactggtggagaaaccatctttagtcggtcgaccaaaatccacaatagtcccggttccactaaaagccgggactaaagatcatctttagtcccgattggtggctacagtgggtatatttgatctttagtcccaattggtaatagatcatctttagtcctagttcgtatgttgtccggggctgtcaggccctcccgtgatctttagtcccggctggtaacatcaaccgggagtaaagatcaccgtgatctttactcccggttggtgttaccaaccgggactaaagttaggatttttagtcccggttgttaaacaaccggtaaaacaaagcctctatccacgggtgcgtatgcaagtcgcctattaattccatccttatctcctcctctcccatccagccatcctctccatcttatcttcttctctcctcctctcctcccatccttctcttccttcttctctcaccccatctcctcccctttcctccccctcctctcctcccttcccttccggcagggcggcggaatggaggccgcggcggccctgggcggggcgacgggatggaggccgccgccggcggcccggcgcggggcggcgagatggaggcgacggcgggctgcggcgagggcggcggcggttggctacgtcgggcaggaggcggtggccggcgctggtcgggagggcggtcgccggctacgtcgggcgcggcgcggcgagatggggcggctggcgcgttcgaaagggcggcagccagcgccgggcgggaggtgccgaccggcgccggacgggaggcggcggtcggctgcgtcgggggcggccggcgccggtcgggaggcggcggcaggcggagaatttttttttctcttctctgtgctatctgatgaatgctgatttcctttctctgttctctgtggtaaatgctctctcttttctctgtgatgaatgctcattgttctgaagatgttgtagatctgaataagtgtaaagaatatggatgctttgttgtttgattttattcatttgatctatgatttaggctttgttgttgattttattcattcgatccacgagcgaaagctaaagaacaatcaaaaaaagaaaaaaggccaaccggatgaaaggaaaagaaaaaaaaagaaaaccaaaactttttagtcccgattagtaacaacaaccgggaccatatttttagtctcggttggtgttaccaaccgggactatatatcgatctttagttccggttatttgaaccgggactaaagataacaccaaccaagactaaaaattgatccgggactaaagattgtgatctttagtcccagattcatagtcccggttagaaaaccaggattacaaagggttaccaaccgggactacaaagcgtttctccaccagtgccagtatgccactaaaatgcatatgcatggcagttctcacttggcaacagctagctatctactggtcgcaagcggccattgtttttatatgccactgatgaatgacatgtcactttttttatacttggtagatattgcatttactagttggatacttactccttatttattttgttgcaagagacatttacaccttctctatttgtgtttaattacaaacatttggaataaaatagatcttcgttaccaaaactctgcaggtccacgttagtattggctaaatgcctacgattgtaagatgagttaattttttacggtcacaactatatgattgcatccttcgcattttacaagtgttgactaattcgattccgtgctcattctcctataaacaaatttgaggaaaaagaaagaataagcatgaatagccatgtacatacatccgggactctagactatataaaaatgtgtcatgaacccataaggctaggcccataggcagcccatcctagttaaatttgagataggattattagttagagaaaggataagattaagtattttctcgattaaacaatggatatcaactagtctaatctgtctctactattactattaatgttatcattactgctgtaaatatacacaagacatactaacagtaccattcttcttccgaaaaataatgtgtccatgtgcatttggtaatgttacttgaccttattactgattaaccggctgtaccactgtgcctatagctagaagtttgttgtgattaaggctaagttctaaactccaactccaaactgaagcttcctcgattttcgttaacacgtttttttctaactagtaaacaatgtgctttgcgcaaaaattttctatatagaagtttttctagaaaatcaaaaaatatatttttcaaatttataatagtcaatacctaattaatgatgttttcatgagccatcatgttttacgtgctgctaatatgctcctccaatatggagattcaaataagccataagactgcacgtctgaaaatgtttaccgatgttaactcaaagctaagcaaaattgtataaaccaccccaacggagtagctgctatatattaggcccatagaaaggagtgctatatagctgctttgtgttttcctcatagtactatctatcgagactgtgagcaccgatgtttcctttagggtttggaggcatacgggatatttctgtcattgttaaccaaacgtgtcgtagtacacgccctgccgtacgttggttcctcacgtaatgatatctatccacgtctgcaatgctgctaaattggatttcatgtagcacagggcatcggtgtgctggttttcgatctacgatgtcaccgttttcagttccatgtgcaaattgcaaatactgaatgaaaaattctagtacatgacgatggcaagctttcagaacaatctttatttcttttggacatagcaaggtgttcagaactggtcgtagtctttcaaaagcaaattttttcactgtaagcaaaaatgttcagaaaaacaatcttttgcgcactagtactagagttgaaatggcgagtgctttgaattactgaatatagtaaaacacattcatatggccctatggaccatatcaaacctgtcagtttcacacgcatttttcctccatgtgttcagcctcgcacgaatcagagaaaaactcgcatgttatttatcatggagtaaaaaggcagagttcaacaatccaaaacaaaataaagcttcaatgtactcattcatgatgttgtttttggggtatttagaatcataggcacaatgttgattttcttagtttgccctgtttcttgtccgggttggccactagatcaattgaggacgctgcgctctggacggaacgcctccgtagtgaagacagaatcattgtcgactcctggaaaagggctctttctctccccctctgatctaatgtatcctaaactcactgtactttcctcctctaatgaaattcaggtagggaaaccctcccctccggtggaaagtatgaaaaaaaaactcattcaccttgtgtctgcactctgatgaaacattttggaagaaatatctgccatgaatcaagagcaccagtttctacccttgtcatctttgcaagcagttcaacgggagatggaaggacaatgagtgatcttccttatttatatgtgcctacagttcactttacaatgcatatttttcaaagcaagtttagctgtaaataacacatttatctcatgatctaattccaagcaggcctgactgcattatttttttttcacgtccctaccaaataaaaagaagggaggccggttccttaataatttaatttataagaaaccagaaatgttacaaagaaatagattaaaggattacatgggccagctttaacaatgcatttagtttccaacctatttacattgaaacggacaccc

SEQ ID NO: 31635 - DNA, 2548 bp, Oryza sativa
aagatgctcatctgtttctgaacctaaaacaaacacacgatgaaaattaaattaaccgttcgttcgagctgatcgatcacgctgatctccagcacgaattgtgaagatatacttctaacttctggtatgtcgtctcacacttgcaatcagtggccagaacttgcataacttgcaagcgcaattatggtgaaaacggagatgcagaccatctaacgaaccggaaattaaaagcacagcatgtttgtattcctagtgcctcccatgccgacagtaaataaatacaaatgttggtgctcaagtctcggatgaaatagctttcgacttggaatgctactgcctctatcccattatatatgcgtaactgattttggctcaaatcccagaatatagggcggcacctgctaggctccgatttatacacattcaagcattgatgctcccttcagttcccttgcatacatatgcacgcattgaagacatcagcaaatgaaacgctttcataaaatttctcctagaataaatactttaaatatttgtattagaaatatatggagaccatatctatagattagtattaagataatactttaataaaattatacatttattggtatttctatatattataatagaaaatagtggttaaaattgttttttccttaaccatatccttcaaaaatgacaactattattaacccggatggaataagagcctgtttgctaggatcctagctcctagattcacctttgttggagctggagtccaatcaaacggtccatctctacccaaaaaaaatagagcagagccaaccagattgctgcagaaaatataactaactggatggagtggccttaaggtcgctctgcaactccggctctagcatttttacaaaactttgcaccgtaattatccgccaatgccattggatcatgccccttcgtcctcaacaccacaattggtgagtagcgactcctctcgataggccggcttggtgatagggttggcggcacccttgaaagagttcccagtggcggtgcacatggaggagcaggcggcagcacaacccgtcctcccctcctcttgcatctccttctccacacctgccccgaatggcggtagatctagcggcggtggcgagcggactcagaggtattagcggcgggcggtagatccagagatgaagaacgccagcagaaacttctcttcggttgaatcaccattgaagaccctagaactccacactccgtcacttcaattttgcacctgttttgtgattgatttgtagaaagtgttgtacccccaactccctccattcaattttgcacccattttgtgattgatttgtagtacctccgtttcaggttataagactttctagcattgcccacattcatatagatgtaaatgaatttaggcacacatatatgtctagattcagtaacatatatatgaatgtgggcaatgctagaaagtcttataatatgaaacggaggaagtagaaaatattgtattaatcagtggggatgatttggtacgaggcttttttttctgattttgcactgatactgacacttgttgctagaaatagtcacttgttttagcatgcagaacgataaattagttagttcctaagaaattgctctaacataattattgtagatcgtacaagaacaagagccctctgcagagaagcttttcttgcactgtatctcgttatacttttaacaaaaggcagaagttctgcataagagaaaaatagttccgcagacttattatacaagagccatcagagaaacttagaaaatatattctatgtaagttagggctaaaagtactactctttgattattatcttgcgtggctaggaaggccacttgttcttcgctttacttcatcacaactatttcaatttctagctgataaaggtttatttgcagctaggccaccgcatcacggaaatccgctacagccatatcctagatgacaaattttatcttcctaatataactagaaaaaatacctatgcgttgcaacggtaaaatattttttatcgctatacacttttcagtcccaacccaccccgctatcttcctctacttggcttgcctctctttgatgtagcccaaaggggagctgtaggctccgcttgcatggtcgactgtcatatccaacctccggaagacagttctgtgtccgtacgatgccagaactgatcattcctatcaaatctggttgaatctttctcgatttcccaaaattggttaaggccttttgatacactcaatctcctccttttgtttttatcaaaatcgaaacggatctgcaattggttgagggattttgatacactcaatctcctctttccgtttttatcaaaatcgaaacgaatctggaaaactaggatagaatggtgacttttaaatggtgattaaatccaataaattaaagcggaattgaaagggaaaatcatatggggaaatgataagggagtagtggggaatcgacttttgcaatcaattggaggaaagaacgtatgaggaggtagat

SEQ ID NO: 31636 - DNA, 5590 bp, Oryza sativa
gtagtttggatcatcttaataaatataatgtacgcatccaataggattagataacatgggagtggaggatttaaaaaagtaataatttaatggagaagatgttatagttaattgcatgcttgcatgcatgccttatagtattatggaacatctaagaaaagtgtttgtgtcttatattatggaatggagggagtaatttctaagatcaagttgcaaattggagtactaattaatacaggtagttactctcggttaaatagcgtacgtgcatacacactcaaaaaagttactcaaatctatacattcaatatatttacataaaaacatgacacattatcatttattagcaactgatacattaattttaacatgcaaatctgcaatttattacaagcaagcataacaaatcgtccttacattattttcataatatttcaacatatttctatcaaatatcaaatcctatatttcttattcttcattcagtttggtttagaattgtatttttttagagaaatagtaattgaatagtaattcattagttcttctattgcattatgtgctctaatatgtgtcgggttttttttcgtcttacgaatgttgccaaatattagtttccctattggactatgtgatattgccctttgcattacttatactaatattgtaaagttgaacgtaaaaattattgttctagctgaatattgatcacgttgtattctccaacatgaacggtgaagagacatgctgctagcttgcataattggctcacagtaatccgttgtggaacaaaatccaacatgattagatgtaactgcaatcatagttatggtggagatggagatgccaaatcaatcaagcgaatcaaaacaaggatggcgtacgtcttgtttttctactaccttcgaagtctgaactctgatgaaacattttggcagaaatatctgccatgaatcaagagcaccattttctaacctagtcatctttgcaagcagttcaacgggagatggaaggacaatgagtgatcttccttatttatatttatatgtgtctacagttcactttacaatgcatatttttcaaagcaagtttagccgtaaataacacatttatctcatgatctcattacaagcaagcctgactgcattatttcttttccacatccctaaaaataaaagcagggaagcccgttacgttataattttatttataagaaaacagaaatgtttacaaagaaatagattaaaggattttcaatgggccagctttaacaatgcaatttagtttccaacctgtttacattgaaacggacaaccagatcatatacatacagctctcctgtcctcgcactctcaactctacccttgtaactcatgcatcacaaaggaaacccgatggtagaccttacaattaattactcttcacgagacaattctcctatttgtcccaaatgaagtacccgatgtcataggtagcacaatttcacaattatcgaaattcctgacgactcccactcccagtcatatggcttggcagaagatgcatctgcatctgcatctacatggcagctttcacttagcaacagctagctatctatcagttgcaaacgtccatggtttttatacgccaatgatggacgaccaaccacttttttcaaacttaatatcgcatttactagatggacacttactcctatacctggttttgttgcaccaaaaactttgcaccgtctctatttttattcggagatagttggaataattctagaacttgtcacgagcagtatataagcgatccattgttcttctacttattaggtttaatttgaacatcgctaaactagccctactagagaaaacataagagtatttggacgtaagacattacaataatggcacatatgaacgctagtccgcctacatgcctagagtagaatatatgaattatacaacaaaatagtagttgacgcatacataatgcttctcaatcctacatggactcttagctaagaatgtaaaatttagttcaagttgttactttgatagtttgcatctccttccattcaaaaactatgacagcaaaaattaagggcaagtcggggtccttggcagtcagccgcgaggtttttgtgcttttgtactccttttaaagcaagccggggtggtgtttgccgatgctagcaccccaccactaaaatcttatgaagaaaataaaacgttatagaagttcgctatcaaccagatacaaaacgctctacagaatcagcaaggtgagatgcaaatcacccagacggaatggatggataattgggtatatagattgatgaattgctctaatttgttgaaaattaatcccaacgatggtaaaacactataaaaaaacgacttttgcatacacgccccttagtttatcgttggcagactaaaataacgtccccatgtaaaaagatttgggtagtgtttggttaagactcctccgccacctagtcacacactcccccatcctctcctttttattttaatctgattccctcttttatttcacttcccctcctcctcccacttgcctcactcactactcctttccccactcttccaccttacttcccctctcactcccaaacggccggccagcatcctcacttgtccgggcggtgacggtgggcttcagaattggagcagaggtagcctctggagcccatgggagcgggagcggtgaccacgaccatggtggcgacatgctagtatgggagtcgtggatccgccaccggcaggcttgggaagggcagatctactatcggtgggctcgggagcggttaatccgccctcacgcttggcagagaggaggtgggggggtgccgtgatgacggcggcaccagagcagcaaccatgaccatggtggcggcggcatgcatgcacaggagtggcatatccgccgctgacgggcttgtgaccaatggatcctccctcacgtgcggtggagatgaggcgaaaggcagcacggcgaccacaaccacggtggcaacatgcggactcaggagcagcggatccgccaccggtaggctccagaatggtggatccaccgccagcaacaggggaagcgaaagagccgaagagcgcactttgcggttgcactgcccggtgaggaccttgctagggtttttaacttcttttgttttttttttatttttaatcgtttagtcgggtatccttactgggcgctagcaaaaaaaaaaggatctttgcaagcggccttctcgaaaatgattttttgtatgccattgtggtggcctcacatggaaatgccaattttcgcatacacttggtgccaggctggtggagcacccacccgcgaaaactagttccagccgtgtacaaagatttctatagtagtgtaatttgttttccacaaatatacattatagcttacactgatatacgcagtcaagaaaagtagttcctgtctattcaaaatattactccctccatcccataatataagggattttgactttttggttgcactgtttgatcattcgtcttatttttaaaaaaaatggaattattatttattttatttgtgacttactttattatacgaagtactttaagcacaacttttcgttttttatatttgcacaatttttttaataagacaagtggtcaaacagtacaagcaaaaagtcaaaatcccttatattatgggacggagggagtaacttggaatgctaaattctcagcccagcaaatccatactaaaatttggctcccaaatttatttttagaacaaactataaatcatcattgagttgatggacccccaatctaaataagttcacacatatttttgaagcttttacaactggacagagaaaagggtctatttggagaagacaccgtcctgcactactaaaaggctcaggacaaatatttgctcaggattataaccttttcttcggatttttttcaccaatcttaattcctcacataaagagggtttcaactgaacctactatatacacggcagtagcatagatgagaagatgctcatctgtttctgaacctaaaacaaacacacgatgcaaattagattaaccgttcgttcgagctgatcgatcacgctgatctccagcacgaattgtgaagatatacttctaacttctggtatgtcgtctcacacttgcaatcagtggccagaacttgcataacttgcaagcgcaattgtggtgaaaatggagatgcagaccatctaacgaaccgtaaatttaaagcacggcatgcttgtattcctagtgcctcccatgccgacagtaaataaatacaaatgttggtgctgaagtctccgatgaaatagctttcgagaatgctagtgcctctatcccattatataggcgtaactgaatttggctcaaatcccagaatatagggcggcacctgctcggctccgatttatacacatgcaagcattgatgctctcttcagttcccttgcatacatatgcacgcatttaagacatcagcgaatgaaacgctttcataaaatttttcctagaatagatactagaaatatttgtattagaaatatagagacgtgccgtgccgggcggcccagctggccatgtataaaccagatacacatcgaactgcttccctggtctctgcgtccagggtagttaagccgtaactaatgggatgaacggagtatatattaggctcgtaggaatgaatgctatatagtcgctttgtgttttcctcataaagagcaagtcgtccttgaaaacaatattgccagtagtatctatcgagattatcagcaccgatgtttcctctaggattggaaggcgtccgggaaattttctgtcactgttaagtgaattgtcttaaaacaccttctgccctatgttagtatgttggttcctcacgtacatttatttaacctcatttccaatgctgtcaatttggaactcacgaagcacagggcttgggtgtgttggttgccaatcaacttggagttcttgatttgtgttgtggattgggattacgagctgtctgaagggggccactcgaagcataccaacgtctcctttttttttaaattggaaagagtacataggtgttggttttattacggccaatgatgctgggacattgccgctggatgattggtgacggttccaaaaccaatacctatatcgggtttgaaactgccacctattgcataatctgcgagaatgtgtattcaatagtaatgatatctattcagtagtgtctattaggtgcaactggcacctagctaatatcttgcattagaaactcatagatataaaagtctcatacaacaaatttctatacttcaaaatttatatgtttttatattgtaggccaaaatagatttttttaatagaaaggataccggagaattttacaagagaaatattttcatgcaaaaaattcttgggggaggaggcgccacatctgttccaatagaagccatcactgctggagggttctgacacttatccccaccttcgacacagtctcaaaataagcaatgggtatagggtggaaactgactttgtttagtttgcagtt

SEQ ID NO: 31637 - DNA, 7179 bp, Oryza sativa
ccacccccccccccctcctcccgcagaccgtgtcctgctcctagcgcacgcaaggtcggcacccacggctgccatgattcgccctccatgacgggtacctcattgatcttgacggcgaacccatccgctgcccgacgcccatcgcccgttgcaacgtccaggccacgctcgccagggagaactccaacatcatcggcacctgctcctctgcccggtcagcgagatgttcaccagcgtggtggcgaccacccctgtgctcggcgccggcggcgacaacactaccgatggattcacctgctccggcattagctgctgtgatgcccatcgccatcggctgcccctcctacctcgtgcagttccttagcctggactagaactaggagctcagcggcaagctacccatcgccgtgcgcatcgccgagcggggctggttcgagggcgtcgctgccaagctcctcaacagcagctcagacgccgccactcgccggtcccggtggttctagagcagtaggcggttacgggagctcagggcgcgcgaggcggaggcggtcgcgtgcgaagcggcggccgcgctatgtgatagggccagtgagctggagaggagcggcgccaagggcaatctcgccatcttaaaaattttatcacctcttttgacccaaaaattataaaatattgtatctggtgtcctacaactaattatacaattttggtagtatccatcagctatgttacgtttttatgatgtcttagccaattacaagttttttgagtgtcatgtagcaaattttgctgaatttttattatcaaagaaaaacatgttgctcccatccaaagataatgaatcaaaaaacatgcttgaaattaattgcatgtattcccatcgaaaaaaaaagtaactgaatataaagattgtctccactctcctaattaactgaaaaacatgttgctcccatccaaaggccttgttaggctagttcctttccataggtattggaggaggttaattcagcatccattaaggtgcgtagaaaatactagggatgaaaatggtatggaaatttttaagatttctggctgccgtttccagttttcaccgaccgttttagtcggtatcagtaaccgactgtggtggaaatggaaacggtaatttcttctggaaatggtagtggaaatgggatggagatttttccgaccgtttgtcggtaaccgtatttatacggtaatttccatcaaaattccgaaagttccccagcggctcagccacctcaacttatcggaagcccatgaatgaaagaaacccggtaggcttgcagcccataataaaaggggaagtgaccagggaaaatattgttaaccctatgacatggcatgtggattttgctgaactttagtctcctcaacttatcgatgttgaagtatgaagtattgttgaactttctttatgttgtttgtcaaacttattatcgtatcaccaattatcatataacggtgttatgtggagtgtgatggtgcaaaaattaagttaaaaattcatctacgtgcatagttaaatgcgtgctatgccacactccgctgattccgacattaaattttgacttccgaccaatatcggtatattccgttccgatggtcccgtttccgatataccgatattaccgatatcgttacaatttccgagtctattgttccgattccatttttgagaaaaaaaatacgaaaataaaaatggtatagggtttttccgaccattttcatccatcgaaaataccgaacaagccccagatgatataatgtacagtgcttcaaccttatgcatttaggagaagttctgaggaaattggagtagagtatatatgtataattttttttgcggggatatgtataatatcatttacaaatggaaaaaaaaagatatatcgtgtcgaaatccaccagatcgaataggtattcgcacctgcaaatcactacaccattccctatgaatctgtcagcaaggcccacatacgctgaaaaagctactctttcacacagagagggtcaggttgtcactgtacccacgacggaataaaaattgagcatatgcctaatttatatcacaatttctatatatatgattactgctcaatataccgacatatatttaagagcaatttttaaaaaaggtaaatagtcagaattatgttctagctttagctaaatatttcagagaactacaacattatttatttgccttacgaatttagcctacttatcacacaggtactagtacgtggataatactcgcactctcttaataagagttgttccacattccatatgcattgaggataaaattaattttctcgtaaaaccgtttgctatttgttacagttttatgaaatactccctcaaagttgtagcaaagagatagtctcggcttttgtgaaatttactttatatttagcatttacatccgctccaaaaatatttgtgtcaaatacaatccccagtttatttcaccccgtacattcaccaaacttaatgcaacaggcaaattgtatgtacatcattcatttaccaaaacttgaagcgacgtatatacatgccagcgcagggtttctgggtttgtacagtacaatcgcaacaaatcagaacaagctgcatccggcactcaataaaaggacctagagtacacacactcaaatatatttgtacgaaataaaatggtcacagaattaattcacgttacgcacacaataaaaaatcaaatatatatttagtttcatcacaattctgtctgtgagaatcaaatatattatatatatttagttgacaatattgtaccctttttgatacattgagagtagagtgtgcatgtgtacatagaactaaactcgtgtgcatatgagcatttgtattcgctacagaatactcaaaatttgtgtaattcgcttatagacataaaaaaacgtgtcatggctgaaagtcacttaaaaaatcagtatttgttagaggacacttttggctcaattggaaagataaattattaaaaagaggagattgccccaagaccatatgcttcaaatatggcgtgagagtaaaatttagaaattatgcaaatctaaatttactatcaacccaagtacaccactaacatacatcatattccatcatagtaatttactggagggcattttcattttcttgaaaaaattctctcccaactaagccaaaagtgttctctagtagattaccagtttttaacaatgtctggcacgtttttacgatgtctaacagtaaattatacaaattttaaatatcatgtaacaaattttgtcagacatggaaccagaatgagtctattagtggagtcacaactacaactcaccctctgtttcatggccttcgtccatctcaatcacacacgaagccgaacttggctggaatacgaggccagggtctaaggtggtgtttagtaagggacttgtgcttttgtgagagagactaaaataagtccctcctctcccaaacaccacgtaaaccccacatttaaaatcttgcctggaattgtcccaatttccatgacacgtcgtgtctgacgaatcaagatgacagtaccatgttcccttggtcatttatgcatatgccaccaataaaagttgctcaccgatcgagcttactaaaaacatgaaaatttgttgtgtcgtgtcaccttcacggcaagtgtcactccttatcttgcctgtgtacagacatgcagtgagtgttattttcaccttatttgcaagctgtccatgttgcaactttcaccatttcacaattccccacatagagaagacagccaacaatcaacaatgtaatcagatcttcaccaatgccttgcccatgacacaaaaggggggccaatgaaggcagcccttcagcatcagatacccctgccaaggctgcaaatgccatttgggatgaggccaacaaatgcccatgaaccaaacgtagcaaccaaaggcagccatcgaaattgttgtaccctctcaaacacacataagccaagcaatgtagctgttatcacacagtaacaaggcaggcagccatttctggtttctgccaccttgtagcctgccatgtggggcttcaggaatttaaaggaccacactctcacacacacacacactcctccaacacatatttacacaagttctgaatttacccatcaaacttcttgtaatcctttgtgtttgattgtcttcaatgtatagagatgcaataatcttgtagaagtttccataacatccgtaccatatgctcttaatagtgcagtaacgtagggcttgcttgaaaggcactgcagtctaattataagctagtctaattataagccgcgaagacacaataacgaggaataagactaattataattttaggtaagactttcctacctatgctcttcgcggtcgaaaactggctaaggaacaaaaacgactagaaaaaccatagattggaaaatttaagttgcaaaaattcaaaattaacaagcatgccctacaggttttaggggaaaaaatatgtaaaatgcatgggtggatggctcttaattgtatgcagctaactgggcatccaagcacaggaggcaggctagctggatagtaacatgcaggatgcaactgctccagatttaatggctgcccaacgccggccaactatccgtcgatgtccccatctacacggaaggagatcttctgcagtagtgaagctagctgctgctgcgttggggttggctcactgacgtattcacatagtattattgtactcctatcctatctacggttttctctgtttgtaggatgctggtgagttggtgattgcgtttagacgagggctgtgcttaattgttagctctgccagcttgatgggtttttgttactcgctccatcggcctgtttagttcgtgaaaaataaaaaattttgtgccacatgagatatttaaccggatgtcggaaagggttttcagacacgaataaaaaaactaattttataactcgtctggaaactacgagataatcttgagcctaattaatccgtcattagcacatgtgggttatcgtagcattaatagataatcatgaactaattaggctcaaaagatttatctcacgatttcccccctaactgtgcaattagtttttttaatctatatttaatgctccatacatgtgtccaaagattcgatctgatgtttttgaaaaaaaatttggggaactaaaccagacctaaaatacactaagttttcattcgacacattctcagttacctcttcgaaatatataaggcataggtctggactaattggggctacaataaaatcaagtggtagtaaacttatataagtagtttagtgctaatagtctcattttaccaatactaggttgctaatatttggacaaagtttaaactagaaaagttgctatattttgagacggagtgagtattattctcaacactaggtgaaatctattatggaaatgtgaagttttatggagtcacaaattttgcgacttgtgccgccaatattgattgagatatattcagaaattctataaattattaagttatgatattggagttcaagactattgtatatgcctgattttaccgtgtacaatataaatgtatttttcacgaaagataaattgacactcaatgtttataaattcttgtatatcgtccaaacgtgtatcaataaatcttgcagaaaaaagataaagattaaatacagacacgtaaaacgagaaagccattaatacatgattaaataagctttaattatttcaaacttaaaaaatagaataatataaaattttcgtacaaaatagtgaaaattaattatgctaaaaaatcaagataaaatatgtatcccaataaaaaaatggaatctacgtcgcaagatctcacaaccccagcaccaaccttttggatcccaatcaatgccacaaaagaaaaaaaaaaccctagaatatccacacaattgaatgattgattgcagctcaagcttcaatccgcacaataaacagattttacatttctaaacctctaaaaaagaaaatgcaatattagattgttcataccctcccataaataatcctcctgtacaacataattgcaccctctcttctcttcagcacactcccactgtgggagtcccacaaaaccccccctcctctcctcctctggctccctctgccacccagccaccacaggatggcatcctcctcctcacctccactcctcctcctcgtctccctcctcgccgccgtcgccgccgccttcctcgcggcgcaagctctcgcccaacaccaaccccaagtaccactcccatctccactctctctctctctttgcatttcaagaaaccaagaactgtactgaccgtgttcgtgttcggtttcgtagggaaatgatacggcggcggcgggggaggggtggaggccgaggctgaggaagacgtacgtggagggcggcgccgccgggatggtgccgcggcggcggaggctggtggggaggttccagatatgcgcggtgtgcacctgctgcgggggcccgcacggggtgtgcatcccggcgccctgctgctacgccatcaactgcaacatcccgaaccgccccttcggcgtctgctccttcaccccgcgaacctgcaactgcctcaactgccacctctagcagatatgcagcacagcacatcagccaagaaaatcaggcaagaaaccccaagtaaaagaaaaaaaacagtaatgcttaatgctgcttttaatctctttgtttttttttctctttttgatttttctttggttggtgccaaatcgagaaatgctaagaagaaatttgtttgggattggaagaacacttggatcatatagttagtagttgtagtgagtggaaatattggtagctatgagtagctttgtgatggatggatggatggatgttttttggttagtttttttttccccattttggggggtgactggttaatgtggtgcctattgaattgtggatataattaattagtatcttggtatatttgaaacaaaattgaatttgttctgtattgttacgcatattcttcctagtggtcgtgtaatatataccgctttagtttactgtcttcaaattcatattgcagagctagtatggttcttctca

SEQ ID NO: 31638 - DNA, 493 bp, Oryza sativa
aactggattagggctattaacttacgagcggcccgaactagtttaaatccttgtctttgttttgcttgatacagtttcgtatagccttagcaaccattgtaccccgatacttccaaatatcgtagtcacggtctaacccgtcgacagtggtgcactaggtagggggctttggtgcaaaaggttcttacgagatgacttcaacctcatgatcttccggcaagagcatccacagctggccaagcttgggagatccaacccaataggcgttcacatggatgcaagtccgatccattgtctttcccatctacgcagtcatgccgatctcgccttcccaaacaacttcgggatccgagattgccctgaccaggcaagcggaaagcaacacttcgtcaattgcctctcacgatcaatctaagagagagacactgacgagataaacttcctaggacctcccagagtggcgaactctcaatcaacctccaaggatcagacg

SEQ ID NO: 31639 - DNA, 31130 bp, Oryza sativa
agaattatatacaaacaaaatggccaaatttgtgccccaaaatttgaaacatcagttgcattatgacaggcaatgttgcctatgccttagtgccttacagacatgtggtcccggattcatgtgtaaaagatatatgaaagagccatattgtgaaaaccaggcttaggagagtagcatagcctgagaagtatttttccttaactgttggctgcaatatacaaagactgcggcagcctcaattcaggtcagaaagactatcactgaacatttaggcagcctcaattaaggtcaaaagaaaggtaactccataaaccgtttactttacactcagtcaccagagtggatttttgcctacatgacgctagcgtgacattactgtcagccaataagtctaaaacaaacagtagggcccacatgtcattgacaaccttcttcatcttcttcctccacctctctccgttccctctttcttttttctcgctaatacccaatgttggagttagggttgcttttagacaaacgtgacagataagggggctaataaggacttatccctttcaaaacttgccaccagtagaacataaataagctaatatggacagtggacaagtaaggtgatgccatagaccatagcacagggccttcctggataaaggatgaaagggtagcaggagagcacaaattttacaaatatttattcttctgaaaaagcaccagtttccgccatttgtttagctctggtagaatgttaaaaacagaatgatcatatttttatcttgtaagtttagtttattaccttgcaaggatgctagaaaaatgtattatcgttttcataaatgagccgaataaacaaaatgcaggagcaggcatgttgttatcaattcatgcagtgttaagtaacaaacagaaaaaaaaaccccaaatgctatgtttagacatgtgatcatttcgtcaagaggaatgaagaaaagattgagaaagttaccacttcatgaagcctgtccataggcacccattcctgaggtccacagagatcagataagacagtagctgttgatgagataacatctttctcttccaactgcaagagttgtaggttatctgattgtctgtaaccttttgatcccttctcagacttccttcctgtacaaaatacccaaatagattaattattttcaacatgctcaaagtaatttgagggtaatatgaacttatatataaaggatatcagcatatgtcctgtagtactatatacaatgatgatagaactttcatcgatgccaaattggtaacattagctactattcaaccactcccatccaaatgcattagttagatgaattgccaccctttcagaagactgatacactaagcctgtgaactattccttcacaaatatactaaaactaaaggaaatagcaatgttgagattatttaaaaaccaaaaatatagaaaactgtatgtggttcctttagtagattgcattcaaaaacctaggataaaaattaaaaggcacaggaacgtctaaaggttgtcacagtaattactaagatcagatttcatagagtttgaattgctcaggtaagaacataacttacaaatcaatataagatagaaccaaattttcctggaaactttaacagataaatgtggcaaaatcaacacaatgggctattcaaaaaataggaaagaatgtatcaatgtaagagttctgatgagaggattgttgcgtaattcaaagaaaaatgaagtgacaaaagcaacatgatggaaatagcttatagatagacatgctattcaagctacacatgccaatattgtaaagaaatggtaagaggaaaaattgacaaatgatctcatatgcaaattatcataactaagtaaccaaaatttgcatgaataagacaaaaatctattatccaaatatcccctgcaactttcatattgcatatcacttttatgtatccatgaaggaagcaaaagacagtccaacaaacttagattgctcaacatacatattataaatttctaatgacatgtaaactgcagtttagtgaacaaatcacttgcataagtcgctaattttcaccactcacgtcttctaagtcctaaatgttgataagacataaagaaccattagcaacacaaggcacgggatcagaaactgcaaactcaatatgcagcaggcaagcaaataggttcttacaaagatcataaaagaaacataatgcccacagcaaactgaatttgtgggcacaaaaaaatagcaaattagattattagcaaaaacttaacgaacaccctgatttcttgttttgcatcaccacacattcaaaaccgtgtccattaacctttttcatttttcacctgaaaccagaagcagtcattcgtattatccaatcaaatcaaacaggaagcaaagttccacccagaaaccacccaattgccacagtaacacacaagcagcccccctgtatccccaaatgtatttgtatcttatttataacggaattgagtgacgcttgcaagtagccctatgaggataagatatgtaacatatcaaaatcaaattctactggtatttgataagataatgttaggtcgcacaatccaacagcgataaataataataatccgatagaaatgaagaatcgcgagattctgataccgaccagcgagagacccggcgtctccgttcctcggccgcttagccaccgccgcttcgcgttcttcctccccatcatcgccgtcggaggaggaggagggaggcggcgggacagcgcgccgggcggcggcggaggcgcggcgcgcggcgtcggtggcgaagacggagcgggtggggaggaggaagtagaactgggcgtcccccatctgaaggaggtcctgggagtcgagcttgacgggctcgccgccgggctcgtggaggacgccctcgacgaggcacccgttcttgccgagcacctcgagcgcgaagcggcggcgcgggaagtcgtagaagatgcgcgcgtggcggcgcgacacgttcatcccgccgccgaggatcccgaggtcgacgtccacgtcgtccgcggcggcgtcgcctccgcctccgcctccgccgccgacgccaacgccgactccgacgccgacgggctggttcctcctgcggctgtggcggccgaggacgatggagtaggtctgcatgtagtactcgaagtcctccccctgaagcttggcgaaccctacctccaggtccgacgccggcggcgacggcgacggagcggtggccgcggcggcggggcggcgggagttgcccatggggtcggagggaagggggggttggttggtgggggcccaatgggtttggaccgtttgattgtttcgctagggcaatatggttttggagtgggactagcaaaactgtttctagtgtgggtaaaggtgtggagtatgggagggggaaagtgaaaaatattgcgatgacacgtaaatcgataagaattattattactagagtatgattaattaggtattagaatataaatttttaaagtaaaatctttttgcaaacaacacaatcatttaggagagtttagaaagtgtgcgcgtgaaaaattgagtaaattttctcagggtcaactcgaaacgaactacactagaaacgcagcctaaaggaaattagagtgtgccttttaaaatttcattttgggaaaattttgagtacagacggccacattttattacactagaaaaaaataccgttgtttcttaaggtatggatggaagaacataaatatacaaaatcatcatcatatatgctggtcgagaagtgcttcttactccaatgtgtcattttaaacaaggctaatttggaaccatgccattataattttacaaagtttgagatatgtcatcggtatctcaatgacatgtagaacccacatgagtcaatgacatgtgggtcaggatggcatatctcaaattttacaaaattataatggcatggttccaattttccctttaaacattgatacggtcagcgagatagtttgttggattaccaatatagtgttggtgaaaagaattctaaaactacatagcaaagattatttttgaaaaacaaatttagccttctcataatcgaaaaggtggtgagtatttgaaaagcatcttttgtttgttactggaacgaatgcccaataagtcttatctccacgcaatccaaacctccgcatgtatgcctttgtcatcatgtgatgccaggggtgtaagtgggtcagccgcgaacccacttataggctaataagcgggctcgcggcttattttagcttataagtgggtttcgcgggttagccacttacacctctatatcatgcctccgtgcccacctcacgcacaactcttgcaacatggggcactcttgctcggctccttttatccgtgatgctcaaggggcatctataggcctatgctcccacgcatgttagcaggttgggtccatctagatataccatatctacatagcatgggtcacgcctagttatgcacctttgttacatgtatcagtctatcttgatgataacttttattttgtattttttttcttcaaatcacattgttggcatatattggtacatgcatgtatctagccaacatcatgtctttcacaaatatctcagcgatatctggagacatcattgtacctgtgcaattaaaaggatgctcaattttcaccaaaacattataatgtgctgcatcaagattcctaattcagaatgctgcatcggccttgttaaattgtattttgggaaattttcgaatatacataatacatggccacatggaagcacataaatatgacaaaccaccatcatatatttttgtcatgacatatatatataggtggcgttttaaccctttaaacattgacatggtcacctggatattattaattagtaatattagtataaaacctaagaaaacatacaagcaaattataacactttgaaactattttgaagacaaatctatagtcttcccatttttaaaagttgaattagaaatataaaaaaaatatcattgcaaactgcacgtattcaaaagagtgaatagctaatttagtccctcaagtttcggcgaaggctcaatttggtccttcatatttcattttgtccacataggtccttcaaatatttgttttggcttgaaaccatcattgggtccacttaatatgccatatggctatttctagtcaatacttctattagaaaatgtcttgtttgcccttaatttgtatacatctatatactagaaaagagaaagccaacatgaataaacaacattacagatgtacttcccattatttcaacatgtgcacatgaaacttaagcaattgctatcgtatacacttgttagtacataatttttttttgttttacataatatactatgtattatctataaaaaattcaaacatgcaatttttctcttatatatgtgaatgatgaggggtataagtgtcatttatgaagagagttattggttcaaggataagtttgaactaaaatgaaaacttgaaggactaatatggatagattgaaacatcaagaactaaactgagcctcagatgaaacttggaggaccactttgactattcaccctattcaaaacatcacttgttcgtgatgcgaacaaatgtcgtgcaccatatgcgcggtctgaagttacaatctctcccatcctcgattcatctccacgcaaaccaatccaaactctgtatgaatgcacctatgtcatgcctctgcacccaccccaagtactcctttggtggttctcaaaaaaaaaagtactcctttggtgtgtgatatgctcaatgcccaatgcccacagccctccccccacacgtattagcatgttagagcaaggctaataatacagctgacctgttggctataaggttctttgcagccttctcttagcctacccatataatagttagctctttacaattaatatagggcccacttgtccctttcacagattttcttggttcttgtgtccaagccggctgtaagtttacagcccgtttctcctctctctcctctcttttctcctccacctcagcatttagccggcttatagcctactattatacttgctcttagtaggatagaccaacctagagatgacaatggggcctgaaacccggaacctgacgagtatttactttattaattaggagcaatgtataattcaatttttatccttacatgtctcttaacgggcaaaactatcactcgtcgggtggaaaggttgtgggtttcttctgtacactgctggagaaaggggcatcagtcccggttggtacctcccttatagtttcggttatgcaaccagagccacgaatccgagactaaagatatccatctttagtcttgggtgaaataatcgagattaaaaataaagatagagtcaggctaggtctggttgctattttttattgtttttaacattaaatattgatttcactccatcctcaaatcatctctaaatcgatcattacatatcacagaacaaaaggatatatttccaaattctcaaatggatcatctccaaatacatcacaaattctaaaaaaattatatcacaatttctaaaaaatcatcacaaatacatcatgtattcacatcgcatacatatcaaatacatctcagatccatgcaatgaataaaaaattcttaaaaaaaaatccatgccgctgccgcctcccctccggtagaggcgcaggttgccgcctgcagcgcggccacactgccggtcgccgtcctccgccggccgctgcccaccaccagccgccgcccatcgcgcgtggctgcgcacggccatgccgtcgcccgccgcccggccgcctgccctcccggctccggtgcgcgcaggccctccgccagcctcgctcgctcgctctcgctcctcgatctgctctcgccagtaggaaggagatgataaggataagagtgataccataacaagtgataccatactataataactattattatgttgatacttatttctaagtgagatctaacaagtggtaaaaataaagatttaagtagagattttaatatatattcacgtgatcaaactcatctaatttgtatacaaattagatatatatatatatatatatatatatatatatatatatatatatatatatatatatgttcaaaatcgtttgcacctttgcagtgtgggtaaaggtggagtttggaaggggaaaatgaaaaagattgggatgacacgtaaaacgagaagagttatagttaggttgtgattaattgagtgttaattattttagatttacaaatatattaatatgcacttttaaagtaaaatctttttgcaataaaccatcgtttaggagagagaaagtgtgcgcgtgaaaaacgagtaatttttctcccaatctactcaaaatgaacgtaactaggaatgcagcctaaacgaaattagagtgtgtcttctaaaattgcatttcgggaaaattttgaatacacacggccgcaaatcacatgattttgttacacttgaaaaaaaattcggttcttccttaaggtatggatggaaggacataaatatgcaaaatcatcgtcatatagatcctccagtgtgtcattttaaacattgatatggtcagtgagatagttgttggattactcattaaacatgggtaaaaagaattctaaaactaactatatagcaaagattatttttgaaaaacaaatttagccttctcataattgaaaaggtggtgagcatttgaaaagcataactgaacgaatgtaaccttgggatatttgaaatgtattcttgaaatatgtacaatgcttgtggatgtatgggctacactggtggagaaaccatctttcgtcggtcggccgaattccacagtagtcccgattgcaataaaaacctggaagggtaacgggtatatttgatctttagtcctggttggtaataccaaccgggactaaagatctttagtcctggttcaaatgctgtcagggcttgtcaggccccccgggatctttagtcccggttcataacaccaactgggactaaagtcacacccctatatatatatatatatatatatatatatatatatatatatatatatgtcttcttcctcctccagctgcccgagcaagcttcaaaatttcttcaaaaaagaggggaggtcatgccaaaatttttagtgaatttattttggtgattatatacaaatcggaggtgcctacaaggttagcaacttcatcctccaatgtttttttgtcatattacatttggagctatgttttgcacacttttttgtctccaaaatttagttgtaagttgatgagagagaaaatttgtgtggggaagaaagaatatatagaaatttagtttatttgctaaagaaggttttataaaatagttgagaaggaaaatatagtgaaagttaatattaaataatagaaaacaaactaaaatgaaaattaaaagaagtacaacacattaatattagtttaaaactttagaaatagtaaataagaattatttggtgtaatattttataatttttgtatgaataatgatattaatgatatgtcattattgtatgactgttgaaagagtttgtattatcttatgactgtcattattgtacgaataattatttgtgttcgattttttttatctcatgtagatggatcggcaatggatgtacgctgaccgacggtccaaagagtttattgacggcgtgcattattttttgagagtggccgaagctaacaggcataagggttttatttgttgtccatgaaataagtgtaagaatcagaaggagtattctgcatccaggactattcatttccacttgtttgagtcgggcttcatgccaagctataactgttggacatcccacggagagcaaggggttgaaatggaagaagatgaagtggaagatgacaatattccggactttgctcagtacgctggatttgaaggaaatcaaacgggcgaggaggaaagggatgctgatggtaacgacgttccggatgatcttgttcagatgttgcaagacgccaaggaggactgtgaaagtgaaaagggggcccataaattggacaagatgttagaggaccacagaatgtcattatattcaggttgcgagcaggggcacaaaaagttggataccactttggagttcttgcaatggaaggcaaaaaatggtgttagtgacaagacatttggcgattaattgagactcgtcaagaacattcttccggagggaaacaaattgcccgagacaacatatgaggctaagaagatagtctgccctctaggactggaagttcagaagattcacgcatgtccgaatgattgtatcctatatcgcggtgagtagtacgagaacctagaagcatgccctgtttgcaagcactacgatacaagattagacgagacgatccaggagaagttgacgggcagctaacaaagaagagaattcctgctaaggtgatgtggtatttccctataataccacggctaaggcgtttgttcaggaacaaggggaatgctagaatgatgcgatggcacgctgaaaagcgtcaacaggacgggatgctgagacacccccccgatggttcgcagtggcgaaacatcgacaggaaatttaaagactttggaaaggacgcacgaaacatatggtttggtttaagtacggatggcatgaatctttttggagagatgagcagcggccatagcacttggcccattacgatatgtatctacaatctccccccttggctatgcatgaagaggaagtacataatgatgccgattattattcaaggccccaagcaacctggtaatgacatcgatgtgtacctaagaccactggtcgaagatcttaaactgttgtggaaaaaggaaggtgtccccatgtgggacgaggataaacaggagagtttaacctacgagcgctgctgttcgtaaccatcaacgattggcctgcagttagcaacctttccggtcagtccaacaaggtgtacaaggcttgtactcactgtatggatgaaaatagaaagtaggtattttaagcactataggaaggttgtgtacatgggtcatcgtcgattccatgctacaaaccactcggtacagaagaaaggcaagcactatgaacataaggcggaccaccgtacgaagcctaaacatcgcagcgggaaaacagtgtttgctatggttaaagatcttaaagtagtgttcggaaagggcctggaagccagcctatagagagcgaagatggttacgcggcgatgtggaaaaagaactctatattttgggagttaccctattgggaattcttggacgtccgccacgcaatcaacgtgatgcacctcactaagtacctttgcgtaaaccttcttggcttcctaggtgtatatggaaagtcgaaagatacactggaagcacgtaatgatctgaagcatatggaacaacgcggcgaccttcacctggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatatgctttcatgaacgcaatttcgcagaaggtcatcgatccggatagattagaagccctttagaatgatgtggtgaaatgtcttgtcagttttgagttgatatttccaccttcatttttcaatatagtgacgcatctgctttgttaccttgtcaaagagatcagtattctcaggcctgtgtacctacacaacatgcttcctttcgagaggtacatgggcgttctgaagaagtatgttcgtaaccgtgctcgtctagaggcaagcatcaccaaggtgtatggaacagaggaggtcatcgaattttgtgtagaatttattgaagaccttcgcccaatcggggtacctgaatcacgccatgaagggagactacggggaaagggaactctcggaaggaaagcaataatgatggtagacaacaatttattccgtaaagcccatttcacggttctgcaacaatcttcattggtagctccttacatcgaggagcacttggctctagttcgtgccagaaacatcggtaagtcagatgcatggattacacggcatcacattgatactttccccgcatggctacggcaacatctcattggtaacgagacgatcaaccaacaactggccttcctggtgaggggaccatctggctcgatcgcgacagtccagggatatgagatcaatggatacacattctacacgagagcccaagacatgaagagcacgaaccaaaacaacgctattcgtatcgatgccatgggacacgatcgaacaactggcacgtcttacggttccatcgaggacatatgggaacttgactatggtcctctcaaggtccctctgttccggtgccaatgggttaggttgactggtggaggcgcaacgattaatgacagtgggatgacaacggttgaccttaacaatgttggatactcggacaaaccttttgtccttgccaatgatgtaacgcaagtcttatacgtgaaggacatgtctagcaaaggaaagaagggcagagggcctgacgagccgaagcgtcacgtggttctcccaggcaaaagaaaaatcgtcggagttgaggacaagactgatgaggattatgatcagttgaatgggcagagggcctgacgagccgaagcgtcacggtgacgattgaccctagcatcctcctatcaaatgaaacaccccttactcacgtagcgatcacaaggagggaacaatagtgaggagaaagtacgtgcggtcaaccgtcaccgccgatgtattgccgtaattattgtgtacacaatgtaaactattttgaatgtattgattatccatataaatcaattattgcatggcatatgttaattacgtacgattattagaatttttaacaattttaaatcatgcatatgccagttatatgagataattagaatttttaaaagttttaaatcatgcatgtgacatttacatatgttaattagagtttttaacaattaatatcatgcatatgctaattatatatgattattagaatttttattaattttaaatcatgcatgtggtatgtacatatgttaaagtttaatttttaacaatttaatatcatgcatatgctaattatatatgattattagaatttttattaattttaaatcatgcatgtggtatgtacatatgttaaagtttaatttttaacaatttaatatcatgcatatgctaattatatatgattattagaatttttattaattttgaatcatgcatgtggtacgtacatatgttaaagtttaatttttaacaatttaatatcatgcatatgctaattatatatgattattagaatttttattaattttaaatcatatatttgattattacgttttatccacttaatttactacagacaacaataatttttcaaagtaattgtcattaatttttcgactttaaaaaattttaatgtattattttctattttagaaacacatatgtaatgaaaatcaatattcattgcgtttatcagtggtcccggttcttaaccctaaccgggtttaaaaagaatttggaaatagcgggaaaatatctttagtcccggttgttcttacgaaccgggactaaagatctaggggtatatatattcccgatgcgcattctcgtcttctccaccaacacttagaagttttttccccgatcgatctctctcggcttctccttcgccgccactgcctagggcatccccgcgccaacgccgccgtcgtatctcgccgtcgtctcgcgggcgtcgtcgtcgccgcctccaccgcctccgctgccgccgcatctctggggtgagagccgccgccgcctccctctctctctctcgacgacctcgcgatctctctctctctctccccaaaccgccgccggcctcctcgttgccgacgccgccgtcgacatcgtcgtggccgaacacgactctgcttctcgacgatgccgaccccgacctcgatgcggccgccaccggcgacgacatcgcgccagcagtgccgacgacgccgggccacactacgccgccgcgatgccccgacgccgccgcggcatgccaccgccgcgctgccacgccgccgccgcgccaagccgcagccgccccgccacgccgccgctccgctgccgccacgtgaacgaacgatcgatcgtgaatgaacgaaacgtacgtgaacgtgatcgaatgaacatatgtgaacgtgaaagtgaacgaacgaacgtacgtgaacgaacgaaacgtacgtgaatgagaaatcgaacgaacgtacgtgaacgtgaacacgaacgtgaacgaacgtgaacttaacgtgaacgtgaacgtgaacgaacgtgaaattaacgtgaacatgaacttaacgtgaacgaacgtgaacgtgaacgtgaacgtgaacataacgtacgttaacgtgaacgaacgaacgtacgttaatgtgaacgaacgaacgtacgtgataggcacatgaacttagcgtacgttaacgagaacgcgaacgattacgtgaacgatcgtgaacgaaacgtgaacttaacgagaacgcgaatgtgaaatacaatatatgttactttgtgtttatcctaatacatttttttatattgtcacgcccggaaattcactaataatttccgaactaatttgtgcataaaatcctagtccaggaatcagccgaggtacacaaactgacaatttaatatacaaatccatcataataataacgttacatacttacaaaagaaaagaaaaacagcagcggaattaacggtctagcgatggcttcagctccactcccacaggcagctcaactagggtataagccaaacgtcttctccttctggatcctttttcttcaactgaggttgattgattattgcaagaatgagcatatgacatactcaacaagccacacagcaaatatgcaagtgcacaaggataccaaaggatggcataatatagtctcatttgcgaaagcagcatttagcatagagcgcagcatttagcatagagttaagagtagtaaaacagtagagtaattaatcagaaattttaatcaacactgaacagcacacccatgctgcacaggcccaaccatcctgaacaaccatacccggctgtacagatctaactccaaaccagaagctaaacaaattattaccagttatagcatcaataattattgtgagaggtgtgagactaatcacgaaaaacattgctcaacccgcccataaccgcgggcacggctattcgaatagttttactctggccagaggtgtaccactgtacccacaagacacagccccacaacatgtcaccatgcgcctcaataccaccacggtacctcggaaaggagctgtgacagtacccctcgcacaacacaactcaaagcagtgcaccgttcctggatcataatcacccccttataaacaaggcatggactccccagcgacccccgtgggcttatctccgccacttctcagtctggtgctccgcaatgaaccatgctatacaaaatgtaaagccgttgcccacgctggcttgtggttggcacggttaatgtttcacaacagtagctcgcgaactggtccttaattgccatgagcacgaccttcaaaaccatgtgctcacaacccaccattaatcatattttaattaccaattaattatcataacacgattaaccatcgtgagctaccattaaatataactataaataataatgtaatatatatggttcatcccattagtgagctaatgtttctaaacatggctaagcaattatatctaacatctagtggaaccaatatatataaagctcaactagtcaaattataatatcccaaggtatcaaggaatagagtaatcaatgcaaacaggccataacaaaggaatagattcacaccacccagtgacattcgaaaataaatgcacagttgaaataaatagagaatttaaacataggatcaacatgctcaaaggattgtgtttaggatctgtgtgacttgccttgcaataatcggtgttcaattaatcttctgaacactcccgacgcactcacgaaccttcgcaacgacggaaacgacaagctaacatgcaaaacaaagaaaaagactaataaaaaccaaataaacaatacatataaagtaaaaaaacatgtagatcataattttagatgaattatgagacttgaacggcctcattctaacttcatatgaatttattatgaattttactagattaaatctaattaaagcccatttaaaaagaattaaataaatttaattcaatttatggataattttaatatgtagatctttattttacacaacttttgcaacttgaaccacattaaaccgagttacaatgaattagatatgaatttttaaagattaaaccggattaaagcatttatatggattttaattgaattatgacgcaataatgaattatttttgaaaaggaaaatgaggattattgcgtcatcaaaggcggtccacggtaaaccgggtgcacaggacggtctaaggaaacgaacgcccgagatcgattctatccaaaacgggcggccgagatcaaaacggtccacagcgggtctacggggacagcgacgatgacgtcagcgatgacgtcatcaccggcggcagcttggcaacgcatgctcgccggtgaacgatggcgcgacgacgcaaacagaggacaccaacgggtagagggcgacgcggcgaactcaccgagatcttggacgacgacaaacgacgacggatgacgacggcaacgaggttgaagcagcggcggtctttgggtcgacggtgacggcggtgctccggcgtgctacagtggcggcgaagcggtggacggggacggcgacgacctcgcgatcccgatggtggcgacggcgaccgacgacggcggctgcaacggcggcgcggcgcggctgaaccgacggcaacgacggcgacagctagggctacgcggaggcggcgctagacgcgacggcgggctaaggcaaaggtggcggcggatagaggaggtcccggggatgcttttatagtggctaggaggcggcaacggaggcccacggcgaccggcggcgagaaggaaagtctagggttagaggagagagatgaatccgaatccaactcaaatccaccggtttccaaagaaaattagccgatgtttccaaaagagaaaaggaagaggagatctcaaggatcatttgccctcaatcaatttgaccggaaaaagagaggggcgacggaatttggaagggcagcggcggtggctcgggcgcggccgggcagctcgaggaggacgacgaccccgacaggtaggtcccgcctgtcagcggctgagagagaggagggaggggcgcggtggactgggccggctgggccagatgcaagcagtccgaggagagggagaaagagagacttgggctgactttcggcccaaaaccaaaagaaagattttaaaacctttttctattaaaattattcatgaaatgatattctattgattaaaaatacttccttggctcaaataaatcccagaaaaatctaggaactatagaatcaagtaaagtatttaatgatttttttttctagcccacttttatattgagatttaacaaattaaaaaaaaattcgatcttctcttctaggcttttaagataatttctaataattccttttagacaacaatttataaattaaggatttttaaacaagaaaagcacttaacataattataattagatcattaattgattaactaattactgaactgttctttgtatcatttaggaattgagctctgaaaaatccgagaaaatttcagagagtgtaattaatcatggagaatttaataaaaattaaatccatccatgctttatatttaggaaattttatatcccacatttaacttcacttgtaaattaaagaacatttaatataaattctattaataatttattagataatttataaatcctaaaacgaaaattcaggctgtgacatatatgttgcagaaaagacgttgtcgttgtcgtccctcaagccggagtggtagttagctctcgaaggaattcgcgcaggcaagtgatgtaattaaatatatgattgttagatttttaatgcaattaagactattagatttaatatacgacacttagacttagcatatatgattatctagagttgtaatgtacgacacttagacgacttagcatatatgattacctagggtcctaatatacgacacttagacttagcatagttgactattagagttttaatacaagattatttgagttttaatataagattattagatttgtaattagacttagcatatatgactatttgagttttaatatgagattattagagttttaatacaagattatttgagttttaatataagattattagatttgtaattagacttagcatatatgattgtctagggttctaatatacgacagttagacttagcatatatgactttttgagttttaatataagattattagagttttaatacacgattatttgagttttaatataagattattagatttgtaattagacttaggatatatgattgtctagggttctaatatacgacaattagacttagcatatataactatttcttctatgaacagatggctgatcgtgatgaggaacagatactgtacgatacaatcgcggagggaagcagccagtactggaacgaagaagaggggaacgaggatccaaaccagaacttgaacgaggaagggaacgtggagagggatgcggaggggaaccaggaggggaacggggaggaggaggctagtggaagtcaaccctccgctggacagaagagggcacgcgggcaacgaggtgccgcgaagaagctagagggttggcacatcataacggaagtggacgaagacggccgacctagtgctccggcagaagcagccaagaactacgttcgacacaacggttgggttgtgtgggataacgtgcctgtcagtactggcgcagaacaagggcacgcggagataatgagagctttgtcccagattcagagaaagagatgctgtggaccacaatgctcgagatattcaccttttccgcgggtacagagaacaaagtgaaaaggtggactttaaagaaaatggcagaacagtttcagagcttcaagggagatttgtaccacaaatatatcctgaaggggcagacactgaactttgacacattcccaaagctaagggatcactgggacgagttcgttgcataaaagacaggtcaacaagggcaggcgatgatggaaagaaacaaagaaaatgccgccaagaagaagtaccatcactacttggggtcaggcgactatagcatcgcgctgccgaagtgggaggagatggagcaagcttgcttaagaggggtatcgaaccggccaccgctaaatggccggatcgatcgaagttctggtactatgctcatggtggaacgctaaacccagttgatggctccctggtcttcagcgatcagatacgcgaggctgtgcgtcgactaacggacgcagtggaagcctcttctcagggcacgttccgacccgacagagagaaggacgagctgtcactcgccctgcagactccagagcatccaggacgaacacgagggaaaggggtgattccttggaagactggattcaaggaggacatccacacgtacaggagtcggatgaggagcaagagagataccgaggcgaagattgcagatcttgagtacagggtatcgagctacgagctcagcatgcaagaggaggtggcaaggaaggttgatgaacgcatggccgcacatcggtcccatgatccctagccgaccattccccctgcaatggtgagcccttcaggcaatcgtagcagctgcgcctcaacggggcaggtaggatcacagagcatggacgcctgtcaagcctgagcagctgcagtccctacccacacaaatgtacaaattccatcaactgtacatggagatgagcgccaccggtagagagatgatcggagcgaggatcagggacatagacttcttgcaaggagatgatattctctggatcaatttcaagggtgtctatgaactataccagctggacgccctcgacgtctctattatgagttgctggattttgtaattatcgttcagttagatttcttattacgtttcctttaattaattaggtccttgtatataagtagactatatataatatatacttccttttatcgttgtagaatggagattcaaagggcccgacggcggggggttttcgatactggattcatcgaccctcagaaagtaaacgtcgcaatgctcgaccagtatccgcaagccacagaggacaatctcgtccatctcctgaaggcgcagcattacaagacgttcatactattgccgtacaacacagagttagtttttactgtcttcctataccaaatttcatccccgtactaacatactaagtgtttcatatgtaatgcatccgacgcacattgcagattccactgggtccttttactcttcgacttggaggcctgcaccgtcaatgtatatggctcaatggataaaaaagagtctacgtttgacaaggttttcgaacttatagacaggtactgtcaaaatttcctatgttaattaagaatcttgttataattaattgctagtatgaatcatagctttaaactccatctagggcttggtatcggttccgtcatttggtccgcggcaaatggagagaaagacttaggcagaagtttaattttccagtgagtacacatgctctacatttatattgaatctccaattcaaatacatataagtgtatattaattagatctctcgccgtttgtcatttatttatagtgcgcaaagcaaaagcagggaactaacttatgcggctactatgtgtgcgagtattgccactgccttgcagaccaaatcatcaccacaagagagctcgatgtacgtacaaataaattcaaaatttcattgcgtatgtatcgatttgttgtttaattactaattaatttcatacattcatatagtttattcgcatgagggataacctgatcacacacaagaaatttatcgtggcggttcaagaacaactcatgggattcatcaatgaacaaatccttgatcccaagggtgaattctactacgacgaaaatacaattcataggttcttagcttctaagataacgactactactacgtcgaaatcgtagctagctaggacatcataatggattgtaattaatacatatctatttttctatatacatgtacacattttctttaatgtaaatatatattttagtcatatatatatatatatatatatatatatatatatatatatatatatatatatatatatatgcacataaaatattaagtgctttcatatatatatatatatatatatgaaaataattctatacacccaggtgtacgtactcctgctctcatccaccgtccatcagcggacatcaccgatcgaacctgctaacgaatccacatacagacccattaaagtttttgcggacgaaaaaaaatcctcataatacttttatcccgcattaaccgtaaccataccaagatgctagcataaatatctctttctgacttactgctaaaccggactgcaaataatagatcggtcaatttggaggcgacgcgctgacgccgacgtgatccatcgaatcatacggccacggcggcaatgcagttcgtccacctgcgggtggcttgatcaattcccaggtgattgattctggtatgtccaccctgttttctctttttcttctagatccatcgaggattttcggcagggtgatctgttggcaactcggcatcgacggcgacgattcgatcgacatccagtccacggccacgtcatgacgactagatcggtgtctacagtgcagcccatcggcaagccggaggcgatgacgacacaatccatcggctcgctgaaatcatacaaccatggcaacaagcagcgctggagacacccctacaccactagcttttacagcatcggcaacggcgagccccctccaactgatgatcatcatccaacgagactaccaggatttgcctggtagaaacaggcgcttccggcgccatcgtcatccatcgcgccgcttcccggccagcgtccaggacacgacggcatcgatccatcggctggcatacaggccgtgctgcccgtgcagcagtaattccggtcaggtgattgtgtcgatcataattgatgcatcagattttatttgatttcacatgcatcaacaaacgcaggggccgcgggccgtggcaacgatcgatgccaactgctgtgaccagatcgatctcgtcacaatgtgctggatggtggcgtgctagaacaatatgctggatggcggcatgctctgtatatactgtagttatatggagtggtaaatactgtatttttctttggaggggtatgtactgatcactttgttagactagtatacagtgcattttccataaatatgctgaacttttcaatagaggagtatatgctgatttttggactttgtatgtactgcatttttctatggagtgctatatgctgaatttttctatggtcaagtatatactgaactttgttacacaaaagtatatactgaattttccatagatatgctggactttttcaatatagtgcttttttacaccaaaaaagtagtaacatactgaaaaaaaagagagaaaagaatagtacgtattcccaaaaaaaggaacagtatatactccttcaacaaaaaattcagtacacactacaaatttagataagtggtttatactataaatctataaatctaaaacaagtgatttatacttgttctctagaaacactggtatatactactagtcgctgtctctctgatccctactaactgatatgtcagcgaggatgcctactaactgatatgtcagcgaggatgcagagattaaggctttctatctcgtattacatgtattgatgagtcaaatattttcttactgatgctgatataatattttaatattttcttgtagaacggtcgccatttggaatgaggaaattcaaacaaattactccacgtatcttaagccgcaaaagaccaaaagcagagagctacaaacttcaatgacaaacgtagtatatactggccaaaggagcagtatactccttcaacgaaataatgtgtatatactcatttaacgagaaatgtagtatatactgactaaacaaagagatcttcaatgaggaatgcaatatatactgactctttacatacggaaaaaaagatagaacagtatatgctcattaaacaaatctagaacaagtggcagatactaatagactctaaagataacggtatatactaatagtcttaaattaagtagtatatacttctcaaaccagcttttagtatatactggatcatcaaataaaaattatataatcttccaaacagagatatagtatatactggttcctaaaaaataagtatatacctaatctaaaataaaacagaatataagtcatgaatttccatgctacagctaggtgcacaaatactacatttcaaattcgtagatacaggcgtgcaaccaataccatgccgacatgcatggatatttttcaacttaattttttttaacttggcttattccctgttcggctgaaaatcaggaatttcaaaaaaaaattcccaccagctaagcaggtcctaattggatcctattagatccaatatggaagagagagtatgtacacctgggagtacataagagtggtcctcttatatatatatatatatatatatatatatatatatatatatatatatatatatatatatatatatatatatatatatatatatatatagagagagagagagatacacatatatgcatttgcataacatatatatgtataaatacatatatattatgcatgtatatgtattgaaacatatataaatataatatatatatatattatgcatatatatgtattgaaactatatgcatggtttatatacagcaacagggccatgcaaaaaaaaaaaggtcagttcgatctttagtcccggttatttcacctgggactaaagatagtgatctttagtcccggattggtagtcccgtttgaaaaccgggactaaagggggttacgaaccgagactacaaacgctttctccaccagtgctatgacgaatattaatttataactcgatgaaattaatttatttgaaatacttttggctttatgttacatattgcaaaaccaaaagtctgttggcaaaagtattgtgcccctaaacatgaagtgttggcaaaaggtaaatttatctgttggcaaagatagctatcatagccttcagggtatgtgttggcaaatgttaaaactgtcaacaaacttttgccagctgctgcaacgccgactatggtgaaaattgtcggcaaaggatttgccgacagttgtgtagttgctgaatatgccttttgccaacataatcgtgtgttggcgaaagtggaccatggtgtagtgcaattgtagtcttaattccacgcaatacaaacctcggcatgtacgcctttttatcatgcctccacgccgaccttcacacacaattcttgcaacgtgacacttttgtctgatacctattattctcttataggtgatgctaaaagtgcacctacaaccctttgctactacgcatgttggctagctgggcccacctagatataccatgtcaacatagcatgggtctcgcctagctatgcacccttactgcgtgtatccgtctatcttggtgataacttttatttttgtgttttttttcaaatcacattgatggcaatatattgttgcgtgcactaccatgatatgtaggcatcatcatgtctttcataaatacctcagctatatctggagacatcattgtaggtgcgtaattaaaaggatggtaaattttcaccgaaacattacaatgtgccacatcaagattggtgatttagtatgctgcatcggccttgttaaattgtattttgggaaattttttaatatacatggccacatatagcatgatttcattatgcagcttctttggtgtgtccgtatttaaacttcctacgagctaaatggggctacctccatttcttcaggacaaaaaaaaaaaaatttcatctccagcaatgtacactatatctacgtctagtttaactctgcacaaattcaaacataaatatttctaatgtatagagactagagtgcaaccatatcaaatttgaaatttcgaacaacacaattcaaataaatttaaaatttccagacgtaaaaatgccatcctacaagcaaagcaaatgttcaagactccgcatagctgcagctacattaatctgcaatttctatcgagtatgcaccgatgtttttctatcgagtatgcacagatgttttagtattgtagctgatgccgatgaagattgaaatcaaccaaggcgactcagacatacaaaaggtactcctttttatcaaggaaaaataacaatcacttgactagaactagcagtgaaaataatgtttacacccaaatttgacacctaggttccaaatagaaaaacattaccaaaatttgaaaggcgtcggtttccttcacagagccggtctgaccaccgtacgtatatgggccggtttgaccaacgtgatgagccggtctaaccagcgaagtgtagctggtcgaccgatagagttcgattcagagatgtttttgtcggatatcggatttccttacttgagagggcatgttttgggtttccattagtttctatcccaagtttgacatagaggagaacatgtaggagggaagaccagcccctgtatatgggacaaggccggttcaattgaaacaacaatctaatctcaatccaatttaaccaattgaatcgctttttttcaatattgcatctactttttacctagttctagcctagttcgtccatctttgttgatttgtgccgtaaatcgtccgcatccgcctccatcaatttatcaagtgattttaatgtgggaaataaaatttcttttagaaatcataactgggaatatttttttaatattctcctactctttggaatttctcctgaatttttagagctcactaattaattttaataacacaaagttcatttcatcaattaattaaaaatggaaaaataaattaaaatccccctctctgtcctgggctgtttccagcccaagtttatttcccttccttcctccccacgggccgaagccctctctccctcctccctgctggagatgttgggcccactccttccgacggcccacacatgccccctacttcctgcgaggtctatttcgctccctctctgactaactggtggcaccaggacccacctgccattttcttctccaacctcaggtcgggagaaccggctacgcccccatgtcagcgcacacatctagcgcgcctccctgttcccgccctcgcatctcgaaccacaccaatgcaatcgccgcacgccttcccccactccccgtggacgtccggctcctcctatccgcctcgtcccggccttagagctgcttcctcgagctatatagagcttcactatcgtcccatctccaatttcccgctattggagttgccgcctccaccattagctccgccaccgcaagaggcaactcggcctccgctccgccttaccgaacaccgccgaagcgccacctcctcctgcaacccgaagccaccgccgctttctcctcctttggtcggcactcgctgctgctccagcctccaggccacctccggcattgtgtccttcctcactggcttcgcagtggcgataggaaaccgggcaccctattcctcgaagctcctcgtcaccggaatccctttgacaccacgtcggatgagttcacccattcttcctggcctctcgccatcccttctcaccaagtccgcccagcccattctccattgttccccagggaccgatgcaccgcggctgcccctctgtctacgccgggagccccgaatcttcgtcctcaccgctaccacaagcggagtagccgccatctccccgtcgccgagccccgcgcaccgcagccttccttgtttgggtgctcggtgaggccccttcccttttccccgtcccttccgccgcctcttatgccgccgccgtgtcgagtggtcgcctgtggtgaccatcaggctggcgctagctgccaatctgttgtgcctgcgcatgcctgtggtcgccctaaccatcgacgtggcgggcccgcatggcagtcccatggaccaccttgtggtctcagtacacggtggatcaactccgtttgagctgctgattcgtggggcccactttttgtggactcggtccacgcccgtcctctgctcacgcaataatccttcttgttttactttagagaaataaataataattacacgataaatggagtttaattctataaacacatttaaatggctcaagacttctaaaattcatatctaattcatacgaactccaagttgggccattcaacttgcaaaattcttttaaaattgagctatacatgtttgtttactttccatgtattgtttacttggttttattagtgtgtttccctgttttgcatgccaacatgaagaagcaaggcaagtcatgcgttccactttgagcataatgagcctactttataaaaggttttatcttttgcaaaaaatatatattttgctaattacatggggtatggattgcttgcttgtgaccatatttactggatattcattccttgataacttggatgataatttaactcgcttgtgtcacttgtcttgacctagctagaattatgttatgcttagccatgcttaattactactgggataatcacattctttacatctagtatattgacgagctgtgagctcaacacacttggccatgtttcattggttgtagttcttcaactaaaatatggtttaatggtgggatgtgggtgcatggtttttattatcacaccatggcaattaaagaccggttcatgggaaatccttgaaagacttgtcgtgcttaccacaagctagtgtgggcaactacaagtccactactggacttgtagtatatcttttccttttctaatgtacctaggtgaacatgggctgatggagtttggttatccccggttttaaggggtaagtagttgttggattcattgtggcacagagggtaggggtggcaacggggcagggtggggccgggttgggttggaatgcccccgcccttgccctcatgcgggtatccccgtccccagccccgcaaaggaagtcgggtgaaaaacatcacccgtccccgcccccacaagggacctagcgggtgaccgcgacccggcgttacccggatggagctaatacattataaaatattgcaatacactgaataatattatgataaaatttcaatagctcccggttgtgtgggttgtttgaagaaaggaaaggtattatggttgaggggaactagggtgttgagcttttttgtcaattttgaatgggtttgttggatctatattattgcaatgagctactttaagagaagtacctcacatctggggcccctccggatcacccgtgggttaattccgatccctgcccccatccccggaagtttgtggggccccgtccccactcacctgtgggtcagaattctcccctgcccccgtccccgtaggggcgggcccccgccggatccccggccccaacggggaaattgccacccctaatagaggggcttcccaccttgtttttaggggtggaggcaaaacctgcagtgtggtgcgcttgattagggggagttatgcgaagggttctatcacgatttctggctttgcggtaccatggtagtacctcatggcatggcaatatggtgcaatatggcggagcctgtctagatttatattactagtaaatgtcacatccgtccgaaatcccttatatattgggacggagtgagtatctagcatatgattttttttacagaggagtttaataacattaatttaggaattaaaatatcaacaagtacaaataatttatcaaagtgataaggcctgagctagacaagagattacaaaataacaacacaatacaatgcaaaatgatctggcaattggaatcactagcatgcacatctactaaaatttggcctttgacgcattctcaagattagaagggcaattggtgctatagatggccatatggcccgagcccgcggcccgcccaaggcacaggcaatttggcccggcccaaacacggcacagcccgactgggtcatgcttatgccggccgggcccgatagccatgacgtgcctaggttgcttcctcggcacggtgggccggcacggctcgacacgaccaaagaaaaatagttgagggacctattgtagacttaattcagccatttgagatacaacccaaagacatgaggtatacaacatagacttattccagcaatataagacacatcccaaagagatgagggagcaaaaatagacttattccagccatataagacacatcccagagagatgagggagtaaaaatagacttatttaatagagaagcacgacaggctatcgtgccttcgggccggcatggcacggcccgagtgctagtgggccgtgcctgggcctgacgtgcagcccgtgggctggcacggcatggcacggcacgaagtaccaatcatgccatgccgacgcaacttcccttggcactagcccaaccgtgcttggcccgtgccattcgggcggcccatttgggcatctatagctggtgctgtactgtcccttctggttgcaaaataaacacatctattgtttttgcaatgcctcttcaaccggattactcttgctcgtccacgatttgccctgagagatcaggtggaagagcatcatcgtgatcctcaacatggtcctgcagcacccctgcatctgcatcctcaatatacggaactgcaggcatcctgatgttctctatgcatgtgcactcatgatggaaaacattatcctgcaaatacatggcaactattatttattgcctgctgcaataacatcttctcatatatactatctataacgcggaggccatgaacctcgctgacgaccattggcgtaacagttcggcgatgaaccttgacgatgaccagtggtgtaacggtgttgcgacgaagcttgtggaaaaaaaaccatcagctggttcttatatacataaaaatggaaagtgcaaaagcatttacatagaaataaatcaattccacatttccacataattaaccagcttgactttctgtgcgatcaaagatggaaaactcaatcacattcttttcaaagtgatcctataaggaaatgatgtgtaatttaaaaatggattggtgaaaaacaaccagatctgaattatttcttgtcatgtatagcccgttaatttgatgtgacatctagttttacctagcactaattccaaagcagaatgatgatggatgatgttgaagcccaggcgtgattagaaacaacccattaatcaagagcttgacactgtgataccacaaaaaagtatagaccgccctagaaacttattttggatgtttctatgtgtttcttcttgaaataataagaggaaaacttaaaattagcgtgggagggctaggtgggtcggttaaggggttagcccaaggcccaaccaactcacctttctccccaaaaccctagggagggcgtgctccatccacttggccgccttttgcccccaccatctccccctggtcaatctctctcctacccccatcccatcttgttgtctctgcatctaaaaaagaggagaaatcgaggattagggagaagggaagaagcgaggagaagggggaaagagaggggcttcaacaaggggacatatgtaaggtttttctcctgtcttggttgtgttctagggagtagtttagattaggtgttataggtgataaagttggatattaaccgagttttccctcggactagggttgttcttgtatggtagtatgttgttcgatcatatatatctctaagttgatacttctgcgagttttctttgttttaaaggagatgctactgaaatttcttttttctttttttggcatggttgtttggatgtttagtggcatctcaggattgttgtgattcctggggtgttacaggcacaaattccctctacccaagatcccttccccagtgatgccgaagccgaaccaccatgcttctgccacctccgcctctactgcaagcggcaacccgatggactccactgtgtcctaccagggtgggttaggacacaagagtaaaaccaagatcaagaaaggcaaggagaagggctcatctacagtacccgcagtgtacgatgtcaacgccgacatcgaagaggagtaccgcttattcttagagaacgtgcgtgtccacgagaatgaggactttgtactggagtatgacggcaaggtgattaggtatgggggagaagagatggatgacgatgatagttgtatagaggtttcgatgaaggagaaggaggaggtgttgaaggctttggtgatctcttcggacgatgagtctccgacgagtctacgaagagtctatgagaacgattcctctcggcaaaaggttactatattgtttcagtacttgccatcttttgtttctttgtttgttt

SEQ ID NO: 31640 - DNA, 1210 bp, Oryza sativa
cctaggtggaaatggtggtggatgaccaggagaagatgaatgagaagaatgaggttgcccttcgtcttaaagggaaaggtggtcccatagaggatgttgaaaaggtcagttctcatgggcctgttatcggtgcctagtatcgtggttatatcaaatctgctttgtagttaagtcctttcaacttgtctcaagggtgtaaatgtctaggattcctgtatggtgcaaatactctataggcgcacgcttagagcccatcaagcccatcatcctgggaggtagaggagtctgatttctcttctcgttccttggttcactcgtcccatcatcttttgtttgttctagatcaacaggattggcagagcctcttgccttcacccatcgatctgtgcatgtgtccgaccataacccttgtccccatcaccgtctccattcctagctgccctccatctcctatctccctctccatccctagctgaactcctctggctatgttgcatccccatgtcctagcttctcaaacctagccaccaggggtagtgatatgcccgcaagccacccccactgccacatgccgcataggagcagtagctggcaccaacgatgtggtcgtagctgcggccgtgatcgagaagacgttgacctttaggaagaaaatgagggattttgagtatgacatgaaagtttttggatttttcatttgaaaactttgtggtttttgaatggaagtttttatttgaattgaaagtttttgcaatttttccgatgaaagattcatatacgaatgaaagttttatgatttttagataaatgttttcatatgtttcaaatgaaagttttgtgatttttgagatggaagtttgaggcaaatcgaaagttttgaatacatggcgatccttgagtcaaaggctggctccttggtgctagcacaagatgcctcatgaaagaaaaatcaaaaccatcactgtgagcacgaccttgtgcgacttgcatcgttagcacaaatgcgctatctagaaacccccgtatatgtcttctacaaggtgattgaaaataatacttgactttgatagtgtcagggtaatgtataaggtataccttcataaacgaaggtttatggtaatatacagataccatataagggaaggtgactttgtaataaaggaaattatctccccgaatagaaagtgtcagagtccaacttagaggggca

SEQ ID NO: 31641 - DNA, 5825 bp, Oryza sativa
cctcctatatgaaaatttatggaaatatatggataccatatacctatgcgtgtacggaaaggtaattttgtaaaaaaataaatatggtggtatgaaaggaaattatctccctggtagaaggtgtcagagtctaactcggaggggacaaggtctccttatcccgggttcaattgtggtaccccgaggtctactcgaagaagggggcagagcactataaatagaaggacccctagatcaaggaggaatagaccaagacaaaccgtagccactagctagccaaatcaagatacatctagaggaaatcggagccatattcgtcgactagatctagccaagtcattcttggcggattagcgtagttgatctaattccagattaatctttctggtattctaaatataatcccatataaattggattagggctattaccttacgaggggcctaagcaagtataaatccttgtcttcattttgcggtctaacccatcgacaaatagttctaaataaatagaaacacattcgctatcgtcatctactttcagcatgcataataaattatggctcatgcaattttttcttacattcccatgcacttccttgtaagcaatattgccatcgttctcctttctacaaccatcccaatgccaactagcccctttgaccgctcgtaggacctccttaatgacatgcggcagaatttgaattgtagttacacttattggacaacattattatcagaatactagactattatctagattcttaatactaggttatgtccaatctagtactagattgctatattttgggataggggaagtaattgtgactatatagtgagaacggggttgatgcactagtgcttgaatgaaccataaagtattatcatgtatatttatgtagcattcttattaattttgcatgcaatccatctctttttgcactatgttccttgttgcgtcgaatctatatcaaatgacatagtttttttttccttgtgtttgtttgattatatgaatattttgtgtttctcccatttctttttttgataaatgtttcttccatttgtagtttttttcctgtgtgtgtttaattatatgaatattttgtgtgtctcccatttatttttctgatatatgtttctcccatttctagttcatcttgtcttagattttgtttatttttcataatcttgaaaaatgtggtccttttaatatcactatatcatagttactagatgttataatgtagtttcttttgttgtgacacatttatcttgttattgtagcagtcacatggtattatatggcctacacatataaatgataggaaagaatctaatttcaagataggattggttgaagctctcagcaaaccattttgccagggagagtatgataggctttatggcatggctagtactcgtgagccattaaaaaaggaacgccggacacgcagtggttcaaagacttactactcttctcattcgatggggaaatcatattttgattgctacccaggtatgcgcaaatgtactacctccgttcacaaaaggatgatgtcctagaatgagtttagtcaaaccgcgacatgttaaatcattagtagatgaaataatatcaatgtttaaatgtgaaacttatattattagatttgacaagaacaaactctcatatagttatgtctctactactttatatagaactgtagtttgagaatgtaatgataaaacatgtgcattgtaggtaatgtcattgtccaagttggcatccttcttgaatgtaatgtttaaattaatgaaatttgggagcatttgaaaaatattattgttttttctcacttttcttatttgcatgctttctttgactctagatctcgcggaacaagttgaagaaactagctatcccaatcgcttggcgctattgcgcgggcttttctactggttggaggtaacctcgtactattattgtgattgttagtaagtgttgtgttcaaaaaattaagtgtgcagtatcttgttgctaatgatcatacttctatcttctagtaatgactaacatatttcgagtttacttgtacacacttctcccaatgagaacagtttaattgttttggacttaacataaatattttctattgtttgctacacaatttgtctagacctatgcatgttgtatgttgaccacatgtttgttatacttttttgcttttacagtattagtactagcattgagttcataccatgatgtgtgcatagtagcactattttatttctttgtacatttactcttcttggcaggttttcttgatcgtgtattttcttttgcagaatgttgggaaaaaacaccaattcatgccatggagaaatgagcacaaacgtttcaaatatgttaatttattatgagaccatattaccttgttgccacctccatatcagagtgggaagctatggaatccaacgagttgtgggtcgtgaacctagcgccagttgcttgcgcataccagttttcttttgtatttttatcttgtttgattggagttatgtaaactttggattggttacatacttacttttcccaaatgttttggttgcgatttgtggagataatttcacaagttctgatctccctaaaataccgagcccattttaaaaagtgttaaattatcaaatctcttcccaagaatactagcaacattacttcagccactaggcgggcctgctcggcccattcaggtttgactctaacctagcccagtagtacacctccacgcgatttcgccaccgcggccgcggcggcgcatcggcgtcgtgatcccgcgcggcgcggcctccccaccgccctagcgcagccgcagccttagccgccgccgcgccatctccgtcggcatttgcaaggtcagagacctcccgcaccgctccctcctgatctccaatctacgagtcaaccatttgatcgatttttcttgatctgttgcgtgcttcgatttcatggccagttgtttgctcggctttattcggtagtgaaacctttgaattttccccaacccaaagtacttcgatttggtgagcaactgacatctcctgttcagacttcagaagcggttgcatgatgattcagttagcttggacccgctcgtatagtgttatacattaaaaaataaattgtattgtgtattctatttttagagaaagaaagaataaactatgtagaagctacaattctacttcaaatagagccgtgcaataatattgcacagaaaaattcaagctatttatcaacaataacaaatgtctgtatgccagaccagacaagttctgtgacgcatctaaatagatgctgactttgaaccctgcccaaaaattttcgttggcattagataccttataacgaaattattcgtctgaaaatgaatggaggttgcaattagtatcattttataagggagcgtgtgtataaaactggaattccctagcttatacaactgtggttcagtgattgcttctttaggacatcccattcccagcagccaaggatcactgatcatgcaaaaaggaatttcctctatttgactgaatcactcacgaatcattgctatggaattctgaaaatgttcaaatgaatatattgtctctagctctgaaagaaagatttgttttggcaccataaacaacccttattgacctgtacttataaccagcttgagattacatcattattagagtaaatatttacaacctcgcaagataccggaagaacctgctgttatcatatatgctacagaaagaaaaaacacaaccaagcacaatctacagcctgattgcacaaagaggaatttgattaataatggaatgacttaacatggtgatggactaagtaaggttcttcttcgaaaggttgtacacactacaagattttgacaaatgaaggggcgtcgtcccttggtcctgcaagagatcgatataaatacagatggtcaacattatcggcagtcacatcttcattaccagaatggccactaatcacttcagccaccaaatttggcatttgctgagctacgtatctacagcctgtcatggttactctgcaagagctcatccacaagaatctcatattccaaaagtggcttaaaccagagagcaatccctcgtcaccaaaaggacattccctgacctcaagcttctgcaaccgagtgcatccttcaaacacatatctgagtgacatgtcagtattgccagagaaggcaacagacagagttttgatcgatttcccatattgcccaatgtacgcgaaggccttgtccgtgaccagaccagaggtcgaaagcctggaaagcttcttgcaattcatcacaattgctccaaaaccttcatccattggctccccggtgatccgatcagggagataagttttcaaaatgctgaggcgaaagacctcaagattagggcagttgctggacataatgaccattgctgcatttgtcatgcttccacaatagtatgttagggttttaagcttttggcagcctttcgagatagtttcaagcccaacatctgatactgagagatgatgctcactcccacgaagcaaacgatacactcgtaaatcctggagatctaagcacgtctcagcgatggcagaaaggccatcatcacctatggagtcgcgcacacagaatgtccggagattgccacaggagcgaatgatgggagcaagctgttgccctgttaaggtggcagagctgatgttgagggatgtgagattggcacaaaccgggtagatcgcagggaggtaatctggattggcgtcctggagacctgagagagagtggagtgacctgcatgctgcgaagtatgtcgcaagttcagacaccgatggaggggcctcacctgcagggtagccagtcttggaccggaacacacccgtgccaaggtgcgttagattgggagcgattgccatgaggcagcacagctgctctaccgtcacatggcgattcacacccagctggcacagacctggtgagcgcgcgacaagggcctccagtgactcaaagttgcagggcgtgtcaacacagctgaacagaagagactccagcgacgtgctgggcttgggaaacatagagatccagtccacctgcttgtccactgtgtcctcgactttatcattaatcagatcaagcacatggagatgcctgcactgctccgcaattatggcgaggccggtggcactgaacttgtcgcagctcatcagtgagagctcccttaactgagggaatgactgcgcgatgagcctgaggtcattgtctgataccgtcatccgcttgaggaagatgcacttaaggtgcgggtatgcgggacccaaagcagccacccagggcgatgcgtatgcaccccagcctttgggcactaaagtggagtctgcgaagcatggcctgcccttcagagtgatggagcgcaggccacgaaaacgctcaatgacacgattcggagaaacagcataacagtttctgatgaagagctcttgccgtgtctccgcctcagcatggtaccagtagcgacagactagcgatgccatgttcctatcacgtgccgttgtgaggaactggagaatgctttccagcagtacattctcaagcacatggttgggctgcggacacctccccacaccgtcactatgccactcaccgtctcccaacatcgaccttccaatcccatagttggagttgcatgttcttcgtcttcatcgccgtaaaaaaccccatccaccaactgaaaattgattctagggttgcctggatgattgctaatagcagatgttaatggaaa

SEQ ID NO: 31642 - DNA, 419 bp, Oryza sativa
gcacaactacaaactgcacaaagtcagggaatcctcattcgtatagggtttattgttgtttttggaaaaagtacgaattaccctcccctgaactgtcgcggtcgtctgaattaccccctgaaccacaaaaccggacattcttcaccccgaacaatgtaaaccggacgaattacctccctcgatccaatccgcggtggttttggtctacgtggcagtccagtcagcaatttatttattaaaaaatatgtgggccccacctatcagtttctctctcctatctctcactctctctcttctcctttagacggcggcggcggaggcaggagcgcggcgagacggcagcggcggcggcgggggcaaaggatgcgaggcggtggcggcatcatgatgctccaacccatcggcccccgcatggcgac

SEQ ID NO: 31643 - DNA, 3226 bp, Oryza sativa
  unsure (1)..(3226): unsure at all n locations
ttataattctgctccgctgagtacactctggaaaagcttgatttagaatatcccacacagaagcagccgataaattgtcaatgataattaaatacctgccaataatatatgcatattaaatacattttgctaggctactattaaaattgatcagaagggagctaaactaaaataaactagctgggtggcccgcataattgtgtggctagcaccatataaaatcggagtaaactcttttacacataattttcttaaactttttaaatagtctataatcatctcattgtcctaggatttttaaaaaatcaaaccttttcgccattagttctcaattttataattgttaaaagtcacaccatttgtccttgcttgctactttgtcgccctttatttgcgacatgcaatgtttctattcattcctcatgggatctttaaaaatcagaccttatatttagtttatagaagtttcgtcaaatgccacccatcaccctcctatttattgtcattgggttttaaaaatcaaatatgatccttgccggtgttctcttttttactttgtagaagcatgtgaaccgtcacgaccctactcctgcatagcctagttcttgtccaccctcttaatcattgttgagattctaatagttgaagcaatcgtcaatagttctgtttcatagtttcaggagttttatcaatcaccagcacactactcctttactgttcgcccgctacctttccaattattatatgtaattcttgtattctagatggattgttcttacaacattcctaatatttcttatttttagttcgaattttggttgtttttctttttctaattcccaaattattttattttttattctaaattttaattaaacttgtatcgtgttttgcactaactgttcttttaatattccttctttttattctaaattttgcttatttctaaattatattctgatttgaactattatttttattttctaaattctgaatttatttcatattttattctatttttgttcttccaatttcataatttatttcatatttattctaaattttaattaatctcgtcttgtgttctctactttccatattccttttattatttttattccaaattttagttatttctaaattgtattcctacttgaacccttatttttctatttctatttcagaatttattttatttcgtatttcgaattttaatggatcttgtattgcgtcctaggaggactcttatttcaatatttctcttttttattatgaattttagtttatttctaaattataattcaacatgaactctgttgtgaatagactcttattacaatatttcttatttttttattcttattatattttattttattcctaaattgtaatcatatgtgaactcttttttttttcttttccaatttctgcaattagtctatttattattttaattaatctcttactatgttcttgatggactcttctttcaatatttttattttttatttcgaattttagtttatttctaaattatattcctagttctaccctctttcttctttttctctgattaatgtgtgatttttattatatatttcagtttatttctaaattgtaatcctacgtgaactgtcttatttccttttccaatttctgaacttttttattttgaattttaattaaactcataccgtgtcctagatagactttctctcaacattttattccaaatttcagtttatttctaaattgtattccttcccgcgtagttttgcgtgaagctagataattcatgtagtgtaagatttaatatatagatctgaaattttatttttataaaaaaatcattatatatagaagtatatttagatttcatatacaactcttaggtcctatttctataaggtatggatttcacatataaattttagattctattctatagtcttagatttcatatacaacacttaacttctattataactgtattttatatacaaatatatcaatcaatctatgctgttataatctggacccaccatgatctaatggtaaaatgtttttctttttttatgattaatgtgggaatttctagtctctacaatgaacgtagtgccttctttcaagcttgttttaatgatataatagattttaaggaacaagttttactggaagaaggataataaacatgttctaacttgtgagtaaaagaatgtgcaactagaatgttgttgactatcaataaatgtaatagcaggtagtatttttgtgtgcctaaattgtatgatccaatattcacttctatggtgtttcagtcaaaaatgcctataacacctacatcaagtttgtgaaatataatgagagcagactagcttactgagtgaccagaagatctgctgtaccttgtgtgtaagttctaatattaacttctgagcaagcttttatttaattttggacataagaaataatatttatttcagaaaatagcagcaccttttatcttgtagatgtctcctgatattatcaataagttcaagctccttacaatcttcgtgggggttattttgctggacctgggagattatgtcgcagaagagccttttcatattaggcttttggggaacctggatgaaagctctacagtcgaatcgtccaccaaatttgttgtagaaaagcttggcaagtgtagttttaccaataccaccacatccgacaatagataccatcttgagctttggatccccatcattggccagccatttgataaacttgctcgtccgcccatcaatgactaggtcagcagtttgttcatagggtgttgatagaacatagctaacggacgcatatctttgtctataggtgcaactgtggagatcgtaccgttcgtaccgttctattgcctcttggacataaatcctgaattccgatatcatgcttccgatctgttggtgccacttgagtcttctaggaacaccactaatcttcagatggttgatcctgcagacaaatctggtcttggtatttagatggacatgccctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 31644 - DNA, 2502 bp, Oryza sativa
acttgcctcttgacttctgctaattcattggctgccattctatacggtctcttatggatcggagttgttcctggtaccaaatctattctaaactctatatcccttttaggcggcataccaggtaaatcatctgggaacacatcaagatactcccggactataggaatctcttccaaagttatttggttcagtcttgaccttaaagattcagaagacaatgcatgaatagttacaactcgaccatcattgctggtgagagttacttttctgttggcacagtctatcacacccttatacctggctaaccagtccatccctaggatgacatcaaggtctttggattctaacaggataagattggccagaaatggtacgccttgaatttctattctgacagaggggctacgttgcaaagagagtgcttgattgcttggggtactaaccatcaaaagacgtctaagatcttctacttccataccatgatttcccgcaaaactcatagataagaatgaatgtgtagcaccagaagcaaaaagcactgttgcaggaactaagttaacaagaaacttacacaaaatcacatctggagcatcttgagcttctgcagcagcaacatgattgacacgggcctttgatgctggtgtggtagagttgctctggacagggacaaccttcacgcgtcggggcttcggacacttgtcagcgtaatgtcctgggtctccacagttgaagcataccacgggcttgctgccttgctccctcttggcaggttgttgctgtgtcgaggctgcaacaggacgtggagcttgattacggatgttgttgcccgcgttgttgttgaagaactgacgctgcggacgaacaacagacgaagaacctccctgtggcctggactggggtcctaaagtaagacgcggcctctgactattcccctgttgtgccttgaagtgagcaatccggcgtttcttctgctccatgcgattgtacttgtcctcctggcgaatagtcttatccactaacttctggaaatcaggataatccccagtcatgagtgggtaagaaagctcatcattaagtccttccaagaacttctcctggcgctcttcatcagtgcgtacatcttccggagtataacgagccagacgattgaactcgtgcagatactcggtaacagagcgagacccctgagtgagcgacctgaattccttcttcttgagagacactactcccgatggtatatgcgtcttccggaaagcagcggtgaactcaagccaagtgataggttcagcagtagtcctattcagacggaagtgatcccaccattcagaggcagggccatgcaactgatgtgatgcaaatgagaccttctcctgatcggtgcactgaagcaaatccaacttcttttctatggcatgcagccaatcaccagcttcaacaggattagtggtgctagagaaggtaggcggcctcacacgaagaaattccgctaacttgttctggggaggtgcatggttatttccctggttctgctggttctggagttgctgcatcatcatgttcataagctgtgcctgttgggccaggacctgggcaagtgtgggattctctccattgttgttgttattattgttattgttgttgttggggccattcccgttgctgcgagtgagcaccatctggcatggacaggagcacaagaagagaaaccaggggaaaactacttaggaccgagaattaatttaacttttattgatcttaagtgagtttcattattacaaactgaagactctcacaccactaaactcaccaactacctaacactcgaaagcaaacaaacgcacccacttacatcccccccactgatgtaaatcacatgcgagacacacacaaccaaacttaaaacaagcaaactaacacaacgatctaagacaacggcttgacaagacattctaggtcttccgagcatcggagttgattgaaggctcgttcggctcgtcttcatcatcttgagttgctccccactcgatcttggaatgggtgcgcttggattcttcttcttcatcatcacttataatgataaccggaggatctgctagggctggggtaacttctttctccaccacacggacctttggcgccaattggtagcgagggacaaatagagctctcttccttgcggtaagatgaatcctggccttctgcggtggtgcttctcccttcaatgcggctagttccttcttcaaacgaaccactttgtcttctagcttgcaaatcttaccacgattccgatcttcacgatcttgagctgctaacacagtctctgcacgggttttcatccatagcccacagcatctcaaccaaatgccttgtggtagcatcattctcaattccttccgtctcaaggtagctggcacggtcactttcctgtggttgacgaggatggtagcgatactcaatgtcggccaactgatcactgtagcgatcacggagctcttctatggc

SEQ ID NO: 31645 - DNA, 2610 bp, Oryza sativa
aaggaatggcttcaggtccttttgcataaagctaattttacaattcttttcacaagcctaaaacctagcatagactgatcaaattttagtaccagtgttcactttaaacaacgacggttctgtcaaccatccattgtgatcccaaggatagcttcccgccattgaatcgtcatggttttctgaggatgtccaccttccctcctctcgggatgtggctccatcagcataaaattcatcatgcaatatcccattccccacaagttaagaatttagagtctagccaagtgtaatacatgtcccggtgctcaataaccgcgagcacggctattcaaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggaaagagaagtctcacacgcatattaaattatggttcaagttaagttctctctctcacacactcatggcagtcctaccaatggcgacaccgatgcagggcacgcctctcggccctacctcaacggctgtcccatcgtagcgcacctgcctcactcaggggtgaaccatctatgcagggatactgcctccgctcggctatctaatccgctaggtctatacccattcgagaagtacggttgtacgggggtcgtttcgtgcttaacttcatggctcggtccttaattgaccggggacggtactagccttttccagataccacccaaatcctccgtccgccccagtcgaaaacagttgtttaattttatttctcctttcacaaatcatgtcatcaacatcatggcaatgtggcactcatgtctccacatgccgcatctcaattaccttcccaaaggtaattgcccaagcatatagcatttgataaatatgagtatgcatgattctagaatagcatttctaagcaattgtcatagttgactagggactcatacgtaaacatggttacaaagatttaagggtaaacaataatcaaggcatggcataatcacaagtaggatgttcatcattgcatgcaattttatttataaacaaaacaatttcgcaattgggatcaacatgttcaaggaatagtgatgacttgccttgctcaggataatccttattattgctataatcttgatcaaccttcacctcctggaagttgcagacgttgcctcacgactaaccgatacacaaggtctataatacgcgagaaaaaccaatattcaaacaacaatcaaatatgcgcaataaaatgtactattcgtgtttgctaatggatcccaatcatgctaaggctaaagtttcttaatctttctattgtcatcgtggcctatttaggagttaaccaacatagcatttatgggatacatatatatttggctaatcagtggtttagtctatcaaatggctatggaaggattttggctatgtatgcatctatctaaataggacggttatatactagaggttctgttgctagatggatttaggatcaatcaaacaattacagtgaatcatttgtattatttattttattaatggaagctttactttaattatgaacatattttacttgccattataaattataaaagggctaataattatccatgctctatatgttaaattcgggaagtttataatattatatttacagattatctcttaatgaacaatccggatttacaattgactatgaacatatgaggtcaagatttataattagtacttatctactattcatgtttgttatatactccccagtttaatatatgaaaaagataaattgattgtataactataatgggatgtacaatatgtgtgcaacaacgtataaggttttggtcgcctactgtacatgagcttatttagaaagtgtactacccaatgctccaagtgattcctaaatatattgtagtttaattatacattagctagtttctatgagtgatattgtatatgtgatgcgacaagtttaagcactggttctattgggttactaataagtggtaatcaatttaggcgtatatatgctattctatatggtattgcatcgattaatttacttagcgattcctccacatctagctctgttatgattctcctgaacaggttaaagagtcatctatgtgtgtttatattttagttagataatcataaggctatacttgatttaaataacctataagccatggatttaattatatggccatcgaatattaaataagtactagtattttcctatacatccattaatttgaaggattgattataactaaattactaccaatattaatctaatctgatcaagaaacatatttttataattaactcggaacttcgaccgaaatactattacgctcgaggaatttccaaaaataatctatgattaatcccgaccatttttatttcctaaatcctcctaatttcttatttatttccttttcctttttttttccttcttttttt

SEQ ID NO: 31646 - DNA, 1807 bp, Oryza sativa
ggctttgagggttccaaaattaattaaaatatcctaatgtggccattattattacaatagcacattgaatgaacttatttgtataataatgtattttacgtggatctagtaattcggtaaatataaattgagactcggtacaatattaatctaattgtctaattaaacactcacatattcttatttatatataaagcttaatttatttatgaccattattttatatgagtgattttcatgtcatgagtaactcggtgaaatgttctaagtatcaatctatatatattccggtgaattacttatttataaacacgatcattatagtggtgatcatcatttcatgtgttcttatatttcatgtgagattcgattcaaatgaataagatttaatcttactatttctttagctaattgtgacatcaagctatcaatcatggttcgaatatttaatacctgatttgtaatttgtaatagaaattaatatttgacttaactatcttgtgcataattatttgtaggattaacgatattatattctcgtaaatttatctattacttaaattttagacccttactttactttctttgtgatcatttacggtttggcaagcaatagcaatcataacaaccagcatgatgcaaaagttttaaaaagttcaaaattttagtgatttttattgtcttgaattttcaggatgttacagcaccattcctggatcataatcaccccctcaaaaaccagaggcatggactccccagcgacccccgtgggcttatctccgccacttctcggtctggtgctccgcaatgaaccatgttattcaaaaggtaaaagccgttgcccacggtggcttgtggttggcccgattaatgtttctctatagtagctcgatcaccggttcttaattgtcataagcactactatccaaaccatgggttcaatacccaccattatccagttttagttggcaagtatattaattagccaatcacgattgaccatcgtgaactatcattaagccatcattaaatagtaatgagtcataagttatcccaatagtgtgctaatgtttttaagcatggctaagcaactataaataacatctagctgaaccaatccaatatataaggtccatgctagtcaaattataacccataggaaaataaagtcatcttcggccataattaaatgggaaaggctcaccacccaatgatattcgaaaatgtcacaccctgaaaattcaaaatatataaattgttgtttaattggaatttttagaaataattttaaaagcctagaagagaagatctaattttaattaataaattccaatataaaatggggccagataaaatttcattaaatactttgcttaattctataattcctagatttttctgggatttatttgagctaagaaagtatttttaataaatggaattgcatttaagaaataatttaaattgaaaaaggttttaaaaagtcttcttttggctttgggctgaaagtcggcccaaaatcccttctctctctcctcggcccagccggcccagtccgcagccgcagccgcccgcccgcgcgagcgcgctgtcgctgacaggtgggtcccacctgtcaggatcgtcgtcctcctccggccgtaaccctagtttcgcgccgccgccgccgctttccaatccggccgttcctttccgtttccggccaaatcaattgaggggaaacaatctccgggatctcctctaccttttctcctttggaaacttcggctaaatcggtttggaatgagtttgattcgagttcgaatcg

SEQ ID NO: 31647 - DNA, 6631 bp, Oryza sativa
cccacgagggggaggggggggaaaaaaggacttttagggtttttctttttataaaaccattttaactttgtttatttcttcttaattattatttgtgctctgaaaattccactaaaatttatttacgcattttaggcttttaggaaatatacaaaaatcctccaagccttattcgacttttaacttcgcacattttaattgttggaggctttcacaaggattttacttattctaagcataattttgaggatgtgttttagagtcgttttgggacgcgacactgcttcagaaagatgtgaagtacaagtggtcggaagaatgtgagcagagtttccaagagttgaagaatcacttaatattagctcctattttgattttgcctgatccaaagaagggtttccaagtgtattgcgatgcatccaaacttgggttaggttgtgttctgatgcaagatgggaaggtggttgcctatgcatctcgtcagttacgtccgcatgagaagaactaccctactcatgatcttgagttagctgcagtaattcatgcgttgaaaatttggcgtcattatcttttcggtactcgtacagaggtgtataccgatcacaagagtttaaagtatatctttactcagccggatctgaacatgagacaaaggagatggttggaattaattaaggattatgacatgggaattcattatcacccgggaaaggctaatgttgtagcagacgctcttagcaggaaaggttattgcaatgctacagaaggacgacagttgccattggaattatgcaaggaatttgaaagattaaatttgggaattgtcagtagaggtttcgttgccgccttagaagcgaagcccactctaattgatcaagttagagaagcccaaattaatgatcctgatattcaagagatcaagaagaatatgagaagaggaaaagctatcggtttcttgaaggatgagcaaggaactgtatggttgggcgagagaatctgtgtccccgacaacaaagatttaaaagatgcaattctgaaaaaagctcatgataccttatactctattcaccctggtagtacaaaaatgtaccaggatctcaaggaaagattttggtgtgcaagtatgaagcgtgaaatcgcagaatacgtagcagtatgtgatgtttgtcagcgagtcaaggcagaacatcagaaacccgccggtttgttgcagcctttgaagattcctgaatggaagtgggaagaaatcggtatggattttatcactggtttacccagaacgtcatcaggccatgactctatttgggtgatagtcgatagacttacaaaagtagctcatttcattccggtaaagacaacctattccggaagtcggttagcggaattgtatatggcaaggatcgtgtgtttgcatggcgtccctaagaaaatagtgtctgatcgaggcagtcagtttacttcaaatttttggaagaaactttaggaagagatgggttctaagctgaactttagcactgcttatcatccgcagacagacggacaaaccgaaagggtgaatcaaattttggaagacatgttgagagcttgtgctttagatttcggtggaagttgggataagaatctaccttatgcagaattttcgtacaacaacagttatcaagctagtctacagatggctccgtacgaagcactgtatggtcggaagtgtcgcactccgtacgaggttgcctatcagttagagttacctcaatctttggcaggagtccataatgtgttccatgtgtcgcaattgaagaagtgtttaagggtacctaccgaagaagctaatcttgaacagatagaagtccaagaggatctgacctatgttgaaaaaccaatccgtatcttggaaacaaatgagagaagaaccaggaatcgagttatccgtttttgcaaagtccagtggagtaatcactcggaagaagaatcaacttgggaacgagaagatgaattgaagtcagctcatccgcatctgttcaccagttcttccgaatctcgaggacgagattctgtttaaggggggtaggtttgtcacaccctgaaaattcaaaatatataaattgttgtttaattggaatttttagaaataattttaaaagcctagaagagaagatctaattttaattaataaattccaatataaaatggggccagataaaatttcattaaatactttgcttaattctataattcctagatttttctgggatttatttgagctaagaaagtatttttaataaatggaattgcatttaagaaaccctcctgtcaggatcgtcgtcctcctccggccgtacacctagtttcgcgccgccgccgccgctttccaatccggccgttcctttccgtttccggccgaatcaattgaggggaaacaatctccgggatctcctctaccttttctcctttggaaacttcggctaaatcggtttggaatgagtttgattcgagttcgaatcggatcggctttcctctcttcgagcccgatctttccttctcgtcgccggccgccgtgggccttcgccgctgccttcgagcccctttaaaaggacccccgagctcttctctacccgccgccacccttgccttcgcctctcgtcgtcggaaacgctctagcgccgtgtgccctagctttgccgtcgtcgccgccgctccagccgtgcgccgccgtcgtttcagccgtcgctgtcgctcgggaagaccgccgttgtgctcgccaagtcgtcgccgtcctcgtccgccgcttcgccaccgccgaagaccgccggagcatcgccgtcaccgtcgacccgaaggttgccgccgcttcctcctcgtcgccgtcgtcgtccgttgttcttccgccgccgttttggtcaccggtgagttcgccacgtcgtcctctacatgctggtgccctccgtttgtgccgaagtgccgccgttcgccggcgagcgtgcgccgcccgagccgtccgctccgccgagccgccgccgctgtcggtgacgtcattgccgacgtcatcggggtcgtccgccgtgagccggtcgtggaccgttcgatctcggccgtccgttttggattggatcgatctcggccgtccgttcgcgtgaacctgacgcccgtgcgcccggttcatatgaaaccctaagctgcgctgacgcaataaaccttcttttccttttcaaaaataattcattattgcgtcataattcaatttaaaccgatataagtgttttaatccgatttaatccttaacaattcataactaattcatcttagctccgatttagttggttcaagtctctattgggataacttatgattcattattgggataacttatgattcactattatttcatgatggcttattgatagttcacgatggtcaatcgtgattagttaattaattaatgtgccaactaaaacctgataatggtgggttgtgagcacatggttttgatggtcgtgctcatgacaattaaggaccggttcacgagtttcggttgtgaaacattaaccgtgccaaccacaagccagcatgggcaacggctttatcgtttgtatagcatagttcattgcggggcaccagactgagaagtggcggagataagcccacgggggtcgctggggagtccatgccttgtttataagggggtgattatgatccaggaaggtgcgctgcggtggattgtgttatgcaaggggtattgtcacaactcctttccgaggtaccgtggtggtattgaggcacatggtgacatgatgtggggttgtgtcttgtgggtatagtggtacatctctgatcagagtaaaactattcgaatagccgtgcccgcggttatgggcgagtctaacaatgtcttttgtgattagtcccacacttctcaccctaatagaagatgctataattggtaataatttgattagctcctggtttggaatggtacattcctggtttggagatagatctgtacagccgggatggttgttcagaatggttgggcctatacaacagggtacgttgtatagtgttggattaatattgtttaattattacttaactgttttattaaattctcaaatgtttgctaaatgctgcttttgcaaatggaaccctattatgccatcctttgttatcctgtgcacttgcatatttgatgcgtggcttgctgagtatgtcatatactcaccttgcaatcattcatcagaggaagagttctacaatgatgctgatggtgtgaaggattaggtgtagccttggtcaagctgcctgtggagtggagtcgtctgcgccgtttatcttattttccgctgcttagatctttattgattgagaggaactatctacctctgtaatgacattttatacgcttattaattagagtaataattgtactctattatcaatttgttattgtgtgcctcggctgattcctggacgagggttcacacacatgaaagcgtttggaattttggatagaaattccgggcgtgacagaaaacaatgcataagttgaaataaatcaatagctttaaacaggttcagcatgctcaaagggttgtttgggatctgtgtgacttgccttgctggccttggaactcttcaaattcttctcctgcgaaaacagactctccggaaacgtcggaatctaaacaaaaaggagcaaaatcaccaaaatagcacataaacaagcatgaacagtacatgtggatatttttaacatgtagatctcaattttagaaaaatttagagacttgaaccaactaaatccgagctaagatgaattagttatgaatttttgaagattaaatcagattaaaacacttatatggattttaattgaattatgacgcaataatgaattatttttgaaaaggaaaagggatttattgcgtcagcggctagggtttgcggtggaccgggcacacggcaacggttcacgggaacgaacggccaagatcgatccatccaaaacggacggccgagatcgatcgggtctacggcggctcacgagagacgacgacgatgacgtcagcggtgacgtcacctccggcggcggctcggcgactcggcagctcgggcgcacacgctcgccggcgaacgacggcgcggcggcgcgaacggagggcacccacgggtagcggactgcacgacgaactcaccggcgaccaaagcaacggtggaaaatcaacggacggcgacggcgtcgaggaagaagcggcggcgaccttcggcttgacgacggcgacggtgctccggcggtcaacagcgacggcggaggggcggacgagaacggcggtgacttggcgaccacgatggcgacctccccgagcgacggcgacggctggagcgacggcgaagcacggctggaccgacggcgacgacggcggctcgaggttacacggcgctagggctcttccgatggcgagaggcgaaagcaaaggtggcgacgggtagaggagacaccggggatccttttataggggttgaaagacgacggcgaaggcccacggcgaccggcgacgcgaaggaaacctcgggctcggagagagagaccgatccgaatcgacctcgaatcaaacactttccaagcgattttagccgatgattccaaaagagaaaaggtagaggagatcccgaagattgtttcccctcaattgatttcaccggagaaggaaagatgcaaccaaatttggaaggagacgacggcgcggctcggctagggtttcgggcggcggccgctggaggttgacgacgaccccgacaggcgggacccacctgtcagcgaccagacgcgcgcgcgaggcggctgcggactggactgggccgacttgggccggggagagagagagagagggttttgggccgactttcggcccaaagccaaaagagactttttaaaaacattttttaatttaaattattcctgaaatgcaattccatttattaaaaatacttccttagctcaaataaatcctagaaaaatctaggaattatagaattaagcaaagtatttaataaaattttatctggccccattttatattggaatttattaattaaaattagatcttctcttctaggcttttaaaataaattctaataattccaattaaacaacaatttatatatttttggatttttaggatgtgacagcggtcctcggctcaccctaggtcgacggcgacgacgaaaaaggctgtcggagcggaggaaggcggcggcgcggctcgggtcgtcggggtcgacggcggtccggcggtccgcgggctcagcgaggggttggacggggtcgacggcagtgcggcgaagccggaggaggcgacgccggggcgggagacggtccggcgagcggagaaggccggccggaggtcgtaggcgacggaggagagagagagcgacggcgcgagctcgattccggcagggagacggtgcggcaagggcggaaacgggcgagggaggcgcggggagggtttatatagggttggaagggggagagggcggccggaggggaaggaaaccggcgcggcgctctcgggctccatcaatggcgccggcgggattaggggagggtttccaaacgaatccaagggagagagggggggaa

SEQ ID NO: 31648 - DNA, 19010 bp, Oryza sativa
  unsure (1)..(19010): unsure at all n locations
aggtttcgttgcagccttagaagagaagcccactctaattgatcaagttagacaagcccaaattaatgatcctgatattcaagaaatcaagaagaatatgagaagaggaaaagctatcggtttcttggaggatgagcaaggaactgtatggttgggtgagagaatctgcgtccccgacaacaaagatttaaaagatgcaattctgaaagaagctcatgatactttatactccattcaccctggtagtaccaaaatgtaccaggatctcaaggaaagattttggtgggcaagtatgaagcgtgaaatcgcggaatacgtagcagtatgtgatgtttgtcagcgagtcaaggcagaacatcagaaacccgccggtttgctacagcctttgaagattcccgaatggaagtgggaggaaatcggtatggatttcatcactggtctacccagaacgtcatcaggccatgactctatttgggtgatagtcgacagacttaccaaagtggctcatttcatcccagtaaagacaacttattctggaaatcggttggcggaattgtatatggcaaggattgtgtgtttgcatggcgtccctaagaaaatagtgtctgatcgaggcagtcagtttacttcaaagttttggaagaagcttcaggaagagatgggttctaagctgaactttagtactgcttatcattcgcagacagacggacaaaccgaaagggtaaatcagattttggaagacatgttgagagcttgtgctttagacttcggtggaagttgggataagaatctaccttatgcagaattttcgtacaacaacagttatcaagctagtcttcagatggctccttacgaagcactgtatggtcggaagtgccgcactccgcttttgtgggatcaaacgggagaacgtcaggttttcgggatggatatcctgatggaagcagaagaaaaggtgaaaatcattcaagaaagattgcgtgtggcccagtctcgtcataagagttatgccgacaatcgccgcagagatttgagttttgaagaaggagattatgtgtatcttcgtgtcacgcctcttcgaggagttcatcgtttccacactaaaggaaaattggcaccgcattttgtgggaccttataaggttgtcagtagaagaggagaggtcgcttatcagttggagttacctcaatctttggcaggagtccataatgtgttccatgtgtcgcaattgaaaaagtgtttaagggtacctactgaagaagctaatcttgaacagatagaagtccaagaggatctgacctatattgagaaaccaatccgtattttggaaatagatgagagaagaaccaggaatcgagttatccgtttttgcaaagtccaatggagtaatcactcggaagaagaatcaacttgggaacgagaagatgaattgaagtcagctcatccgcatccgttcgccagttcttccgaatttcgaggacgagattctgtttaagggggtaggtttgtcacaccctgaaaatcctaaatatacaaattgttgtttaaatggaattttcagaatttattttaaaagcctagaagagaagatctaattttaattaataaattacaatataaaatggggccagataaaatttcattaaatactttgcttaattctataattcctagatttttctgggatttatttgaactaaagaagtatttttaataaatggaattgcatttcatgaataatttaattgaaaaagttttttttaaaagtctcttttggctttgggccgaaagtcggcccagtccacagccgcagccgcccgcgcgagcgctcgctgtcgctgacaggtgggtcccacctgtcggactcgtcgtcttcctccggccgccgccgcccgaaccctagccgaaccgcgccgtcgtctccttccaaattcggccgcgcctttccttctccggtgaaatcaattgaggggaaatgtttcccgagatctcctctaccttttctcttttggaatcatcctctaaaacgctttggaaatccgtggattcgagttcgattcggatcggtctctttcctccgagccttaactttccttctcgtcgccggtcaccgtgggccttcgccgcagccttccaacccctataaaaggatccccaagcccgccgctacccgtcgccaccctcgccttcatctctcgtcgctggtagagtcctagcctcgtgagaccttgtgccgcagtcgtcgccgtcgctccagccgtgcttcgtcgttgttccagtcatcgccgtcgctcgggaaggtcgccatcgtggtcgccgtcgcgtcgccttcctcgtccaccccttcgccgtcgcggaagaccgccggagcatcgccgtcgtcgtcaagccaaaggactccgccgccttttcctcgacgccgccgccgtccgttcattttccgccgctgttttggtcatcggtgagttcgccgcgtcgctctctacgtgctggtgccctccgttcgcgtcctcgcgctgtcgttcgccggtgagcatgcgcgcccgagccgccgccggaggtgacgtcaccgctgacgtcatcgtggccgtctgccgtggcccggtcatggaccgttcgatctcggccgtccgttttggataggatcgatctcggtcgttcgtttccgtgagccgccgccgtgcacccggtccaccgcaaaccctagccgctgacgcaataattcccttttccttttcaaaaataattcattattgcgtcataattcaattaaaatccatataagtgttttaatccgatttaatctttaaaaattcataactaattcatcttagctcgaatttagtgggttcaagtctctaaatttttctaaaatcgagatctacatgttaaaaatacccacatgtactgttcatgcttgtttatgtgctgtttggtgattttgctcctttctgtttagattccgacgtttccggagagtccgttttcgcaggggaagattttgaagagttccaaggccagcaaggcaagtcacacagatcccaaacaaccctttgagcatgttgatcccgtttaaagctactgtttctattcaactattgcatttattttcgaatgtcattgggtggaattaacctattgtttgttatagccctttttgttcttgattactttattccttgataccttgggttattataacttgactagttgggctatatatatattggttcagctagatattagatatgattgcttagccatgcttagaaacattagcacacttttgggttaacttatgattcactattatttaatgatggcttaatgatagttcacgatggtcaatcgtgattggttaattaattacttgccaactaaaacttgataatagtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcccacgggggttgctggggagtccatgccttgtttataagggggtgattatgatccaggaaaggtgccctgtggtggattgtgttgtgcgaggggtattgtcacagctcctttccgaggtactgtggtggtattgaggcacatggtgacatgttgtggggctgtgtcttgtgggtacagtggtacacctctggccagagtaaaactattcgaatagccgtgcccgcggttatgggcgggtctaacaatgtctttcgtgattagtctcacacctctcatcataataaaagatgctataactggtaataatttgtttagctcctggtttggaatggtatattcctggtttggagatagatctgtacagccgggtatggttgttcagaatggttgggcctatacaacagggtatgttatatagcgttggattaatattgtttaattattacttaactgttttattaaattctgaaatgtttattaaatgctgtttatgcaaatgaaaccctactatgccatcctttgttatcctgtgcacttgcatatttgatgcgtgacttgctgagtatgtcatatactcaccttgcaatcattcatcagaggaagagttctacagtaaagccgatagtgtggaggattaggtgtagccctggtcaagctgtctgtggagtggagccgtctgcgccgtttatcttttttttccgctgcttagatcataattgattgagaggaattatctacctctgtaatgacattttattcgcttattaattagagtaataattgtactctattatcaatttgttattgtgtgtctcggctgattcctggacgagggttcacacacatgtaagcgtttggaattttggatagaaattccgggcgtgacagtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgtttttaattcttaaaacctgcttaacaactaaaatgtagaatggttggcctgggttggcttgggacgagctgggacccagggtcgggttgccagttcggtctgaatcatcgtaggccttgggttaaggcaggttcgtgtgagttcacggccttgattaataatcttgtatagctctaggactgtgtttacaaaatagctttgagcaactaagtgtcttttagtgctgtttactgcaaaccctaacccccctatattatggctcccttgtactcccttgcatttattctgcacttgtgggtgtgtcttgttgagtacggtggttgtactcagtcttgctcaatttttcccaaacccagaagaggagcccctggatgatgaaggctttggtgtctagctcgtgcctgccgtcaagcgcctgtggtcgtcgccctagtcttccgctgtttcccgtttgtctttgtgtgtgctgggccttcgccgcccatgtaataaagtaaccatttacgcctccgcttgataaactctgaaatgtatcaacttttggtgtaccttgcctcctgggacaaggaataatacacacatgtaaggaacgcccgttgggttatttccggtcgtgacatatttctccgtatttagccccggttgtatggttatgacgggctgtcgtaaagaactcggcagtcaggggtggctcctcgaagtaccaggagggcatcggaaagagggtattagctagtatgttggttaactagaatgtatgtatactatgtatattagaagtatagtaatagattatctttctattttcttcctacctagcttagataatatattataagaatgagtagcttatgcttgtgtgttactctacccttggattatcttaacccatgcttagaatatgattatcacaaataatatataaattgttagtcaagttctctctatatgatcttcccacgggataaaataaatacaatacccttggaatactctcgggtgaaatgctacaatggtatatccgtgcgcttgcggatgaactctgtaaccataatataccagaagtatttgtgtgccattggtgggaattatatttctagtaatgtcgttaagaaataccaacagaggggagaattatacccgaacgagtaagctctccgcagccgcgcaccctacgccgaactcattatgctcggtgatgggactagggccaccagatggcgaaataatctgccagaccccttcaacaaagggaccgatctccggtcggggaggtgaagtcggcagagacaaactggggcgcggtgagtgtcatatcagacactgtcatttagatcgccactgcctggccctctcgctggcgactcgccgaaggcaatgtcacagccccaccagcgccagaggctttcgccgtcgccagttgcaatgcctggtccgaagcaacagcgttggccgaagtgctgcccccggttggcgcgtcggcatcactagcaggcagtggagacaggagcctcttttgtggaggtgggtgtcgtggcgccgacgaagttggcatcccatccgaagatgtttcgctgtccgagaagccaccggccacctgcaccacccctttcttcttcctttgggcggcggcaccggccttcgacgacgagccagtgatggttagcaacgcattagcactagcgatgttttgaggacgcgtgggcgaagcgctagagccggccccagccttcgcccgaacagggcttggggtatagccgtgtgacccagcatcgtcgtccgacccgtcttccctctcatcgtcgttgtcgtcgtctgcgttggtctccacggcgtccttggccactcgccgagttcaaacctggcttctcttggccacgtcgcgcttccacttttttgacgtcccaacgtcgtgatcgactctcgcagggttcgcccggctggctagcgtgccgtcgtagacgcgattcgcctgtccattggactgttactgaagcaggcgagcgtactcggcggtaattaaacccccgatcattttcgccgactcagctttggcatcctccagcaaacgaactaattaaaaaggggaaagatgacaaaaattatataagcccaaacaagccccaagatgtgagatatcgaaggaggggagggaagcttatgattgatgccaggaggaagcacgaggcgggaaagaccgagcacttcttcaccctctgcggtagtaatcccccaatctcgcgcgaggggagaaatctgtagcatgcaaaatttttcgcagaggtcgcgggtgctcaaccgatgcgcaaccttgcgaagaaggatgagccgtgcctcaagcacgccatcaacatccacgttcggcttgatgatcatggcgatagaaagacgccggaagcgaagccacttcgccttgtcatcttcggcggaatcgtctttggagaagtaggggttgtcgatgtagaaccatttttgcatcgaattgcggtcccactttgccatcgacacaaggacaggccatgcatccgagcgctttggccgaagcatgaagtttacactgccaaaaacagtcttctttggccccgccagagtgttgtcgtccttggtcgccacgcacaccatgaacagggtggcgaagagctccgcggtaggagtaaatccacacgtccggcacatccagacgaacacgaccaagttgagaaatgccgatgggctgagctaggggagcttgatttcgtacaactccagcactgatggcagaaagttgtcacatggaaggcggagcccggcggtgaaaaaggcggcgaacaccaccgttcgcccgtccccggtcgaagggacaacgtcttcgcccgcacaggacacctggcgctccgcaaggacgctggagaggacaagctcggccaggtcggcctccttgacaagaaacttgccaaggtagcacgaccaaccatcgctgaggctgccagggtcttcgccagacgatccggccttagtaggcttgcgaggagccatcgaatccgcgatgaaagaggtggcgaagacaggaggcgaaaagctagagcaggaatgatagggctgaaggcacgagagtctgacagcggtaaaaacgagaagtggggaggagtgatagcgacctgggatgagggttgtatagcccgatcgcacgacggttcgactcccacccaaccacagcctgacacatgtcaaatggtagacggaacggtaaattcccatcgagccgggccacacagtggcaggctagaaccaaggaaaaccaagaggcccacggagcccgatactgttcactttcaatttcaaaccacctaaccatttcgccataacttgggcgaaataagaaaagattactaacacaggaactaagctctttgtaggtgcaaaaggataggtttcagtaggaacatcggccgaaagggggcgcctcatgccataccacacaatttgcatttgcacggtatcggccgaagctccctacttacccttgcccgtgaggggcttgttggaggtataccacgagggccttcggccagacctgccgaaaccgttgtcacaccctgattttcgtcttaggatttataaatcatttaataaattattaatagaatttatattaaatgttcattaatttacaagtgaagttaattgtgggaaataaaatttcctaaatataaagcatggatggatttaattttttattaaattctccatggttaattatactctctggaattttctcggattttttcggagctcaattcctaaatgatacaaagaacagttcagtaattatttgatcaataatgatctaattataattgttaagtgcttttcttgcttaaaatccttaaattataaattgttgtttaaaaggaattattagaaatgattttaaaagcttaaaagagaagatctaattttaatttgctaaatctcaatataaaattgggttagataaaattttattaaatactttgcttgttcctctattttctagaattttctgggaattgtttgagcaagggaagtatttttaataaatgaaacatcatttcacgaattattttaattggaaaagtttttaaatcctcccctaagtcgttgggccgatttcggcccaactcttctcttccccgcgcggccgaatcggcccaagccggcccagccgacgccgaccgcccctcctcctcgggtcaccgacatgtggggcccacatgtcggacccatcttcctcctccagccggccggctgcaagccgagcccaagccgtcgcccgagccgccaccttgcgccctcaaatccgcatccaatccggccctttttcttccgtttgtttgaggggtttttatccccacatcctcttctatctttcccctcaagaatcggagcaaatcgttgggtattttgcccgaatcaaactcgttttcgagtttatccccaaaaaccgagtttagattttcccggagcgatttcttgcgggtggagtccgatctcttcaatccaaggctataaataggaccacctcgtcgccctctttcgtttgccccctctcccgtggtctcccgtgcatcgtagctcgccgtcgacgtcgcttagtccgccgccgccgccggccgggttgcagccgcgccgccgcgtcgctttcgccgttgccgccgcttgccgtcgccgcccgtaggtgcgccaaggggtggagaagcctggccgcccgtcccccttcgccgccggccaccggagagccgtcgccgccgttcaaccgagccgccgccgcctcttgcgtcgtcgccggccgtcgtcggttgtcgtgggacgttttggtgagtaccatcgggttcgtctcgtcgtcctcttcgcgtaggtgcccttggataggccggccgacctctctatcgccggcgaggtcgtctcccgtgtcatgccggcgatgatgacgtcagcatgacgtcatgattccttttttccagttttttctaatagattaaatcttctgaaaatcatatctaaataaccgtagctccgtttcaggtggttcaagttactaaatttttctaaaataaagatctacatattaaaattgtccataaattgaattaaatctatttaattctttttaaatgggctttaattagatttaatcttgtaaaatctataataaattcacttggagtcagaataaggccgttcaagtctcataattcatctaaaatcatgatctacatgtttgttacctttatatgtattgtttatttgggtttttattagccttttacttcgttttgcgtgttagcttgtcgtttccgtcgttgagaaggtttgtgagtgcgtcggaagtgatcaagaagattaattgaagatcgattattgcaaggcaagtcacagatcctaaacacaatcctttgagcatgttgatcctatatttaaattctctatttatttcaactgtgcatttattttcgaatgtcaccgggtggtgtgaacctattcctttgttatggccaatttgcattgaatgctctattccttgataccttgggtaataaattgattagcttgaaccttgtatattagattggttcagctaaatgctatatgtaagtttgcttagctatgcttagaaacattagctaactaaaggggttaattataaactatgttatattattattattaattatggttacattaaatggtagctcacgatggttaatcgtgtgatgttaattaattgataattaaaatctggttaaggtgggttgtgagcatatggttttgatggttgtgctcatgacaattaaggaccggttcgcgagctactgttgtgaaacatttatcgtgccaaccacaagccaccgtgggcaacagctttatcttttgtatagcgtgattcattatagtgcgccagactgagaagtggcgagaagtccacgggggtcgctggggagtccatgccttgtttataagggggtgattatgatccaggaacggtgcactgttttgagttgtgttgtgcaaagggtattgtcacgatttccccatttgcaatgccgtggtggtatttcggggcatggcaacatgtgtggaatcgtgtcttgtgggtacagtggtacacctctggccagagtaaaactattcgaatagccgtgcccgcggttatgggcgggttgagcaatgtttttcgtgattagtctcacacctctcacaataattatggatgttaatatctggtaataatttgcttagctcctggtttggagttagatctgtacagccgggtatggttgttcaggatggttgggcctgtgcagcatgggtgtgctgttcagtgttgattaaaattaatgattaattactctactgttttacttatcttaaatctttgctaaatgctgcttttgcaaatgagcctatattatgccatcctttggaatccttgtgcacttgcatacttgctgtgtggcttgttgagtatgtcatatgctcattcttgcaataatcatcaaacctcagttgaagataaaggatccagaaggagaagacgtttggcttataccccagttgagctgcctgtgggagtggagctgaagccatcgctagaccgttaattccgctgctgttttcttttctttgtaagtatgtaacgttattattatgatggatttgtatattaaattgtcagtttgtgtacctcgactgattcctggacgaggattttatgcacaaattagttcggaaattactagtgaatttccgggcgtaacaaccgtccacccaatgaaggatcaagccagaggcgtcaacttcgacaaaggcgaaggcacacggcgaaggctatgcggcgaagcatgtgggcgaagatcaagggcctggctccgagcttcgcagttcgaaagaccacatgggcaaagggtatatggcgaagggcatttagcgaagcatatggacatcacccaagacgggccctgggcggagaaggcccaatgggccactatgcgcccgggggccctttcgccatggctaggccaagcttgttggcccgttaagagcccatatatgtaaaggacacagtatgccctcaataatgtccctatcataagggcaaccatgtaaaatcccctataatcataaaccctagaagaacagagcctataatagggttataaatagccccctaaggccatgtaatggggggatccccaaaaaatttctaatcaaccaatacagtcgtctttatttccaacctgttgagagagccacgtcgttcgacgtgacgcagttatcgttcgacaacaaaaactaagcaaggaaatagaaagtggtactctatgatctgttctgtctctcaattgcctaaggtggtgacaagcgtgtattccacaaatgttagtcgtaagggtaagcctccgtgcatatttaattaacatgagagagagtactcaaactgtgcgcttgtacattttagatatacaccattgtagcaactcctgattaacaaccaagtttttgtttccctttcgtcctttactcgggacgagcaaaggttcaagcttggggggttttgttgacggtcgttacagacaaatttcgaccgtcaatataactaaaataatggagaattagctatgcttacaatgcattttgtttccaaatagtatatatatttccacttgtacatggaaataacatgttacaggaatttatcaaataaaataaagagaaagcggagaaaacctcactcctaagcaatcaaatggataaggagggcccacatgtctggtgtaaccgccagaaaccgctttaactgccataaccacctaaaggacccacctgtcagtgccctgcccgaagctagaggcctgctgggccggcctaagttcggctgaactgccgaaccctaatggcgacggctcagcttggccctccacgtgcacgctccaaatcgcatactaatgacggttacaggggcaaaatggacaattcgcatagctacaaccgtcataaatacccaataaaaggaggagctcattcactctctcaacacactcaagcaagctcaaattcttcttcatactttagtattagtagtatagtgctaagcggagtagagtagattagtattcggagtcctcgaggtctccggaagagttttggtatggctctagcagctcttgtattctcttctgtaatactttccgaattaatgaaatactcatttttatacatcttcggtattttgttcagtctgagtactggtcttacattatatctgtgttatattaattatgtgggtagcctaccagagaggtgtaatggtgcgggtttaatgtctggtttaccagttgctctatgtcgtgtgcgcgggtatagagtagtatttagtaatgtaagtgtggtacttagattattaaatatcattaattgggcatatatgctgcgggacagtagaggtgggccgctgatggtgatagctcagtactggtattcctccacgttagtatatattcctaagacaaattcctggggagggtactcctccgtatttagccccggttggacggccatgataggttgtcgtaaggaactgggcaacccggggtggtctctcgatgtaccaggaggacactgtaggggggtattggccatatgattgtatattagcagatgtaaactaggaattgagtgtatgttagaagtatagtaattgagtgctttctattttttcttccacttagttagaattattttattatgaggagttgaatagctttgcttcgtgtcactctacccctatattaaaattaacctctgcttagattttgataaatacaaataatgtatgtataaagagtattagcatagtctactcatattatcttcccttggaattaaaaatacgataccttggaatacttccgggtgaaatgctacaatagtatatccgtgtgcttgcggataacttccgtaaccataaatataccaggacaatttctgcgccattgctgaacagtgactactgtgacgacatgggtatcaagctctgcttcacctcacccgcccaccccaagagcaacgttcaagcggagcgtgccaacacggaaatcctcaatggcctcaagacgaaaacttacaacgtcctcaagaagctcggggactcatcgatcttggagctgccggcagtgctctaggccgagccgcgcaataggagaaactccatgtttcctcgtgcacggggctgaggcggtcctcccatccaagctgaccctggggtcaccctgggcatcactgtataacgaaaatgatcaagatcagcttcgacacgacgacctcaactaccataaagagcgaaggcaacgtgcagcccttcgggctacccgttaccaacaaagcctgcggcgctaccatcagtgcaacgtccgggcctggtcactgcaagtcaaagaactcgtcttgtgccacgtcccaacgcgtgcaagattgagcaaactctcacccatttgggatgatgttgagggtcgttagcgatcaatttcgaccatcaatattatcaaaataaaggagaactagttatgcttgcactgcatatccatgttagaataacaatattccacaagtgttaggttcattaaccttttgcagagaacaaccataaagtggaagagaaccgatatcaactcaaacgataaattaattggacgatgtcgagaatcagacttatgtccgaatgggccaagaactcagaattgacacgatcaattgggccaaaattcacaagtctgcgaagagaagcaacagaggaggcagccagccaaaacctgggctggttgggccggcacctggttcggccgaacccccctggcgccgttggatgcagggtttcttctagacggcgtggatcactccccaatgatggttggagggcagttccgaccattccaactgccacaaccgtcattggcagcctatttaaggagctcctcttctctctccacacacgcacctcaagcaagagttctctcatattcactcaagatagtttagtagtcttaagctagtggagtaggaatagagtagaaatcggagtccggaagccttcagaagagttcgggtatggctttagtagctcttctcttctctttagtaagctttgtacttttattagaatactcttctttatacatttatggtattgaaatactttccgagtacatggatgccaactttacattatgttcatgttatactgattatactattagcttatctcggagatgcatcggtacaggtatagtgtttggttatgcaattactctatgtcatgacaatgatattagagtagtatctgttagtttaggcgtggtatctagattgggggatatcattatttggggttatatgctgcagatgagcggtgggccgctgatggtgatagctcagtacgggtattcctccgcgcgtgaatatagtcctaagttaatttcctggggagggtactcctccgtattttgccccggttgtatggtcatgatgggctgtcgtaacgaacttggcagttaggggtggcttctcgaagtactaggagggcatcggttcgagggtattagctagtatgtcagataactagaatgtatgtatactatgtatactagaagtataggaatagatttcctttctcttttttttccacttagcttaggtaatttagtatgagaatgagtagcttcctgcttgtgtgtcattctacccttcgattatcttaacccctgcttagactatagttattacaactaacatataaattattagtcaggttctctctattatgatcttcccatgggattaaataaatacaatacccttcgaatactttggggtgaaatgctacaatggtatatccgtgcgcttgcggatgaactctgtaaccataatataccaggagtatttatgcaccattgctgggaattatatttctagtaatgtcgtttagaaataccaacaagcatttctggcaccgttgctggggaagatttgtaatagagattaccataactagtactttatattttcctctgtataatcactgtcctttgcaggctaaccttggttgttttcacttttattatggaaacagggtagtgcacgactggttttaagttgccagaaaacttcaaagaaaatccagaagctttcttctggagcgtcaggccgcgagtcgctgctcgacagaaaactctaccaacagagaaaccagccgtaccagcgtcaccgaccttcaagactatgactaacaagactctccgtgaattcgctgctccctctgctgacaatgtgaccattgggccacaaattaacctgggagacgtggattttgatttgaagtctagcctcatcacgatgcgcaggctagccctttctgtggcaaccaaatgagaatgccaatgctcatttacagtagttcctagagatttgcagcacatacaccatgaagggtgtcagtccaaacaacgttaggctacgactgtttccgttttctctccttgggaaagcgaagaagtagttttatgctaaccatgctacgatcaatacctgggatagatgcttcacgacattcctctcaaagttctttccgatgggcaaaaccagcgcccttcgcggaagaatttcaagtttctaggagacaagggacgagtccattcctgaggcacgggaacgacttcaagaatatgtggccgcctgtcctcatcatgggatggatgactggctgatcttgcaaaatttctataatggactcactcccatgtcccatgaccacctagacacggcagctggatgagatttcttctcaaagacggttcgaggagccatcgatttgatagagaagatggtctctaatatgggttggagcgaggaacgactccaaacccgtcagcgaggcatgcacaccgtcaaggagatggaaatgctcgctgccaagatggacctcctcatgaaatgattggacgaccatgacaaaaggccacaaggcatcgtcaaagccttggactcacacgttacatgtgaagtctgcggcagcacgggtcattctgggaatgattgcccggaaacccatgaattggcgatgtacatgggcaacaacaacaatgggtatcgtccacaaggaggtcaggggtggaatcagccatgcccatattatcaaggagctaacaacaacggtaacttttctaaccaaccctccttgaaagatctcgtttttgtgcaagctaagaccactgatgctttaagcaaaaagctagctgccaattacaagatcttagaaaacattaatgttaagctagatagcttcgcttctgctttccaaaaccagctgagctttaacaaaatgatagaaacttagttagctcaattagctgccttagtacctgcaaatgagtctgggaggattccggggcagcggactcctccattgaaaatgttaaggtgatcaccacgaggggaggtaagtccacttgtgatctgccatatcctaaccctgtaggaactaacaaggaagcgccatctggtacttcagctgacaaaaagattcagctagagaaggttgtgccacaagcatactatgacacgcaattgctgccatttcctcaaaggaacaggaaaccgtcagtggacgagcagtttgctcgttttgttgaagtgatctagaagattcacatcaatatgccgtagttggatgctatataagtgctaacatacgcacgttacctcaaggatatcctcaacaacaagagaccgctcccaacaatggaggtggtcaagctgatggagcagtgcaacaatgccatactccacaagttcccggaaaagaagaaagatccggggtgtcctacgatcacctgctcgatcggggcacaacagttcaaccaagccttttgtgatattggagcaagtgtcagcgtcatgcccatggacgtctttgaaaagctcaacttcacgatgttggcaccaacgccaatgcacctgcagctggccgactcattagtccgttacccaacagggatagcagaggatgtgccggtcaagatacgggattctttcatcccagatggtttcgtggtgctggacatggaaacaggaaaggaaacactgctcatcttggtgcatccattccttaaaactgcaggagccaacattgatgtgggaacgggaagtatccgtttccgtattaacgggaaggaagagaaatttgagtttcagccaaggactaaacactgctccatggtcagaatcaagtacgggccaaacctacaaaatatcctggtgaagttcatgcaaaatttcctggaaaaggaaaccacgtttcccaggaaccgttattggaacacactggtaaaacctagtgttccggccaagaagctagagcagccggcttagaagaagttgtctcccgcaccaaagccaaagaaggtgtggaagaaaaagccaaaggcgcccgctccatgacctctagagataggttgaaaatccgcgaactgaactgaaaggaggtacgatcttgcacatcggacctaaaatgacgcgaccttcgccaacaggtaaattggtatgtatctgcacatttattttcatcaacttgaatttttgcattaacacatgtttggatttcaaaaaaaaaatcgcatttaggatttttgaatttttgagcaaaccaaaataaaattttcaacgaaaatttattgtgccacgaccacattgaccgttgaaacccaacggccaaaagtgcggccggttgggcccacaggggttcggccgaaccggccaggcaacggttacatgccacttttggcagggtaacggctagtgggtcccacatgtcatttctaaccattgtaggtgtccaatataagccagccagccaagagagggaattccatcccatttcaacacattttcattccctctctaaagttttctctcaagttcattcaagctttgatagttttccttaaattcaaatacttagttgcatacatacaagttgctttggtgaaactaaccagcgggtgaaattcttgctattctaaccctcgccgagttagtccgttcttgctccattgtgtagaatgaggaggcgattgtctcgtttgttcaaggggtccgactcttcatcaagtcatcatgactagtctatagctcgttcatcagccgatgtctcgatggaggacgccgacgctccgcgacgtctcctgaacgacgccgacctcgatcttgtcgacgatcgggaaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 31649 - DNA, 707 bp, Oryza sativa
ccaagttatgaaagagtggtcctgccttgacgacaacatgatggcatatcgacaagaggtacgcaaattggaagacaagttcgatggactcgagctcagtcacgttcttcgacacaataatgaagccgccgacagacttgccaactttggatccaagcgcgaggtggcgccctccgatgttttcgtcgaacacctttatacgccgacagtacctcacaaagatactactcaagttgcgggcactcatgacgtagctatggttgaagccgactggcgagagcccctcatacgattcttgacttctcaagaactcccccaagacaaagatgaagccgagcggatttcaagacgaagcaaactttatgttatgcatgaagctgagttgtacaagaaaagcccttcagggattctgcaacgctgcgtatctttagaggaagggagacaattgctgaaagacatacattctgggatatgcggaaaccatgctgccgcacgcaccattgtcggcaaagcttaccggcagggttttttttgcctactgcagtgtccgacgccgacaaaattgtgcgcacgtgcgaaggttgccagttttttgccagacaaattcatctaccagctcaagagttgcagaccatcccactgtcttggccgtttgcggtttgggggctcgacatggttggcccgtttaaaaaggcagacggcggtta

SEQ ID NO: 31650 - DNA, 860 bp, Oryza sativa
ctggtaccctccgtttgtgccgaagtgccgccgttcgccggcgagcgtgcgccgcccgagccgtccgctccgccgagccgccgccgctgtcggtgacgtcattgccgacgtcatcggggtcgtccgccgtgagccggtcgtggaccgttcgatctcggccgtccgttcgcgtgaaccgccgcccgtgcgcccggtccaccgaaaccctagcccgctgacgcaataaaccttcttttccttttcaaaaataattcattattgcgtcataattcaatttaaaccgatataagtgttttaatccgatttaatctgtaaaaattcataactaattcatcttagctccgatttagttggttcaagtctctaattttttctaaaattgagatctacacattaaaaatatccacatgtactgttcatgcttgtttatgtgctgttttggtgattttgctcttttctgcttagattccgtcgtttttggagagtccgttttcgccggagaagagtttgaagagttccaaggccagcaaggcaagtcacacagattccaaacaacccttggagcatgttgatcccgtttaaagctattgtttcttttcaactattgcatttattttcgaatgtcattgggtggaattaacctattgtttgttatagcccttttgttcttgattactttattccttgataccttgggttataataatttgactggttgaactttatttatattggttcaactagatattagaaataattgcttagccctacttagaaacattaccacactattgggataacttatgattcactattatttcatgatggcttattgataagtcacgatgggtcaatcctga

SEQ ID NO: 31651 - DNA, 15623 bp, Oryza sativa
cagtggtacacctctggccagagtaaaactattcgaatagccgtgcccgcggttatggcgagggtctaccaatgttattcgtgattagtctcacacctctcatcatgataccaaatgctataaatggtaataatttgtttagctcctggtttggaatggtatattcctggtttggtgataggactgtgcagccgggatggttgttcagaatggttgggcctatacaaattgtatagcgttggattaatattgcttaattattaactgctttattaaaatctgaaatgtttattaaatgctgtttatgcaaatgaaaccctactatgccatcctttgttatcctgtgcacttgcatatttgctgcgtgacttgctgagtatgtcatatactcaccttgcaatcaatcatcagaggaagagttctaccgtgaagccgatggggtggaggattaggtgtagccctggtcaagctgcctgtggagtggagtcgtctgcgccgtttatcttttctttccgctgcttagatctttattgattgagaggaactatctacctctgtaatgacattttattcgtttattaattagagtaagaattgtactctattatcaatttgttattgtgtgcctcggatgattcctggatgagggttcacacacatgtaagcgtttggaattttggatagaaattccgggcgtgacaagttggtatcagagcctccttgaccctaggttatgccaaatggttacccatagaagccctctaaaaatattggaaaagtagaactgttctcctccctttctcttttaattaaaccaaactaatggcacatgtatttcataatatttttttagtggttctcattcaaaatttattccagtgttattagtactgtactactggctcatttaccagcaaaagttttacaatattgttttatttaatcttgctgcaatgaaataaatttagcatgttgattttataactttcttttatttcttttgaaacctgttgttcaaaagtacaaaatttgtgaccttatttccaactatttcaacttatcctgcaagcttggtttactttatttacttaccttttactttgattttctaactttactcaaattaatccaaaaacttgtgctattaattggataaatgtcttaactccctcctttcacttgtctttagatgccgcgctacaagcctgagtacctgtttggtgttgagggttttgtccaggagttgcgtacgatgtcctttgtcattggatttgggactgcccctttttatgcccagattcctcatgatcgtcatgaagagaagtgtcgagtcaaagtcactttgaacagtaatagtgaagaggtcccctcagtaatgttcgaagctggaggaagaaactacatccatgcatgtcaggaggtggcaaggatcgccataggagagctccgcgatcgctacagtgatcagttggccgacactgagtatcgctaccatcctcgtcaaccacagggaagtgaccgtggcagttaccttgagactgaaggaattgaaaatgatgctaccacaaggcatttggttgagatgttgtgggctatggatgaaagtcgtgcggagactgtgttagcagctcaagatcgtgaagaccggaatcgtggtaagatttgcaagctcgaagacaaggtggatcgtttggagaaggaactagccgcattgaagggagaagcaccgccgcagaaggccaggattcgtctcaccgcaaggaagagagctctatttgtccctcgctaccaattggcgccaaaggttcgtgtggtggagaaagaagttgccccaaccttagcagatcctccgatcatcatcataagtgatgatgaagaagaagaatccaagcgcacccattccaagattgagtgggtagcaactcaagatgatgaagacgagcagaacgagccttcaatcgacctccgatgctcggaagaactagagtgacttgttaaatcgtggtcttagatcgttgtgttagtttgcttgctttaagtttgcttgtgtgtgggtcgcatgtgatttacatcagtggtgggatgtaattgcatgtgtttgtttgtttttgagtgttaggtgcttttgagtgttaggaagttggtgagtttagtggtgtgggagtcttcagtttgtaataataaaactcagttaagatcaataaaagttaaagtaattctctatcctaagtagtttcccccgatttctcttcttgtgccctgccagatggtgaacactcgcagcaacgggaatggccccagtaacaataacaatggagagaatcccactcttgctcaagttcttgctcaacagacacagctaatgaacatgatgatgcaacaactccagaaccagcagaaccaaggaaataatcatgtacctcctcagaataagttagcagaatttcttcgtgtgaggccgcctgttttctctagtaccactaatcctgttgaagctggtgattggctgcatgccatagagaagaagttggatttacttcagtgcactgatcaggagaaggtctcatttgcatcacatcagttgcaaggccctgcctctgaatggtgggatcacttccgcctgaataggattactgctgaacctatcacttggcttgaattcaccgctgctttccagaagacgcatataccatcgggagtggtgtctctgaagaagaaggagttcaggtcgcttacccagggatctcgctctgttacggagtatctgcacgagttcaatcgtctggctcgttatgctccggaagatgtgcgcaatggtgaagagcgtcaggagaagtttttggaaggacttaatgatgagctttcttacccactcatgactggagattatcatgatttccagaagctagtggataaggctattcgtcaggaggacaaatacaatcgcatggagcagaagaaacgtcggattgctcaattcaagacacaacaggggaataatcagaagccgcgtcttactttaagaccccagtccatgccacatggaggttcttcgtttgttgttcgtccgcagcgtcagttcttcaacaacaatgctggcaacaacatccgcaatcaagctccacgtcctgttgcagctccaacacagcaacaacctgccaagagggagcaaggcagcaagcccgtggtgtgtttcaactgtggagacccaggacattatgctgacaagtgtccgaagccccgacgcgtgaaggttgtccctacccagagcaactctacggtaccagcatcaaaggcccgtgtcaatcatgttgctgctgcagaagctcaagatgctccagatgtgattttgggtacgttccttgttaactcagttcctgcaacagtacttttcgattctggtgctacacattcattcttatctatgagttttgcgggaaatcatgggatggaagtagaagatcttagacgtcctttgatggttagtaccccaagtaatcaagcactctctttgcatcgtagcccctctgtcagaatagaaattcaaggagtaccatttctggccaatcttatcctgttagaatccaaagacctagatgtcatcctagggatggactggttagccagacataaaggtgtgatagactgtgctaacagaaaagtaactctcaccagcaatgatggtcgagttgtgactgtttatgcattgtcttctgagtctttaaggtcaagattaaaccaaataactttggaagagattcctatagtccgggagtatcccgatgtgttcccagatgatttacctggtatgccgcctaaaagggatatagagttcagaatagatctggtaccaggaacaactccgatccataagagaccttatagaatggcagccaatgagttggcagaagtcaagaggcacgtagatgatttgcttcagaagggatacatcagaccgagttcatcaccatggggagctccagttatttttgtggaaaagaaagaccatacccagagaatgtgtgtggattatcgtgcattaaacgatgtgactatcaagaataagtatccgctacccagaattgatgatttgtttgatcagcttaaaggtgccactgttttctccaagatcgatcttcgatcaggatatcaccagttgagaatcaaagaggaagatatacctaagacagcttttaccactaggtatgggttgttcgaatgtactgttatgtcttttggacttaccaatgcccctgctttcttcatgaacttgatgaataaggtgtttatggaatacctagacaagttcgtggtggtctttattgatgatattcttatctactcccgaaccaaagaagagcatgaagaacatcttcgccttgcattggagaagctacgagaacatcaactgtatgctaagtttagcaagtgtgaattttggttgtctgaagtgaagttccttggtcacgtcatctcagcaggaggagttgccgttgatcctagtaatgtggaatccgtaactaattggaagcaaccaaagacagtttcagagattccagttttctaggcctcgcaggatattatcgaaggtttatagagaatttttctaagattgctaagcccatgacacgactgcttgtcacgaccggaaataacccaacgggcgttcttacgtgcgtgcattaatccttgtcccaggaggcaaggtacaccaaaagttgatacaattcagagtttaacaagcggaagcgtaaatagttaatttattacatgggcagcgaaggcccagcacacacagagacaaacgagaaacagtggaagactagggcgacgaccacaggcacttgacggtaggcacgagctagacaccaaagccttcatcttctaggggctcctcttccggggttgggaaaaattgagcaagactgagtacaaccaccgtactcaacaagacacacccacaagtgcagaataaatgcaagggagtacaaaggagttatactataaagggttagggtttgcagtaaacagcatttaaaggtatttagttgctcaaagctattttgtaaacacgattctagaactatacaatattatttatcaaggccgtgaacccacacgaacctgccttaacccaaggcctacgatgattcagaccgaactggcaacccgaccctgggtcccagctcgtcccaagccaacccaggccaaccattccacattttagttgataagcaggttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccatggtatacagacggaagacgtgacatagtttccaacccatcctagccatagacaagagtaccgacccgatcccacctacggccggaacccccgggacaggcaggcaggactgagcccctagcagcaggacaccggccctgtgccatgacatctcgactaccgggccgcagctcgtgtagccttcatttgccctagagatgtcacccccgacttcgtccatctccatccgtgtacttttgtttataactagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcggtgtgaagccaattccacaacaaccaaaccattccaaagtgtccaggtgatatgaatattcccaaagtctagagttgtaaaccgcctaatgttacctaattaaattgcgaagcatctacctaaaattatactagtggtactatgagtagagtgtccactagttggggttttgtttattctagggtgaataaggtaataataacaataacaataataataaggtcataacaaaggtaaataggcatggctaaataaaacagtgataacgcgggaatttaaataaagcgataatgcaataatttaaatcaacctaattttgtaaactgggattcaatatgttcaaagatgatgtgacttgccttgctcgctttcccaaacgtcggcttcaacttccacgaagagcggatcttccgaagctgcagcgtctacacgaccaacggaaaagaaaaggcttttactctaataaaccccatataacaagcagaaacaaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaatttaaaatcggatttattgcgtcagccgaggggaggggcgcgcggaccgggtccacgggagtggggcccacgcagcagccccacggtccacggtggaccgggtgcacgcggcttacgccggccggcgccgtgggtcccacgcgtcagccgcacccgagggcgcgggcggctgacggccgggccccacatggcagccgcgggacgcgcccgaaggcggccacgccggcacagccgacgggaggcggagcgcccgcgcccctatggtcgccggcggcggccataggcacggcggagcggcggccgagagaggggagggaagggggaagcgaaacagcggtccacggctcaccccgggtcgacggcgacgacgggaatggcgaccggagcggaggaaggcggcggcgcggctcgggttgccggggacgccggcgttccggtggtcggcgggcgaaacggagggggtgacgaggtcggcgaggtcgcggcgaacccgaaggaggcgacgccgaagcgggagaaggtccggagcgacgacggcggcggaccggagctcggcggcgacggcggagagagagagcgacggcgcgggctcgattccgacggggagagagagcggcgagtggcggaaacggtggaggaggcacggggagtgtttatatagggttgggagtgagagagggcggccggaggagaaggaaaccggcgcggcgctctcgggctccatcaatggcgccggcgagatttgcgggagcaaatccgcccgtttgaacgagagagagagagggaaaaatggggggaaagggagagggaatcacggggagtgatttccccctctttattgcgcgcggggacggcgggaggcggcgggattcgcggcggcagcggcgctagggcacgggcgaggcggcgggagcggcgcgaggtaggggatgacgggtgggccccacccgtcagcgagggtggcgggcgggcccgcccgtcagcggcgcgcgcgcgggggaaggcccgatgggcctcgggggacaggacagagacggagggagctgggccgatccggcccaataggcggagggggggggggaaaaaaggacttttagggtttttctttttataaaaccattttaactttgtttatttcttcttaattattatttgtgctctgaaaattccactaaaatttatttacgcattttaggcttttaggaaatatacaaaaatcctccaagccttattcgacttttaacttcgcacattttaattgttggaggctttcacaaggattttacttcttctaagcataattttgaggatgtgttttagagtcgttttgggacgcgacaaacctacccccgttaaacggaatctcgaccccgagattcggaagaactggcgaagagatcgggatgggctgccttcagctcgtcttcacgctcccaggtagcttcttcctcggcgtggttgctccactggaccttgcaaaaacggattacccggttcctggtcctgcgttccatggtgtccaggattttcactggcttctccacgtaggtcaagtcttcgcgaacttcaatttgctctgagtcggcctgctcggatggcactcgaaggcatttcttgagttgcaacacatggaacacatcatgcacgttgcccaaggaggcgggcagctccaactggtaagcaacttctccgcgtcgagcaatgatacggaaaggacccacataccgaggtgcgagcttcccctttgtctgaaacctgtgtacaccgcgcaagggcgtgacccgaagatacacaaagtcatccactgcgaattccaggtcacggcgtcggttatctgcataacttttctgccgggactgtgccacctttagattatcccgaatggttctgaccttcgcttcagcttctctcaggatatcagtcccgaacacttggctttccccaacttgatcccacaatagcggtgtccggcatttgcgtccatacaacgcttcatagggtgccatttgtatgctggcttgatagctgttattgtaggagaactcggcataggggagactcttatcccaggtcttcccgaaatctaggacacatgcgcgaagcatatcttctaggatctgatttagacgctcggtctgtccatctgtcacgtcctgataaattcatcccgaaataaaaatcatcttctaaaaggaataatagaattaattaaaattcgaaaagaaattggcaaaccttaaaatacgtacaagaaaaattcaaatgtgacccggagaatttttgttaaattctccttggtctaaaaggagccctcaaattttagtggaattttcagagcacaaataataattgaaaagaaataaacaaagttgaaaaggtttataaaaagaaaatcctaaaagaagtcttttccccctcctcctcccttcttgggccggctcggcccattccctccctctctctctctctttccccccggcccatcggctcctcccccgtgcgcgcgccgctgacaggcgggcccgcccgccgctctcgctgacgggtggggcccacctgtcatcgccttcctcccgccgcgcccgccgccacgcccgtgccctagcgccgccgccgccgcggattgcgccgcatcccgccgtccccgcgcgcattaaagagaggggaattactccccgcgtttccctctcccgattccccctcttttccctctctctctccctcggattcgtccggattcatcccgcgaagttcgccggcgtcttcaatggcgcccgagatctccgcgcgcggttctcttcccgggcggcttcccctgccgtgctatatattcgatccccgtgcttcgctcttccgtttccgccgctcgccgctcgctctcgccgtcggtttcgtgcccgcgccgtgctcctctctctccgccgtcgccgccgacctttggttcgccgcagacgtcgctccggtcctccgcccgactcggcgacacctcaatcggcttcgcagagtggttgccgaccccgtccgccgctccgcttcgcccgccgaccgtcggagcgccgccgtcatcgtcatcacgagccgcgccgcagtctccctccgctccggccgccgttctcgtcgtcgtcgttgtcccggggtgagccgaggaccgccgttcgccttcccccttccctcctctctctcgggcgccgctccgccggccgatggtcgccggcggtgaccatcggggcgcgggcgcgccgctcccgtcggccgtgccggcgaggccgccctcgggcgcgccctcgcggctgccaagtgggcccggccgtcagccgcccgcgcccgcgggtgcggctgacgcgtgggacccacggcgccggccgccgccagccgcgtgctcccggtccaccgtggaccgagaggctgacgcgtgggccccacccccgtggacccggtccgcgcgtcccctccctcggctgacgcaataaataggatttttaattaaaaatttaaatgaagaaattcgcaaatatccatttaaagagcatataaacttcaaatggccatatcttggccatttgaactcggaattggaccgttcaagtctctaatttttccttaagaagtaaagaacccatttttgtgctttgttcctgcttgttgtttggagtttattagagtaaaagccttttcttttccgttggccgtgtagacgctgcagcttcggaagatccgctcttcgtggaagttgaagccggcgtttgggaaagcgagcaaggcaagtcacgtcacccttgagcatattgaatcccagtttataaaattattttgatttaaattattgcattatcgctttgtttaaattcccgcgttatcactgttttatttagccatgcctatttacctttgttatgaccttattattattgttattgttattattaccttgttcaccctagaataaacaaaactccaactagtgggtactctattcgtggttccactagtataaatttaggtagatgcttcgctgaataattaggcaaccttaggtggttttataactttagactttgggaattctcatatcatttggacactatggaattgttggattatggtggaattggacatacacctctctttctctttcaaaacccctaaaacctgttttcggtggggtttgggtgcatgccagttatgggaagtagcaccccggccactataaggattaagctcgggcctctgttgcaaagcactaccgtactaaccacatgtctaatgggtaaggcttaactcggtgctcagtctagtcctgaacaaaaggacacggatagagatggatgaagtcgttgcgacgatggatatctctgaggcaaatgaaggctacgcgagctgcggctcggtaatcgagatgtctaggcaaatgaagactacacgggtcggtgcccgttagtcgagatgccatggcactggactagtacgcgggtggtctcacccctatgtgtgtggcgcacccggtctagatcttgttgctaggggctcaaccctggcctgcctgtcccgggataccggccgtaggcagggttgggtcggtacttttgttcacggctaggatgggtgaagggttatgtcacatctttacgacgggttccaaggccatggaatgcggagtaaagatgtgtcttgtgggtaaagatgtacacctctgatcagagtaaatctattcgaatagccgagccctcggatatgggcaagccgagcaatgtacccaagtcagtgttttaattcttaaaatttgctcaacaactaaaatatggaatggttggcctgggttggcttgggacgagctggaacccaggtcgggttgccagttcggtccgaatcatcgtaggccttgggttaaggcaggttcgtgagggttcacggccttgtttaataatactgtgtagctctaggatcgtctttataaatggctttgggcaactaagtgacttttaaatgctgtttactgcaaaacttaatccctattattattcccttgtacctcccttgcattaattatgcatccgccggtgtggcttgctgagtactgtggttgtactcattcttgctcaatccctcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttatgaataaaactatttgcgaaagttcctttttctccttcccctaatgctatttgcaaaaggtttactccgttcttccttcttcggattttcaactagtactagatggtcagctttgcgaagaagaagatgtcgtcaattgtttgccgaagctccggaagactgcaggatccgctagtgaagtggaggaagcagtgaagccagctgtgaagcaggagtgaagatcttggagaacccgtcgcagaacctaagccaccctctagggtagagtcgttagtcgtgtgtttccttgtttgtgtgtgtagcgcgtggtttgcatcagtggggtgtgatgtaaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggtcagaagtcaggacattggtacctcaagctcccgagtgaatgaagcaccagacaccagttgtgtggcagtggtccaacacctgattaaccagaaccaattgcttatagagatactacagcagcatcggatgccaattttgaacccgagtcagatgcaacatcaagtgcagttggaggcagtccaagcactcacaccacaagtcagcgcaccgccaacatcccagaaggcccctcatgccatgccacatgttgacccaaaagaagcaagtatcatctgttttatgtgtgatgagcaagggcactacgcaaggaactgtcctcagcagaaaagaaaagcaccaatgcgaaccgaagatgaagtccgtaagatgatcattaccagcacagaatggcctccaccaggaatgacaaaacatcagagaagaaattcctcccgaggtgcacaacagttgacagagcatcttttagctaatggaggtagagtgtctggtagtgaagattcagatcaagtctcctcagatgatgaagatgcgaagtctccccaaggctttaaccagaataaaatagaacttaaggcatgctctcgttgtggagaaatcggtcatgttgccagctcgtgtgcctctacatgcgttcattgtgaggaagaccatccacccgacaggtgtccaacgagcaggatcacttgtttcttttgtgaaggaactgatcatgtaccaaaagattgtcaattcagttttctgctgacgaagaagatggccaaccaacccgccagttccaacggagagaagcatcaaggcaacacaaatccccgccaaggtcaccgtttcagcctaactccagtgccaggacagaggaatcgaaatgagaaaagaaaatgccgagtccgggaagacatctgttgcttcaattgtcaaggaatgggtcatttcgccgacaagtgcccaaaaccgagaaacatagctgccggcacgtcagtccacgcaactccctgcaatcagaagcttgctcctcaacgaattgtcatccatgcatcccgaagcagtcctatagcccgcgttgcaacagctccaattccaatgaatgcactaccacaaggtgtcaatgctcaatttcagccccagccaccagctgacaagacaggggccagtatctgcgttgtacctttggaagttccaatacagcagctgagaaatcaagtacaagatgaagaacccgagtgtaagaaagttattgtttgttacaactgcagtgaagaagggcattactccaaaaactgtccccaaccaaggcaaaatcgacctccacattaccgccaatttacacgaagcagacattccaatcgtattgtggtcactggagcaaacgccgtacccgtaaggcctcgtgttaatcagaacccatagcagaaacaatgcaccaatgctcctcctgctgcacctgactcggcaataaatcttagcaaccattctctgcatcgacagcctcagcaaagaattgttgtagatggaagaagttgtgtctctccccgacctactccaggcctagccaagggcaatcaacctccggagggcgataccaagcagaagaccgtcatccgcttcaaccagcaatcagaaggaagcttctcctgtgaatgatagcattatgcagtcctatcacatcatcacagaaccaatcgaggatgcagtcactggaacaatgccagctatatctctccagaatcaaaatgagcagccatgtttgtggttttcagtccgctacttatcatggtgtaatcgaaagtttgcagcaatcatgtaatacataaatatattcatgtctataaacagtgagcttgctatgcttatggatgattcatattgagaatacaatgtaccgatgttaagcaccgtccctttttgtttaaggcagtgcctcgtattcatgtaatgagggagaaatgtgtaatacagacaagttccatgaggattcgtttgaaagatgcggatatgtgatcatgtgtataattgtttactgacaaaggagacctagggtctcgtgtcagaggaactatattctaacctcgagttaatagccaacctgtggatggaaaagaaaaacaattaaactgtgttgggttaaaaagctaacgagacagtagttgaggataggagttcggatacgccttttacagatcaagataaggattgttggaggaaaccccgaagggtacccgccatacctctacattgataagatcggatatacctgccaacagataaggagatccaggagacatcaatatttgagaacataatagtcgatggttggtaattagtttatctggtatcagaaaaaggtcaaaggtgatgtggcagaagaacaatttggatgctccccatctcgaggaagcactaaagatgaccatcggcaattaaaccctagtggtatagatacagatagcagacaatgtatttccctgaaggtagtcagtgcagcttttgacgaaccacatcaaggtttcaccgaaaggcagcaagccaaaggacctcatcatccccagaagcgtccgcaatccacattcaagaataccacctgttagagataagccgaaagatgattgataaaagagattggcaaagatgttctctagcataaaagaagtaggccgaaaggtgattgataaacagaaacatgctctgcatcgctcaaggaagacccctgattgtaattgccccgcaacagtcaccttgtcattaagtaagcaagatgacctaggtaaaagtgtttctatgaaggcaaggagtgaaatcttcaactcggtatcagatgctacacgaagtgaaaagtgcaagcaccggttaccaggtaatgccaagtcttgggagatgatccaatgggaaagaacacatcaaggttaaaagtgtaaaggaatacgttgaatgctaactgaggacaacctgaagataataatgggaagtaaactgaatgtaaagaaagtgaatccgagctgcttgttcgtgagagccattcccagttatagaaccagtgatatgttcgaagatagtctatagaggtcaggttaaaatcacctctcacaacgaagcctcagatttgacagggtaatgattagacaataacaaatccagcagtaaagccatttgggaagacgtcaaagtataacaagtaggataagttggctctcttgggaagcataattcaaaggtaaagtta

SEQ ID NO: 31652 - DNA, 958 bp, Oryza sativa
cttgggttaaggcaggttcgtgagggttcacggccttgtttaataatactgtgtagctctaggatcgtctttataaatggctttgggcaactaagtgacttttaaatgctgtttactgcaaaacttaatccctattattattcccttgtacctcccttgcattaattatgcatccgccggtgtggcttgctgagtactgtggttgtactcattcttgctcaatccctcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagcaaatccaccccccttacaagaatctcgtccccgagattcgaggaggctagcaagaagataggttgggcggtcttctcttcttgtctgacttcttccgttgcgtcttgacgaacttccagcaaaactttaccactcggaactgcttggcttgacctcctgttgcggatggaatcttctcttcacctgacttggaccaggatgcaccttttggctgactcagactaggttgcggtagttcagtgatgcttccgttctagaacttctcatgattcatatcttcggagtcaacctcggacaagttatcaacttcatgtcatgcgtcgtaacctgcttgtcattactaggataccatgcttgttatttgcttctaactcgccaccaactgcctcatattagcttccctggtctccgggtgatagctacttctgctatttgatgcaagggtcgata

SEQ ID NO: 31653 - DNA, 10136 bp, Oryza sativa
tatacatggtggcggcggcatccaaggctgatatggcggtggatttggcgaccgcgcaggcagtaaacagagagagaaaaagagatggaggatgaaggaaagaggctgacacgtggggtccacttgagggcaaaattgataattcacaccatccatcatccatgcttggcaatcggattattctgcttacgtggacaaaaaaatggtataaaattaagatttcttctctctccaatggtaaattagtatgtgtaaacttaagagaagtacttggataattgccaaacgaaaaaatggcaaatagttaagttttctaccatgggcaatggttctgacctcaataaggcttgagcgacaccacttcgtctcctttctcctccacagccgcccatttgtgcacctggcctacaccaccacttgatccatccttcctctcctctcttctcttctcttccctttgtctcctctatgctaacggcgaagtttggcctcttctccgacaaaggccgagggagctcaagcttagacggctcgccagtcgcctccctcactatcaactcgtaaacggcgcgaggtggaaaagaaagagaagaaagaagtttgacactgatatgtgggcttcacatatatttctttattttttacttctcactttacacgtgggtcatgttttttattttctttttattgattaggatgccacgtcagcgaaaccaaccatccataccaccacattcattctgccatgagatctaatttaacttggtttagggatatgattttaacttcattgcatgtggacttattcccggtcgatatcccattcgaaacatgtgttgatgcgaaaacacacacactggcctgggagatctgcttagctccagtgcagatccaagggttgatgagatgcgggtatgtcagtcagtttgatcctgcaactaacaagatatgtaaacagcagatcaagtagccgatcggttgtcaagccgatgaagtgattccagccgatgccgataccagccgatagtgatagggttttgagatatcggctatatgtttgatgtagagtctgacactagatataaataaagacaatcggctgatgataatataatataacaataataatatctagtggaaaccaatcggttaacaatatgatatgatagaacaagcactgatccgatggttaaagcatatatcggctggaggtccgatgtcataaaatccacaagattagattaaacagtgaaacctctgttgcgatcggctgaaccctacttgtatgtaatccttataagccgatgcgacgtccagataacttatcggcttgcaccccgataaaacactaacatgaacctatcggcttaacaagatttatattatcaacaacagtctagtaggttgaacctaaccgatgcagcacaagattgtatatgataatctaatactcgatgagccgatagatctgtctaatgtgatggatataacaaatctatttacaacagcattgtgattgtagagatatatcggctaagacagaagatcagacctaactgagacagttccaactaaaccgatgcgtctctaaacacaatgcagttagagatagaattgagatatcaggtaggcaaatatatcaaccaaaccagagcgatccaagagatcaatgcgatgcagccttgaacaacaccaacttagccaatagattcacctggcccggtggaacgtaggacttaccccttcgctggagatcgaactgaaccgatgcagccccacgtcaggtgccaaattccgctggttgataagtaaaacctcagaaaaaagggtggcgatgcgctgagaatagttgtattgatcgaaagattgattcacaatgaccctgggtgtacatatttatacccatggggagatactagtccttgtaggacaagaaagaaactttcctaaagataaaaggaaaagataaagtccttatcggacattgaacacaccttcctaaagacaaaaggaaaagataaactattcctaattaatagataaactgccatgccatatcctccttgaatttggactcttttagataaattttctttagttgatcgaactccatcgagaacacaacttctggcgatttgacgactctcatcggctaatgccaggactctgaagccaatactgactctaagccgatgattactctgggcttaccaaatttcactgatagcaacatgttagaccttgtttggctaattccacccacaaaggtctcaatcccctccttgtgggaataaccgaacaagaccttatatatgccataaaagagtcgcaattagggatggcaacgggactgggcagggctgagttgggctggaatggccccagccccactcctccgcgggtccatccagcccctacccccagagtggagggagatttgaaatcgatccccgccccaccctctctggggacccgccacacgacgggggcttgctgcactcgcatgcaaggatgcttggaggaggcggtgcgaccgcacgtcacgttgacgagaggagatggcgaggctgaccggcggcgggtagaggcatgcctgcgtggaggtggagtgagatggaggccgcgcgatggcggttggaggcacggtgacgggcgaaggtggcgcgacgtgggccaaccgatggcggctgtgggggatgggtgacaggagtgggggtagaggatgggggatcgaggaatttgggtttagtaaatatggctcacttattgggtcaactaagcttctattgttggaatggactactttttaagacatatctcatatccagagcccccatcggtttactcgtgtatgactaatgatcttcatccccgtccctagaaatttgcggggccccatccccagtcacccatgggtgagaacccccaccactgccccgtaggggcggcccccacgggatccctggccccaatgtgaaatttgtcaccccaagtatcaatcccgttctggcccatgggccgcacgcgactgtaatcccaagcccacaagggcccatcaggccttcttaagagctccccgcgagtccaaacccgaaacgcgaaaaaacaaaacagaaaaaaaacaaaaaaaaaacatattatttatcgagcaaatgacacaagtttatattggtggcaaccgattactttatcaagtgggtagaggcgattcctttgaagaaagttgattcgggggatgctatacaatttgtccaggagcatattatttatcgatttggtattcctcagatcattacaaccgatcaaggctcgatcttagtgtccgatgagtttgttcaagttgccaatagcatgggtattaaattgttgaattcttcaccatattatgcacaagctaatgggcaagccgaggcgtctaacaagagtttgatcaaattgattcagaggaagatttctgattatcataggcagtggcatactagattggccgaagcattgtggtcctattggatggcttgtcacggttcgatccaagttcctccttataaacttgtttatggacatgaggcggttttaccatgggaagttcgaatcagctcgaggaagacagacttacaaaatgagttggcagccgatgaatattacaatctcatggccgatgagagggcgaacttggttcaatcaagattgagagcccttgcaaaagttaccaaagataacgatagaattgctcgacattacaacaaaaaagtggtggccaagtctttttcggaaggtgaacttacgtggaaattgattttgctgataggaacttgtcacgcccagaaattcacgaaccagaatttctaagctgaatgtgtattaaacccctgtccaggaccagccagggtacacaaacgacaattgttgacatacagatccacgtcttacaaaaatacaaaagattacaaatgcagcgaaaaaggtaaaagcgagctaagccaagacttgactcctgcagcgggcgattccattccacaggcaacccttgacggcagcgacgaaccaaccttttcaagacatctccaactgagaagaacttcaactctggtgtgggggaaaagagcaagactgagtactacccactatactcagcaagtcataccggaagaggaggtatgatgcaggatataaccaaaggaggctacggggttcatttgcataaagcaggcatttaaaaccagtagttgaaaacagtaaaaacagttgtagtaattaagcaatattaaccagtcactgtccaacgctacgccacgttgcaacaggcccaaccaaccacctgaactacaccagttaattaagctaaactaggggtgagactaatcatggtgaatctggtcgaccacccataaccgcgggcatggctattcgaatagttttactctgatcagaggtgtacaactgcacccacaagacacagccccacgacacgttcccgtgcgccgacatgccaccacgacataccggaaagaggccgtgacaggacccttcgcataaccctctctaaccgatcgcaccacaccttagggttcgcccccgtccccagcaggcaacgggcagcccccctttcatgccgcggtgaatccggaagccgatcaaccggacaccccggccgacccaactccatcacgcccaccctcgcctgggtacatcggctagagaaaagctacactacaagcccagccgttacccacgctggcttgtggtaagtacgataagttcttccagggcatcccgcgaaccggtccttaatcgccatgggcacgactagcaaaaccatgcacccacagcccaccatgtagtgtattttaattaaccaacaccattgcggtggcactaatccaaagctattgccaataatcaaagtctatgctttaatgtgatccccttttgtgcactagttgaactaagcttggctaagcatctcctaaaccaatatctagtcattttaatacccaagttatcaatggcgtaagggaaacaacatatagctgagtaaaaggacccatcccacatgatattgtaaaacaatgcaatatttaatagaaatgcgggacatttgtaaattgggtacaatatgatcaattgcaatgtatgacttgccttgctctcgcactgatggaaccacagtaacgtcttcgagaaaccacgaatcgacaaaacgggcgaaatctacgcaacaaacaaaacacacaagcaaaacatgctataagactactgaaacaggaaacaaaaccatttttaatggattctatacatttttatgaatttactgagacttgaatggactttatcggagctcggatgaattagttatgatttttagaagattatctgtgtttttactaataaagaaaaagccttaatgtatttattgcgcaataattcatcccaggactgacgtcagcaaggggtggggcggcgccgacatgcgggccccactggtcaacggctcaagggggagggaggggtactggcaggcggggcccaccgggcggcgactcatggggaaagaaggaaggcggcctggctcggctcggcttcaagccggctggccggttaaggcgagggcggcggcggcaagcggccaccgacggcggcggccggcgacgcgggcgacagtgcatcgcggcgacgagcatgcggggagcggcggcgcgcgcgggaggaagagagagggagttctgaccggggttcggccggcgcgggaggagacgacggcaaacggcgacggtgagtgaccggagggcgacggcgaacggcggccgagctccgggacaccctaagagaggaagtgtgagaggttatagggagagagggtgcccacgacgagcgagagccatggccgacggcggcggctatggtggtactcaccggcgcgcggggagaagcgggccccgacggcgggattggatggggatgcggcggccggggtagctttggcggcggcgaagctaatggcggcggcagattggctcggcggcggctccagcggcggcgagcggcgatcggaggagtggaaaaggcggcggcggcaggagcgatagagggcacgggagggagcggtggaaataggaaagggtggaggggattggagggatggtttatatgggctcgggaggggcggacgaggctgggaggcagccggatttctcgccaacgtggggaatagagagaaagagagagagagagagattcgaattcgaatctctctgttgcggggtgcacgcgctagtgggaggagtggggatggtgggcggcgacgtgggcgcggggcgcggagtggggcgcggaaggcgggggaggcgagcggcgtgggcggctcggtggttgccggcttggggagcggcggcgggaggtggaagaaggagccgacaggtgggccccacctgtcggtgacccggaggggttagggaggagggaggagccggcttgggccggcccagccaagggaaggccggcgcgggaggcgaatggactgggtcgacggcccaggaagagaggaaaaaggaggaaaaagaaaaagaaaaagaagaaaggatttttccagggatttaatattgccctttgctcattttaattggttaaaattattttcaaggctctgagaattccactaaaaatcgtgttagcatattttgacatgtagaatccaagaaaaattccacatgtcgattccgattattatttgcatttattaattagggattcatctctaggttaaattaaacaattacttcggacgatttattttatgaatttagagcaagggaggggaacttcagggcgtgacagaactcgagataacaagttcggcaagtggtcaccgaattgggaagggccgtttcaaattcataaggttgtgtccaaatgggcttatatgttgcaaggacttaatggagaagtctatggacgagcgctcaatggcaaatacttgaagaaatattacccaagtgtttgggtgaatgcatgatcggctggatgttgccgatgcatgttagccgatgtgtttacatcgccttcagatggccgatattgttatatcgcccttagctgttttcatactgtaatcagttgtgttttgccgatgtacaatggccgatattgttatatcgcccttagtttttttcatattgtaatcagttgtgttttgccgatgtacaatgaccgatatggttatatcacccttagtccaaattttaattttatcaatgccttcatcattataaaattaggggccacatatatacaagaagttgcaaatttttgagaattttttagcacattaagatctattaatcggcatagcagttcaattgcaaaaagggggtttcaaagtttcttagcgaactacaaaataagttatcctattacaagaccaattatccagacaagtaacgctggatagccgacacagcgcgttgtctaatttgatctacttcttcgatggcttggatgtcttgggcgttggttccagagatgactttaagggacttggtcatgtcagccacatttgtgatagccgatctcaatttagacttctgttcttcaacagcacttctgttcttcaacagcacttgggagattggctaacttttgcttttcaagatccaactcggcattgcattcttcaagttgagctataagatcaatcttgcgggcttaaagccgatctatgtttgactgaatcggcccaatagaaggatgatcaagcttggctttctcctcatgcatgagttgccgattggcttggatggtggcttcgatatctttccgctcccgccaatcggctatccgttacttagccttttccagcttgaattgatgttgttcgaggaatacagctagagtaatggtgtttgccagatcgtctgggattagggcttggatttctgcaaatcgtgcccgaattaaaccacagtcagccaccagattatccaatgatgactctagccgaagggatatatcttcaagtgttttcttgacagtttcatctagaggggctagagccttgcttgtggtttcttcctctatctcatcaaagtaatccttgatatcgaaagagaacagatcggctaagacctacaagagagaaattcgaagaaattaaatattaaatagatatagccgatctaaaatcttatgttaaggagagacttactgggatagcaggagcaattggttgttcttcttccccgacattatgacttcctgtagccgatggagtgtgatcacttgatgtttgttgtacaggaggtgaaggaggaggaggctgcaaaaaagacaagggataagtaaatatcagctatgatcagataagtgaaaggatttgtataggaaaatcttatcagtggagctggtttaagtgttgttgttgccgatttcttcttcacagcagtcttctttttctgaaaaaaggggatttataagtgatcggctatgaataaaatgattgcaaaaagaaatcatgagagatgtttacccttgaaaaatgagctggagcagcaggaatgggaggagtttgcttgggcgaagccgatggtgttttttctcctatatcactcaattcggctgctgcttgatcgatatcttcttcgatttcttcttcatccagagcttgctcgatggatggatctaaggtgggcaagtcatcggctggcttgggtttgtgcttcttcacgttcttcttaggagccagagccgatggatcaatggccgatgccttggtcttcctcttcctgccaacatcggttggttctctcatttgtccttgaagcagacttgaggtactgggggcatgatagccgatgactagaggagctaatccacctccgttaggtagaaggcctgcagcatattctatgtccctgccgctattgctcttgcgaggaggagaagattctgttgtctgcaagataaagagagaagttagtcaagattcaaatcggctaacaattattcaaacaaaattggctaagtaaagatgtacctgagggacaacatcaggaaataggtctgtcatgtacatagaagctaactgatggaatatatgttgcttccattctccccaccatcggtcaaagtttctgctcctaaaccttgccagctctatgttgtcaatgctccccaaagggggtcctgggatattgagtagccgatccatcatcagtgtggatgagatctaccctctgcattggattttatcggcaaagaataagccgattggtagctaccccattccaaattgcctagctaagctcatttggtgatagaactcataagacacctgtatgtttcttccttgatggatgccaacaggaagaatgcatggactaatggcagtcgagaagacttctctggatttttgatgcttttcagagttgatgtcctcaaacctaaagtctgccgggaggtcaaaattcactgagtcctcataagggaaccaaatccgagcatctctctggaatccctcgtagaaactacaaaaccagtctttgagtagttcggccgataactttgctctagaatcggctggtgttgatgcagcttcaccatatgacatacatcggcggtgagtgagttcttctccatcatcacctgtgatcggctccagcctcgggaattgtgcatctatcagaagtggccgattcacaaccttcatgacaacaaggttgagccatgtttgcagcagccaccatggtccacctgcacccactactgagcctatggctatcttggccgatgcattgctcaacatttcgtattgatagccaagaaggattttgcccaagagaaattgccttttggtttcaagggcttcggctaagaattgccagttggtagtcggaccacagctcgatccacaaaagagaaacttcttgagccacataatgagaaaggcagtgtgttctcgaggggtgacagatcccttgcccatgtatgctgctacatagccagacccgccccctatgctcttggtcctgaagtcaaactggttcttggtgtttaggcttatggggttagccgatgaagtcacatctaacacagtaatcatagtgatgtcgatcagagttggggtcattggcccttggttgaac

SEQ ID NO: 31654 - DNA, 4345 bp, Oryza sativa
gaacttgcttgctagccgatatatgcttataccacacagtccaactcttctcgggggaagttttctcaagagagggccaagacttgaacatgttcttccagtgacctagattcgggttggccaatctaaaaggaatcctattggtttcagcgatgatgaactcaataggatcagggttgccaatcggaccaagaaaatagtgatgctcatgcgacaggctaggaatcgcgaccagattggacagatgctacagatgcaaacaagaatagagaagaagaaaacaagatgagacaaagaagaaccaatctattgcgaaaggagaggatctagccgatggatacttacctctgtgtatttggccgatggcgcgatagacgggctggcggaagttgacatcgccacaggcggagatttggccagaagggaaaatcgccttggggtcatgtggtgcgccgaggggatcgccggagagagaaaagatgagtttggcttaagcggtgaaaacggaggtgacggtgtgaagtttcttaggggtgacggttagtatttaaagcgctgcggtaacggtcggaaaaacagcaacgagcgatattcttggagaagcagatatggcaaatccgaaacattaccaaatattccggacttggggggcatgtgttaacaaccaaatttggtaatttcagtatcagagacaaagataaaactgaggtggaatccaagatggaaatcgtttcggaaatagagaaaggatcggctaaagtccgattcggctgcgaccgtgatcggcagggtccgagttggacaaggttagtcgattaagccgaatccgacaatgtgacacggtacacgttgtcgggttgagttaatgtgcttcatgaagattgccacgcacggattgagtcctgagaaggcaattgtatctattaattaggatatttcatgtaatttctttagagatatatttgggcaaaagtctgccgcaaagacttatggtattttagagttcgttagagataagagtcgtgtctgacatggacatattttgtaatctcggggataaatagaccccgagccccatgtaatcaatctaacacacgttcaatacaatctcggcgcatcgccaccgttttactttcgtttgtttcgacgagttcttacttctgggtcgagctgcatcggttttgatcttcaactagaggtaaaacttgttatggcggcttgcgttctcgggattagtgcttccatctttatgatactctaatcctgtttatgtaattcgtcgagttatcatgtattctatataatcctgtgcaatattgttatttaaccttcaatcggctaacatctgttgttagaaggcgaccgatcaagttaaatatcaacgttgacttagattatataggatatccaccaccctatgagacaatcaacggcttgattatctagatattgtccttcttttcatacttatagctgcatcagttgagtttgatcttataagtcgtgattagaatctcaatctctagcctacttttggttgccaattagggtagcatcggggtttcagcctatcttacctgatttagcctcatattttatgtgcttaattgacatgctagatctgccctttatgttaagatcttgttgctcttaggtatattaagctccatgtttgatatattttacttgtgttaattaatatcttaatatagagtggtatcggagtattaggtgatacatgctagatctatctgatcggctatgctataaatatctataatctcgttgttgatatatatttcgatcaaagtgatttatactgtctcggcatggcgaccgatctatcccaatcactgacttaaatacatatcaacataaggattatataatgttaatatctacagccgatcgaatagatttagttctttcttacttatttatatctgccgatcgatttaaatatgacatcggctcggagataaatgatatctcatcggcaactggccgatcggctatcatttatggatttatccgcggtttctttatctttattccttgttgattgcaggatcaaatcaactggcacgctcgcgaacctaaaagcaagatttttggacctgcactgaaattaagcagaggcctcgtgttttcgcatcaacacatgcccgtcctgagcccccacctccaccgctcaggggacggacgaggtcgccacgaccctcacttcacgcgcatcggcctccaccctggccagccgccgtgcgagccaaccgtagtttgtaaaatggatttaaaaccttgtttaactgctatgacactaacatgtgggccccagatccttgatagtcaaattttgaccaagtcaagttgaccatagacccacctatcaatagtttagtgtttttccttctaaaaataaatgttctctaaataaaatactgtggtataacgctgtcactgaaaaaaaaaggttttcttccgaaaaataactcttacaaaacatagaataactgaacagggaatttttgcaattaatctgatttatttcaaatttaaatatttgaaatgccataactcactcgttttaaatcggatttcgataaaactttcactggaattcttctaaaacaagacattcccgatggcattggttggagtgccatggagtgcgagattaaaagcatacatacactgcagtgtgagcgtcgggacgtgtactagtcttgactagcctcataagttttaattctacttagaatagtattggaaacgattgtgtgacctctcctgacgtgtaggaaggtcagaatggtgagaaatgtgggaacctagatacgagggtaaaccgaaccaagtgaagcttggagaaggtggatgaaccttccttaattaacaacaacttcaacttttttatttaaaactgccaagtgataggtttgtgaaatctagctttatgttaataaaccaagctattctttgaaccccttatgtgtactaatgcattatgtagtattggcttactgagtacaggtaggattccacccgtacaaatgctacatggacgaggaggagccgaagaagatagagtagggacctaggtttctccagtcatcgcctgtggaataagatggaccatcgcagcttcttttccactatgtcatctactccttttggtgtttggtatggtaatcaaccatgtttggtcttttttatttgagttctactcgggcaactctagtattattaatgtatagtgagacctttataacgatgtcagttaaacatgatatgtaattttccatgtgtgtgcaatctactgatttataaaatagtattataaatacatgaggtctccgatgtacaaaacctagggcccacgttacgttcctatttctggcatctaattgcatcaccgtgattccctactagttaaacaatatcagatcgattaacaacacggtgcaattggcaaagcggcacatgtctggagctgtacttaactacttaatcgcgtgaacccaaattttttactactgacgaagaactaacttgatggggttgatccgtgagatgcaaccatgtacagtcacatgaacagggcacatgggtgattcatcaatattctgaacttttttgctgtttctttgacttcttgttgaaagtggatgtgaagctcgtcatattgtttgttgcttaggaagctcctcccgtatatagctctcaatcaggcgcagccttgacattgtatgacggttctttgtttctgcactatactaattcgagcatcatatagctaggctaggctccttacatgctttttccattcatgttgctaattaacagtgtcacacgcagacatctctcaatttcgtactagtgcagttctgttgcaggatctcctgaagattgatcgcaacaatggcacgagggccgatggatttgtggaaccagtgggcgacccagatcctggtgctcttgagcctcacgttgcaggttgtcctccacatcttcgccggggtacgccggcgcgaagctacgccggtggagaggttcatcctctggctggcgtaccagctggccgactcgaccgcaatatacgccgtcggtaatctttccctgagcagcaccgcacgagagcacaacctggttgcgttctgggcaccattcctcctgctgcaccttggcggcccagacaacatcaccgcctactccctcgaggacaacaagctctggaagcgtcacctcgtgactcttgtcgtacaggtcctcggagtagggtatgtcctctacaagaacatcgccggcaacgggatgatgatcgtggtggctgccatcctgatgtccg

SEQ ID NO: 31655 - DNA, 12276 bp, Oryza sativa
agcttgtacagcgtgacaagcaccagcatttctatatcaagtatgagcatcctcgccacgttggtgacaatcatggttccaatgatgagttgcttctgcatcgagctcactccttgttccacgtatgcgagcgtgggatagttgattctgtgatcatcaatgatgatgatgattcagataatcctgacagtaaagtaattggggaccttcttatgcaagataaagatcacaagagcatgtggacagtgatggagatggagctctccctcatgtatgacatcttgtacaccaaggcatatgtgattcacactagcttaggatacatcatccgcatcatggcgccgatcaccatcattgcctcactcttactgtttcatttcagtggcaaaggtggccacaaccgaatcgatgtcatgatcacatatgtcttgttgggcggcgctctcgtcctagagacgaggtcgctgttgagatcactttggtctacttgggggctagtgttcctctgtgacacacgctggagctggcttcgacatgtagctctctgcagcggaagatggcatcggcttcggtacacagttctctctttccgcagagcaatcaagattgttttttcaagaaattcaaggaggtggtcgggaaggatggggcagtacaacatgctgcactcatgctatcataagatcaccaaagcgacagcaagtcaccattggttcaagacgctcaacgatttgtccactctggtgggcttcgctgactggttggatatgcagcattgctgtcaaatctcgaaattccagacaaggtcaagacaactttgcaagatatgcatgagagatttgcaccaaatgatttgaacactatgggcttactgaggcataactgggggatgctggcaatgggtgaggacatgggcagcgggactcgccctgagcagttcaagaacctgaagaggtttcatggtgttgacttccatgagagcatccttatttggcacatcgccacagacttattcctcgctaaaatagggaaggaagggccaactgtagaggcaatcagggcgatgtccaactatatgatgttcctctttgtggatcgcccagaaatgctaccgggactcccacataaatggctgtacgagatgacaaaaaaaaacataatcgaatcatgcagagcatctaatggtttcactaatgaagtgaagcatggtgggcaaagatcccttaggctcaaacagacagagcaggtagctggcaaactactcaatattgacaaaagggaagtacaacctggccctaaagttcctcgtctcaggtatgcaagaattgttgctgacacactgtacaaatggaaggatgaagatccaattgatgtgttgtttgacctgtggatagattttctgatgtatgcagccaaccgctgcaatagggaatcacatgccaagaagctcaacgctggcggtgagtttttgaccatcgtctggctaatgattgagcactttcaacaattagcaaaagcaaaaaaggagcacggcaatgaataatgcaggttaatgtctatattggcatatgactatgagtaatattttactttttgagattttctaaggtcttagaaaaggtacggggacttatcatattgttagagtttaatcatactttattactttgtatgttagcctaaacatgatcatctctgtttaatgcgaaaattaatctaactgaccttgtttgtaaagccattgaagccaatttgctgaattcatttgcttgccgttcttgctttccttttctttcttcttctgcttttcttctgttcttcctctttttgctctactttgccctgagcttcctgctgatgcaaaaaaaaaaaaaaaagaaaattgtagagatacctcatgaaccctttacaacgtcgaatcgatagagcgacttaggtttagggttttagagtgaagagagagagagagagagagcgggtaacccctctgcctctcctccacttttaatggttttaataaatatattattagaaacaatctgaggtcaaacatgtgtttggagatgttgtctgaccatgcaagaggtaaagtaaagcacgattatatttttccaaagacaaatatacctatcatacttgtatgaaggaagtcaacgcaactcagtcggtttcgttactacatagtccctccattttttattagataacgttgttgacttttaaacacatgtttaattattcgtcttattcaaaaattttatgcaaatgcataagatataaattgcgaattgcgcttaaaatacttgaagtaataaaacaactcacaataaaataaatgataatttcataattattttgatgagatcacggtcaaacgtgtactatatgataaacgacattatctattaaaaaacagtaattaaattaagttacatcgtttttcaagacatcaaattagtactccctccgttttatattataaatcatttgactttttttagtcaaatttatttaagtttgaccaagtttatagcaaaatatactaacattttcaataaaaaacatattatctaaatatattcaatgttaaatttaataaaactaatttgatgttataaaatgttgctaatttttcctataaacttgatcaaactaaaaaaataactaaaaaaaagtaaagcaacttataatatgaaacggaggaagtacattgcaatacgtcgtctcatagtcatacacggtgtctacaaagcccaacatcataccatgtctcatataacagatttagcaaccattttcagagatggacgtgacttggcccagggataatccttacattattattataagatactttttccattgtatattataagtcgtttagttttcttgactaagtttataaaagaaattagtaataacaccaaatagttttattaaatttaaaattaaatatattttgataatatgtttatttaatcaaacttaaaaaaatttttaaaaaaattaaactacttataatatgatatgagtagaaattggagccgtttgttcaacccatctggtctgcttaattgaagaactagagccgttgacgagctttagtccacgcaagttctctgctcaccaaacctccttccatttgatatttttccaaagaagaccgccatccacttgactccctatagtctccgtcataccctgccataacactattcctttaattaatatttaatatcttcccctcctcttaatattataaatggtttaaatctttatcaaacttatttatgtttgatcaattttacagaaaaatatagctagcaaaatttttaatacaaaacaaatatactatcaaaatatatttaataaaaactaatttcaggtcatagttgttgctatatttttcgtaagttagttgaacttaaagaaaactagatttagaaaaaagaaaaacgcaacattagttaatagatttatatttggagatactttgatgtcataatattttaatggttttaataaatatatcattagaaacaaaactaaggtcagacacatgtgctttggatatgttgcttgtctgcccacgaaagatgttaagtaaaacatgaatatattttccaaaggcaaatatagcttcatacgtacttttctggtggaacttaacggaacccggccggttggcctctggccaacaacgacacgaaagacaacgacgcacacatgatagaaactgaattcattaactaatccccccttctccaatttattcattgacaatagttataaacttaggatgatgatcacatggtcacttgctgctgatcacgtgaagcagtgagaaatggtagtaataaaatctgcaaatgacaaatgaaagattattattctgtttttaatttatacatgtcgaatttgaacttggttatggagagttatattgtcaaaacttaaaacttggatatggagtatttaagaagacatacaacaatatagggatattttcttaattaagggagaaaaacatgtttacaccaaagtaggaagataactactcctagttgatacatggagttgaccgaatattttcacgtcttcctttaccatgtctatgaagtattgaaggtactgctcttgtccttttgtccaatatctaaaatccgtagtccacacttctttgttcattcaacgtacacttcaaccatctatatttcttttaaaaatttaaaccactatttgggttgctataaatattacatctcagataaattaagtaatactccatctacttctaaatataaaaacacttattagacatatgtttgacaattcatactattgaaaaaagttaagtattatttatttttttgtggtatattttattatttaagatatttttagcatgattatattttttttgtatttacacagatttttatcaataagttgaatagtggaacatacgtcgaaacatcatatatttatataaaaaatgaaataatggtcaaagctatatctccactatcaaaaaaagaagggaaaaaacaagaatagagatggagcagtacttcacgtcagaataatgtgtgactatgatgtgtgggcctataagaatggacttcatctgattaggtactcacgtagctgcttccataaagtaccaaccacatcggatgtggattaatatattcctcgaggggacatcacttgttgtttatatgttatataaaatagttattaaaccaataaaaaaaattaccaacatagatgaatatgaaatatatcactccgcaaacatgcataaccaaattcaacttgtacaagttgcaacaaaaagaacaagtttatcgcacgttcacaactatatttattatttttgttacaacttgtataagttaaatttaaacttgcatatttgtggagtgatatatttcatattaatatatgttgctaatttttttctaattttttaatacctatttagtggcatgaatgaaacgagaggatatctcatctagagatgaaatcactttctcaaccacggcaccctcaaccacatcaacttgatacagtcctttttcttactgctgtacatgtatgaaacttgcaagttttttgggattacacgatggacacttgtgagcaacttggttgttaaccatgtccatgtagacattgaattgaagctggcgcagccagcaacaatggcgggaggaggggtgatgcacctcctgaacgaatgggcgatcgagatcctgctgctggtcagcttctccctccagctcgccctcctcttattcgccgggttccgccgcgtgggcgcctccgccgggctcgggagctggtggaacaggcacgtcaacgccggcagcatcgtcatctccgacgaggtcaagagcacgtgttcggatacatccagaacatgttgaggggcgtggactccatgtcgaccaccgagctcgacgccatcaggacgacgagaggccagcgcgcgctccggcgccacggactccacggcgacctcgccgccagcctcggcgaggagttccaccaaggcatcctcacctggcacgtcgccacggacatctacctcgccgtcagcggcggcggtgaccgatcttctgcagccatagccaacgccggagacagggcggcggcggcgcggcggctcgcggaggccgtccgcgcgctgtccaactacatgatgttcctcgtcgccatccgccccgacatgctcccgggcctcgtgctccggaggctgtaccaggtgacatgcgaagacatggccagaatatggcgggaacgcaaggacacccacgaatcatcgtcttcttcctccagcggccgcttcatcgacgtcctaagcatggtcaccaagctgttccagctgcacgtcgacgacccgacctccgcctccaggacgccggagaggaagaagctggcggcgatgctacgtgacaacgcctacaatggcgatcagaatgtgaggagccatggcgtcttcgccggcgctctgctcgccgacgagctgctgctgaaggagaaggagcggcggatgtcgtcggacggcggcggcggcgggttgttgttgccggtgatcttcgaggtgtgggtggagatgctgctgtacgccggcaaccggtgcagcagggagtcgcatgcgaagcagctcaacagtggtggtgagctcatcacgctggtgtggctgttggctgaacacgctgggctgtatcgtataaacaaaactaagcagcattttaagtgtgctgaatatgctactgttatggtatagtttactgaggtagactctgtctcatttttgtttttttgggcctacaagtctgcaacaccggaacatcccaatggatggatgatttggcaggtatatatggaaaagtgatttcatctcttgagagcatatcctctaaaaaaattaaaaaaaaatacaagatagcttaatatgaaattaatatatcactccacaaaaatgcaaaggcaaattcaacttctagaagttataacaaaaataacaaatataactgcaaacgtatgataactatcagtttaatttgttctttttgttgtaactagtagaaatcgaatttggtcttgcatgtttttcttaatttttttataattatttagatgatatgcaatcaacgaggggacatactccggtatatatacatgggttaaactgggagtcaaatcaactccgttgattttttttccgtatatttatcctcatttttgcatgtcaattagataggtatcaaaaatttcaaaaaaaatattgatacgatatatcaatataaaatatatattatcaaatatgaaaaattcaaattcaaaaaataacaaatatgcatataaacagtacgtactatttacagtaaaatttgttatttttgtttctacttatatacgtagaatttgaatttacatgtttatgaaatgatatatttcatatcgatctatcacgtcaatcttttttaggcaacatgcacaaaaggaggggtgtgttggcaacttttttgacaagtcgacaagcacgatcgcaacacctaaacgctttgcggtgctatggagtcgccaaccacctcgatcttgccaatcggtcaaatcaagatgggtttttttagaaaaacagctaaaccggctagcggagccgatttagatatcaaaatcagcctctagaccaatttagatcaatatgaggataactatccgtctcatgggcaaaacggaaggtttccaggacaaacctacagagaggtgtcgcactctcgcagcggcggcagatgatttacagtgcaaatcgacaaagatggactaaaactagggtaaaatagaaaacatggtaaaagaacgatttaagtagattgtattcgggggattacaattgaaccggccttttctcttaaataggggttggtcttgccctttacaggccctcctccatgtctaactcgggatagaaaccaaaggaaacccgaaacatgccttcccaagcaaggaaactcgagacccgatgaaaacagacttgggctgggaccctgacggtctgaccggccatatatctgcggccagaccggccatatacctgcggtcagaccggccctactatctggtcagaccactcacatacctgcggtctaaccgaccctgtgaaggaaacccggcattttccaaacttttgcaattttcccctatttcgtccataggtgctaaatttgggtctaaacacatgccccccttttttatgaacatcgtgaatctaaaagcatagagcatattgtcttagggacgatctttttgctgaactgagccgccaaggtcgctagttccggttttttccagttcaaccgttggcccggtctgattttttcgtactatggcgtatataaggctcagagatttttctggtatgggtactcctctgtatctattaccagttggatggccatggcagattatcgtaaagaacttggcaataagtgatggtttctcgatatactaggagggcatagttatgggctattggctgcataattatacaatagcaagtgtagactaaaatgactatatattatatattataagtacataaatgattcttttcttattctttctccacttagcttagattattattttagtgagaatatttttgtttagttccttgtgtgtcaatctatctttatccctaaaatgattaatccctacattagactttatctatacaagagatatatattattagtatagtactctcttaccatatcttcccatggcattaaataaatatgttaccttggaatactttcaggtaaaatgctacagcggtatatccgagcgcttgcggattatatctgtaaccgtaaagaataccgagtaatatttcgagcatcattgctggaaattatatttctattaacgttgttaagaaatatcaacaaccatctcatagtgacttcgcttcaccagtactccattccttccctctgcttcttttctcttcctcaccgacactccatcctcttcttcacaggcactcaacgcattccacccgtcaatcttatgcctcttccctcaatatatacccaaggcagcttcattccattgacacgggaaggcgtctttgacctccaacaagtccttgacaacagcagctgcaatttgtcatcaacttctctcctccaaatgtctacaacatttcatggaacatgtattcgagtggacatcatttttattttttcaaatcgatccaattcccatgcacatacgtagcatggtcgtcccatctctcttctctaataccctctcaaacattcgctgcagggtctggtggtggcactaccacagggtgctggagttggagagacaaaaaagccagttggagaaccaaaactggcagttggagcaacaaaactctagactgtccagtgagaagcgtgacctggagagcagggtgaggaggttgggttatgaaaacaccaatctattagatgagaagatgagggtggctcatgagtcctcaagaaaggtctccgcactggagtaccgggtgcgggagttagagcaccaaaacaccaaactgtccagtgagctagtgaagcaacgggagaacacgaggaaggcgggccagctgttcatgaatgctgccgatacgtaccaacaagtagcagagaagcaaattagaacaaagaaagaggaattggcaaacacgagaaaggcaggcctcctgttaataaacgctgctgatacgtaccaagaagtagcaaggaagcaaattaaaacaatggtggaggacctggaggatgcgaggatggcggttttggtggtcatgaatgctgccgatacataccaactagaagcggagaagaaaattaaggataagatggaggaattgagggtccttggggtccagaaggcagaaatggatgcgagggccgcatctttggaatctgggcttaagacagctctagcaaagattcaggaattggaggctgactgtgataaggtgatgattgaaaataataagctttggttggaggttgagaggctcatgatggaactgagggtaatggcacacaagaaagaggtagctgcaaatgcatttggtgctgaaaaggcagaaactatgaaggaattggaaaaccatttgatgaatgtggaggaaattccgactagcatggatttgatgaaggatgaaaatgataagattcagttggagatcttgacagcaggcagaaacattgcttgcttgaattagatgtgttagtagaggagaataaagcatgctaaatcaagaaggaatccggggacatgaagggggaattgatggaaatcaagggtgcagatttcatgaaggctgaaaatgaaagctttggttagaggttttcactgcagaacaaaaacatagtctgccaggagcagaagttgagaggctcaaggagaatatttggatgatatactttcttgaaacatttatatctctatggatcgtccagaagctagggtggcccttttggtgcgacctgtttctatccacttgaaaacaataaaataaattggtcctttggaatgggtttacaatttttagaaataaactgtaaatgtgagattccttatcgtaatacatggagcaaatttatcttttcaattatatatgcatggctctctcacttgggtagtataaatacatgcatattatacctggtgaggattggtgtcctggtctattgatagaaggtcatgatcagcaaaagcatggacatcaaacaaaacagtacacgaggattttatacacgtttgggctctcaacatcctgttggttactatatacttcttccatctcataataagttcatttttaatttctttcatttgtcccaaaataaaagttcatttttagagtaatcgtagcatcggagtttgtgaaagtatattggagtttgtgaaagtagagaataattgtattgtgaatagataaagtgagaaatagttgtattggaatttgataaagtaaggatattctagtctttttgttttgtattggtatgttaagatagttgtattgtattgtgtgggacgcactatgaatacccttatgttcaccgctcacgaccccgtcgtcattagacctgcacgtacaccacatggttcctgtcacgcccggaaattcactagtaatttccgaacttatttgtgcataagatcctcgtccaggaatcaaccgaggtacacaaactgacaatttaatatacagattcatcaaattaactaaaacgataaatacttacttataaggcacttagtcctcatcttgaagaaaactgcagcggaaaataaaatctagcgaagctccggctccactcccacaggcagctcaactggggtttaagccaaacgtcttctccttctggatcctttttcttcaactgaggttgattgattattgcaaggtgagcatatgacatactcagcaagccacacagcaaatatgcaagtgcacaaggataccaaaggatggcataatataggctcatttgcaaaagcagcatttagcaaaacatttaagagaagtaaaacagtggagtaattaattagaaattttaatcaacactgaacaacacacccgtgctgcacaggcccaaccatcctgaacaaccatacccggctgtacagatctaactccaaaccaggagctaagcaaattattaccaggtataacatctataattattgtgagaggtgtgagactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcataacacaactcaccatagtgcaccattcctggatcataatcaccccctcaaaaaccagaggcatggactccccagcgacccccgtgggcttatctccgccacttctcagtctggtgctccgcaatgaatcatgctatacaaaaggtaaagccgttgcccacgctggcttgtggttggcacggttaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaacaacagtgagtcatgagttatcccaatagtgtgctaatgtttctaagcatggctaagcaattatatctaatatctagttgaaccaatatatataaagctcaattagtcaaattataataacccaaggtatcaaggattaaagtaatcaatgcaaacaggccataacaaaggaatagattcacaccacccagtgacattcgaaaataaatgcacagttgaaataaatagagaatttaaatatatgatcaacatgtttaaaggattgtgtttaggatctgtgtgacttgccttgcaataatcggtcttcaattaatcttcttgaatacttccggcgcactcgcgaaccttcgcaacgatggaaacgacaagctaacacgcaaaacgaagaaaaagactaataaaaaccaaataaacaatacataaaaagtaaacaaacatgtagatcataattttagatgaattatgagacttgaacggcctcattctg

SEQ ID NO: 31656 - DNA, 4609 bp, Oryza sativa
acgacgcgaacggagggcaccaacgggtagagggcgacgaggcgaactcaccggtgaccaaagcggcggcggaagagcacggacggcgccggcgacgaggaaaaaacggcggcgaagatcgggtcgacggcggcgacggtgctccggcggtcttcggcggcggtgaagcgacagacgaggacggcgacgacttggcgatcccgacggtggccttcccgagtgacgacgacgaccgaagcgacggcggcgcacggctggacgaacggcggcgatggcggcgcaaaagctcacggggctagggcgctacacatggcgagagacgaaggcgagggaggcggcgggtagaggagacaccgggggtccttttaaaggggctaagaggcggcggcgaaggcccatggcggccggcggcgagaaggaaacttcgggttcgggagagagagaggaatccgattcgatctcgaatccatcgacttccatatcgaattaggcgacgattccaaaagagaaaaggaagaggagatcgaggagattatttcccatctatcgattcggccggagaaggaaagacgcggccgaatttggaaggagacggcggcgcttgcgctagggtttcgggcggcggcggcggcgcgaggaggaagacaggcctgacagacgggccccacctgtcagcggctgagagagagaggagagcggcggctcggcggattgggccggactgggccgagggaaagagagagagagagggttttgggccggctttcggcccaaagccaaaagaagacttttaaaaacttttttcaatttaaattattcatgaaatgcaattccatttattaaaaatacttccttagctcaaataaatcccagaaaaatctaggaattatagaattaagcaaagtatttaacaaaattttatctagcccaattttatgttgagatttaacaaattaaaattagatcttctcttttaggcttttaaaatcatttctaataattccttttaaacaacaatttataatttaaggattttaaacaagaaaagcacttaacaattataattagatcattattgatcaaataattactgaactgttctttgtatcatttaggaattgagctctgaaaaatccgagaaaatctcagagagttgacttaaacatggagaatttaataaaaattaaatccatccatgctttatatttaggaaattttatttcccacatttaacttcacttgtaaattaaagatcatttaatatgaattctaataataatttattaaataatttataaatcctgaaacgaaaatcaggatgtgacagttccacactcgttggttgtgccctgccgctgcagcctccctgtcaccacagatccgcgatcaccgcgtacgctaagcgtgccatccatggatctatcactcgatctctctagtcgttttcggccacgctcggtctcgtctttcggccacgttccatcatagcaggtctaatcatcagtgaggtcatcgcctctacaacttccttgttgtcgccatcaatctcattgccatgactgatgattttctgtcaatgcacgaccgcacttcatgtttcttccttcgcatgtcttcttgatctgatgaaaccttcggctctattactacttgttataaaagttagttgatatagcggaacgacgactaaccttctcaatagcttcgtctattcatcacccaagacatgccagatgacgatataggaacacaagatatttgttaacgaggttagccgaaacctaatcccaggggctctgattatgggcgttcctccccaataaatatagcaccttagctgccacgagtacatggcctcgtcatcatcatctccctgcatgtttatcctacgttgtagtctacatggttatattgtggtgcccccctctctatttaagaaagatttttgggttacagagtgtgactctaactatacccctaccacctattacaactataaatccatttgtaaccaaatagaactagtatattcgatacttattctaacaatacgaactaatgatcataacataattgggtggtatagtctttttagtcttcttttttgaaatagaccgttaacatgtcatatgggtaacgctagtccaaaattggtgaccaatcgacttatggattgaatagagataattgaattgagggaataaaagcaagtgttacactgaaacaatctgaaccgaccaagttaaatcgaatgggcagtggccaataacaaaggtactttggagcgctaaattttgatctaatagataaaatttattgacttgatgttgtgcaattaaaagaaaggaaaatagctttaattgcatccaatggagatgaactttatacatatacatataggatatgcaaaaagaatgatagatgcaagaatttccattttgcctttctttaaaagaaagggaggtactagctagtacaataccttgggtggaatataatcattatggctttgatttcttgcaatcgaagcaataagaataatgagatcgagctatgtcgcggaacggaaagaaaataaaagaaaacaaaaaaatatgccagcatcaaaatagcaaaacatttgatgccatgcgattgcagtcattgatgaacgatcgatatatctctgctgatttaatttccaatgagaattcatttgtttctttcttccttctgcatatattgtttttttttctggtgatttttctcctttgttgaattactagcactcctctgtccttgtttaattttctttgtacaaaacaaaacgtatattcactcatcactcttccccatcgacactccatacctttgctgaacccacacttcttctcttctctcccttgattcttccctcttcttcaagggagtcatagatacttcatcctctagttctccttctcttgtataaattttcacgatgcaacttcggcagaggcaggaaaacattcatcatccttcagcgggtgcacagcaagacagcgaggcatcttccacctgcacctttgtgacaacaacgaccgacaatgtcgtcgtcgagcgcatcatggtttgcgggtgggcaaagacaacatcttttttttccttctgcgttgtgtggtggtcatatctctcttctctcctcgaattacttttacggtgatctcaaaaggttgccaacaaatacgttgcacgggctttttagtactattatacaaaccgtatgattttaattatgtgtcgggtgtattggttaaaaattttattttctgtggaaagattaataaattttattagtcatttaacataaataaaacttggtgataaaaaattatatagaacatgttgcaatattccatctgttgctatctgttttcttaatttaattgtttaaattttttgaatgagtaagtactgatttttattcatatggtactctcagtatagtttttgtcttgacttcattcagtaatttaaaactaataattaagtactgagtattgtttggcgccttgtttatagcttttgaatcatttaataattttgaattctgtatgtaacatatatggagttgtatttggcttggaatctcaagtatagttcttccatgatgtcataattctgtgactggtattaataagtacttgtaccctgtcaaaaaaaaagtactgagttgtactccgtttggagtttcaattatgctttttcttatgatttaataatacagaaatttataattagtcattgcctatttgttattgtattgaagtcgttgacattattccgaaattaggaaattaattattacaaaattaataataaggaattttagaattaacaagtatcaagctatactaagtatatccttgatttaatgatccttaaattcaaattgacaggtacggagtagtatttgtggtattatattttgaatcttgtatttcttcaaaattgactaacatgtatttttgttttattttaatctgatttagctgatatttgcgtgtttattttcttcggaatttcagttacatgtattatattttactatatcattctaattctacctcacagccagtggaaggccatattatttttcctttgtcctaactaatgttagaatttgtcctaattaatgttagaatttcttataggcctaacttttttaaagataatatacttcctctgtcctagaatatttcatttctaccattaagttttatcaaaaaaaatattatatttctaatgaggtgggacccaataaattaattggatgaagattgcattgcctcaaccttcactttaatcaagtcctctaataagattattgtggtcatttgtgtatgctgctaatctgagattcaattattctctaactccatactttttagcaaatgatactaggaaaaacaactccgccaaaatgtgctcgagtaattaactaataacctactctgtcctgttccataattcttgacattttgaataataacacggtctccaaaatatatattttactatgtttttctattataatatatacaataaattaggcaaaatttgccctgggacacctataaattgtgtaatt

SEQ ID NO: 31657 - DNA, 4913 bp, Oryza sativa
ttagctccgtggcataccagtgctccgcccgtgctgtgcctgcgcctcgccgccgcgcgtgtgccacaccgccatgcctgcactgcaccctcgtgcgagcaccacgccaccgcgctgcacagcgcctgcgctgcccttcaccacgccgactgcgcagctagggttgggatgggaaatttttcacgagagagagagatggggaggaagggaaggggctcctccacaatctccggtcaagcagagcacaagcgtgctagctctcccggtggcttgcctcgccggcggcggagacggcgacggtgcggcgcaggatggagccgcgggtggtgttggtgcttgcgctggtggcggtggcggcggcgggcgtgccgtcaatggaagcgccaagcggaaggggaagaagagaaggggcaaaactgtcattttacgcggtttctctctcatcaattcagtggatattatattttaatgtgcccagtgtcctgtggcaaattaccacacttttagagtgtcctcaggcaaattcacgtttttcgggtgtcccccagctaattacataacttttgagtgtcctgtagcaaattttgccaataaattaataaagttagtttatttttattgtagtacattgtaagacaaatttatatatgttgttttaatacctttaaactaaatagctttaaagttactgatagtcaaagttataaaagtttgattttaaccttgttctaaacgtcaagaaatatggaaccggagggaataccattttcgcatgtgcccgctctcgactaatctcggtatattacgtactcgtacagtgatattagtatattaaaagaaactccttgctctttgtcttacattgcaactaattatgctactaaatttttcaagtaaaaacgtagtgcaagataatgtgatgaataaccaacaatcttgtattcaatcaagctgtataaaagggaaatttgtaaatggagatgtttacctgagaaaaacataattgctgcttcgtccatcatgggtgaacgtctgagattatatgcaaatgcgaacatgacaccacggcatggctgcttagttgctttcaatagcaattccgaatattcatatgggtacagccgtacatgagcgttcaatccaaatattacgtatggttatatacctttgaattctgttccacgcatgctaatttaatttctgtggaaaagattcttacaatatctatagacaccggtatgattagacttaccatcatgatgatacgatccacataaccaataactagatgtttctgattaatatatatggagctcgtagaaagtgtcaaattagtataggtatagttatactgatagattctactagcagtattagccagtacaaatggcctcaatggttgatttattagttttattaccagtagttatttatgatgatagtataaatacatatgatctattcgcgattctaatgcccctctaaaacatatgcgcagagatcttcacagatgacagggtgaggaccctatcacaccaagtctccacacttggggacagggtgtgggagttggagcacaaaaaccccaggctgcttggcgagaaaggtaaactggagaagcaattggaggagaccaaggccggggttcatgcccatctaagcgagaaggaaaggtggagaggagcttgaagggtgaaaatgataagcttcggttggaggttttgaccccggaggaaaaatatagccagtctgcagcagaggttgagaagcttcagaaggaattagttgcattggcagaggtgaaagaggtagctgcaaaggcatttgatgatgagaaagcaaaaatgatgatggaatctgtggatcttaagagtaggctagaggaaatccagggtaacatggatatgattaagagtgaaaatgataagcttcggtcagaagctttggttgcagagcagaaactaaacatatgtgaagcagagattgagaggcttaagatggaattgggtgcattgacagaagcgaacgaagcagctgcgaaagcatttgacactcaaaatgaagaaatcacgaaggagctagaggatcttaagacaaagttggaggaaatcaaaacaaataaggatctagcggaaagtgaaaatggtaagcttcggtcggagcttttgtcagcagaggagaaatacagccagtctgaagcagaggttaagtatcttaagcaggtaatgggagcagtggtggaggcgaaggaggcagctgcaaaggcatttgctgccgagaaggaagacattatgaaagaatcagacaatcttaagaggaaagttaaggaaattcaggatagcaagcttttggtggagagtgaaaatgatgagcttcggtcagagattttaagtatgaagcagaaacatggtcaatttgaagtagaggttactagcctcaagaaggagctgggagcactagaggaggcaaaggagatcaccacaaaggcatttgaggttgagaagacagaaatcctaaaggaattggaggatcttaagaggaaggtggtggaaatccaaaccaacaaggatttagtggaggtagggaatgataaacttcggttggatgttttatctgcacaacagaaacaaagcatattagaagtagaggctaacaatctcaagatggaattgggtgcattggtggaggcaaaggaggtggctacgaaggcattcgacgctgagaaagcaaaaataacgaaggaattggaggatgttaagaggaagatggaggaaatccaggtcaagaaggatttggtggagggtgaaaaggataagcttcggttggagatattaatagcggagcagaaacatagcatgtctgaattggaggttaaaaggctcaagatggaacttggtgcattggcagaggcaaatgagacagctgtgaagtcatttgatgctgagaaggaaaaattcatcagggaaatgggggacctcaagaggaagatagaggaaatccaggtcagcaaggaagctgctgaggaagtagggcgcaacaagaatgcagaggctgataggctgagggctgagttggtgaagatccaagtttctttatcgcaactacaagcatcctataatgaacttgatgctaagcattctctcctaaatgatgagaagaattcagcccagaaagcattagatgttgagaaggttgaagcatataagctgaagtcaaaatttgaggaacttgaaaattataaggctgaaaaggatgaagaggctgggaaactgaaggcggcattggaggaaaagaaaagtgagattgatgtcctcatcaaggacaatgagttgctgcgtctcgcaattgctgaggcacaggaaaagaataagggaagcattttatcatgcttatcaccatgcggctccaaataattaggtcgggaatgtgttgcattaataatgtaatggtgatcaattaatactatgcaatgaaataaaactttcacttcctttgttatatgtgatatgcaagaatgctaatgttcttgattagtcaggtacattttgtgatgtctctaaactgagtattttggtaaacctgtcaccttaactattactccctttgtcccaatttagagggcatgtaaattttttgacggtgtaccaatttaaagggtgtggttccttttccactgcttttcttcccggagtaccctctgcattcatgcacatgacgcttgcacatgcccgcgcaataagggtgtgtttggttcctcgcatcttcctagcatggcccatcttcctcatccaggttgagtttatcctgttaagtggatacacacgcagtcgtttggttgtttgcatcagtctagcctggctcgtaccagatattgtttggttgtttgtgcgatagatacggtttggaagagaatttgtttggttgattttatgagccatatgtatgaggactttttttttcctgtgggtgagattaccgattgcaactattttctatattaatatttttcttctggtaaaactcataaattgaactaattgtctaaactagatttcggcaataataaaagggggtggctatcaagctcgagaagtgaatgggtttggagacaaaggatttatacaggttcaggccttctcattcaagaagtaataccctactcctgtccggggatgaatccgccgagtatcttattgattgtatgatttggagaaaatcaacacatgcccctagaggcacccggaccccccttatatatgggaaggagtccgtattacaaaagataatctatatccctaacggaatatgcagatacagataaaatacagtcgtaaccgactaagtctcaaggtatttccttgatgtacaagttgagaaacaaacccgagatacaaataagatattctatctatattcggtatcctatattcagtccaaatatcatcgccgtgtagatatgggacatccataatctccacagtagcccccgagacctttgcagtcaaccatcatagccttctcaaagataataatccgagtgcttcaaacttttcatgccaaggcctgccgagtagcgaagacgaagactgtaaagggcgaaaagataaagaatatggtgcatcgaatagatgcacctaattaggtgtagcccccaactatgtgattagttaacaaactaaacatatagttgagaacaaaataatagcacaatcgtgcatcatatgacaaaagcatacacggcgcctaaagaggcattcttagccgactgctttttagccataattaaaaggaatccgagtggttaacactctaaaaggttcacgaatgaacacacttgacaggcatccgaatagaaaactctaaagattacccaccaaatattataaaaattatggtaatgaataagtctaata

SEQ ID NO: 31658 - DNA, 13936 bp, Oryza sativa
aagttaacccatacagcttttgtagcctaaaaaagcttacaaaaacagcataacacctttctgtcgggcaccttttaatttgcattgcaataattccaaagaattatatgaccgcgtaaaaaggattttatcagcattgggcaacactattgtgcgcataaattgccaaagcaaaaaatgcctaagtccctaaggagcacaatgggccacgctgttaaaagtactgggctgaggtactgttcaggcctaagcccattcgcacctccgatacccttaacaagaaatcccgtgatccaagcgacacttcatcttccccgccggaactctcgccattttccccactccctgctacagtacagagctgcgccggcaaactagggttcaccattccactcgaatccaccttcgaaaagttcatcaaaatccttcccgtgatccaccgcctcaatccctcacctctccctagccatccctcgaatcaaatcagcgcattcggaaaaaatcaatggcggaagagaaggaaagctttgaaggccaatgggcgccatccgacgtgacggaggagaacctgaaggagatggtggcgcacggcgttctccctgccaaggaaatcatcgggtggcggccagcgtgcggtgaggcttttccgacccccgatacacacgaggctgtagtcttctcccatttcttctatggcggcttcgctcttccgacctcaaaatttttccgcgggatattaagcttctatggaatcagcttgcatcacctaaacccaaattccatagttcacatcgccaatttcgtccatgtttgtgaagccttcttgggaattaagccccacttcgctctgtttcgccgaatcttctttctcaagccccaaccaaacaagagtaagccatgtgtagtcggaggggccggatttcagctgagggggactctgagccagaagtacttctctatgcccttcaagacctcaaacaaagggtggcatgcaaactggttttatattcagaatcctgagcctgctcttcccgagtactcttgtcttcctccggtgtaccaagatacctggaactctcttccgattggggatgaagcagcccaagccttggagctgatggatcgcatgctaaaactcaaagaacaaggcttacaaggagagcagattactcggcacttcatcaaatgccgattggcaccaattaaagaaagatcccgtacggtattcgagtttgacggcaagcatgatcctaatcgtgaagaaccagattctctggattttaaaatcatgaaggagagaatgtgtaaaatcttctcaaatgctattgtcgtcagctactcacatcagctgccagttgtgccatataacgcattcaatccgcctccgcaggtacgtatccgaaatcttcaacctatgaccaaaacataatcttgtcttcatgttgagttaactaaccgtggaggcatctcattcaggaatatgtattgatgaagtctgaccccccaatcactcagcgccggtctcctcgccagcacaccgttcagggaggtggagggccgacaatcagatcagatccgcaacctcaaatctccaatccgactgggcagacaggttctcgcaagagaaagctggtgcttaatgatgacgaaggcgacgacggcaacaaatctggggacaaaggctcgcccaataaactcccaaagcataccactcccaggaaaaaactggctagtcgtccaaggccaaagattagaacatcttccaggtataaacctcttggcaccatttcacttcaacatgcttctctcatggaaataatactgaatattgaaagaacactttgcaggaaaccatccgacatagatccaactggaaaagatcctgatccgactgtgacagaaccaagttcatccaaggattctgagccgactgccgaaagccagccgactggcgcccatacttcaggtgataaggccaatccgagtgaccagcctccgactggaaaccagtcggcagcaactgaaactacaacaacccaagagcccccgattggaaaccagtcggatgtaggtccagatcaagaaactcccgaagttgaagcgcagacgacaacttctcaaggaccagaggctggtaacgactcgatgattgggtctccagataaagaacaaggatcaccccacgctcagctaggaacatcctcaagtaactcatcttctcaagtgatgccgatttaaataacttcagcttattcgtctaatatcttggaaatacatcaggaccaccaggcgatgacgaagaagaaattcctcgcataaaggcggctgatgactctcgtcctcctatcttgctcaaatggtgggacgagaactcacaagctgccggcatcgtcataaatcgtcaaaaagaagatgaggaagtgtgccagctgaagaaggcacttggagaagccactcgcattgtgaatgtaaatcttccgggtgactgcctttgatgactttgttttctcttcagcaaaactaaaccatgaaccatcatgcaaagaatccatcttcgcaatgaggccaagaccgcaactttagaaaagctggttcctcatttgggaactcttgaagcagttagggaccagctacacgaggccaaggagctcgccaaaaagacagagaaggaattaagggaccgaattgctcagctccaggattcaaacttcgagctgagtggttcatcaaaaggtaatctctagatctgtcccattaatttacgctgtcgtaactgtatcctcaaccatttggatttcaaacagcgcaagccgccaggatggctcaaatggagaaacaaattgaagccctggaaagagacaaggtagaactggctgcgcaaaggaactcggccttgaaggaggttgaaggtactgccagctgacaatctgaacttctctctttttaatgcagtagatttttatcataaatgtgttttgtagaccgcaaaatcaaatctcaagctcaatttgacgtcctggttggtaagatcaagaggcttgaaggagcaagagatgaagtcgctaatgtcgctacaccactcgtccaagctatgttcctcaataacagtggtccgagtgcactcgacgcaaccgaaatcttcgacaagctgagagttgctccggatgtatatttcaagaatatcaagaaagctggaagtatgggagctagcacggcattggcgatgaccaaatccttgtacccgaggattgaaattgacgccattgatggctttacagacgggacaagcgtagaggctgctcttgatcttatcagcaatgctcaaaatgcggctgacaagattgcaagtgacgtcgtagatcaattccgcaacaccgaccttcagccgagtagtaataactctgatgatgaaaggattgattctgactgagcataaatgtagcaaatggaggcataacttgtacaatactggtgtatttatgctgtgcttgataattctagccaagtctttgatttcttaaaagcttttatcaagctttgttgagcctaaaacccaaagaagctattaaaaactttcagtcctcgcagactaagtagaaaaatcaaacaaggcaatgatagaccaaggaagcaaattgaattgataaaaaatcacactccgttattatgatgatagaccccgactgacaacttcaagaagaaaacttgatgttgacagtcaagatagggaagtacagtgataagcttaagcgtagaaacgacgaagatgttcgatgttccaagagttgtcgacgagtgtaccgtcttcgcgcttgagtcgataggaacctggccgggtgactgcagagatgataaatggcccttcccatagaggagataacttgtgccgatctcgtgtagtttgaattttcctcaaaacgaggtcgccgactagaaaggcacgggatcgaacattgcgattatgataacgtcgcaacccttgtaagtatcgagccgactgaatcaaagctgcttcgcggacttcttccagtcggtgcaagtcatccactcggtcctcctcgtagcgttcttcgcggaaattacgaaagcgcaaagactcgaattcgacttcactcggcaacattgcttctgccccatagacaaggaaaaaaggtgactggcctgtggcccgactgggtgtagtacgcaaagaccaaagtactgatggtagctgttccacccatttaccggcatagggttttagccggtcaaaaactcgcgctttaatcccttgaagtatcatgccattggctcgctccacctgtccattgctcatgggatgtgccactgaggcatagcaaatcttaattccaaagtcttcacaaaagtcttgaaaaactccgccagtgaattgtctgccattatcagtgatgatccgattgggcactccaaatctatgcacactgttgatgaagaagtctcgagcgttatctgctgtgattgtgacaaccggtttagcttcaatccacttggagaatttgtcaatggccacaaagaggtgcgtgtaaccgccgactgcctttttaaacgggccaaccatgtcgagcccccaaaccgcaaacggccaagacagtgggatggtctgcaactcttgagctggtagatgaatttgtctggcaaaaaactggcaaccttcgcacgtgcgcacaattttgtcggcgtcggacactgcagtaggcaaaaaaaaccctgccggtaagctttgccgacaatggtgcgtgcggcagcatggtttccgcatatcccagaatgtatgtctttcagcaattgtctcccttcctctaaagatacgcagcgttgcagaatccctgaagggcttttcttgtacaactcagcttcatgcataacataaagtttgcttcgtcttgaaatccgctcggcttcatctttgtcttgggggagttcttgagaagtcaagaatcgtatgaggggctctcgccagtcggcttcaaccatagctacgtcatgagtgcccgcaacttgagtagtatctttgtgaggtactgtcggcgtataaaggtgttcgacgaaaacatcggagggcgccacctcgcgcttggatccaaagttggcaagtctgtcggcggcttcattattgtgtcgaagaacgtgactgagctcgagtccatcgaacttgtcttccaatttgcgtacctcttgtcgatatgccatcatgttgtcgtcaaggcaggaccactctttcataacttggttgacgaccagctgtgaatcgcctcgaactattagacgctttatccctagggagatcgcaattcgcagtccatgaaggagcgcctcatactcggcgacgttgtgggacgccgaaaaatgtatccaaagcacatagcttaatctttctccagctggggaaattagaaccactcctgctccagtgcccgaaagtctttttgatccgtcgaaatgcatggtccagtgctccatcttctccgcgggggtatcctcctggcactcggtccattcggcgataaaatcagctaacgcttgggacttgattgaaattcggggcttgaatgatatgtccaaagacatcaactccaaagcccacttagcaatccgtccgtttgcttcgcggttgtgcagtatatcaccgagtggaaatgatgtgaccaccgttaccgagtgaccttgaaagtagtgagatagcttcctggtagtaattagaataccatatagcagcttctgaacctgagggtacctcgttttggagtcggctaggacctcgctgacaaagtaaatcggtcgctggactttctggacatggccttcttcctcacgctcaacgactaagactgtgctcacaacctgggaggtggctgatacatacagcaacaacggctcctgcgggtgtggtgaggctaagaccggtggctcggtgaggagtttcttaaaatcttcgaaggccttctgtgcttcgggtccccattggaaatcatctgttttcttcagtagcttaaagaagggcatcccccgctcgccaagtcttgaaacaaatcggctgagcgccgccatgcatccagtcagcttctgaacatctttctgggtacttggcggtttcatgttgaggatagcagtaactttctccgggttggcttggatacccctatgagacaccataaaaccaagcagcttccctgacggtactccgaaggtgtatttttcagggtttaatttcatcctgaaagcgcggatgctcgcgaaggtttcttctagatccgagattaaatcatccttttgtttggtcttgacgactacatcatccacataggcttcaacgttgcggccgatctgcgttgagaagcatctctggatcatacgttgataagttgctcctgcgttttttagtccaaacggcatggtgacatagcagtatgctccaaagggcgtgatgaatgaagtcttcaagcagtcggattccttcagtcggatctgatgataccccgagtagcaatccaaaaaactgagaagctcacagccggcggtcgagtcgactacctggtcaatgcgaggcaacccaaaaggatctttagggcaagacttgttgaggtcagtataatcaacacacatgcgccattgccccgttttcttccgaactagaaccgggtttgccagccagtcgggatgatggacttctttgatgaagcctgccgctaacagcttggttaattcctccttgatcgcgtccttcctgtcttgtgcgaatcggcggagtcgttgtttgataggcttggcatcttctttgacatgtaaggagtgctcaatcacctctctaggaataccgggcatatcagatggtttccacgcaaagatatctttattgttctgaagaaaggtgatgagcgcgctttcctatttacaatctaactcggcgcctattacagcagttttagtaggattagaaggatctaggggaatcttcttagtcttggcttcgctttctccactttttgaagtcttggtagcgggcacttctccttcgctcgccgtggctgcagccagtcggatatcctctcgggcagacgccatctcgcgggtttgggccatgtcgcaactctccttgtcgcatgtgacggcttgcttgatgtcgctccgtagggataggactcctcggggaccaggcatcttcatcatcatgtaagtgtagtgcgggacggccatgaacttggctaacgccgggcgtccgagtatggcatggtatgctgtctcgaaatcggcgacttcaaagctgatattctctgtgcggaagttttcccgagtgccaaaagtgaccgggagggtgatctggccgagtggagttgcggataatcctggaattactccgtgaaaaggcgcattgcttggttttagctcggagcgaggaatctgcatatcatccaaggtcttggcgaagaggatattgagtgcactgcctccgtcgatgagggttctgcgaagcttgacgttacggaccactgggtctagtaccagggggtaccgccccgggtggaccactcggtcaggatgatccgagcggtcaaacttgattgcaatctctgaccatcgaagatattggggcgtgtcgggctgaacagcattgatctcccgttcggtcaacttttgcttccttttagactcataagccagggggccgccgaagatatggttgagctccttgcggtggtcttgaaattctaccggggtgtcgccgtcgtccttcttcctcgacgtgctttgttcttcgtcggagttcttccgtgtagtcttggcgtattgctccgcgaattgcttgtagacgaaacaatctttggccacgtggttggagttaggatagtgcgggcattgggagttcatgatcttgtcgaacgtgttgacgcgcgaacgctgtcgagaagagtgaatggcggttgcaacaagttcctcaggcttacgcttgcggtccttatgattgttacttccacctcctcccgtagccggcgtatccttttttggcttccaactgggacccgactgctttgatgcggtgacggcgtcttcggctttggcgtactcgttggctttttcaaacataagtttgactgtcctgggaggtttacgcccgaacttgccgaccaattcttcgtggcgaatccctttggtgaatgcggcgatgataacgtcgtcggtgatgtcggagatcttgttacgttgttcagaaaatcgccggatgtaatctcgaagggattctccggacttctgaacaacgttgtagaggtcgaattgtgtgccgggacgctcgaaggtaccttggaagttggcgatgaagtggtcgcgtaattcggcccaagatccaatcgtaccacggggcaatccatggagccaagatcgggcggaatccgctaaagccactggtaaatagttcaccatggccttgctatctcctcctgctgcgcggatcgcgagaccgtagacggtaagccacgattctgggttggtggtaccgtcgtacttctctattccagtcggcttgaagccggctggccaatccactcgacgcaggtcgtcggtgaaggctgctactccatcaaggtcgtcgtcgtggcggtccggcgaatgatgatggcctcgagctgctcggcgctgtatgattgtgtcgcgaagatcgacggggcggcgacgaggtggtgagcgaggccgttccactcggcgctccctatgatggtcgggaggcgagtgaacggaccgctcgtcgtgacccctgctcctgcgattggatcctgcgccagtgatgctgaggcttggatgacggtagtcatgagatcggaagtgggggagtcggctgccagtcggcgtgcggacgctttcggagttaactgggaccgaagccgcaatcatggtctttgtctggttcaagatgttgacgacgtgatcagattgattgagctcgttttccttgaggagggtgtcgaggagggtgatcgcggcaaccgcattctgttgaggggtgcggaaaaccggtgtcccttcaacatcttgttggccgatgaaatcacgcgctcggcgccctgcttccaaggctcgctgctgtcggtcctcagcctccttcgcggttcgctcacgctcctgctgctcacgccgtagccgttcttgttcttgtgcttgacgctcctcctccagtcggcgacgctcagtctcgcgacgtgcttcggtttcccgggcttggcgttgctcctccgtctcgttatcggccatgaagacgccgaagtagagaggggtgtagttgtcatctaggcttccgtcgaagtcgtcgagatccgggtcgttgtagcgagagctaaactcgtcgtactctacgatgtcggtgggacgcgagtcgacagtgggagagctgtagtagccatccagctgatccgtcgaaaccgtgccgagtggttggaggatgacgccgacttccctgaagctaggcgaaatcggtgttgaagccgacttccgcctaggcctacgggatggagacgctgtcgtgatggagacggccgctaaatcgtcggggagcttcatcaggatcggtgggtaagcctcatcatcttgatctggtgacattggagaagatgcgatctcgcccgagtggtttgaagccaactcgattgagatggtcttgaagtaactttcagccgcgtttgggagtccaaacgggactgaaatccggttctctcccgactggtctgactctgagtcaaggagagagatcttgccgaagttgttggtgacgaagtcgaggctgccgaaccgaaacgtctgcccgggtgggaagacgaggtcgtcgatgccggagacggaacccattgcactgatcggcgaaaagcttgacgcacccctacctggcgcgccaactgtcgaaactagatttcggcaataataaaagggggtggctatcaagctggagaagtgaatgggtttggagacaaaggatttatacaggttcagaccttctcattcaagaagtaataccctacttctgtccggggatgaatccgccgagtatcttattgattgtatgatttggagaaaatcaacacatgcccctagaggcacccggaccccccttatatatgggaaggagtccgtgttacaaaagataatctatatccctaacggaatatgcagatacagataaaatacagtcgtaaccgactaagtctcaaggtatttccttgatgtacaagttgagaaacaaacccgagatacaaataagatattctatctatattcggtatcctatattcagtccaaatatcatcgccgtgtagatatgggatatccataatctccacactaatgcagtcctacacagtaaactaacagggtatttattactataatagtggctacttattaccggttggagaaagctaaaaaatgaaaaaggagaaaagggaaaaatcgtgctagtcccttcgcattcctcgccactaagcacgacaattcgctgcttgctatctgctccgctgagcctggctgctcgccatcgttgccgcatccctagaccactccaattggttgcgccatggatctggcaaggatgacggcgacgacgacaagggtgcgaagttaatgaccttgacctcgacctcgaccattccaattggttgcgccatagatctggtggtgccgagctcaaccgctcgaacaagtcgccgccccggatctggctgcgacaagcttgtccacgaaaaatctgacggtggcgaactttcagtcccagttacttactgctagaagagatggtcgccgatctttgtcaagcttctctctcccttcatcgcgtcaccggtgagcacagtgaaacctagtttggatcttgtggaggaaaaatgaggaggctgggtgcacccttgcacacgcgggtgcagccgggtgcacgcgcgcgtgggtgcagcacgttgcatctgtcgggcctggctgaggtgcgaagctcaaatagagcgtttccccgcagccagcctgaggaaccctttttgaacgagtggagccaggctgggaaggtcacccaggcaaccaaacaaagagagaatgcatccatagatgcgggccaagctgaatgcaagaaacgaaacacaccctaactgatcaggcgacgcaactgcctgcacgtggagctgcacacgcgtgggaccacaggattacatgcatgcagttgttacagctggtaaaataacatactataagtcagctataaacacatatcgagaagataaaagaggagagagaagagcagcgtgctacatatttatagccagctgcagcacagactcttacacacaatgtgagtatgacaaatggaaccatgtaataatagtgtagtatatgtttataagtaattattgtatgaattggctattaagttgactatagttgatttggagctagtagttggctatactattaaacttgcacttagtaatctgcatgtgtttggatcaaacctgttttattaggggcagtttaggaaaaaattaactctgcatgtgagctcgttggtctcggtgaatttatttgtgcgccctctaaattggtacacaggggtgttgacggtcgttagcgattagtttcgaccatcaatattactaaaatagagaagaactagttatgcttgcaatacatatccatgttagaataataatatttcactagtatttggttcactaaccttttatagacaataaccataaagtggaggagaatcgacaacaaatcagatgataaatcaatcggacaatgtcgagaatcagacttatgcatgaatgggccaagaactcagaattgacacgaccaattgggccaaaattcacaagtctgcataggagagcaacggaggaggccatctgccgattttgggccaggcccgctgtcacgcccagaaatatagccctaaatttccagactattttgtgtattaaatccctgtccaggaccagccagggtacacaaaaagacaagtaatatacagttccaaacataaataaagcgtaaaatacttacagaaggggcacttagtccccacaccgaaacgaaagcagcagcagcggaaaaaggcgatcctaacggggcttcaggtccactccacaggcaaactcaactggggtctgagccttggtcttctaacttcgtcttcaactcagaagcactacacttctgaaaagggggaataatagcaaggctgagtacaaccaccgtactcagcaagccgcaccaatgatgcaaacgtgcaaggggatacaaggatggtttgtggctatttgcataaaggcggttgtaaaacattttattgagcaaaacagtaaaatagttgagtaattaaagtaaccttaaatctccactgatcaacgctacaccacgttgaacaggcccaaccaacccacctgaactacagtgcattaggtcgatttattaagtgtgagactaatcacggtgaatctggtcgaccacccataaccgcggacacggctattcgaatagttttactctgatcagaggtgtacaactgtacccacaagacacagccccacgacacgtttccgtgcgccgacatgccaacacgacataccggaaagaggccgtgacaggacccttcgcataaccccctctaaccgatcgcaccacaccttaaggttcgcccccgtccccagcaggcaacgggcagcccccctttcgtgccgcggtgaatctagaagccgatcaaccggacaccccggccgacccaactccatcacgcccaccctcgcctgggtacgtcggctagagaaaagctacactacaagcccagccgttgcccacgctggcttgtggtaagtacgataagttcttccagggcatcccgcgaaccggtccttaattgccatgggtgcgactagcgaaaccatgcacccacagcccagcatgtagtcgcattttagttggataattacgaccatgaagcatggccaggtgtctcgagcacgcagctcattctgatactaaaaaggtctaatattgtaattatcccatcaactgagctagtgttatttaagcagggctaagcatatagttctagctaggtcacataagtaacatgagctagtcgatttattacccacggttgacaaagggcagatatcaagtaaacatggcacaagcgagcagataggtaatacccgaatcccatgtaattaacaaaacatgcatatttatttgtaaacggtaaaatatttataaattgggatcaacatgctcaaggggaatgtgtgacttgccttgcttcttcaaacaatcttccgaactcttatccttgcgaccgcgaacatccgaaacgacggattctacacgctggcacgcaaaacgaggaaaaactctaataaagaccaagcaaacagtacataaaaagtaaacaatcatgtagagctcaattttagatgaattttgcaagttgaacggctcaattcggagttcgaatgaattagatatgaattttataagttttaagccatttaaatgaatttctataattattcacgaattattgcgcaattattatttattttctcaaaggaaaaggctgtggtaacgtcagcaaagggccggcaccgacaggcgggccccactcgtcagcggcacaaggggcaagcacacggtggactcaatccatcgcggccgaggcggcaccgtggacccggaccacggaagtggtccacgggaccgacgccctggattggcccaaagcctatccaacggccatgggtggcgcggctggggcaaggcacggctcaaagccggctggacgaacgacggcgcgcggcggcgcggccacccgcggcgacggccggtgacagctcacgcgggcgaaagcggcgcacgcgagaagagcaccggcgcggcgcggcaaggggga

SEQ ID NO: 31659 - DNA, 674 bp, Oryza sativa
ttttccggtgcgtgggggaaacggcgcggacgtgggcggcgaccgcgcccacgcatgcgcgggagagggaaccgcgcgaggaaggcggcgacgtggggagcacgggcggccatggcggcggttgtgaccggcgtgaggaaggggatgggcctgacaagtgggtcccgcggtcccacttgtcggcctaagggagagaggaagggcgagggggggggggttatgtagatttttcaagggagagagcaagcaggccgagcggatgggaggcaggaggccggcccagatagagagaagaggggagggggattgggccgggcccaaggggagaggggagggattttatttgttttacatttaatttaattggtttaaatgaactttgtattattataattacttcttgtgctccgaaaattcgcgggaaatttcagagagtattttagggcacaaagaatattacaaaatattcccgaccaatgatttttaaagggaaaattttaattctcccaataattcacttggataaattgcttaactttttatttaatttctaggaaatgcattattaaatgatttttaatcccgaacgaaaatcggggcgttacattcttgctcttggtagaggcagaagcgcccgcttgcttgctgctttgctttccgtgaggtttcttgtg

SEQ ID NO: 31660 - DNA, 1198 bp, Oryza sativa
  unsure (1)..(1198): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggcaaaagaatcatgccagtaaccagatagtccacgctgcccgttattcaaaccacttaacacatgcaagctgccattgtgttatttgttctatgcttctataatagtcacaccctgagaccctctatatttgttgttcttcatcccagatgccgaaacaccaccacaacagcttgtatatatcaatcctttatattacaccaattgttatctctatctctctcacagacacaaacatcagctgctatgcttcctgttttgatcttgtttgggcttctcttctccctacagtgcaatttccctgcatgctctgccacaaataatggcagtactctcatggcaggccaagtgctcaccggtggaaacaagctcatctcaagcaacggcaagtttgcgctcagcttcttccaaacaggcagcagtaagtcatcagacaacaccaccttgcccaactggtacctaggaatatggttcaacaatatcccaaagttcacaactgtgtgggttgctaatagagataagccaataactgaccccatctttaaacagtcagaactcagagtctcaagagatggcattcttgtcatcttaaacaaggtggccaagtcaatgatttggtctagccaaattgagaatagaccaaaaaccagcaggaacaatagtgtagtgctgttagacaatggaaaccttgtcatacgagatgcctcgaacccatccaatgtgtggtggcagagctttgatcacccaacagatgtcttcctccctgaagcgaagattggtcggaacaagattactggtcagaaatatagttttacttcaaagaagaattccgaggacccagctctaggcttatattgcatggagttagacccctctggttctaggcaatactatgataagctttgcaactcgtccactgtgtacttttccactggggagtggaacggaagatacttcaactcagtgccggagatgtcaagcaatgttttatttgactcccaattcattgacaacgatgaagaggagtactttacttacactccatttgataaaacagtaattacaatctgcttaattgatgtatctggccttacaaagcagc

SEQ ID NO: 31661 - DNA, 1447 bp, Oryza sativa
ccatgcacccaaagcccaccatgcagtcgcattttagttggataattacgaccatgaagcatgggtaggtgtctagagcacgcagctcattctgatactaaaatggtctaatattgtaattatcccatcaactgaggtagtgttatttaagcagggctaagcatatagttctagataggtcacataagtaacatgaactagtttatttattacacaaggttgacaaatgtcacgaccggaaataacccaacgggcgttccttacgtgtgtgtattattccttgtctcaggaggcaaggtacaccaaaagttgatacatttcagagtttatcaagcggaaacgtaaatagttattttattacatgggcggcgaaggcccagcacacacaaagacaaacgggaaacagcgtaagactagggagacgaccacaggcgcttgacggcaggcatgagctagacaccaaagccttcatcattcaggggctcctcttctgggtttgggaaaaattgagcaagttgagtacaaccaccgtactcaacaagacacacccacaagtgcagaataaatgcaagggagtacaagggagccataatataggggggttagggtttgcagtaaacagcactaaaagacacttagttgctcaaagctattttgtaaacacggtcctagagctatacaagattattaatcaaggccgtgaactcacacgaacctgccttaacccaaggcctacgatgattcagaccgaactggcaacccgaccctgggtcccagctcgtcccaagccaacccaggccaaccattccacattttagttgttaagcaggtgttaagaattaaaaacactaacttgggtacattgctcggcttgcccataaccgagggcgcggccacataccaccacggtatccggacggaagacatgacatagtttccaacccatcctagccataaacaagagtaccaacccaaccccaccaacaattaaaatgtgcaaagttaaaagccaaataaggcttagaggatttttgtaaatttcctaaaagcttaaaatgcgtaaataaattttagtggaattttcagagcacaaataataattattaagaaataaacaaagttgaaaaggttttaaaaaagaaaaaccctaaaaatccctcttccctctcttgggccgaatccggcccatctccctccccctttctcctctcccccgcggcccatccagcctcttcctgcgcgcgcgccgctgacgggcgggcccgcccaccaccctcgctgacgggtggggcccacccgtcatccccttcctcccgccgctcccgcctctccgcccgcgccaagcgccgtctccgccgccgccgccgaatccgccgcatcccgtcctccccgcgtgcaatcaataagggggaattattccccgtgattccctctccctttcccccca

SEQ ID NO: 31662 - DNA, 680 bp, Oryza sativa
ctttgccgccgcccgggcaagctcggccaccgctccatttcccctctccacctccgtagcgccgtaccacgcgaaccacctctctccaccgccgccgccgactccagccgcgtcgcgccaccgcttcagtcgacgccgacccgtgccgttgcctccctcagctccgcaaggatgaggaggacctcggctgctgcccctcttcgccggaaatccgccggagctccttcttcctcggtcgccggtgagatccttctcatattgtcgcggtcggccgtcgttaccggtcaccacgcaccagtcctcccctctttaacccctcctttatctccctcagatcgaggctgagcccgtccgccccatcccgagcgacgcccgtcgccggagctccgtcgcgtcgtcttcctgaggagccccgccgccaccgttccttgccgtcggccgccccttcgccgtcgtgcctctcggtgagcactcccctccctctcccttttcctccccttcgtcggccgcctcccgggcgtcctcgcgacgcgctgccgccgccggtggccgtccgaccgggtcgctgcccggcgcgccttccgccgctctccgtgccagcgccgttgcggtggtgccgggcaccggttgctgcctcccccttgccgcgccgggccgctgctctctcgcgtgcgccgctt

SEQ ID NO: 31663 - DNA, 1977 bp, Oryza sativa
atccctttgcacgtctgcatcattggtgtggcttgctgagtacggtggttgtactcagccttgctattattcccccttttcagaagtgtagtgcttctgagctgaagacgaagttagaagaccaaggctcagaccccagttgagtttttcctgtggagtggagctgaagtctcgctaggatcgcctttttccgctgctgtcgttctgtttcggtgtgaggactaagtgcctcttctgtaagtattttacgctttatttacgtttggaactgtatattacttgtcgttttgtgtaccctggctggtcctggacagggatttaatacacaaaatagtctggaaatttgggctaaatttctgggcgtgacaaagaagcaggatgcagattgttgtgtaacatggccaagctaagctaaatgtggaggagcaaagcatatgctctagtctctctattgcttgatgagaagtataaagctgaaaagatcgaagatgtccccttgtgataatgagaaacttgaaaaagggatagtgcgtggcctcgtgctcgctgcatgtgcaccgtggagcggagcctcgcggcgcctgttgttggtgcgcaaggacggggacgaggcgaccacggcggtggaggagaagaacgtggcagtcttgtgcgccctaaccgggctgcgaggtggagtggtgtgtgtgatgttattatgcctactatggatataactattgttcacatcatggatcaacaagaagatatcaagataagtcgttcaagtgttgaaatctgatccggcaacctgctacattgtttgtcttcaaactgctgccaaatatgcatacgagctttgttttgggttcatcaatactcgatgaaaagctcttggactcctctttccaacagttctagtctcatctccaaactccatcttagtcggccgcaataaaaaaacaaggagttgtgttaatataatgggcatatgggcttgtaattttatctgggacctagggtaaagtagggtgcgccccaatctagtggagcatgatcctagggacccttagctcatcctcgcacctccataaatagctaggcaccccttcagagtttcttgggttttgtgtagattaaagtttagacattgttactttaccttacagttacgtgtgccggctagaccatcaaagtactcgtctctgaaaccccaacttatcctggactttaattcctatttgcaattcaggttgcttttatcttgttcttatttgtttcttcgattttgcttgcaaaaataaggttgttctgtatcagccagatcaacaacccacgaagaagtgtatcgaagctaaggcacaacacaacatcatctcgtacgattgtagtcgggttgacaacttctctcacaaatcatagttatctcaattcaccaaaaatcgggtcaatcaaagccgtgagcatagcgagtggagcttaaggaaggtcgaggctcttcagaggacaagcaacgtgagcgcgggggtgccctctaaacacaaccacatggaggagcaggagcgtgttgccccttacggtggcgacggcttccaggtccacgaggagtgccttcacaagccaactctcggcatcaccggtggccgtgaggttgggaagaaggtggtgattagtttggtggcaaggtctccgcctctggcgatgccatcgtgtgcgtcggtggtgggtttggcgatgacactggccatctagtttgtcttgtcacatagacaaaagcggcatacaattaagaatcctttttctcccattactagtaagtagaaacctaaaaatagtactccctccgtttcacaatgtaaatcattctagcatttctcacattcatattgatgttaatgaatctagacatatatatctatctagattcattaacatcaatataaatgtaggaaatgctagaatgacttacattgtgaaacgggggaagtatttggataa

SEQ ID NO: 31664 - DNA, 1538 bp, Oryza sativa
gaagggcctttgtgggcttgggattacagtcacgtgcggcccataggccttaactgactgacagcgattctcttgcggcccatgtaatatggcccgaacaggatcgcgactgattgcaggccagacagtccagcccagcccaggacactttacggctgttttccgtgacgacagctgcattttgtctccatccatggctactccatcctgcctagcttgaatgctggaccgatcaggtgaggggaggaaccagttgaaggccagtggcttggcgttggcgttggcattggcattggcattggcaactactgactgcatcaacactctaccaagaaacagctttgccatgggcatgtttggtgcacctatttgggttgacgcccatagggtgttcgacgaaatgcctctgcgacaggagcctttgcgcgtccagattcagtgtatgggattccgccggcaatcaagttatgtgtgtgctagattgctaatactctctacttgcatcagcaactgactctagctgtagttgtacaaaaatctcaaactgcagagtggggactgcgcttattctgggagaagcagcagaacggccggtgcacagatactgatgtgatctgtgcctgcagcgatgttcagagaactagacagctccgattaacagcattgcttggacagaatcttaggtcagcccctttcttttcgtttaaacactttaatcaaccagaggcctgtgattttctttgtttggtctatgctcattgttaaaagatataaggagttgggttgtcttcaatcacacatatcgattcaggcaatgagccaattttgtgatctcgacagaatatggtattcaggaaaataggaataaaattgttcattgccactggatggtgttacaacttacaacaacgtttagttctggatattttgttttttcttctggggtcctttatatgcaattcttttttttttgtgtgtgtgcttttaaagcgtagtacctaatatacttgccataaaaaatgatctctatctttttaaaaaatagtgggctggctggttcagaaacaaaaacacatgaattgttttaagtaaaattttcaactaaaaagttgtctcgctgctagccttacacttaatttaaggatcttatattgttaggcactgttcttggtacaattgcatagcaatgatatcatttaggcataattaccatgaaaggaggtttgaccattaggaaaacaaaatatttcattcatacatgtttgcatccacaagtaactgaagcaactctgtcctctctctgaacatgctgagaggagagagagagagagtaaatattaaaacatcttaatagctaatagtagtgttttaataaataagtaagataatcaaagcttcaccagcctttccatctaggatgtgcacaaccattattttcgctatcaatagtgtacatggaagcaagataattattctgttgaaataccactgatctggtccaatttgaattcttgcacgtcacccaaaatactttcaag

SEQ ID NO: 31665 - DNA, 5651 bp, Oryza sativa
cggcccaagaagggaggaggagggggaaaagacttcttttaggattttctttttataaaccttttcaactttgtttatttcttttcaattattatttgtgctctgaaaattccactaaaatttgagggctccttttagaccaaggagaatttaacaaaaattctccgggtcacatttgaatttttcttgtacgtattttaaggtttgccaatttcttttcgaattttaattaattctattattccttttagaagatgatttttatttcgggatgaatttatcaggacgtgacaccatctgtctgcgggtgatacgcggtgctgaaatttaatcgggtacccagctcttcttggagcttcttccaaaagtgagaggtgaattggcttcccctatcagatacgattttcttgggaacgccatggagactcacgatcctagcgaagtagagctcggctagtttgttccctccataggtggtcttcacaggaataaatcgagctaccttggttaatcgatccacaactacccatatagaatcatatccaccttgggtttttggaagtccggtgatgaaatccatcccaatttcatcccatttccattctggtacttggagaggttggagaagtccggccggtcgttggtgctctgccttgacacgctggcacacatcacaaagggccacgaactctacaatttccccgcttcatactgacccaccagtatttctccttcaagtctaagtacatcttcgtactgccagggtggatggaataaggactttcgtgagcttcctgaagtatcaactgtttaagttctttgttatctggaacccctactcgatttccgttccatagggtcccgggtcatctttgggaaacccccaactttaccctggttcatatttttgaagaatccacgcatgtccgggtcgttcctctgagcctcgcggatttgatcgagcaaggtaggcttggcttccaacgcagccaagaatccgcgaccaactatgcttaggttcagggcttccatctgttgattaagtttgggtggaatgccacggacgttaagagtgttgcaatagctctttcgacttagagcgtcagcgaccacgttggccttaccaggatgatagtgaattcccacatcataatccttgatgagttctaaccatctcctctgccgaagattcagatccgactgggtgaagatgtatttcaaactcttatgatcggtatatatttcacagcgattcccaatgagatagtgccgccagatttttagagcatgaaccaccgcggctaactccaagtcatgggtagggtagttgcattcatggggccgtagctggcgtgaggcataggccaccacatgaccgtcctgcatgagcacgcaccccaatccttggcgcgaagcgtcacaatacaccatgaaatccttgcgagtatctggcaagactaacactggcgaggaaaccagcctttctttgagagtttgaaacgccttctcgcattgcgggctccacacaaatttctcttctttcttcaacaactgtgtcatgggtcgagcgattttggagaagttctcgataaacctccggtagtatcctgccaaacctaagaaactgcgaatttgagtgacggtcttgggttgcttccaatcagtgacggcggtcactgtttcggggtccacagcaacttctttagcagatatcacgtgccctaagaatttgacttcggacaaccagaactcacacttgctaagtttggcatacaattgatgttcccgcaactttcccaacaccagacggagatggtgctgatggtcttcctctgattgtgagtataccagaatgtcatcaatgaaaaccacaacaaacttatccaagtattccatgaacactttgttcattaggttcatgaagaaggcaggagcattggttaaaccgaacgacatcaccgtgaattcatacagcccgtatcgcgtggtgaatgcggtcttcggaatatcttcttcacgaatgcgtaattggtgatatccggaacgaagatcgatcttggagaataccgtggcacctttaagctgatcgaacagatcatcgatccggggaagagggtacttgtttttgatggtgacctcattgagagctctgtagtcgacgcacatcctcttcgtcttgtctttcttctccacaaaaatcacaggagcaccctagggggaagtactcggacgtatataccccttttctttcaactcttccaactgtttcttgacttcggccagttcatttgctgccatacggtagggtcgcttgtacagcggagtggttcctggagcaagatctatccggaactcaatctcccggttgggcggcataccgggtagttcttccggaaacacgtctccgaactctctgacgatggggatttctgacagtactatctgatgaagttctgaacttctgacagaggttgggggtgcaaagaaaacaaccggttgttccggccctcggtacagagtaaccgtgcgtctcgcacaatccactactccttggaattgagccaaccaattcatcccaaggatcacatccaagttcttggtgtctagcagaatcagatccgagggaaaaggaatcccctgaatttctatagggacggcagggctataatactttgctgtcataacccctccaggggtggtgatgagcaaagggttcctaagcctttctacccccaactgatttctccccacgaatggcacagatataaacgagtgggaagctccagagtcgaacaaaatggtagcagggatggaatggatgaggaacgtaccaacgatgacgtctggagttgtcagcacgtcctcggccgtcacatggttcacacgaccccgaataacatccttaccaccattgttggagcggggaggcgcttggccttgctggcgcctcggcttcgggcatttatccgcaaagtgcccgggctcgaagcagttgaagcacagacgctgcggaccttgagcgtccctgcggccttgaccaggctgcacagttggcgtaggaggacggggcgcacgagtcccttgttgattctgctgctgctgcggctgtgggacgcgcaccacgaattgaggtcgaggcgcggagcgaggttgctgctgctgttgttgctgctgcgaggaggatccccctggatagggattggtgtagcggaccctttggttagcatcctgttgattgcggaaattcgccaagcggcgcttgtgcgactccagttccttgtgcttggcttccaagcggatgctcttgtccaccagacgttggaaatccggatagtccccggagactagacggacggacagctcagggtccattcctgccaagaacttctcttgcttctcctcatcttcccgcacatcctccggggcgtaacgggccaggttgttgaactcatgcaaatactccatcacagagcggttgccttgcttcaactcccggaattcccttttcttaagggccatgactccggcaggcacatgggtcctccggaaagcggcggtgaaacgggcccaagtaataggctgcccctctggctgcgtagcctggaaatggtcccaccatagagatgcgggcccctgcagctggtgggcggcgaagatgactttctcctcatcgctgcactgcacagtgtctagctttttccccacggcatgcaaccaatccaacgcatccacggggttgttggagctagagaaggtaggtgggcggatgcggaggaactcggcgagtttagagtgttgtgggggtggtggtggagcattctgttgtggcggattttggaggtggtggaggaaagcagtcatcatgttggcctgctgggcgaggatttgggtgagaatggcgttggtatctggtggtggtggtggaggcggaggaggaggtggaggtgggctgccctggtggttgtggttgctgccttcaggttggttgccatcaccggtattagcacttctcctggtcatcaccatctgaaaaccccacacagaaccagcaaacagagagagagctgacaattaaagctaaccacccacgactaccataattcttgaatttattactgctattaaattggttcattaaagttcaagttgcttagacgaataaaataaagacaggctccgacacagttataccacacaccggcataaccatgccccacacgactccaacaagaagacaaacgagaaagaacacacgcgcaagcctactaactgctcgtctaccgctgcgacgggccaggacggaaggtgagcaacagcgcatcctccgtgctaccaacgccggaggcttccccctcctggggaaccacgggcgcgggctcggcacgaggggtctccacgaagcaggtccacgccagggactgacgaacaagctcgggcctggaggtgcttttgcgggcggtgatcttctggctgcggtagacgcggtggcgcttggggcggcagacctctccctgggcgatcttgagctgatgcagctgcgcctccactgcgtctaggtccttcttgagctgcaggttctcctgatgcagctccaggatcttcaagttgttctcgaccatcccacggcgcaccatctgatggaagtcgatacgagccgcgtcgtacgcctccaccatgcgcgccaggtgcacgatggtagcgtcatcctccgagctagcatcccggaaggtggcgtagtcgcgggctcctccacggcgagggtggtagcggtagggcgagtgctacaactcgtccgggtagcgctggtgaagagtgccgatggcgaggagagcggcgttctggtaagcggcggggaaagaatctccacccgcggtgactgccagcgaagtccgctcgggagagccagtgaggatcactgcagtaacctcccacgcagcgtggggctctgcatcgtcaccctcctgatccggaagcggcctggcctggtagtccactccatgcggataccccaggacaacgcacatgccccgcagctccaagacgaaaccagtcatgtccaagccacgacggctgacgctgccggccatctacaaacaaaaacaaaaagaaaagcaacatttaaaaaggtcagattttggcgataaatgaagcagcaagacagagagagactagagggttttcacaaatacaaaggatttttatttcgaaaatactgctatggcttgggatctacggctcgtcctagggtcaagggtggctctgataccaacttgtcacgaccggaaataacccaacgggcgttccttacgtgcgtgcattaatccttgtcccaggaggcaaggtacaccaaaagttgatacaattcaaagtttaacaagcggaagcgtaaatagttaatttattacatgggcagcgaaggcccagcacacacagagacaaacgagaaacagcggaagactagggcgacgaccacaggcacttgacggcaggcacgagctagacaccaaagccttcatcttctaggggctcctcttctggggttgggaaaaattgagcaagactgagtacaaccaccgtactcaacaagacacacccacaagtgcagaataaatgcaagggagtacaaaggagttatactataaaggtttagg

SEQ ID NO: 31666 - DNA, 91 bp, Oryza sativa
ttaacattaagctactaagaggagatgagggtgggattacacttgtgcaatcccaccaagtggacaagattttgagtcgctttggatatag

SEQ ID NO: 31667 - DNA, 933 bp, Oryza sativa
tcatgaggggtcatcgccttctctgaagagaatctcagattccttcaaaggtgaggacttggtctggcaagctattcttctgcaaactttttgagtttttatactgtttgtaactttgtttccatccactaaggaagctcaaactggttaggcataggacaagcatacttagctgtaagcacatccaccaatcatagtgacaggcaaccagtagccaatgcaccaagcatagcttgtggtcctttcagatcggaaggatcacagtaaattgacagttgcagatacacatgtgagtgtttgcttgtgccaaactgttagagagtacaattccttagctgcctgctgttgttcatgtctacagtctgcacctaacatctacaaggaaccccacatgttgcacttgccacgaaggaacatgatagtatgttggttaatgtgcagacatacttatgtagatgagcccaccaattattttgatttttatagatgagacagaatgtcagatagacaagaattatcaacttatcttttctttctttttttcacttgttcagacggcgagacgcatacttcagatgagagttggaacccaacaagcctccctgatacaccaccttcaaaggcaagcaacgatggcaaccagataaaggcagaaaacatgaaagccctcatccaaaagcttgagctcttgcaaatgttgagtgaggaagctctgaaaaccgatgacactttttcatcagttgctgccaataaagatcaccagtacctctacgagatactttcagcatcagggatcctacacaacaaactaaattttcaaatgatgcctcatcagctgcgaccatcaagctacccgattaatccagagcttttcctcatccttgaacaagcaaaaccagacgaagaaaagctgcaccgtaggctcatatttga

SEQ ID NO: 31668 - DNA, 453 bp, Oryza sativa
cttaagatataataagcatcatcatcatacaaagaacgcaatagaattgcgactaacatagatatgaaaaaaatgaaataacagtaagcgaaggttataccctgtgaatgtccctccgctggattgtgtggcagaactgcctccgttgatgttgtcgttcgcagcggctctggctcccggcgtgccatctctaggtgcggcagtagcagcggcggcggaagacattatgtagcagacgacgacgacgaacaaaagacgaggagcagtcgtgcggaagcactccccaaaaacctgatcacccgcctacccgatgcagatctcaagcaaaggtgtggttccggaggccctactcgttccaatctctcgtgcgcgcaagcgatcagaagcggggaaacagaacagtagcagcaccagactcgcgcgaggaggaggaagaacaccagatggaaagta

SEQ ID NO: 31669 - DNA, 779 bp, Oryza sativa
tgtttgttaaccaaatattgctcaatgtttcagttccttgcgttcctttgttggaacgaatagtggttgcactaaagggattttagacttagtttggtataagatgagaattttgtaggattacgattcacattatttgcgccttggtactgaaattgtaaaatcgagggttagggcaaaatttggtcactgctaaacattctaatgttaccaaatcccaactagacaaagacatcacatgttatctgtagtagtgcaagatgtgtctgacaggtggttcctgttattatgttgtctgaaatactgttgatctggttggagacttataacagatagcatctggtggtcatcctgaaaaaatataataaaatgtatgaagaaaatagaaatggatctttgtctgaccagggaacatcttcgagggaatctttggatatttttttttttggttggcaagatctcagtgttactgtttgcttgctcatgtagatatatatatgtcagttaactcatggattgtatagccagtttaaaacggttacatataccattagctaagcttcctaagaagcagaaatttggcctatatgctgatgaaagacagctgcctccttagcttccattgcgtcaggtgcaccttccctttgtctactccactaattatctcatcaataagatccttaaagatggatttttcaatggccaaaacaattccttgccgttcactgtcggagctcttccactctttcatgccttgcattgcatcctctgctagcctg

SEQ ID NO: 31670 - DNA, 779 bp, Oryza sativa
cgaattatttgaaacaaagtttgtggttaaggatagagcatgtcgtactataatcgatagtgagaggtgcaataactttgtgagttcagatttggttgagaaacttgagttgcctacacaaccgcatcatcatccatattagatcaaatggttcaacttttgtggtaagttcaaggtaaatagaattgtgagaataaacttttcgattggaaattaccatgatactggcaattttgatcttgtccctatgcaagcatgttctttgttgtttggtcaaccataggtatatgataataatggatcgcataattttgttgctaacacatgcacatttagacataatggttggaaaatgaaattggtacccatgagttttactgaaattttcgaaaataatattcaaaggatgaagaatggaatcgatgagattttcagagataccaagaaagatgctattgtgatgtcttcaactaagtctgaattacaaaacgaacgtatttttgtgcctattgttttggacactaatattttgcaggcatctgagaataaccaaggtaatgagaaagagaagaaatacgaagtggaaaaagatctatctatagctccatgcatgctggaagaatgttccattgaccaagcacctataatttctaaagaggagaaaagagatactgataatggtgttataactactcagggtatgcatagttatgatgtgccaactatgtccactacttatgctatgttagagcaacccatagtggaaacaattgttgaaa

SEQ ID NO: 31671 - DNA, 2109 bp, Oryza sativa
  unsure (1)..(2109): unsure at all n locations
taatagaatttaagggataaaagtattctccccggcaacctaatttaacttttaaaagaggtggacataaaagaaacttccaaataaatccattctcttttcgcactccagtgtatggccccttcttctcctgacgtgcacgaccttaatggttgggagctgaaatctcgctcttcacaagtagggataaatattttcggaagtttgtttagggctaatgttgaagactatttttttttcttaaacaaaaacctaaaaatttaatgatttggagtagtatagctgatctcacgagtatatttcccaaacttaggggcctgtttggatgcccacctcactttgccacaattttgtgtcaaaggtgtggcaaaatgtacattgtggctctataattgatgaccacacttgtggcaagctttgattaagaaaaaggtctataactagtgggatcaaaagagatctaagaaagtgcggcatgctaaaattgtagaatcaaaccaatcctagctatatttgatcatattaacctactgcaagtgtagcaacatgtggcaccaaccaaacatgccttaaatcccagtcggacgtacgtgaaaatctaaccgcccgccccacctcatggcatgattgaggagatcaaccaccggatcggtggccccactgtcttagctaaaccatagccccacgcattagtgggtgagagatgattaccgcctttgggtaaaggaaagccagtcatagtattaaaccctgagtgccatattagctcattcatagtgtgtcctactcatttgaggagcttcggagtgccacgtaggtttaggttacagaattcctaaaaaatccttgnagttcttcnaatatttctttcacaatgcacctaggtggcattcagccccaacatgccaactaggagatcctttccacgtctgtatctgtcatgccccaagtatgctcctcgtgcaaagcaagcgagaatgggccagacgagcccccagtcaaagccactcgcattgtaagaatagtttcttatacgttcttcagcttatgtggcacatagctttttcgtgagtctcctcatagatggtagcaacactgctctttccctgcaaagtggctttagaagtggcttcaattttatagcttatcccctattatttttgtagttctcattttatttttcaatttatgtggaggtccaaaatttacaccgaacaccctaaaatctagaaaaaaattataatacccccctctcctttctcccttatcctttccctacttcggcctcctccttcggctaccctgccgcatccctctctccttaccacccactatcggcacccctctcccccttcaccactttccctccccccaaccgttgcccgttggtgtggctctccctccaccttcctcgtcggggcgccgtcggaaattgagcgacagaatggcggatcgaagcgacaacgagctcggcaccacgtgcgtgcgtggatggcaaggagctcgagacggatctagcaatgttggcgtgtccgtctcgtcggcgcgaccgggcagagaggcggccaaagcagcgactgtgtcgccaagcggattgacggcggggcttgctggatccagcctcaggcggcagtggcggcttgctggatctcccctctctcccatgggatgagctcgacgatgacacggaggctaggaaaaacgacaatgtgctcactcactcatgcacgcgggagcgggagggcgagggcgagcgcggtaggacgatgaaatgaggtcacgacctccacaacacaccgcttttcgcccctggattagaccgaggaacgagtgaccaaagttggacgcttggacttcagctcggtttggtagaagctaaaggctgtgtttagattcaaaatttttttcttcaaacttccaacttttccgtcacgtcaaatgtttggacacatgtatggagcattaaatgtggacagaaaaaaaccaattgcaccgtttgcatgtaaaatcgcaagacgaatcttttgcctaattacgccatgatttgacaatgtgatgctacagtaaacatttactaatgatggattaattaggcttaataaattcatc

SEQ ID NO: 31672 - DNA, 1041 bp, Oryza sativa
cacacacacacacacacacacatatatatatatatatatagctaatataagtctattttatgtccctacttgttggcccatgccatataatatgtgtatttttcatccctattctttgtgccgtatcttacatatggttgaaaataagtctgtttcacatccctgaacttcgtgtcgggtcctgccggcccagcgtgccaaggtaacagcccagacatggcactgccgtgcctgggccaggccgtcgggcctcgggccatatggcctcgattccacgcggcgcgtggaaccgcacacgcttttggctcggctcctttggcagaactaactatgtggcgctcgcctattaccaggccgcgtaccggttccgcggcaacacggcgtggctcaacttgcccgacaacgccgcatcccgtgggttgcttcacgcctccgtggacgccaagctctaggctgtgccagaacatcatggccgccaagaacgccaagtcctccatggcaccgcctccacttcagtctctgccactgccacctcctccgcgctcatcaacaactgctccttctcgtcctctggcaatgcaccgtgcgctgactcatccctttccctgtcatagtcgttgttgatgaaaaacacgaggcctgagagatctgcttaactccagtgcaggtccaaaactcgccttcgggtatgctagcatgccagttgatttgatcctgcaatcaacatgaaataaagacaaagaaagaactaaatcgataaacgatagccgatcggctaagtgccgatgacatatcatttatctttgagccgatgtcatatatatacatcgatcgacagttataaatgaataataaagaactaaatctacttgatcggctgtagatattaacaatatataatccttatgtggatatatacttaaatcaagtgattgggatagatcggtcgccatgccgagacagtataaatcacttagattgaaatatatacaaacaacaaaactatatatgttcatagcatagccgatcagatagatctag

SEQ ID NO: 31673 - DNA, 3911 bp, Oryza sativa
  unsure (1)..(3911): unsure at all n locations
cagttttggacagaatcatcacctaactttatttagattttgatcttgccattttgaactttgagtaccatattattgttgaagcagcacagtagcatcatttctgtctgtcatgtgggcttttgttggaatgtcaggaaattgatcagcctgccttgatacctcacatagctgaagccaagtctcaaaaatatccatatgaagttcttttcagaagcttgcaaaaacttttgattgatacagctacttcagagtaagcctgatttcccttgtatttttattcgtaatggcttttgaatgagtggcaacctgatagatatccactaactgcaggtaccttttctctgatgatttctttggtgaagaatcactgtttaatgacatatttgcaggtttgttttgtcctatttttgaatgtctatcttatgtggatgtagtaatctaaatggagaagcatctagtgtaaatccatcgctcagttctagcatgtgaatgaacattcatatttaccatttgatgaggtttggatggatcagatttaaagggatgtgacgggacactcataaatgatggctcaaaccgcaaggcagttattatttgtaaatagtggtccatgtggctattacatcctgtttggatctgatccacctaaaattatgaatcaacccagatggagttggcattttagaacctgaagttcaaagatgcgtagatactcccccaaaccgcttttacatcgtcctttacccgtaggaagcacaatgcgtgcaaagactaccatacatttatatgcctgtttttgctggtcatactattgagacatactttgatcaatattgttctgccacagtggcttgaataactaccatacatttagtttgtcaaggccaatcttaattcagatgttttgtggttaccctgatttaaattttgctgaaaattaaaagtccagtctttgttatgaacatttctggctgagcaagtgagcataactcttctcagtcatttagaaaatgtgcaggatgagatttcaggagttgatagaaaatgagaatatgctttgcattacactagtaaccaaagtaatatactatctgttcattttatttaactttaggaaataatccatttattttatcatgtctgacatataaatgctccatgtcatagataatccaaactgattaattgaatatatcaagtcaagccattttatactattaccactgtcatctacctgaaaatagacaatgaatatgtgttttaaatgtttaacataaacatcaaacaagtgatgtctgttacttttcccttaggacctatccaagttgttgatgaacatttcaatgctgtgctcctgaactgttatgacgcaatcggcataatgcttatgatccgaataattcatcagcatcaggtacgctttgagttacctattgaagcagcttagaaatatcaccattcatgcccttgttgactgtccttgctttgaaggaggccacatctctctctctctctctccattttaggtagaaccctctatattgttatatgtgagaaatctaagtggaattgatgttttatgcagctaatcatgtttaagcggcgaatcccatgtgtggactcttacttagacaaggtgtgtgctttgtcgcatttttgttgaaattttatacttgtatcgacttttttaagggtcactatgttggatagccaatgcttcgccatgaatctttcttttgtttcaaattcatcaagtccatttgtgcacattgcacacttgcacaggttaacttatcactctggcctcgcttcaagatggtgtttgatttgcatttgaacagcttacgaaatgcaaatgttaagactctttgggaggatgatgttcatcctcactatgtcatgagggagatantcgctgaattntnnacagcantcccttcgtgccattctccaaatgtgaatatggaatggcaggttagtttatcaaattcaactcaacccgatttctgaaaagaattattgattcccattccatgcgataagcaacccctttatatggcttatgggaattgtataatgttatttatatctgcagcttgatcttaatctcgagcggttgcggatggctgttgaggaattgcttgttaagttggctaagatgttccctaaacaaaagttgcaaactgttttcctgataaacaactatgatttaacgatttccatactgaaggtaggcggtgaaagttcaagcttcattaagttgtactgtggtgcaaatctaacttagtatcnnatctttattaannnatttgttcctggaaggcttggtcatacaggaagctggcactgagggtggaaaaacacaagttcactttgaggaggttctttaagagcaatatttcagtatatgtggtatgcaatgtgccctctgagatagaaataatggaatataatttctgcgtgggcacatttcattggttttactgtgttagggggtacctgtttgcatctgtttaggggctatttggttgcatcctaacttgccagggcaccaaaccgtgatgtgttgtgtgaccacttgccgtttgtcctagtctatttattttagtacgacctctgtattttccatttgattctagaatttttacatgtccagagaaaatagtgggaggcctactgtcagtttagtatttcttttcttaggattacgaagccaatcagaggctagtcccattgatttttaatactggcaacagatgtccattttttctcctttcgtttgaactttattgacaatatttgtaaagagggagctgtgtggatagttaaaattttctaggggtaagctgatataatgaacaaatatttatgcaggaggaacttctactggagcatttcagtgatttgatcaaatttgtgaaatctcgcccgtgtaagttgatccctgttacaacatcaagctggttcctttttttgcaacggcatctcatctttatgtgtgtgttttaccagctgaagacacagcatcaagctcggacaaggccagtgttagtgatgtcgagccattagtcaaggattttgccggtcggtggaaagctgcaattgagcttatgcacaaggatgtcattacatcttttagcaacttcctctgcggaatggagatcctgaaagcggcactcacgcagctgctgctgtactatacaaggatcaccgagtgtgtcaagaagatcaatggtggctctgctctcaacaaggacctggtttccatatcctctatcttatatgagatcaagaaatactccaggaccttttagtcagtactggtcctgccatgtacactggtgtattattctcatgtaacgaaaatcctgatatatgctatgcaggttggttgggtttgacacggaactctgtttctcttgctatttggcagatgttaagaaattacacgggggtgtatctaaaatagtttttcgattgagagtaatggctgtttgtggtagatcgttgagctgattagcgattagctgcctatcagtcagccattcagatgttctttaattgtagtcatagccattcagatgttctttaattgtctggcggtgtttgggaccgtagaaacttatccccgcctgtggataagtgaatagaaacacataaattttgccatctatcaacaaatcgaaagaattaacatttctgtgactgtatccactcgcctcttgccaaagcgcccacatgtattatactccctccgttttacaatgtaagtcattctatcattttccatattcatattgatgttaatgaatgtaacattaaaaaaaacctgcacagcacatgaaggcgtccacagcgccacttgactgtcaaatataggcctaatctaattcttatcccttaaccgc

SEQ ID NO: 31674 - DNA, 1305 bp, Oryza sativa
acgatcttgccagatcctcgttgaattgccatcaccaattcggcgcacaagccccttgaacagaatatctcttctcgctaatatagctctccaagtatggcttgaatgtttcttccgagtggcttgtaagaactctgactcatgatagtatctgcctttcaacactcgggcacatagtgaattaggatttttgatcagtctccatccttgtttacctaacatagctaggttgaacaatctcaaatctcgaaattccatgcctccatcagctttcggtttagtcagtagttcccatcgctgctagtgaatgcgtctgctatctgccgagctcccccaccagtagttcgctatcattgatttcattttccgacaagtatcctttgggattaggaagcagctcatgggataggtcggtacaacttgagcaactgatttgaacagcacatccctacctgcacaacttgcttcacggccactccatgttccaactagatttctgattttggttggcataaattcaaaggtgtcctttgttgcccgccccaaggcagtagggaggcttaggtacttctccgctaatgcttccatatcaatatgtaaaacttctcttacctcccgtttgcatgcattatcgcagttagcactgaaaaagatcgctgatttatctctgttcaccaactgtcctgatcctcggttgtataagtcaagaatatcttgcaaccgtcaagcccctctctacgaagcttctaagaaaacaatgcagtcgtctgcaaacaggtgtgaaatccatggagcgtgtatcccaacctgcacacctctggcaagatgcaccggtccaaccacccttaagaggcaggagagaccttcagcgcacagtaggaagagatatggggagattgggtccccctgacgaatccctctcgacggcttgaacgggttcgaaagttgtccattgacccgtacagagaaagatactgaggtaacgcatctcatgataattcgcacaaaactttctgcaaatcctagttttaacatcgtaccttggagatagtcccattccactcgatcttaggctttcgccatgtcaagtttgactgcgcatgcccccgtttttcctttcttcctctttagatagtgagtgcattcataggccactagcacgttgtctgtgattagtcttccaggcacaaatgcactctgttctgcagagataatctcatccaagaacactcgcagtctattggcgagtacttttgagcacaacttatagaccacattgcaaagagagatcggtctgaagttctt

SEQ ID NO: 31675 - DNA, 768 bp, Oryza sativa
caatatgcaagtttagtgtcacaaatgtggtaccattagatatttttctggaagtaacttcttgttggcaatatatttgaaaaaaatattatacatcaactttcaaattggttttgttattatcaatatatactttcagtaagctcagttctttaattgctgggcatcttttttataatactattgaatgaattggctagtttccacatccagaatggacaattgagtaattcttgatcattttagcctttagtcctgaatattgctaatttcacatgctgatctttatgctgcaaatcgaagttatgcatgaggtatgatttggacacttgattgtccttgtaaaccatctctcttccttttgggcatatgttacgtatgtctgctggtaaattgtgaatgcttggttggtgtctggtaagaaaggatcagtctacactgagatagaaacatagttacttatccactatttgcagtatgagattgaataatttctgattcatggggcttacttatagttctctctggcaatttcattgtcatttcgcaggatcgcccttcgaccaaggtccatgctgcccctggtggtggatcttccctgggctacctctttggtggaaactgaaggagtgatcctggtgcactgtagcaccggatgaagaaggaagtctaccgctatccttgtttatcagaactgggaacccccattgttttatcattctctatgcatgtcccgtacctatgactccgtggcaaacaccctgcctg

SEQ ID NO: 31676 - DNA, 1084 bp, Oryza sativa
atgtggggtttcttagtacaacgaatctgaactattatgttggtttttttttacggagggagtatgttgtttggttaaataaaaatgatattgctttttagaaaagacgaaaaaaaactgcatgtctaaccctataaatggctgattttcatgtgttatttggatgagtacgtttttagtctttgctcaaaatgaggcatgacaatcagtcattgttacgtcaagtctcacttgttggagcagacaacaatagaggtgttcttcaatggtgatggacagagacgtggcaaccggatttgcgaaagttgtttctctttcatatcgaacttttgccaaacttgtttgtgtggtacggtagttctactgtaatagtgttgatcgctgtgtataccatggtcagaatgttttgaaagaaatacgaagaagggtttttttaatcattatatatcctgtaattatcatggaaaacatttcgttttaatttggaacggggggtgaaatagctgagtggactaaatagacagaaactcagaatgtgatagatagatgcatgcatgcatgtatgcgttcgtggaattccatcgatttctggcagcaaatcaaagatgcctgcatgcgaacggcaaggtgcagatgaagtgatgtagaagtagctagctagtcaacgaggactagctatagctagcgctagttagaccattaattcacaatgctcccatgtggcttccacccctaagggccacccccggagaccggaaatatttcggggtggccattttccctcccaccagcagagcttttccaagactgggtagctctttgccatcggttcctcatcagtttttcaggaagagagaaagagagaagaggagagggatgcgtcgtcgtccccatgctccacgccgccgcggggaggaggacgaccggacgccgtcctcgccggagaagctcgccggctcaatagggggaaagcgacggcggcggtgaagatcgatttggcatcggcgaactcagagagagaaagaggggaaattcggcgagttgtcactccgcccggctccgcgaggaccaccgacggttgggg

SEQ ID NO: 31677 - DNA, 776 bp, Oryza sativa
gctaacgtgacgagctgacttcgatcatccagactgagtcagagaccgagacccacatagcatacatacaaaatattctacattagaccagttcttcctctaccacctttcctccatctctcttctctctcctcagctcacgattttagcgagcaagctatgccgatgatcattacagaggcctgacgaggaagcacataatatgctgcaggaggtacacagcctcgctaagctataacggcgagtcggcgattaaaaaaaaaaagtgttccagtgtacaattaattcgttctatatagattcatttttcaagtgaaaaagagccttttgtaactctttatgtaacaccttgactaccattaatacaatagttataaggtagagtctctctacctttttcagtcaaaaaaaaaagtgaaaaagagacatatcagcgtttttacaacagcagctatatttgttacagctccttgcgtacaacactttgattgatggattgcacaaggaaaaaagataaggcattgtttagatcaaaaaaaatttagccaaaaacatcatatcaaatgtttggtcacatgtatggggcattaaatgtggaaaaaaacaattgcacagtttgcatgtaaattgcgagacaaatcttttgaacctagttgtgccatgatttgacaatgtgatgctacagtaaatatttactaataacggattaattaggcttaataaattcgtctcacagtttacaggcggaatctgtaatttgttttgttattagtcta

SEQ ID NO: 31678 - DNA, 446 bp, Oryza sativa
aattttctgaatgaccaaagcaatgccccgtggctgtgtgctggggattttaacgaaatcttagatgccggcgagcaatttggaggggcgctgcggccagaaagacaaatgaatggttttcgtgatgctgtggccatgtgtggctttcttgacttgggtttctcgggactgccatacacctgggataaccgtcaagaaggaattcataatattaaggttagactcgacagagcttttgctaacgcctcgtttgcggatatgttcaaacagatcaaggtagttcataagctaacaacagaatctgaccactgtttgcctggtgatcgagtgcaaccgatcccagaggcgaagaggtagaagaactttcaaatacgagaacatgtggaggagggatccttcttatctatagctggttaaagacacatggggggatgtaaaccatgtcc

SEQ ID NO: 31679 - DNA, 716 bp, Oryza sativa
ttcatctcatctctctatattgtttatatcgggttattatccattaccaaagagagaaaagattgaaagatcttggattaaacaatttgtgtaattgttgctttggtgatagatgataaaccaatgtttatgggattaacctctcttttacataagttgtcaactaggttatttcctgataatgaaatgtggtagatatgtattcttttgtgatggaccttaatcatgataaggatgaaatgcatggagatagagcgatatgtatcacttcttatctcctactttttgataggttcatatatatcatttccatgttattgttatataagtgtgagactaatgtttacttgagtcttatcttatttagtctcctttacattgagacatggacatcatgaaggtatgtttttttgtttactttatcattgctacatgccttcttcatgtgtataggatagaccccattggttcttctttaattatacatacacttgtctctcttgtatagttatttgtatgcatatatttagggcgagcaaatcctatacatttattgcacatgttctagatccatgttcacctattatttatattgaatctttgcacttgagcttatgcacgagtatatgacacttgtggtgttaatgaatactcaacgaacatattcatatatttcatatgcaacccgggtggtcatcaagtggaggatgacaacc

SEQ ID NO: 31680 - DNA, 435 bp, Oryza sativa
ttcgcctggcctgcagcccttcccgtcattagcctgagccaggcgaccgaaatcgatcgcctgagctccaggcagcaacagcgatacatacttaccatcttaatcctaatctttctcggaggcggccacgcgacgtagattccaggagcgaagctgcgctgcttccgccggtgtgcgaagccgccgccgcccgccgtctttcgtaatccctgcgaagccgtgctgctctcgccggcgtgcgaagccgccaccgtcttgccggatccctgcaaagctgtgttgctgctcccgccggcgtgtgaagttcgtcgccatcttgccggatcccagcatagcagcatcgcccatgctagatgctgcccaggctgcctttcgtgcgaagcagatcgatttgcaggttgccagatgcatttgcacatctggacagaatcatct

SEQ ID NO: 31681 - DNA, 533 bp, Oryza sativa
catggagcattaaatatagattaaagaaaaactaattgcagaattaggggggaaatcgcgagacgaatcttttgaggctaattagtccatgattagccataagtgttacagtaacccacatgtgctaatgacggattaattaggctcaaaagattcgtctcgtggtttccaggcgagttatgaaattagttttttcattcgtgtccgaaaacctcttccgacatccggtcaaacatccgatatgacacccaaaaattttcttttcgcgaactaaacagacccttacttgatgttttagagttcaaaacaatttagtgctaacaaaagtatgtatggttcccaagttctcccgcaatatttgaagaaatggttataaaggaattattttgttgcttacaggggaagctaaccatcttggaattaagctttgaataatggacgttaacaactattgacccacaagaatatggatatctttcatggttcaaattgaatgtttcaattaatcaattctagccgtatttgatgggtga

SEQ ID NO: 31682 - DNA, 1500 bp, Oryza sativa
  unsure (1)..(1500): unsure at all n locations
gaaagctttttatatgaaagttgctctaaaatatcagattaatccatttttcaagtttgtaataattaaaactcaattaatcacacgttattaccacctcgttggtgtgaaacacttaatctttatctcatcttcaggagattcaaacaccaccatattacctaaaaatcatgtacatggtgatcaaagatgctcttcattacacatcaaacacgcagctaaataggggcgaatctttattatttatagcgagcgtgagtggttacggtatgcaattcctttcatcagcacagtgtgagcatcacgcgtccccgtcccgtcggcgcaccagcacagccacaggttggcccagagagggtgcttcaactgtcggcgcttgcacatctggaccgtccatcgcggcgatcggacggccacccgtcccgcaaccccgccccgcgtcgcctatacaagacgtcccacccccccccccccgtacgctcctcccccatttcgaacggatccgggcgcagggtgcgagtgcgtgaggcccaatccccaaatcccccccccccctcgccgccgccgccgcccgtctgcacgcaggcctcctcgtcggtgaggtccccccgctgatccgtctccctcccccccttcctgttgatccctgcgctgtggagtggcccggatcctcctgcgagatcccgtcgcccccactttctttgtttttttattttttacttnnttctcgggtgttcggcgcgggcaatgctggatcggtggcggatttcgctcgccgtaggtagcgcacggcgtgatccgttcgtctgtagggtcgtttccgcccaccgtgcttttgggcggttgtttgtgctgcgtctgtgcgttcctggtaggtaggaattgcgtggagagcattagcgaggagtggaatgtatgttcgagattcggctgcggaagctaactttgtgggacgatttctgatgggtccttgtatggtctgtggctgtgtgatgtgtagaattgtggattttgttttaggcctttggaagaggatgccacgatctgttttgtttagtttttcggtccgattggactggatttcctgaatcattctgtgctgatctcatccctttgatgaaacatagtgatgtacgtcagtatttgcaacggtgtggtcgttcagatgagcctgatcttgcagttagatttgaatatctagtaagcgtgacatgaacgtcttaataaacgtcacatgagcgtcacctactgttttctagcggcatagacgcctagtggagacggaagatctttctttattggttatcttgttgttttgcacaaattacttggtagtgatgttgctgtctgtgtacttatagacaatagaaagttgctttcaaatgtaatacttcacaatgttgagcagtaaacgcaccagagcgtaaaggttcttgtgttgtttatacttcatgaatagcaaactaccatctaggtgcttatagccaccttttatgcttg

SEQ ID NO: 31683 - DNA, 665 bp, Oryza sativa
tctttatagacttctctcagcctacccatataatagttagctttttataattaatacgtagcccacttgtctgtctcacggagtttttttggttcttgtgtccaagccggctgtaagtttacagcccgcttctcctctctctcctctcttctctcctccacctcagcatttagctggcttataaccttctattatacttgctctaagggacctaagatgaacttattcctttatttgattcgtcgattttactttagctggagcaggatggcttgatgtgggccagacgaaactggcataggaatggtcgacaggccgagaacccagctcagtattcgcatcgccatccttcggaggattcttcggcggagttattttagtactcccaacacgggtgcggcctaccatggacgacctcgccgtcgtcagcttcgccgggggcctggagcccagccagaagccgccgacctccatgagtttcagttgccctgttcgtccatatacaggtcttgctcgcttgaatcctaccacgcttttctttctctctttggcttcagtttcagttggtgcgctactgaaatgctctggcgaaatgcgtattgagatgaatgcaaacgttccatggattaaggtggaaaaactgccaagaaatccaactgggttca

SEQ ID NO: 31684 - DNA, 792 bp, Oryza sativa
  unsure (1)..(792): unsure at all n locations
aaacaaaacacaatacaaccacgcacgttcaattacatacgagcccacttaccaaatgcatacatatatacataccctatccgtataaccacctttaaaagtatgtcttaataatgacaaagtcaccacaagcttctcgcactcatcgaatgtgcaggtaaaaacgcattcgaggattggaccggtatattttaaaattgataaaatcatcaccgacgttttcctatcaacgtatagattgtctatcactaaaatagtatatgtactaagtttgcaacttgaattcagatggtgggttcaaaggaccttgccacaaccacaacccacaagggacaacaaggttacccgaaaatgtgagttctttaaaagcaatgagttttgtttctgtaaataggggtgatagatccatgatctattgttgcaagtaaaccgcaagataagattcgtgcaggagccgtatccttagacagatactaaatcaagtcagggctagctcagagtctcgatcattaagaagggacaattgccgctaatccgacagcgatcagtagcctgtcctttctgttaccagtcgtgggagagttcggattctccacaatttgtccaaatggagtggtatatcaaggtaagctgaagagagaggccggcgtttcatcatccattgttttttttcctgctgtatcgaatcgtacaaagaaacaaggagacggtctctttctagtatcgattaggctgtgnnnnnnnnnnnnnnnnnnnnnnnnnnnnnnnnnnnnnnnnnnnnnnnnnnnnnnn

SEQ ID NO: 31685 - DNA, 585 bp, Oryza sativa
gtcgcgccgcattcgaggcctctgcctccttatccctcatcctgcgcgcctccgccgcgccgagcagcgactggtattgccgccgcctcgccttgccgagcacgcgatggagcctctccgtctacaacaagcaagcagagctacaccacaaccatcagaaaaacatcgctgaacaacatagcaataacaaaacaacacgatcaacgacgaccctcacatgatcctgaaacagatgcaccatctcgttctcgtactggtcgaattgcgtgacgagctcgtctcggagaggagagacgatgcggaggaggccgtcgtcgacacgtgctccgacccgccatcgtctaactcgagactgagcaccgtcaccgccggccgcttgtgcagctgcgcgaggctcactaccttgtgccccttgcccctgcgcctgcggctgcaacgacacttctgcatgcggcgccaccatgcccgccgactttgtctgctcagacgattcctatagttgcccccatctgcaagccagggggaagaaaaaggaggggaacgaaatgatcaaggggcgcgccaagagtgtgagcctgtgagagg

SEQ ID NO: 31686 - DNA, 648 bp, Oryza sativa
gtgtttggtcagatttttcttctggcaatcatgccttatccaaacagagaatggcaagatatcatctcacacaaagaaagcaaccagccattagtccacagtggcacagtacgtgttgccttgcactcttcaccttcatcacgccctgcggctcaagattcgcatgctcgtgttgtattcaccttgcaaggcaaaacacatcacgagttgcacagcaaaccttcgcttggacagaacgagtccacagccttaaccgccatgcaatgcaccacctcaaatggcaatgggcattggcagaaagcgagatgtctcggccggttaaaagctccatggacgcagcacacgcaagcagttattgccacgtctattggctcggcaagtttggcatagcaggcagaaagcaatcaataaatagcacgcatttactggggggttaacataggcagggattgatacaggacacacccgtaatatcctccaccggtctaggcactttctgtatctatatatacgtaagcacgtcctgattcttgtgcatttctcgtcctgatttgcgtcctgcagctctctctcatcacagtttcgcaatggccaaaaaaacaatactgcaggtaagttacgctctccgtcttcgtccaatccgatcaa

SEQ ID NO: 31687 - DNA, 862 bp, Oryza sativa
ccccccccccgaacacacacacaccaaaaaaaaaaaagcttcccatattacccccaaggccccaaccatacctcatctatgagggggcatcatagtttcttttctattcacttaatctttgctaaaaccctagaaatgcttatattttggaatggagggagtattgttcttacttctttatccaacagctagcattcgtaccacagcttacagagaatatatagttgtctcattcagaaagctgaagaattttgctaaaatacagggaatgagatcattcagctcacaacattacaaagggacgtctcatcataggcagaagcagtgagatcatttaagtcataacattccaaatctttggactgtctaactgttcaatcacctattccaacttaatatgttcaaagaagtttgttcatagcagaacattactaatcagaaaacaactcattctagaattgggggtgaaactgttccagtcggttgctaggtgtatgaccaaatgaaattaccacaacaacaatgcgcggattaagatccagagttttagagctgtgcaagtatacgtagaacagtagtaagaagaggaaactacaggagcgtagcaagtcgtagatccagtaccgaatggcgcggatcgaagtagaggacgtccatccggaaggcgaggctgcgagtggcgaggcagcgggcggcggcggatcgaccaatgatgccgagcacgaggccgcggcagcgcctcatgccgcgacacatcggctggacggagcctagccacccagcggcgacagcggccggggccgacgaggcgtggcgcgagagcaggtgggtccggcggagcagcccgaggaagagcgccatg

SEQ ID NO: 31688 - DNA, 518 bp, Oryza sativa
attcgatgtgatggatgaaaaatttttattttagcaactaaacaaagcctttgtgctacatggctgaatattaagtctttcgaagtggtcatacaaaaattctcgtttgagctgtgctgcaagaaactctgcatctatcgccctgacacgcgcttcattacgatgaggttggcaagcctgcaggacatcctcgtctagtcgtttgcacatgatgtagcctgtagcctgtagccatacaagagagcacgaccaaattactggagtatggtacgttgctgcaccgcgtactgttgggaatggaaggcgactaatcaacctcagaggccacatcccatgtggtcctcttcttgaagacgtcttttaccctctactggaacggcagcagtaaatcgcattgcctcccagtagtcaatggccatcgatcacgagcaagcaaggcattgatacgcgcgtacgtacagtcagtcctacacacatccgtagtggtatatactccctccgtaccaaaaaaaaagaca

SEQ ID NO: 31689 - DNA, 3361 bp, Oryza sativa
  unsure (1)..(3361): unsure at all n locations
caccacctcaaatggcaatgggcattggcagaaagcgagatgtctcggccggttaaaagctccatggacgcagcacacgcaagcagttattgccacgtctattggctcggcaagtttggcatagcaggcagaaagcaatcaataaatagcacgcatttactggggggttaacataggcagggattgatacaggacacacccgtaatatcctccaccggtctaggcactttctgtatctatatatacgtaagcacgtcctgattcttgttgcatttctcgtcctgatttgcgtcctgcagctctctctcatcacagtttcgcaatggccaaaaaaacaatactgcaggtaagtaacgctctccgtctccgtccaatccgatcaattttcgtggcgtcttaggattattattttcttatagaatcaagaaagggaattttggttggttggttggttgcaggtggtttgcgcggtggcgctggtggcactgtgcgcgtgcggcgtcacggcgtcacagtagtcaccggcggaagcggggtgccgaaagcacgtcgcgaggatcacggagtacggcggcgtcgggaacgggagaagttccaacacgacggcgttcgccaagacggtgacggacctgtcgctgcgcgccggcgacggcggcgcggcgctggtggtaccgaagggaaagtggctgacggggcccttcaacctcaccagccacttcaccctcttcctcgaccacggcgccgagatcctcgcgtctcaggtgatctgagccaccaacaacatcggttgcatgcatcaaccccctctcttattaccatttaccatgattaactgcgccattatctctatctctatctcggctggtgtttcgccgcgaaagtagcgcatgttaaatgtccggttcctactactagctctaattcacctatagctaatctaatacccaatttatatgatagtcatgtcatacacacattgtatcttggagtcgagtccgtgctgcagctgactacatatctgtagctcactgcttttctctctcatcttttatctcattaaaatatattgtagctagctaatagtctgctatttttctctctcatcttttatctcattaaaatatattgtagctagctaatagtctgctattgtcccttctcttaccgtcacacttgtgaccaaacagtcacacgcgaccgccctaaagttggcgggtactagctacttccgttttattggcgtagatgatgctttttgccagggaaaaacgccttttttggtctggggtcccatatctgtcctcccaggctcccatctgttcttgatggaatctcaaactggcaaactgttaatacgaacattaacatgctaaatgccacggttacatgctgtattttttttttgtcgtaatcaaccttatctgattgtcgctctcaagaaatgggaggacaacgtattaaggcggcgcttaaatatgtgccaagagctgtatgttgggagcttgaacccggtgatgtgtcattgcaattgcggtggttgcctattgtaaggatgagctggtggctattgaatacatgtaaatgaaccggttttgatcagatagctgattaattagtttggaccattgaaggtcaatcgatgttaatgtgatccgtttcagttgctaaccgtgccgtactgagagaaagagaatggattgggagtgttaggacaaaagctctgccatgtcatttcagaaatttctactgttatatggttgctccacttttatgctttgaattttgtcagcacataacttgtggacctgctactcttatctgtttttgttcacccgttttcagttactagtgtaactggttcatctctcattatctgaagtgttgacagtctaagctgttcatttcgttcttcagaacttggaagattggcctctgatagctcctctgccatcctacggaagaggaagggacgaaccaggcccaagatacagcaatttcattgctggatccaatctcacagatgtcatcatcactggtacacgaatgaatgcgtgatgaagattgctattttctcaaccttttcgtgtaactgctgtgattgtggtatatgtttagctgtggatatctgaaattgagcaacatttcaggtaggaatggaacgatcaacggccagggccaagtctggtgggacaagttccacgccaaggaactcacctacactcgcggttacctgctcgagctcctctactctaacaatatcatcatctctaatgtcaccttcgtcgactcgccgtcatggaatctccatcccacctactgcacgtaagaatcatcagtactcgcaaccagaattcagtttctgaacggttagatatagatcatgatgctcaccttctttgtgttccgtgctgcgccagcaatgtgaccatcagcggcatcaccattctagcacctctcaactcgcccaacaccgatggaatcgacccaggtataaacatacaagtcacactgcacttgatcaatgctgccatgaggaaagcattggtttgtgctagatgtgatgagctcttgttgtccatggtgcagattcttcctcccatgtcaagatgagggacagntacatcgtgtccggcgacgactgcatcgcggtgaagaggggctgggaccagtacggcatcaagttcaacatgccgagccagcacatcctcatcaggaggctcacctgcatctccccgacgagcgccatgatcgcgctcggcagcgagatgtccgggggcatccgcgacgtgcgcgccgtggacaacgtcgccatcgacaccgagtcggccgtcaggatcaagtccggcgtggggcgcggcggctacgtcaaggacgtgttgtccgcggcctcagcctccacaccatgaagtgggtgttctggatgaccggcaactacggccagcacccggacaactcctccgaccccaacgctctgccggaggtcaccggcatcaactacagcgacgtgttcgcggagaacgtcaccatggccggcaggatggaggggattcccaacgacccctacactggcatctgcatgtccaacgtcaccgcgcagctcgcgccggacgccaagaagctgcaatggaactgcaccgatgtcaagggtgtcgcctccgacgtctcgccggtgccgtgcccggagctcggggcggcgggcaagccatgcgccttccctgaagaagagctcgtcatcggtccgcctgaattgccaacgtgtagctactgaaatactgatataggatgatagtatggtgtgggtaatggcctgggctatgagatgcttgggaccaaagagatatatatgatgtggtttagtgag

SEQ ID NO: 31690 - DNA, 1302 bp, Oryza sativa
aagaagagctcgtcatcggtccgcctgaattgccaacgtgtagctactgaaatactgatataggatgatagtatggtgtgggtaatggcctgggctatgagatgcttgggaccaaagagatatatatgatgtggtttagtgagtaaagttaagcagtttgaaaatgctgccggataatctctttacacccaattcatttatgagtgctcatctgcgaatgacctgaccaaagcaaagccttttcattttgtcttctgacagtaaatacagcacgtgacaagataacaaaatcatcaaacttctaaacgaaactttgcaaaaacaatgacaattgacaaagtgagaagcaaagctcaacgtgcctaggcagcggtttgcaatcaccgtcttcccctgcccttgctcatgaagtggtggcgcttcaacctcttcttccggatcaccacggaggacttgatgtgctccgcgaacggcatgccaaggagggtgagcagcctgagagcctcgttgtcggtcttcgcggtggtgacgatgcagacgtccattccattcttcttcccaccgacctcgtacgggatctccgggaacacgccctgatcacgaaggcctatggtgaagttgccatggccatcaaagctgttggggttgacaccaaggaagtccatggtcctaggaagcccaaggttgatgagcctatccaggaagttgaacattacctgcagcaagccaaaataagctcatcgatcaaacatattccctaggttcccaaatacttgtcactggatactattcatatttgaactttgatcacttatattttttagaaaataaaatgcatatacctaaaaatatgccatattattaaagttgttactccacatagataggtattaaactttcgttcgtccaaccatttaaaatttgtggtcaatgtaaaatactgacggccaacggtgacaataatttggaactggatggagtaattgcaattctcacacatactttaggctattatactgtcatgcaaatcccaaattgatacaacattgcagtccccaatttgtcaatgtctgcatcgcaagtagccagaggtacagaggactcaccctgccgcggagcgtaacggcaataccaatggtgttcccctcgcggatcttgaaactggcgacggacttcttggccttcgtcttgacgggccactggccggtgatcatggcgaggtccttcatggcggattcgagccccttggagttaccggcttcagcccccaacccgcaattcactacaatcttctcaaccttg

SEQ ID NO: 31691 - DNA, 2971 bp, Oryza sativa
  unsure (1)..(2971): unsure at all n locations
atttgtcaatgtctgcatcgcaagtagccagaggtacagaggactcaccctgccgcggagcgtaacggcaataccaatggtgttcccctcgcggatcttgaaactggcgacggacttcttggccttcgtcttgacgggccactggccggtgatcatggcgaggtccttcatggcggattcgagccccttggagttaccggcttcagcccccaacccgcaattcactacaatcttctcaaccttgggcacctgaataaaatcgagaatccaaaacacactcctctaagctcaattattgaacaacaatcgaatttcccgagttccgcaaagaaatggccatgtctatcctataattgcgagaagggagacagaggtcgaacacctggtggacattggtgtagccgaactcctcggtgatgagggggaccaccttctggtcgtatacagccttgaggcggtgcaccttctgtgcctcggtggggtcgacgaggacgatgcccgaaggcgaggtcggcggcggcgccggcttgggtggcgcgtcggccgcggcggaggcggcgacgcggagggctcggcgaggaggcggggagcggaggaggaggcggacgttacgggaggaggaggcggtggtggtgacggggaacggggccggcgaggacggcagggtcacagccgtggccgccattgaagcgtgcgcgaagacgaaggtgggagctaagaaggaagctttatgccatggatggattacgggataaggcgagttggctgtggctggctgccgttgctgtccagtgtcgcaagtgggctttctcgtcatggttcggcccatcgaactgttcgacatggtttcaggccttaggcccatcaaaaccgttgatttgggccttaggcccatcaaaaccgttgagttgggggtgaactaaacacggcttaagagaagggtaaagttacatgagtcaacaactgcaagtctgcagtgtgtgaatttcgatatatgccttgttttggtcaaccggtaacagtgtttgagtatgtggcccattctgtattttctaatgcactacaggacatcactagtatagtagtagtatgccattaaacgatgacttcaaacataaaaaacgccgatgaagagcttaaacaagatcaagcaaactctgaacctagcaacagttgctggcagatcagcaggagatctgccacgcttgatcaacattgaaaaatggacggaatatcacgacgaggatcctcgtcacatgcttatgcctaactaatcatgcagtaaccgtaacatgcagttctttataaccaggggacaatcactaggatctgatttgaaaggtcccagatcacaacattgcgcttgccctaccttgttctaccaaggaccagcaatgccacgaccgtgatcctgtgaggatcgacttgacaccaagagtagaaacacaacggacaatatcttccttgtcagtttgcaacctaatcctgataaactacattaacctccttgacctcaagaagtaactgtcagtctgtgaccttgtcacttgacagggccttaatgaacagccattcagcagtatggaggaaccgcctagtgtgcataagcttcattaattcttcttcacggtcaaaaagtaatcagccatgcatcactttcatatttacatccggcacatctcgtgaacaagagatacagaatgtcggcaaataaagaatataaaagaaagtacacattttatcagtgaacacctcactgtcagcagcacgactcaaccagactaataaattcagaatggtactgattaatatatatcattaccagcagtactagcaaaagcatcagccattcagccccagcacatcatttctaatacctgtgtgctccaccgtccaaatgagcttccaaatatctatctaaattattcttctattaacaggacagaaaagcatattacaaggctacaattgccactgaagcaaaaactaataagagatgacagcaaataaaaagaaaaaaatgtgtgataagtagctctcattggatcgcatctaaggtctctttcctcttaatcctcctcttgatctccttctccagctcctcaatcccacccacctcctccagctcctgtcaaccacataaaacagagacattttagaacatttcagacaatttttccgacgatcacaaatatttgtaatacatcttagaacatttcaaaatttccagtccttttatatcaacacagttcaaattctacattagcttcccaatcacaaattcatgcttgcaataaaggagtactgcaagtatgcaaactactcgacaaatggacaccgttggagcaggagtaagccaacaagcatccatggtagcatggggcacgaggaagcaaagcatgaatagcatgagacacatctcctcaccttgggaccaaggaacagcccatatggcacaccttcgaacttgtccatgtgatgtatctgcaagaatgaatggcaggcaaggatggatcagctcacataaattcagaaccacggcaagagaagctcagagacagggatgcgtggtcggctgcagttaggtggagagcgaccgggccggacctggtgggcggcggcgacccgccggaagtagggcacgttggcgatgggccccaccgggaagcggcggtggaccaggccgtcgtggacgaacatgtacgccatcccgaacagcgtgatcccgagtccctgcggcgaacggacacgtcagcacttggatcatctctgcccagagccccagatcacaaaaattcaaccttggcaatcaaattgaacaaaaagaaacgctgctagcgcttgtattttacttgttccggtgagaccgttgatgggtacctcgcatgggtgaccatggcgccgtcgcaatnnnnnnnnnnnnnnnnnnnnnnnnnnnnnnnnnnnnnnnnnnnnnnnnnnnnnnnnnnnn

SEQ ID NO: 31692 - DNA, 1278 bp, Oryza sativa
catctcctcaccttgggaccaaggaacagcccatatgtcacaccttcgaacttgtccatgtgatgtatctgcaagaatgaatggcaggcaaggatggatcagctcacataaattcagaaccacggcaagagaagctcagagacagggatgcgtggtcggctgcagttaggtggagagcgaccgggccggacctggtgggcggcggcgacccgccggaagtagggcacgttggcgatgggccccaccgggaagcggcggtggaccaggccgtcgtggacgaacatgtacgccatcccgaacagcgtgatcccgagtccctgcggcgaacggacacgtcagcacttggatcatctctgcccagagccccagatcacaaaaattcaaccttggcaatcaaattgaacaaaaagaaacgctgctagcgcttgtattttacttgttccggtgagaccgttgatgggtacctcgcatgggtgaccatggcgccgtcgcaatgcgacaacaatacctattgctttagtacaatctacgttatagggggaactatttaatcattcgagggatgttctctcatttgcttacagaatatccaaaggttatgaaattttttgacaacactcagataacatatctgtgcaactacataaaatcttatattcaaactcaactcacacgttgagatataaaaaattaaattcaatgtatgattagtagcgtaatgttcacatctgaattatcttttcttttattcgtgttgtgtatatggaagttgaacataatttttggtggactgatagatctcactatactctacattattactttttaaaaaaaaaaattcataactatttgtatcgaatttgaaagagaaaaatatacgagataacatccctcaaagatattagaatccattataggtttctctgggaactcatggaggccaggccactccgtttttctaaattttctcgatctcgaatgttcaattttttattgtttatccgatgcagcaaggacatcaagatcttttggagttcgctctacgctttggcttctcttgacagataaattcatttttttttggcaggcggccatggaatgtgaatgtaatcaactgaacatagtactacatcatgcacttttgtcattttaatacggccacgttaagcacgcttggtcaaatcctggtacagtgtgtttgagagaagtgatggggatttggttgaaatggaggaggatcgaccactcaccgcgccgaagcagaggccggggacgagg

SEQ ID NO: 31693 - DNA, 9858 bp, Oryza sativa
  unsure (1)..(9858): unsure at all n locations
tacgtccgccgctccgactgtttccgcgccgcgcgttccgccaccgccctccggcatcctcctcgggctccggctcacccaccgccacgcgcaaggggacggccagccgccgcgccgggagcggcgcgaacgccagccgcagcagcgccgggggcgatcggtgtgccgccgccaccgcggcgggggagagaagaggggcccgcgcggccaccagcctcgcgacggccatggatgccgcagccgcagcctacgcgaacgcggacgcggggatggatggacggttttgattgggcgggtgaagcggtccgcgtccgcctcggggagcgagaggcgtcgtccaagacaagtgggtcggatggagtcgccgtcgtcacgagtcaacttgtgattgtgagcatggaaattcgtgaggaacgccggctcggacccggtggcttttatataggagtatcaggggccatgtggaaacagcgacttattcacgttgacactaatttagagtattaaatatagattaattataaaaccaattatataaccttatactaattcacgagacaaatcttttgagcctaattatgtcatgatttgacaatgtgatgctacagtaaattttttataattatagattaattagacttaaaaaattcgtctcacgaattagctctaatttatgaaattagttttttattagcatatttttaacactccaaattagtgtccaaacatccgatgtgacacggactaaaaagtttttagtcccatctaaacagcccctcattactccctctgtttaagatggtataaattataatacaatgtatctggatatacctctgtctatatatgttgtattagaatatgtcacattctattttaggttgttttttttttctggagggagtaggcacgaatgcacgatgcggatgcgagctgagtcatgcatattttggaatggaattattctcagatcatcagcaattggtgtattggagattaaggtctttcctgaagctggggttatctcgttgccgctgggtgattggccaggttgaggccgcttgcctgagctaccgcggcgtcaggggcagtggaaaatgacattgcaggttcagggcacctgattcgccacgtggccgtctcaacgcatccgcgcacgcagcttctggtcagctatacaccgcgccggcgagccgtcctccgctgcgtcgccatcacaacgagttactcctgacccctgatctcaagcgtcggagttcacctttcgattgagcgctcgattctggtctgacttataaaggtgcgacatttttcatcattttcttatcgggaattggctgtttattatatatctaaattcttgaaaactattcaaaatctctttcagcatatactttcatcaagtatccaaacctcaaaaattctgagatttactatcggttttcgtgaaaaaacgtaaaccctaactgagatctgtatgtagttcatgttctagctcatcatcgttctgctccatgcatgccatggccaatgcttgctgggcacaataatttttaccaccacacttcttcttttaggcatagctcctttcctttgtcgttaaaaaattggagaggatagaacatctttctaaagtacgaactccacctgatcatgttcgcttatccagaataggaatgtggctgcctgccctacgaacgccgtaggccatggaaggggtgtgtacgtgtcagggcagcgtcccgacgcgagcgtttgcccggcgaatgctgctgctcgccgccccactacgtggccactggcatgtacccaccgcacttgccgacgcccacgctttcctcccgctgcagtcacgcttcagcagctcagcacctcccactcgtgaattgggcaccccatgaaaaagatggaaaaagaaccaaaccgcttcaacctcaacgatctactattaggggtttacaaaaccacacgattaacacacggttattacgattaccatgcacgataacctttgtagtttttaaaaccacggtatgtcttacggttaccgcgcggtaaccatcttaccgcgggagttcggtaaccgtattaaaaacggtaaggggaaccctactacttttactcagaaccttagatgctactcagatcactataaccactgggctatatgactatttacgaagccctactactatcccccttgattatactcgcaagaagagacatctagatcttttaccttcgccctggtgtagtcaagtctcatcgtttcgctacctgcttacctggtgatcggtggttcggtacaaacacgacggaatatacgagtgctctcgtggtgccgatggcgacgcgcgacgagaggccacctgacggcgacgggagcctcgccgtagtgggggcggccgcgccgcggttgctcgcgctcggcgacacgtacccgacgggggatttaggataactggttttcggaggtggacgtggtggtcaaacgcgcggtgagttttttaattgggggaaacttttggatgatttggatctccaagctgccgtaacagtgccacctattccattttcgcggtagcctgatagcgtgaagtgtgaaccctgaaatggacggataatggaatatggcaatatcgcatacggagtatgcaaatgaccgaatgtgtgtgtgcgggtcgtcgtccacgtttctcacagtctcacctgtctacgacagcaatcgactactactcctccgtctttgattttaatattttgtttgtactatttaatcatttattttattaaaaaaattatacaaatataaaaaataaaaaattgtgtttaaagtactttagataataaagtaagtcacaaataaaataaataataattctaaatttttttaaatgagacgaatgatcaaaacagtacaagcaagttaaaatacgttatattagaggacggaaggagtactacggattgattgatggatcgggatggctttgaggacaaatatctttgctatctgcttagctgcagtcgatcgagcagttaactaattggtttctactccatggagtaaaaggaaaaggaatgaagcatctattgttctctgaaaattgacaacagctcataccactaaacacgctaagcatgtgcaagaaaaataaaagaagagcggcaaaacatatactctctccgtcttaaaatataacaacaatcaatcttgtatgttcagatttattgtattagaatatatcctatccagtacaaagttgctatattttgaaagagatagagtagcagtactaaaagcgctaaagcatgtttttagtaaaagaagaagaaaaaagcgactcaagttctcaaactcatgcttaacacgctaaacatgtatagtaccaacagtacatgttttagcggcacctttgaaaaactaggggcacctttgaaacgtatataatattaaaaaaaatagatgaataaaaaacacataattttaacagaataaaagtacgaaacaaagtccattaacataattaattgagtattaattattacaaagcttgaaagataacttcatttgacttttaaagaaatttctatataaaaaagttatttttagaaaaatcatttagtcgtttagaaaacatgcttatagaagacaaagagttgtaattgctaaacgaaaaaataaacgaggccgaagtgaagctaaacaagctatgaaattaaataaaagaaccaaacatgtactaagtaaagctaaacaatcttttttgtttggcatgaaagctaaacaatctaaaacatgtactgccaagtaaaacaatatagcaaagcaaaaaaaaaaagtaaagctaaacacgctaaaaacatgaactaccaagtcaaaaagctaaacatgcactaagtaaaacaggtacgaagtagaagcacatttcttttacccattcataaaataaatgtactaaaaaaacctgaaccacatgtgttcgctatttaaggttcccaaccagaaccctccgtacggaaaacggagcgatccattagcgcgtgattaattaagtattagctatttttttttttaaaaaaaagattaatttgatttttttaaagaaacttttgtataaaaactttttcaaaaaacgcaccgtttaacagtttaaaaagcgtacgcgcggaaaacgagagagaggggttggaaaaggggtgtccgaacacaccctaagtagaagcaactaaacatgtactagctgagaaaaaaaagtagaaataaactaaacatgtataagtaaaataataagcatgaaattaatacacgtgctaataagtataaaaaagaacaaggtaactaaacatgtactaattaagttaaaaaagtacaaagcagctagacgttgtactactaaataaaataactaacaaacatgtaatcaatacatgtcccaagtaaaaaaaatgcaaagcaactacccctctgtcaaaaaaaaaaaagggtccaattctaaggacaaatctggattctgaatacatgcaatccagatttatctctagaattaattttttttgacagagcgattaaacttgtagtagaaaaataaaataaaacatgggccaactaataccacctaagtactccatccgtctcaaaataaatatagttttgcactattcatgttcaatgtctgttcatcttacttgaattttttattagtatttttattattattaaatgataaaatatgaatagtactttatacgtgagtcttttttttcataattttttcaaataatacagacagacaaacgttggatacgaatatccatggctacacttatcttggaacgaatgcagtatatactaactccgccccgaacaaatataagtctaggttgtttagcatgtattaagatttgtgaagaaagattattatgcctcgcattaataataggaaataattttaatgataagtaaatgatgggacaattaagaatattttattatgacaaatgttgtaagaaaaattaaatcatagaaatataattattatgagatggaggtagtaatactaggacaataccaaacatgtagcaaaaaaaggtaaaagttgaatggttgttaagggtaaaatagaaaaaaaattaaatgataagtaattgatgagacaattaataatactatattatgacaaatgttgtgggacaaatttaaattaaaaaatactaggacaaaaccatacttaaaaagtagtgggacaaatttaaatataaaaatactaggacaaaaccagacttgtttaaaatataaaaaatactaggacaaaaccatacttaaaaagtagtgggacaaatttaaatataaaaaatactaggacaaaaccatacttaaaaagtagtgggacaaatttaaatataaaaaatactaggacaaaaccagacttgtttaaaaaaatttataagtgtggctgctgggattcgagcccaggtctccacggccacaacgtggaattctcaccactaaactacagccactttattaaacaaggttaattagtcatcatatattgaataaaatatggttaaagcacaagaacaaacttccagagcattttttgcacgcaggggcagccggtagctaaccgtatctgtttgttattgatcgcagggcaaaatttgcagcttggcatgctgaaaccgcgatatacatttgtcgggcagatctcagtgttactctaagtctgaatgataatagacattcgcttcttcagtaattttcctccaccctcccattgtcattgtcgtgttcttcaagttcaatctgaattccaattctcaagcactgatcgttccatgaccccatcggtaggcaaaggagcaacaatttctacagattttcctttccagaaagcgatctatagatttcaccttcaatcaggaaggatactggaaggtagcaataagtgaaccgaacggcccaagacaatccatcacaaggatggcccatgtgaaagaaaacccacccaactgcaaattactaaggcccagcctgggcaaccaatcaccgacctttccagagcccaccgtatagcaactccgggcctatacggcacggcccgttatcgaggctcaccaacccgagcgggaatctccaggcaaaatcatcggctgcctcaaaacccctgagccgtgcatcctagggtttccctctcctcctcccctctctccccgtccggcaacgcagcctcaccgttcaggcggcggcgaaggccgcgtcgaccccgcgcagcgcaggcgccatggccgccccggaggcaccctcctgctacgttgggatcgcgcggcagtccgccgccttccgcctcatgaagcaaatggtgcgtgatactacctaattcaaagttttcctcatgcgttggggcatgcagtatgctattgctagacgtaggtttatgttggttaacatcggttgatcctgtcggatatggagtctgaaggagttgctgttgttgttcctgttgaattgtaactagcaacgtttgttaatgctacggagtggaatttgggaactgccgcaaacgagtgaacttggcttggattttggaaaggagttgaaattcacattcttcacgagttatggctgcacatagattgaatttagtgtagttaatatttctaatcgaaccaaatgagtaacgtgaatggaatggtggtttgcactccataaacaagtttatttcgtcagattatactgatttttctgtaatttagatttgttctctttttactgattttaaagtgtagttagcattttttttttcattatgctttaggggtgggaagaaggtgaaggccttggtaaagataagcaaggcattaaggggcatgttagagtgaaaaacaagcaggacactcttggtatgtttctatatagatcttctactttagaagtctatttgtaaggatatatatccttgttaaccacccgtgggctctcttaaacctaatctgatcgtttctgcaggtgttggtgtagacagtcctcataacaaatgggtatatgacaccacccaatttgacaatatactaaagaaactgaaagtggtatggcgtgtaacaattactttgtttgctctatgtataaattggtcattatttcagttcctaattgtttcctattatctttttcttgtcatttgatcgttgctcccatcttctttggcagcaatccgctactcctgctataaaaggtacctgacggtgtttgtgcgtatagttcttattttcatcttgttaggtgttgtttgataacatttttggtgtagcagaatttgaagatgatgtaagcaattcaccagatagtacaccaaaggaagctaaaccaacaaacaatgaagttaccaaagttacccgaccccaaggaaggttggtttgctcccatagcttcagtatttgtatttctgtatctattttttcttctctttacagtttacgcaatacttatttcagatataagaaaagagagagggggaaaagtgtgagcggttattcagcaaaagatcttgaaggcatacttgtgagttgttattcttatgtgtgcctatttctttcttagctaatctagttactatccatgagcaatttttttcttgtgcacctgtgtaaactgtgtaacttactttattacatgcatgaaatattgtgtttgcacaggttcgcaaaagtgatgacaattgcaaagtggaccaggaagttgaaccaacatgctgtgatgaacctgatcccatcatctgtcaagatacaggtctgtaatttgcatgtttagtttccccatcattgcttcttggtctgagccaggactgaggtgccaaacttttagaactagaatgtgtacacactgcatacaagtcactgaacagctaaatggtaaagctctgctgattatactcatatactgttaattttggttctctactagacgagatctaccatgtcagcatctaagttgctaattgcttaccagagtaaagcacattttatttgctctctaatctttctctcttcactaatggtttgaattgtgactacctgattggttgtactgcacatggtctgatgcttggtttggattgaaatgattctgataaatttgttactctaaatatgtaatcttcttttgagaccatagactaatatcattgagattttactaatagttcatgacaactctctgttcagtatcgcaagctgatgatgtgaactggtgggggcataaatttggattcaagtcaggcggctttctaggagcaaaatcgcgcaagaacaaatcttctgctacaaaaggtacttcaaatgtccgccagacatttggggaagaagaccaagaaaacctatacaatcttgttcaggttggtattaacagtctatcagatctcccataatgtcctataacaagactgtccatttcttaatgtgcttttagagactttttaaccacatataagcaacttgcctttgaattctatatttttcttacagtttggcctgaaattgcaaagtcaatttagacctctgttgattgattatcgaacaaatctgatgtatttaaaaacatatagatatagctgagttctcaataatatccattccatctaaatggtctttgtaactgctgcaggacaaagccacatctggaaagcagggtcttggcattaagggtctgccaattaaagttgccggacaccgttggaaagggaacaaaacttcttttggtgatagcgatgaggaaaattcaacccaatccaatgaattatcagagttggaagaagatggtgatgaggaagaatctgctacgataatgaactaatagacgccaatgtgaatactgtgaaagaaatgtgcgtggatgttaaacaaaaacataaaaccaaggtcaagaaactttgcaaaacaattcttcgtcaggtatggttgtttaattatcatactctctgtatgtggcttcatgtgttgtgccgtaatcacaacgtttatttacttgtattattcccaggccccagcacaatctatgaaattgaaggaacttaaggtagctgttgaagcacattcagagtctatgttctccaacttctcttgtaggcgtgaagctctattgttcttaaagaggaaggtacgggttttctttttcatttggcagaggctttgcgatctttctctctttcgttatggagtaattagggagcacctactatagaaggtatggtatgtagttgcataaagaaaaacagatagcagatttggttgcaatgtaacttgttgggatcttcaccatagccattgtatcatcagcgtgacctcattgaattagaacagaagctctattgagctacatgttgctactgggcagcggtgtaatagccttatttaacccttttctgtctattttgcagctccaaggaagcagaaaattcaatattgatggcaaacgggttcagcttgtatcgtaaattacgaagccgttcgggtgtgacatgaagccattgtggtcatattaggctattcgtgcttctgatgagtgtacgaaagtacggagcacagtatgctctgcggtatagatgtaagaagtaatacccctcacgcatggggggtcaaattttgcaaaacttacgaacggctgagatgctaattgtgtgtacactgttgagcacatttgattttcatcgttcatttccctacagcaaatgtttggcagccggttctgaataccaatgcacgtcaatattgtaccttagctggtgtattagctggtgtatcttnnnnnnnnnnnnnnnnnnnnnnnnnnnnnnnnnnnnnnnnnnnnnnnnnnnnnnn

SEQ ID NO: 31694 - DNA, 5300 bp, Oryza sativa
cgagggaggtgtgtatgggcttcctatagctgccagtatccaattgttaatttccccttttggttttcttgttacaatgtgtgtatgatgatgatgatgtaggctgtaaaggatggggctgatgccgtgattgctgttggtggtgatggaacacttcatgaggtattatttgtgttgacttttgcaatatggatacaacctttgtactaaatttgtccagaaacttgatattcaaatacggtaatatttgtggatggaatgtgcaggtcgtcaatggcttcttctgtaagggaagtcctgtccatgctcttgatcaaggacctgatcattccacagcgcttggtgtgagtgtacttagtttctagctattctatccaatcagatcacccttctagcctcttaaattaagcattagactattctgaactgaaatgtttgtttatgcactggaatttgttcggtagtgaagcggattgtttttctctgacagctcattccacttggaactggttcagactttgcaaggacatttggctggtatatttctccagcataatctacatatggtgtttagataacctctactttcactgatgtttctttcttttgtgcaaccaggacaaatgatcctcatgaggcgattgatcgaattgtgagaggttccttctttgattcttcttttatagtgtgtgctgtcagtccatactcgtggtctcatagtggtcattcatctcctggtatatgtatatgaatgcacagtaacattattaaagtaccagttgtcatatgactagccaggtgattgggtttgtcttaaaagatttgaaataaagtttttggaagcataacaatgaaattgctattataaactggccatcttcatgaaaatatacaaaaactagatttatgtctactacgaattcgcaatcataacatatgaggctcacaggtgcatatttttgcaggagtcaaatcaaaactagatataggtatgatggaaggcccagatggaaacccacattattttgttaatgttgctgatatccatttgtaagtcaagcatggctcatttgacctgtgaaattcaatggatggtttgaaaaggaaaaaattgctctgcacctgcaggagtgctaaggcgggttatttttcttctatgtacaagagatttggcaacttatgctatgtttttggagcgctcagagccttttggggacatagtaatcgagatcttagaataaaggtttgcatcgcactggttttagaaggaagcttagttgcaatcttactgatttttttcgtcattatcagtcccacacctcttgaatttactagtgcatataataggtaaatggtggagaatggaaaaccattcgtaaagtcactgcactatgcataggaaatgccaaatacttcggcggtggtatgaagatcactccaacagctgatcctttcgggggtgaccttgaggtgcctaaaaagtcatttttctttatagttttgagtaagcattaagaaaagttagcctttgttaatttatgtgtcatttcataggtcgttattcttcaagatttcaaatggcatgatttcctgctcaagcttcatagattgtatggaggaactcatctatcagtgactggtgtgtcatcgataaggtaaggggactccgctaatgaatcttagtgttgctctacttactttaaacaatgctgagttaagggttgtacttctggttggtttcatccaataacccttcagttgttatttggcatataggtcagatctccggacagattaatcttgttagcatcatcactggtagttttgcaatgacatgatggcaatcaaaattgttgaggaatatttattcgagctctatgcctctattgctttcctcctgatatgtgtctcattagttctaaaacaggattcaatgtttgttaagccttctcaaaatagctaacatcactattaggctgtttaactgggtattctatttggggtcactaagtgacaatatttttgtcgcagagttcagtcgattgaagtagcagaaggggaagttagtgctgacatctttgtgcaatctgatggggagcattttggttttcttccaaccaaattttcagttcttcccggtgcagttgatttcttctgctagattagtatgcttcttcctgtgggatacaaaggtttcttaatccttgtcaagtcactacgtgtactttgaactagctgtgttattttgaagtgatatcgtaattgaatagttacattcattttctggcaatacatgggataaaatctgttgtcacccgccatgtaatgactataattatatgcaacatttgctaatcaaactaccataaaaatttggtggtgacggtgcactatgaactgtttgaattatactggaccaaactggcatcaatgtaaatgacacaatgacttttaggcttgtaccctgtgtaatttatacttttgccttttgctcaacaacagaaggacatagttagctgcagtttcaatacaaaatttatttaccttcagcttccaacttcgaagttactattcttactcatagtaccttatgaatcagtcacacgatgtactcctatatgagactgatgctgctagaattcaccacccaacgttttctcaagagtaaattgcactttacactggtaaaacgcacctatttttgctttgtactaattttagcacatactttcagtttttatcagttgtactccctccgtctcaataaaaagtgcacttagtattgggtgtgacattttatagaacacttatatgaaatgtcacatccgatcttaggtgcacttatattaggacggagagaatattgaaataagtttcactttatgttaggatacatcatcaaacctatagaaaattcactaacttatataaaatttgaataaaactttgtgaaacatgttctaaatttgaatgggtccataaattccacttgtgttttataagattttctttcaattatgtgctgcaatctagaataatatacctgcatggaagtcaaaatatgtactaaagctggtgcaaagccaaacaaagatatgctctacccaatgctatgtaattcctccgtcccaaaatgtaaagagttttggttgaatgagacatgtcataatactacgaatcttaacagtagtcttacggattaggatgtgtctcatccaactaaaacttcttgtattttgggattgaaggagtacaatatactcttctcttaatttgtttggttcatctattattttttaatgggtatagtattttgttagggggagtactaatcaattacacggccgtacctgtgattatgaagtcgatttaaaatttctttcttgtgaagtgattctcaagcagagtatttgctgtttgttccttccatacgtaaggaataatttctgttgcttgaaaatttaaatggccattgagatactcctagaaagtaccctgtcccctgatgctgcggcaccagactttaaccctgtctatgacttgactttattctcataatctgccatgttctcctgtagccctgtcgcttgaccatgacgacgtcatacttatacgttctgaccttgtaaaacttgtactccctccgtcaaaaaaaaaaaaaagacaaaccctgggtttccgtgtccaactttgactgtccgtcttacatgaaattttttataattcgtattttcattgttgttagatgataaaacatgattaatattttatgtgtgacttgtctttttaatttttttcataatttctttcaaataaaacggacggtcaaacgttgaacacggaaaccagggtttttctttttttgggacggaggtagtacttcctccgtcccaaaataagtacagccatggttttccgcgcccaactttgaccgttcgtcttatctgaaaattttttgaaaaaatttgaaaacataagccacgagtaaagtactattcttgttttatcatctcataacaacaaaaatgctaattataaaaaaaattaaataagacgaacgatcaaagttggtcgcgagacgaaggtagtactacttacagcagctttggtcatgaacagcgtgaaaagaaagtgtgttccttctccgctgccgcctgggcaaagaagacgaaaataatggtagaaactggaaaaaggaaggaaggcttgtccaaagcataatccaataatcctacgtcgtgacaggtacggtatccgttttttccccgtacgtccttcccatgtgatgcgtcaacagttaaaaaattgccctcttttgctcggctcatccgcgcgccgcgcgcgtctcggccaacattggcaaacacgcgacgcagccaccgttccgtccccgcatcctcctgcgtctcctcgtgctcgtgcggctctcgcgctcgctgcgcgcctgcgccgaatcgagcgaacgccgcagccgcaggttgcagcgcgcgcgcgcacgtcgtgtgcccgtggctgcgtgccgcgagtcgcgacgccatgctaaaaagaaaaaaaatatcaccggacgcatcgcgtcgtatcgggcggagcacacgagtcatggacctgtacgacgttgtgggggcgtgagttttactcgtcctcatgtcatgtcgtccgcgagaagcaaaaggaatttacgcacgcgctcgtgggtcgggtcgtggaacgtgaacggcttgtacgtcggggtatatggggacaaaatggccttctgttgcgttgctacaccccgtggttggcgttgcacgtaaggcatccgatcgagcagccggagcgagccggggtccgggggtctgattgtgtgaacgaatcagtgatcgcctgaatggtgatcggagcatatatgctttggctggcccggcgtgatgattactgcgtagcacagtagcaggacgcactggaacagtactagtaagaaggccatgattattatcgtgattagagtacacagcctcgtaattgcacatacgcaacggaggcgctgccaggtgtcgtgtaccattcttttggtattagacttgccatgactatcgtgtgaatgcctgaatggcaattccgagccgtagcttgcgtacatcttaaagaaacccactcatcgcgatgacgctatcagccacatgaacattaccagccagactgtatcctcagggagcccggccgccaattgagaaaatctgcaaatgggtacgactgctaattactactatgatttaataacacaatagtagaacagtgtgaaggtgatactaccaaatatt

SEQ ID NO: 31695 - DNA, 11887 bp, Oryza sativa
gttgcgcaattgtcatgtatctcgtgtactgtcaatcataagtttcaattcatctatacccctttaaaagtctttaatattggttgcaaagaatttgccctcttaccattgcttttgtagtttttagaaattgcatcattatgtttttcatgacaattgctctatccatatttgaatatatgagattattcggttatatctttgaaaatttaaccgtcaatagctctaaaaacagttagtttgaaacacataacaatcatatgggaacatttttatttatatgtagttttacaatataataattttgttacttcctcaatcccaaaatatagctatctattactccaggagtacaactatagatcaggacaacttggtagctatgagccccattggttgtcctaataaatcaaaaccaaagccagaacttgaatttttaagttgaatttaagatattttcaatgtagttttttatattgggttttaagtcgctaataacacatatataaaagtgttacctataaattaactttcattctctaataagttgtttttggcttattatgatatatgtgcaatcgatgaggtcttatattttgggacggagtatttaaatagaaaacaataggtcaaataagtctcagtaacacctgagatcctgggttcgattccccacgggaatgaatttttcaggatttaacggtattgtgctttcagtggtaggcgacgtacctgtcgacagcgagacgcctgtggtgacttcgtcaatcctaatggatttgccggcccagtcttcggagatgctcataggggtagggtttgcgtgtgtttatagaggtgagtgcatgtgcgttgtgagtgtctgtgttgtactgtataatttttttttaaaaaagaaaagatagatatggtttacatgcactcttgctcagagattgaatttcagtggtgctgtagacctgtggtgcacaccatatccaaattaccatcgtccctactacagcactactcctttcttagctcactgtcggtgggtccacatgacaaactgggcccacctgtcatacgagcgtctcaaatcggtaacaacaaactcgctagcctcaccacctcaaaactcaaaagttacccagaacgctccccacgccgctctctcgtcgtcaagtcgcatgcctatgtaaagcagagcgaccaaagaatccaaggaggccaaagcgctctctctctctctctctctctctctctctctgcttcatcagctccccgtggcggcgatggcggctcagaggaggctgctcgccgaggcacctccgcaccagccgcacccctcgcggcaccagcagggcgcgccgtcgtcggtgtggagcgccgggtacctcaacgggtggctgtcgcagcgcacggcggtgttcgggctccgcctctgggtgctcatcggcatcgccgtcggcgccgccatcgtgctcgtcctggtcctcgtcttcgtctgcctcttccgccggcgccggcgccgcgatgacctcgcatccaatctgtacccggccgacaccaagattctcaagcagcatctccagcagcccacgccgccgaaggacatacaggagatcgttcgccggcagcagcggcagcagcagacgccgacgccgacgccgccgcagccgcctccaccggcggcgcaacatggggtgcagctcgccaaagcagagactccgccgccgccgcagcggacgcagccgccggtgctaccggcgggatccacgcggtcgacggcggccagcggcatgtcggccacgacgagcggcgggagcgagcgggacggcgccacgccgaggagcacggcgagcggctcggctgggccggaggtgtcgcacctcgggtggggccattggttcactctccgggagctcgaggaggcaaccgacgggctcgcggaggagaatgtgatcggggaaggcggctacgggattgtttacaagggcacgctgcagaattccgccatggtcgccgtcaagaatctactcaataataggtactaatcctgtgccttctcttggagcttttcgatttgatttggacatctccagcctttccatccttgtatagcctagaattcgtccttgggtgagtagaaaggatggagaatatagttaggaatacccgtttttattttttattttttaaagaaatcaattttccctttctgtttaaactggggtgtgtgatttcgtttgttcgtaaaaatgccactgatttcgtctgtttaaccgtgtttgtgttcttgttcatcggtttctttggctgtttgctccggttgtattcttgttcatcgaattgatacgcagatctctaatcttatcttcttctgcgataatgggttgttggacttggatatgatcagtctgatggaccaggaagtgagctgtcaaaaactgtgaatttccatttgaagaagggaaagatccttttttttttctagtgtatttgatcggattttttgtgcatagaggtgcaacttgtttcagtttattcatgaagcagtggtctgctggtgaacggttgggtcgtggggctcaagaagtttcaaattgctgtcatcatttacctcttctgtgcgcccatctccattccccattcgcctcgatatctgtgacgcaatttaatcctacacggctttctagggactggattaccgtttcattttctcacacattttcttgttctgttttatgacaacaaaaaatcaaattgttttcctgctttgccaggggccaggctgagaaggagttcaaggtggaggttgaagcgatcgggcgtgttcggcataagaatctcgttagattgctcggctactgtgtagagggcgcttataggtacaatgaaatctcttcatcaattttgtgcattattattccctctctgattaatggatgttttactcacattgccgttttggttgaacaggatgctcgtgtatgaatatgtagacaacggcaatcttgatcaatggcttcatggtgatgtaggggaagtgagcccactaacttgggaagtcaggatgaacataattcttggaactgctaaagggtaatgcttctctcactgttgcacgccaattttgccaaagtgggtaccttgaacagtgttatattggtatgccttgcctgattctgtttaatacttcgacattaaagattatgaatattatgggcaaatataggtcatgatcattcagattttagaagacaggtgctagctggcatgggaggcttgttttgttgtgagacatgcatcatagttaggatagtagagtctaattctggtgaaattgattgtcgtaggaattcaggtgctttactcaagtttgttaggttgtgttccttagcatgcacatattcccaaagacagctgattctaacccatgtttagcagatacgaaaaaaaaaacatgtttttttctttgttagcattaggcatcatttggttgttcagaaaacaattagaatttcatgtgcatttaaatagtacaaacgccaaagtaaaggtgtcgaatttcttggacattgcatgtgctcatcttgcattcgtcctttaattgctttcctgttgccagcttgctttattttaatcaaagcacccagtctgagattgttttgattcgctctatagagatttaagatactgcatgtaaataactaaatacttaccttgcacatgcgttcggactagaacattgtgaccctgtttgacagttaaaatctagattaaagcatcatgtgcattgataagcactctaccgataatattctttgcctgaaagcaatattgtcagtggcttgcttaaacaacatcaacagttcttttaaaagatgggtttgatagggaaacacatgaatactgacacccaacttctgctctctaggctggcctatcttcatgaggggctggaaccgaaggttgtccatcgtgacatcaaatctagcaatatccttcttgaccagcaatggaatgctaaagtgtcagattttggtcttgcgaagctattgtgctcagagagaagttatgttactacccgtgttatgggaacctttgggttagtattgacaatccacacacaacctttactgtacataaaagttagtacatcttatcatgactgaaattggctatgttgcagttacgtggcacctgaatacgccagcacggggatgttaaatgagaggagcgatgtttatagctttggagtacttataatggagattataacgggtagatcaccagtagattacaccagggcacctggagaggtcagtatcctacctattctttcatgaatctcttccaggatcgttggcatctgatggagctaaattgtcttcttttcaggtgaacttggttgaatggctgaagaccatggttgctgagaggaaagcagaggaggtagtagaccccaagctgcccgagaagccttctcccaaagcactgaaacgggcacttctggtcgcccttcgctgcgtcgatcctgatggccacaagaggcctaaaatgggacatgtaattcacatgctcgaaatggatgatctactatgccgcgatgtatgttctactcacttatgaactttttgatttcttccatttactaaacagtatagttaactcattttctgattgcaattgttcatcatacaggataagaaacccggaagagatgcgcctcagacatcggacagacacagctcaagggatggcgggaacttcagcaagcgtgagaaccaacggtacagatgacaacagcccagcactacagttgaacatgagtttgtatggattgccattagggattgccaatattaaccatgttgtcattacataattttttcccctctcgttggatctcataaccagctctccttgctcttttgactgtattatactcgagcatcattctatgacacttgacacttataaactacacaagtgtagggtggtgttgtgactgagactgactatgccccagctaatgcttacagtgttaatgtgattctacctaatgcaagtacagttgtctgctctaatgcatcttttaccagtccactcctgataccagctgcctgctttactgcactgggagaagtaatgctttcttcttgtagcctaatggttggtgcctgcttgcacatgatgtcacatgaccatttttgcatctcatctcatctcacacttccatcctgcatctaaccctttgtttatgatcgccattagtagttggctgcagagcttgggacttgtatattctgctggcaaatgcttttgtccactatactgcatctggtgatcagctgcacagcatttgcgccagttcttgtcgcttcgccttgtcttgatctaaatactaatcttcgtttccatgttcagttgctgtgactttttcgtactagtatattcattagttcttttttacagccaaccagctctggatcttgtgctaataaacttgaccgctgacagtactgattaattagcaggtgatgatcctaccatcacgtgaatacgtgatcgaacaactactgtgcaatcaccatgtatgcaatgaatggtcaagtactaacatgataccatgccacaaattagtttgatcatgctgattcatttatttgacactgtacagtctgtactactgaagtggaatagcatgagagaagtttctttcatttttcaacggttagcttggagctactgtgccctggaaatgttcagagatggattcttccattagaaaaaggttgagttatgacttgtgagttgagagagtagtgcaggacacagcacactagtggccaaaaaaacggcttggaggattcatgaaccgatggcagaaaaaaacaagaggaaaaaaaagcacagcgaaaggttatccggcacaggctgccgcaaatactaaatcttgttggacagagacatttttgggtgatatctgacgcgttcttcaccctttccccactttattcgatagaataattgaataaacattcacctatcttgataatgcttaatgccttagtctaattattgcacaaagtctctcaacaacctgaaagacgcagctaagcctgccactgccgttgtgatgacttgtgaacagctgctgctgcttcatcaagctgataatgcacaatcatatgccatggtacaggtacacgcattgtcgaggtctacgtccacatagcttcaggcgatctccgtcctgtagcgtagcgacctcgtgaacacctgagctgttccgaaatggacgcgagcaatatccacaaggcaccaggttgtcgggttgccgccgttggggttttcccggtgggccagtcgacggcggcaacgccacatggaatagaaccagcccgacgtactagaagaaggcacgggcgccagtctgttgcggctagctcgccccccatggcctctggtccagcctttaactcgtcgtgttcacctcgcggttcgattcgattcttcttctgccagcagcccagccttcaccgtgagtgctactatactgatacgttgtgtagccatcgatatgcaccgtccgattagtgaccagacggccggaattacatcgatttcgatcatgtttgatgaagcttaacattctaaaaagacaatcggttggtagtcagtttatagaaatatgaatctactagtttttttttaattatgcaattgcaacttcttaaatttcaaataaaaagctgaattgtttcgaaaggttttgttttaggagaagtttcagctaccagaaactctctcaaatatgcccatagcccatccgcagttggccgctgccgttgttacggctcccgtcacgcgcggtgtctctcacgtcctctgcggcggccgctgctgcttagctggatagcaaacgccgagccgtgcacgctccgctgccatggacagcgactcgcgtcgcgcagcacggcgccacgagcgcacaacgcgccgggccagcctcacgcgcgcgcggacgacggcgttccactggaactcggtctttctcacgagacgccgacgccgtcgtctactcgtcttcgttcacagatggatagggaaaaaaagggaaacaaaaagggcgacgcgcgtgagcttgcatgattgatatgtaccatactaatataatctgacaaaagaaggtaatgctaagagataagagaggcaatgatcactttcagcctttggaaagctgacgctgaggcaattatgtagggaaaaatggtttcatcaagttgtgctagtgtcggcataaaagactgcaatagtgctagttccgtatcaaaggtgccgcactgacactgaggatgagggtgtatgtacatgcatggggagctcttttgatcaatcacacaagagagatgatgacactactagtaagcatatgcctgaacaagcacacacacatacatacaggtagtatgacatgcatgctgtcagttcagcagcacaagagatgccggagagaacaacagctgcgttttagcttctaccacttgcagttgcctggctaccaccaccatcagagagagggcctcttggttgtttgccgttgttctgtggggtcaggttgtctggtgcagctctctttggcctcaactacagtcaagataaagcgttgataaatagatgttccatactgatttatgtaacctttgtgagagtcttaggctcttagcagcgcaccttttcctcggatttttgataaaaatgcctcaacaggatgttcttggggtctgttgttatcactgcgattccagacacaaacggtcagggaaatagtgaaaatagcaacaaaaaaaaaagaggtgatttctgtacagtaaaaaagaaaacttggaatagttggggtagttctggtaggaatggacgagagcccagaaagaaccaaaacgaggtaaagagagcgagcaactatcgagtctgatcgactacgaaaatatctaagagcaggtacaatagcaggctattagccagctgtaaacatattttaatgagagaaaggatgagagagaagagcagcgggctatagatctgtagccagctgcatcggggactctaagacgcaatgtatgtatgacaggtgtgaccatatattaatagtatagtaagcaactattgtatgaattggctattagattggctatagatgaattggagttagcagtgggctatactattaaacttgctctaatgaactaaagcactcaagaattcaccactatcagaagcaatatcccatgcacaggaaattcaagagggaataggcagcaaaaatacggaggggctgttcagattgttgccaaaataaaccttacctaaaattttagcaagttgacaatattaccaaaattttggcaggatttcttatgtatttaccaaaatttggcaacaaaccaaatgtaggcacatttttggcaactttgccaaaaaatgatatggttgaaaatggcatcaatctgaacagcccctgaataaactggaaactaaggaactagctccatgcctgcaacggaccaatgaagtacaatgtttacatagaatatctaaaaacaatgttctttttttttagataatggaaatggtttacatctttggcctctgccaacaggcacacgggcaatgagtcgagaagaaaaactgtgttctataaatgtaaccatccaaatcatattggcaatatggcataaacagaacacttcaataaaactatgttggcagcactagaggaagatgactaatatgagaggttgctttggttggccagttcatttgctccttactaataaattgcccagcttgcctatagttttctttcatttttcttttgtggagatggtaagcagcatgcaatcaattttttactgaatacctgtacctgaaatctggagatagttcagtggacaggcctgaaagcaaccaggatgtttggtggttcggcctggcctgccaaaagattaggctaggaggaaaaaaaggacttaacagaatgctcatacaaaattgtaataggtacacatagtgggtcagagcaaagtctctgaggcgaaaatactaaattatgttgattcatcattaggaaactccaacctctagtccaaatagatgttgctctagcatgtgttattccaaaatttgattgctaaaattataaaagcatttaacttatcaaatcaattcaaggggactcaactatgaaggtgtaagatcaggtttagttggtctttccagtttgccggctaggccctggctctctgactctcaaccttttctgctctccctcataaagtcatactccaagagaaaagtttgctttgaagctataaaaaatgtaccagaacaaaggtcgtaagggaactacttgaaagtaagctgggcaaattagccataatgtatgtgagttacatatcaagaagccaaaactacagtcctagggaatgcaaaaaatattgactttgaagacatatctaacagtccaacagaatctattcatggatctatcactcagaagatactaaagaggctgcattactgaaaacagtatagatgattggagttaaatatgccagccatgaaaggcaagatagtcactttttggctcagaccaaacaactcagaggatctgctatgccatgtagagtactactgtaaaaggaatttgatgcaatgtgaatgagcagtcacattcaactatacacatttgaacgtttaggaaccacacactcagaagtgaggagcagcacagggaaatcagcattggtaaaagaaacaagggagcaagataccttgaccgggaggtggatccgtcctgtgtgttgcaatgtaagtggctggtacgacattctgaaacacaaaaaaaatagggataagtattggcagtttcgcaccaatgcaacatgtccggactccagagaataagttaccagcttgatactctgacgagaaacacaaatatgacaaactgaatatatgctttgcaaattacaatgcaagtggctgcctggaatgacattcggagcaaaaaccgactagtaattcatcaccacaactgaaaccttaaagggcgttggccatgagagaaaccaaatcctaaatgtataatccatgattcacaaatacctcccaaatgagatattatgatccaactatttggcattgggacttagaaacaaatagtactaaccaccttttgttaatcatgcgcactggaatttcagacacacgctctgacacacaataggactgactagaggtaaagctccggcgtgagggatcaggcacacaattcatggcatcatcaacacaatcaacctaattctgaattgtacttggcggtcggaggcatgagatcacgacagctaagcacagagatcgatcgcgagtgaggggggacagagtcacagaggggctgaccgaccaagggctgcgcggaggggtcggcggggacgacctggctgaagttttgcgggttgtaggacggccagccgcccagggagctctccatcgccgccgcggagctcgcagtgacgtcttcgactccgactccggcgacgccccctcttggtttctccacccttttccagcgaccatggattcgtggaggactataatggagcacacagagtcaacattaacttttgggtttcggcccattattgctatcttttgggccttagatttcactggccaaatgggctttaaggcccattttctacctatacatttgtgcttagcgttgtcttgtgtaattgtgttattatcagataataccacgattatacgaatgaattaattcttttagataatggaatgtaacattccagtctttactcaaagagttacagccaattattacagaactcacacagaacaaaactcacatagaaagttcacgatagcacaaacaaagctaagcaaacataaactaatacacaccaacagaagaaaaatatgccataactattgaattgtattagagaaccgccacccgaagttggcaaatatatgcataattgtcgtcaaacgaatgaattaatgaattaagacagacaatagtacaagattcataagttctttttttcgaaaaaaacaaaacacaatacaaccacgcacgttcaattacatacgagcccacttaccaaatgcatacatatatacataccctatccgtataaccacctttaaaagtatgtcttaataatgacaaagtcaccacaagcttctcgcactcatcgaatgtgcaggtaaaaacgcattcgaggattggaccggtatattttaaattgataaaatcatcaccgacgttttcctatcaacgtatagattgtctatcactaaaatagtatatgtactaagtttgcaacttgaattcagatggtgggttcaaaggaccttgccacaaccacaacccacaagggacaacaaggttacccgaaaatgtgagttctttaaaagcaatgagttttgtttctgtaaataggggtgatagatccatgatctattgttgcaagtaaaccgcaagataagattcgtgcaggagccgtatccttagacagatactaaatcaagtcagggctagctcagagtctcgatcattaagaagggacaattgccgctaatccgacagcgatcagtagcctgtcctttctgttaccagtcgtgggagagttcggattctccacaatttgtccaaatggagtggtatatcaaggtaagctgaagagagaggccggcgtttcatcatccattgttttttttcctgctgtatcgaatcgtacaaagaaacaaggaaacggtctctttctagtatcgattaggctgtgacctcccataagtgatacaagaaccggca

SEQ ID NO: 31696 - DNA, 800 bp, Oryza sativa
gaggatgcagatgcagactgaaaactgaattattgacatatatgacgacatctatgtacgaaaaccttgagcaaattggctaagtgaaacagcgaaatctaagatctttttcggcggattgatggcgtttcgagggtggccaagggcccgtctttgctgttggttacggtcaaggtataactgcttgcgagacatcatggactattctgtggccatcgatgtgggggtgtttgtgtgagtgatgtgaagatgctggcgaaagccttgccgggtcttgggccggttcgacgacgacggcgcccatgggcgccgtttcccttcttggaggcgttgtcatggcattctttcatatccccacaaatttctaggtgaaaacctccttccgactttcgaacgagcggcggtggcgttacacgttgtgtcctccttgggggcgtcacttcggagaagttctaacgcatcgacgactgtcgatagtctttttcggttcaaaagctttcataccttttgttcggtgaggccttcgccttcttgggtccgcttctttcttgtggtgggcaacacgctcttcggttgtttctgctaatgaagtcgaagctgcttgctgatgggggtgcggcgacgctcggcaatgatgacatgttgcagtctcttccaaggagctctggtgctggccgtgtgaaggaagttgctcttcggtggcttggctgacgtccattgttggatgtcggagctacttttcgctttggtgactttcgtggcttcagtgttgctgcagttgtggagtcggcgctgctagg

SEQ ID NO: 31697 - DNA, 6291 bp, Oryza sativa
  unsure (1)..(6291): unsure at all n locations
ccctcctaatgtagatagagttaccctcattattatttgatggcacatactgcactagtatatatgataataaatgcagacatgcaaataaacagttaaatgtgaagtgtatagcacatgtaagtaaagtaaaaaaaaaactcaaacctgcactagtaaatgtagtagaacaagtatgtaggagcaaagtatgaaagttaaaatgatatgtatacatgagaacagggggagtagtagtggctcaataaaacctccatgtttagtccttaattagaagcagatgttgtttgagagagataccaatcacaataactttaataacattttaatcctgaataacttatacagtttcatgctgtatatcttgcacgactggagcgatgaggactatgtgaagatcttgacagtgtgcaaaaatgctatttgttaaaaaaaagcaccatgaaaaattaatatgtatgaagctatgccgaaacaataaacctaaataaatgcatgcctatccatataaattttaacccgctgacaacccgacaatgagttactgcatctatcctaaaatataaaaaaattaggattaaatacatgtattacgaaagtaggcagaataccaataataagttatcatctcatccaaaaatataagaactttaggattgagcacatgtattatgaaagtatgtagaattaagtaagagaaagttgtgattcattgagaaaacgaagtaggtagagaaattaaattaggaaatgttattattggttaaaaagagtagaactactattaggagcgctagagcgtggaatattgtttatagcgccaaacatgcgttagcccaggcccaccccaccccacgtcccgtcatcccactcctaccgatccgagtaaattgtttactccgatcgggtgcctctaccacccacctttatttgagtaaacaatttacttcgataataaaaacaacttccatgctttcgatctcaccccatgtcccgcatcgtgcacccaccattatcggagtaaatgatttactacgataaaaacaacttctctgcttccggtatatattctatttttcccgtacccaaccaaccactctcgcccccactccgttttttccttttttttggatctgaatcgatccaccatcccagcccacagatcggcgacacaccatgaaggacgacgacgacaccgtggtggttgatggcggtggccggcgagcagtggccggcggcggttgaggtgaaggcactacttcaggcctcgctgctggacgctaggcagcaccataaccagcaaggaggtgttcacctgagccaatagcaacaaccagcggctactccacgtcggcgacattgatagaacaagcaagtaaggaaatgacactctaatttgcatctgcatactctctttcaacttcacgcatgaagccntatttttttttgcaaatcaaattaacatgtaatctccaatattacctgatctcaattgataggctgcacaggtcctacatttgcacatcgtgctccatgtagctggcccaaaaggttaaggtggagtccaccggtgatggagattgttggctatttttcttttgctcgtcatctgtattgacatgaacgagaatatttttacatttttttgtgcttgttagatgatggatggctgctactgtgcaacgtcaagctcaactctataccacaccgctacattcttccatgattccatgatggatttttggctgaatcattttttttcttttctagtttgattcacctgtgagtaattttatcgcttgtgtgtgattgagcctgtaatttttttcattcatacaactattttgtgatacagatcaacaatactcttagtaccagtttttattcttatactgtatattgaacacatcagtaaacatattactacatggtggctatgagatcatggctatatcgagaggaatgtggaaattgttttactcgcagaccacaaaatctaaataatattggtaaaagaattactagcgttgtaagcttgtagtaattcttttacgaccatttaggtatggcgtcatacgatgtggagacattcatgagaataaatttgttactttagaatgagcagatgtgggaggctgggagtaaatgaaaaattccacggagtaaattcgttacttttcaaacgtgcggagatactagaaaaacggaaaactcggaaagaaaaactagacggtaaatattttactaaaacgcgaaaacagaaaaactatagagaaggaatgaataacagaaaaatctggatggttaatattttacctggaccattgatgaagcacatataagatggaaaagagaaaaaaagaaacacggaaggtggggtgttaaaaaacgaaaaaaaacgacccgagaaaaggtgggatgcggaggaaaggtggggtggtaaaaaacgaaaaaaccggaagtagaaggcggtgtgcagcgctcgaattattattccgcgctgtagcgcgtggaatagcgctaccgtaaaagagagtataagtgaagatgttgcaatattttaaggtaaattttaaatgctagaagttgttatattttagatagagagagtagctaaagttatttcctttatgtaactatacattgagagcgttcatattagccacaatatatcttttattaagagaggtcaaagatgattcatcacaatctctttaaagacctatagatgtcagaacaaaaataagaaaaaattaccctgtaagatcatggtgagttcatattataacggtatagattcatctctataggtgtacaagtataattgtatctaaataaagacatgctaatagctgcatatcaaacttaattcttttttatatattttatctatataacatgagttaagagttgtttatctccgattcaattttaaaggtatattcctgtgtaaaattgtgtgaaaaaaagctagtttgccaaaatggagcacatggggctaagctgacgggggatcctctagagtcggccagcattttcatcctctactattttccaggtcttttgaatcgtgcgaagaaaaaaggggatcgtctttttccatggatctgtaagtcttccatatacgcaccgtcatgctgacattttcagtgatcggatgaatggcggcatatatctgggaccaaataaaacctggtgcaaattggctccacgaaagccaagatcttattcagagagtaatcgccatggaacatggtgagattggcatatactatgtaagttggacagttggtcgatcaagtcatcaaacaacttacagagaagataaggtgcgaatcgatgaagctgaaccatgagtgcaaaaacgttcgtaaagtgtattgacgtacattcattgaattttcaggggaaatttgtctctaaaattgatgaatcaaacatttgaaaatttcagagaaattttccagggaataattttctctaaacttaactgccaacgtttggacagttggtcgatcaaacaacttccagagaagataagatgcgaatcgattaatctgaaccatgcgtgctaaggtttgtaaaatgtattgtcaaggattaattgctaacctataacgtacattcattgaattttcagggaataattttctctgcttgcagacagtcagtaaacccatttatgaatacttgatgtacatgtcctgattcgttctcttctctgtcaatgtggatgatgtattgatgtatatgtaagtataacagggtcagtctaaaattaaacacaagacgactttcccgacacgcttacgcgcgtcgcgttgaaaggattcaccgacttattgactcatagtgcaaatctaagtggcatctgccttttattttcaaattagtttggcagctgaagataaagcttccggctaactgctaggttatggggctaataacacacgagaagataatataactgaacagacaccactaactacagaaaaggttgcacatatgcaaatggaaaatgacatgccccattaccagcactgtgcgtgataaccttaatatacccacttatccctctatttctttcctgcttcaacgtggaattgggccatgcacgttgttttcatggcctaatatgtttcctgatttgttaatcgtgactcaatcgctgaccaagctcaactctgatattgaccaagttaggtaaagtagggtagtatatcttagatacactcgataatacagtaatacaccgataagtggaatgtgatttcaaccctaaaatttcgtatttaattctcaacacgcttataatttcttcgtgaaacccttccaaatctcattttaggtaaagtagtgtatcaagtaaaaaacaagccaaaaggaaaacacttgttttttttagtttgttcgttcgatgatgaagtacccacgttccactccaacagaagaggccaaactaaagatcaggcatgctgtcctaagagaaaatcgaaggtcagactgagtcctacacaccaagggtagcttctgaaacggctgggatgatgaacaaaagggtgtcttttgtgcgcagcatctaccggccaatattcctttgcaggcgtgcgcctggtgattcaccaccagcagccaccggattctccgccttgcaacccatgcaatctcgagaatatgctgcatcatgaaactattcttaatgccgagaacaacgagagaatcattcagagttcagacatcttttcgacagtcatatgctagctcctgctattagagcaaatttaatagtatagtccactgcaagcttaaaatcatctatagtcaatctaatagtcaattcatacaatggttatctagaaatgtatactacactattaatatttggtcctatccgtcatacacacattgcgtattggagtccgtgctgcagctggctacaaatctgtaagagcaagtttaatagtatagctcaatacaagctcaaaatcatctatagccaatgtaatagccaattcatacaatagttgcttaatatactattaatacctgattctacttgtcatacatacattacgtcttggagtccgtgctgcaactggctacaaatttatagccagctgttcttctctcttcctttatctctttaaaatatatttatagctggcttatagcctgctattgtacctgctctaagagtaagtataatagtaggctataaggtggctaaatgctgaggtggaggagagagaagagagaggagaagtgggctgtaaacttacagccggcttggatacaagaaccaagaaactctgtgagagagacaagcgggctctgtattaattgtaaagagctaactattatataggcaggctaagagaaggctacaaataaccttatagccaacatgtcggctgtattattagagcaagtacaatagcaggctataagcaatctataaccacatatcaagaagaaaagagaagagagagaagaaagcggactacagatttatagccagttgcaacacggactcaaagacattacgtgtgtatgagatatgagaccgggtattaatggtatgatatatttttatagttaactattgtatgaatgagctattagattagtaatagatgatttggagtcagtagttagctacactattgaagttgctcttagccttgctctaacccgctttcttttctctcttatcttttcttctcgatacgtggttatagctgggttatagtctgctattgtacctgctgttagaagtattctatccatgttcacgtgtgctggtggtgatcatgtccgatcccagctcagatgggcctaaatgagcgtgcaattcttggtcctcgaaataggagctgtgcattgtccataggagtacttcatgattagagagtattggggcgtgatcgaccaaaaaactacacaatctggggcatccttttcttttattagaccgatataattaaccatgcatcatgcaatgccaagtgcccaagtatattgctttcaccacaacgagggttcacgctttagcttttgtcgcgctcattcaagtagcaccatccacaataatcaaataactttccttttgactgaacctgtcgagagtagtaaaaaacagagaccgtcacgctgacgaccagcgggacagcaaccgccacgtgggcccccacgatgccggtcggtcagcagatcgggcaggcgagatttgcccgcacgttttgccctcaaacccctgatagtacgtgcctttgacagcaaaagaagccgtgg

SEQ ID NO: 31698 - DNA, 4101 bp, Oryza sativa
cccgaaacgcctcgtcggtttagctgcaacgtagattcaccgatcgatcgatcccttccaccacgctccactccaccgggggaggtaaatccacgggaaaacgggtgtagtgaagcgagcgaggcgcgcaccaaccgcagtcaccaccaccggcacccaacacccagacgcgcggctccccggttgcgccgcactcgggctgtttggatggtatacgaagtttatcatcattcatcatactttttacgtcacatttgtttaagttgtggcttacaagtgtcacactttagggagttaatgacatgtgaggtcataatagatgagaagaaatcttgtcataagtgtggctataaaccaaacaatagactaacttaatcaatcttgtctactggtgtggtaatctttagtaacctttaggaattaggatcaaaccaaacagcccctctggggagaggccgttacgttatcccacgggggaaaaatacgagaaaccgcaaccgaaaagagaggaggaaaagggagccgcgcgccgtcgacgccgtgccacttaaccaaccagccaactcaagccccgcccgtaataaagcgagccccccgccgcacgcacgcacgcagccgagaccaccctgctgcagctgctgtgctgcgcgggttaaaaagagagagatctattaactggccctcctctcccacagcaaacacactcgtgtcgtactgagcatctgagctcggtggttgccgaggaggattcgccggcggcggcggcgggggggagatgtcgcagcatgcggtgtgctgcggggcgatgttctgggtgtacctgatgtcgtgcgtggggctggtgatgttcgccgggctcatgtcggggctcacccttcggcctcatgtcgctcagcctcgtcgacctcgaggtcctcgccaaggccggcaccccgacggacaaggacaacgccggtacgtcctcctctctctctctctctctgccccccctagctctactgctgctgctgatcactgcgtgtgcgcgcgcgcgcgcagccaggatcctgccggtcgtcaagaaccagcacttgctcctctgcaccctcctcatcggcaactccctcgccatggaggtacaaatctctcctgctgtttttcgatcccctgtatgcacgtatccagattggagctgatggctttgtggcggcggcgtgtgcgcaggcgctgccgatatttctggactcgctcgtcccgtccttcggcgccatcctcatctccgtcacgctcatcctcgccttcggtgaggtgaggcattgatccatctcgcgtgtccatggactatgggttgctcacttggggtttggctggctgattcggtttctcctgtggtcgcagatcatgccgcaggccatctgcacgcgctacgggctcagcgtcggggccaaggcggcgcccgttgtccgggtactcctcatcgtcttcttcccggtcgcctacccaatcagcaaggtgcgcctgctggcttagcctgtttcgttgctcttgtttgcttgcaaagaatttgggggaggaattggaaccttgtagttggtcacttggccggggtgtgctcacaatttggatttggatgggacactacaagtggctgaccgcgactaggacgcagatcggttacttactgattcattaattaattttccaatcaagggacttgtcccattctcatttagtcatctgtctacaaaattctttgtagccggtgactaattaattagtaaatgtaatctgtcccattccccattgaaccagaataagcaatcatagccgtgaagcaagaaccctgttttagtgttcttttttcctttgccagactaggaaaaatgccttcataagcgtgtttgattgctcctgaataattttagatgaagcaattcaattcgcttcttagtttaattatttcctgctaaactaattgttttctgaatcatattttacaaagaaaaaagaacagaatttaattggggctgaaacacagcgaactacttattgtcgcagatgaatgttttgagttgcattcaactaaccatttccttgtttctaatgcaaaattagctataattagaggatgcatagatatgcttgtgttttccactaatgccatgtcttaatttgattcatgtccatctttccagttgttggattgggtactcggaaagggccatgttgcacttatgaggagagctgagctaaagactttagtcgatatgcatggtaatgaggtaggttttattcttattctcttatgcatttctggtaagttgtagctctttacactatgtagtttgcatcaatagtggttttttttggttgcaacagctgtgtgcggcgtccaagagttgatctcaagaggccatgttctatatagattctagacaactttttatgacatgttatagcaccttaaatgagtccggttataatatttgctgctatatggacaatatgattgggcatttctacatgccttgaatattttcttctggctctaatatacatatattctctgggctacttgtgtttgcaatagctattggtgctttcctcagacaaatatgaataccattaaacttctgctggttcacttgttcttaggctggcaaaggtggagagctgactcatgatgaaaccactatcattacaggagctttggagatgactcaaaagactgcaaaagatgccatgactcccatatctgaaaccttctcacttgatataaacgctaagctggacctgtaagaatattccaactattgtacgtgttttgaatgacacattctattgatgctactgttctcttcttgataggcacacaatgggtatgataatgaccaaagggcatagtcgtgttccaatatactctgggactccaaacaatattattggccttatattggtaggctaaactttatgtattattaacttttttggtgccaaaaatcctgttccctagaaacttatgactttcatgttatttactcttggatgcatgttgtcaatgatcaatctttgtggcttgagttgccggttctaactgctgtgtcagtcacactttttattgtgaataagatagcacattacagatattcgatactgaatctgctagcccatttcagttttaatagataaatacttgaattagagaagaatgtttttgttgtgatgaaatatattttataaattcattaatgatattctagttctctggttaaaggaagcctttgcagcagtcattcaaccatgacacgtcggtaataaaattgtcataaaataattgttttcagttgattgtgggatcacatactctaacgaaatacagatatgagtgactaatttggcagagtcttgtgtacttccactcaagctgcccttagttattcaaaacctgaggcaacattcacaaatttaagcctttctaaacatgcccttatgattgcttatatttttgccgggtcggccgaaagatttggtcgaccaatttcattaagtgggggaaaagatttaattgcctataagtaattcacttttggaaaaataacaacaataactttcccgatccttccattactgtcacttcctggacatcctatatcccaatgaaatagccaatcttgccactttactttcatgtgtttgttatttactatttgaccaataagcaaagaccatctcattttcaggttaaaaacttaattacttgccaacctgaggatgaagtgcccattgaaatgttactatcagaaaaatcccaaggtatgatcttttattgctttatcaaattggctgtttgccccctaggcccctactgttcctccctaaaaagctactactatgttttcattggcttgattaaaaaatgtacccactattaactttctctgagtctgagttggaagtcaaaatctcgtgcagatacattaggcatgcttcaagaaagctcaaggctacgcatatctactactacttaaaaaataagaggtgcttccatcgtccgtcaaaaaaaccgggtgaaaaaaaaccggaacgaatccgattcatcaacgcggtaaaagaaaaatcggg

SEQ ID NO: 31699 - DNA, 4989 bp, Oryza sativa
  unsure (1)..(4989): unsure at all n locations
gggtttcgccgctgaagaaaaagaggggtttttttccccgatatcgacgctcggccgtccgatcaaaaccctaaagatcggacgatcggtgtcgtccaggccgaaatcagcccaagagggatcgagagtgaggcctcttttctggcccaagcccaggttgtggcctggggaggggaagtgcacttgcgcgtgcacaaaaggccgtggaccgaccggcaagggccggaaataagtctattttaggtccctcaggcccaaaaaaagagaataagttcatttttagtgctcattttttcagaagcattacaacaattataagttattgaatgtgtttatttcgaagcaaacctaaaaggaagtattttctttctttttccaagtaaataattgttaaatgacgtttgtattaataaaattaacaattaagctctgaaaaattcaaatataatttcaaagagcgtaactaatcatggagaatttaaaaaaaattaaatttaaccatgtcattttatttctcacacttgctttacttgtaaatttatttaattatacacatacctacttaaaaataccaaatatttcagcgaatttgtattttaattaattgcatatttttctaatctgtacgcttcacattgtaacacacaggcacttttgctagaccaaacaacacttttggtcaatatacacactccgtaatcacccggtgcaacgcacgggcacttttgctagtataactaaagttgacaagttaagattatttccatggcttaaactgagggcacccaaggttgctacatactgtgatatgctttggaattgattcaaatatgcacttctgaatacttaatgcttctatgctcttcataacaagagaactattctcagatatttggaatctcttatttaaggaagctatactccatgttgccttgtaatttgcgtgtatctatctccatacaaaatgttcgtttgtcatcttctaattttcctttggtgttgctgctttttggtatatcagggtgtctgatgatcttcctctctacgacattctaaacgagtttcagaaaggtcacagtcacatggctgtggtggtcagacgcataaaagaaccaggagcatccattgaaaagacttatagtgacagatcagattacaaaactaacagcgacagatcagattacaaaattaaccacagagatgcccatgctgatggtacatactttccattagccatgatgatcacttgtttttccaggaataaatatttgtttggctgtctgatcatttgaaaataccctcaggtttgtcaccctctcgtgtcagcattgctggaagtcgtcgaagtaacattgaaaagaatggagaggtgcgcttatataagaaatcagaaaaaaagcgggacaatattcttgattttaatagcggtccacttccaagctattcattggatcaagaagcagtggggataatcacaatggaagatgttatggaacaattgctacaggttggagatattcttaaatacagcttgttcttaatttatatttttatttgaaaacaaagtcttgcatttttcacatcctgatgcttttttgaggacaccattattttttctccatttatactcttgtttgttgtataaagattttagtgttctccaacctatgggagcaacacgtttaattcagcatgatgttgcatttttttagagtcatctagtgttttccaatagttagaaaagaaactagaaatttttcatagatgtatcgttctttgtaaaatattttcgcttatacatgcaaactggcataaacttctcttggcaggaagatatcttggatgaaacagatgaatatgttgatgtacataacaagtaagtggcttgaaccctgttactttttactcttaacagaacctccaaatgatgagagaactaacatttctttgttttgcaggattaaaataaacatgctacctctgggcaaatcattatcaccaactatatctccaagtaatgggccccattcccaaggactcaggaggacccctatgacttctccattgtcatcataccatcatggtggctccatcttacgttcccctgcttcaaacaatcctcagtctcctgggactttgccgacaataatttctcctgaaagatcgcctgcttctcaagcaccttcgcgtagttcacctaattcaactcaggtgagtagtcactttgtgtctatgcgggttatataggctatttgtgacacatcacatcacatattattttattttcattttatttcgcctaaattgcaaggaacttattttcatctacctgtaaagatttaggttgtattttccccttgaatgtgaaacagttgttggtggcctacatcataccatgctcattgttcttctgtttccttcataggtctcaaggaattcgtaaaacggcgttgagagctaaagagctctaaggacaacgtttcctgagaaatggtaaaatgtcaacataaacagattaagacattttgagcttaggactgaattatacagatcagcatatctcttgtactgttgatgcttatttgttgattacatgcttgtatatacgtatggcttagcatctggacatcgctatagatggaagtctcactacctactgtagatgtatttttgtcagcttgcaattaccattgcagaggaaagcttgaagataaaaatgtaaaaggaatgcactagtatgcatttgtgctgttcttgtatgcatgcccccatcattttaatgatcagcaagcagatgttggtgcattcactgatggctatccacaccatttaagcactgtacaagtcctctcatattgtatcagaaattcagattagtgataaggcgcaagcttatgtttgtgatgctagtttggtgatattgagcagagtgttgtgactaaagtcaaagttacataatgagatcagatcataagattgcaaagggcaaacctcataattatcgagtgggccatcaagagagaagctagtggatcagccggaccatcaaggacagttttacctgaaaagataaagggaaatgtagggcagagaaatccacttcaaccttaaaaaaaaatgtaccagacacatgctccttccgtaaaaaaaaaacaatatagaaggagacgtgacctctcctagtataacggtgatctctcctaggttgcttttttttttcttaggacggagagtgtgtatataagtgacagatccgagacgtggttctcgatccgacgaccctcggtgatcgcagttcgctccttctatacttttacggttttaccctgttgtatatgaacagaggacgaacatgtaaataaatactacttccgtttttttaatagatgacgccgttgattttttctcacatgtttgaccattcgtcttattcaaaaaatttacataattataaattattttgttatgagttgttttatcactcatagtactttaattgtgatttatatcttatacatttgcataaatttttttaaataagacgaatggtcaaacatatgagaaaaaattaagggcgttatctattaaaaaaacgaagaaagtacaaaatattcaatgcgtgcaaccgaaggcatggatgaggtcaggatcatccatccggaaaaacaaaaggacaaaaaagagaagaagagcttctagattccaacgctacgtatccaaccgcgatcgcttcgtcaaatccgcgcgcgcgtcgtgtcgcgtacgcgcccacgcccactcccacgccttcgcgcgcgcgcgcgcgcgtngtcgtctccctcaccactcgccccgatcgatcgatcgatcgagtcgtcgtcgtcgacccgttttctctcctcttctcgatcgttatatcgcgaccagtacgcgctactacttctcactctttgccgctcgtttcgctcggagtagccatgctccaggcgagctcggagttgcagcagcagccggcggcggcggcggcggcggccgggatgtgggtgcccgggatgagcccgcaggcggtggacgccgggctgtcggcgagggcgcaggagatcgcgcggaggcgggaggagatgctcgggatgctgcatgacctccccgagtccgagtacgagctctcgctcacggacctcgtcgagaaggccggcggtgtcggcgtggcgccgccttcgccttcgccgtcggaggggaaggcagagccgggcccggcgcggacggcgtccggcaggcagtcggagcagcagcagcaggcggcggcggcggcggggaggccggagaggagggggtcggcgaggcggtgggacagcgcgggcggcagcagcttccgcagcagcagcgacggcgtcctgctcaacttctacatgccacgctccttcacccgcagcttcaccgcgccgcgcaccactggccccggccggccgccgtcggtctccggcgggcggaccgccagtgtctgctccgatcgcaacaagaggtaatcaatcaattctgactccaactaacactccatctctatgttctccatcagtttgattgcaaattaaggagattaattagtactagatcacgaagaacacacagaaattcgttagaagaaccaactttttcaacacaaatattgtactatttagtaaattcgtttttattcagctagcgataatatagtactcccacagcataggaccaatcaaacccgtacatagacagtcaacaaaagcaaaacgtataagcatcaaagccggcacggcaattccaaaggtaaagtaaaacgagtctacatagaaatggtcctactctagatgccgcctgctgatccgcgcaatctgtaaaacgaagatcaacctgcttgactgcttgtacgttccccacatcattccacctgttactgtttggtatatccagtagtacatgctacagattactgttttacacgagtagtacgagttactgtaaatgcgacga

SEQ ID NO: 31700 - DNA, 12414 bp, Oryza sativa
  unsure (1)..(12414): unsure at all n locations
nnnnnnnnnnnnnnnnnnnnnnnnnnnnnnnnnnnnnncacaaatattgtactatttagtaaattcgtttttattcagctagcgataatatagtactcccacagcataggaccaatcaaacccgtacatagacagtcaacaaaagcaaaacgtataagcatcaaagccggcacggcaattccaaaggtaaagtaaaacgagtctacatagaaatggtcctactctagatgccgcctgctgatccgcgcaatctgtaaaacgaagatcaacctgcttgactgcttgtacgttccccacatcattccacctgttactgtttggtatatccagtagtacatgctacagattactgttttacacgagtagtacgagttactgtaaatgcgacgacctactccgatggagaaagcaagggaagcgagtgtcgtacaaacggatagatggttaccacgcaaccacatgagtcgggacaaggggacgcgtccttgtctcactgaattcgtggaccagatagcgtgcgcagcgtctggtttaatgccggcaattctgagatcgacttgctaatcgcgacgtgaaacgaactgatgatgacgatgatgcagggagagagatggcgagaccgtgcggtgctggtcgctgctgtgggatcggcggtggcgcaagtcgagccggggagatcacggcaacgagtccgccatccgggccgcgatcctcaaggcggcgaaacacaacgcttcttccccaaagaaaatctgaatgctgctgctagcgtccatcgttttggtcttagatagctagcgcagacttatctgcctgccaccactgggtgtatcaatactaatgtatggttttgtacatacttatgagtgtccattttgtgcttgtgaactgattgtgtgtgaaaaactgaagataggcatattggaaatgattccataattgcgtgcacatccagggtatcgttgtgaactcaagttcagtttataatgggaggcagtcgagatgaatcatatgtattgtttctgaagcattttacaaaattgagatgcaacattgaacagatatactgtatagctccgttttccttccacgccttgcactagcacataatgtaacgggcactaccaagatctctaaacaagagtcatctatctctaaatagactagaaaagaagctacaatcccaaccataaccttataatctcaccccagatggcacttggaacgaacatacataaatatgtcactatggacaaagataacctaaaataatccttatttgccatcattcctcaggtcttattgaagaatcccttttttttctttggtgaggatcttatcgaggaattctgttggccaaccaacatcagtctcagcaactctgtatcaacaattttccggagggcgtcagattcatatttagctgacagacaaaatgtgctttgcaaatattaattatcagaagtacttacattggaaatctttatccaggattcaagtgtgttgatggcctccccggagcgttgtgtttcctgtgctaacgctacaccatcatgcaaagtatttactttaccactgacaagaagagatgctgcagcattcagcacctatgaagaaaaaaagattgattaatgttttgcatagcaaagcaactcaacgtgtgcaaggtaataattaagtgtcatatatgatttgtgaaaaaaaatctaaacaaaattaaatcctatcatgacaaggatcggtaagctgtttatgacagggcgcactgcaaacccccatctattgaagaacttcctatgaaatattcgtatgttaaagataggctaaccactgcagaattctgagttcattgtaaaaaaatgcattacaagaagtttagaaggtagaaagtagaagtaactagaaagagaggataactgtaatgattaacttacgagagcatcagcaattgaacctctttgaccagcaagaacatcctggagaacttttgcgttgaacgctggatcacctccttttagatcttccagcgtgcagcggggtataccaaaatccactggattgtaacataattttaaaaagtgagactaaaaaaaaagtgtatcatatcgtcataatgtatttcagaagttagcatgcataattagaaataagtataatgtgcataaaacatgcaattgatgagactaaactcgaagactcgctcaaattacacaagtgagtccaataaacagtctctgtttctaaaaattctgagaaaaacatagaaaaaaaaactcgtacatggatcgaagagcattttttcaatctttcttggtgtgacatcaaggatatatccaggccctacagcattgataaaagaaattctcagttaaatgcagaacacttagttttaatattccaaggtatttttttgaggaatcatggaattttagcagcagtgtagcacagtggtgaaatggatacattagtatgtgtccgtaccaagtgggcttatttcatccaaacccttcgaatggacaaccaatgctctcttcattccaatttttgagctgcttagccatcttggtaacctgagtaaagcaaaatatgttcattagggatgaacaatgaacactagatggaaaaccagcaactgcaatatagcttttagcggggctgacatctcaagaaaaaaagctttataaccatgtatctgcaagtcaagtaacacaatatttgctaaagatgaagttcactaaaaattggaaaaggagaatcttatatctgaactctgaattgagcaacatcggttcaacagctcaacagtagatgtctgatgcttgcctttaaggtctttaatataaactcgcatcatttgtcaacttaaaaactgccctacacctactttaagtataaaaccaagacaatagtggtgatgatgacgatcatgtgggtcaacgaaatattaaattgtcactttaaaaaatcttttcttgcatatcatactatttatgctttgatgatttactagaagaaaagaagaaatgaataaggaacttactatgttctcgtggtaaacaccaataacagcataaggcacccttgctggatttaagagaggaccaaggatattgaaaactgtctttattttcagcttcttcctcacaggtttcacgattttcattgctggatgatagtttgcagacatcatgaatccaacacccacctcattgacacatcgtttaataccctgaaaaaagaaaatacaataatatatataaaccccaccaggtttctgatgccataagatgcatataatagtgaataatgtaaaatttgaaaagccaggggcaaccagcctttctgtgcttagaagaaacagccacattataaataaatggagcgactacatctagaattcctaactactccctttgtccacaaatatctagagacgagtctaaatatgtaacaccattcagcctcagtttgtgactacaagaacaagctatgtgtatctgcacacagtaacttcaaatgttgatgttcataatccaattactggaatccaacaattcaattgtgcctttttacaccgataagcaaacctaaacaaatgatagaaccataaagaggctgatctacacatctatgtagtagatctgagatgtcaactagacaaatggggcgtgcttcgcacctcagtcagatgaaggttggaggtaccaacctcagtggtcagcacaaattttcagtaagctatatctgcttgcagtggcagagagacagaggactggcaggggccgtggctacccctatccccaagtatcgtactattttacgcggtacacaatttagcactagaatgagtatagatctatcatttggaacatgcttatataattcctactgcatggcctgctctacaaaattttctagttccgctaccagcagcttggtggatgtgcagctctgcagtcagcaccctcagtgttggagcaaaggtttgaattgggttatgtattatgggtatggatactggtgttgtagttctaatgtagaatctctccctctgtttatgtatctcatgaacagaccaaaccacttgtactggaactttgtgatccactgagatgcaggtggcctgcttttgtagcctaaccttttattcccagaaaaaaaaatacacatgctgtaaacatcacacgtgtctttagacgaaagggagctatggtcttcgactactcttcatagccttcttttctttgggtggcttgcaaagggaccatgctgtttcagcttccatttcatatgtacgattatgtacttgacagagaaaaaaaaagtcaaacacagaaattacttcaccaaactaaaggttaaaaccacacgggtgatctaggcctgcaacccacatcatattttagaggtattcacgaggtaatatcacttgccagttgccatgaagcatgaatagtgctcctactagtgctacagagtacaggagtacaatataaatgcatgaatataagatcctaaaggcaatactagctcacaggaccaggcagaaagcaatcagtggtcaatcaggcaaaggcaactacctcgggtcccaactcgatgttgacaccaaacgcctccagcacatcggcgctgccgcaggccgacgagctagctctgctcccttgctgcacaaaacgcaagcgagaacacattattgcatcaccactagtagtactactacctaaatccaattggagcacaaactgaagggaaaatggcatgcgcatgtataatctcccataaacaaatgaaaggggcgaggagccagtaccttggcgactttggcacccgccgcggcggcgaggatggtggagccggtggagatgttgacggtgtccgcgccgtccccgccggtgccgacaatgtcgacggcgtcatcgagcccgtcgacccggacgcagcagcctatcatcgccttcgccaaccccacgatctgagaacaaggcggagaaatctctcactcccatctctggaccagaacgaaatcaaaattagcgccgcggctgaggcggcgcacccacctcttcgtaggtctcgcccttggccctgaggagcacgaggaaggcggcgatgcgcgcctcgttctcctcctccagcagcagccgcagcgtcgcctccgcctcctcctccgagaagtggtcaccgccgatcagcgtctccagcacctgacgtcaccaccaccacaacaaacaaacaaacaaacaaacaaacaaacggctgagacgagccccggaccagatgaggacgaagagggggagaagcgacgagacattgcggggcgcaccttgtcaaagaagccggtgcgggggaggcatcggaggcccgcgcggcggtgtgttgcacggcaacgcggggcggcgccggaaggcgcccggggaccggccgcgcgtggtgcgcccgaaggggaagaaggtggaagaccggcgcggggccaagggctttggcgaaggagaagagcttgatcgacgccgccgccattggtgcggcgaggcgacgcgaggggcgagtggattcgtgcgggttgggggtggggttcagacttcagaggaagagagaagccagcccagtgttccgtgtgttggtgtgaggcgaagacctgcgagcgagcggattttgtagggatggctgcgaaactgaaacagatctgctcgccaccaacctcacttttcttttccacttttgggtgtgtttggatctaaagtttgcaaaattccatcacatcaacatgtcatacacacacaacttttcagtcacatcatctccaatttcaatcaaaatccaaactttggacggaactaaacgcagccttgttgcataggatgagtactccctccgtcccaaaaaaagacaaaccctcgtttccgtgtccaatgtttgaccgtccgtcttatttgaaaaaattatgaaaaaaaattaaaaagataagtcacgcataaagtattcatcatgttttatcatctaacaacaatgaaaatactaattataaaaaaatttcatataagacgaacagtcaaacgttggcacgcaaacccgcggtttgccttttttttggacggagggagtatgcaggaataataataatctgtactacagttattgaaagtttgaaactacagtatctgaatatctgatctactgccgtactaactctttttattaggcaactatttccttaaatggttaaccccctttaaaacgtattataggaataaagaaataaaggataggaaaaacatataaattgaagtagcgggtttctttaatcctataatatggagtagaaaacacagacaaggttctaagatatctaacctctcacttaattctctttagaattgattataggaatgtaatactatacaaagtttaacgtccttttcctataaatcaaaggatatgggaactaaatgttgattggttggatagcattaccgtcgtgcacgtagcccattcaggttggatcctaagcgctcgcaaaactggcatgttccatcaatagctgtgttactgtgtatatctgatttatatatagaggccggatatatccatttttttttaaaaaaatcatagggtatataggaagaaaaatcctaagaaaattattcctatgattattttttttaccaatccttcgtgggcccttagtatagaattacaacatggtgtaatttaatgcctctccaaaatgcatttggtacaatcactttgatacttttatcttataagaaaaaccgtgtaatttgatgtttgggagtaggttgcagtcgatgagtgctttagagcaagtttaatagtatagtccactactagctccaaatcatctataaccaacgcaatagccaattcatacaatagttgcttactatactattaatacctagtctcactagtcatacacatattacgtcttgaaatccgtgctgcagctgactatatgtagcccgctgctcttctctctcttcttttatctctttaaaatatgtttatagctggcttgtagcctgctattgtacctgctcttataggactatgcagcatatgtgccatacatcctacactatcatcggattattccaaaaaagaagaagattattataggatgaattattgcgcacgtggaaatcgcgatgtttctacgctttggttgttggagagacaggacgaaaaactcgttctcgtgagctcgtcctgctgatggtactctccctgcttcttccgtggcgaccttttccaacgatctggctgtaagattttgctgattcgttgcacaaacaccacaaatccaacttgctcatatcttttgtcgcgaccacgatatactatgttatgtttgaattgatgaaactgatgagactggaagattaagttaacgcatgtaaaatgaaaaaaaaatcatcaacatacgactaattatgatttaatcattataaatttgacaaatagatatttgatattttaaagcaaattccgtagaaaaatttcgcaccaatcacatcatttagtagttactccatacatctcattttaagtgtgctgtggacctctgtatcaatatttgatcattcatcttatttaaaaaatttataaaaatattagaaaaataaatcacgtgtaaaatattatacatgttttatcatctaatatcaatgtaaatactaattaaaaaaaatttaaaataaaacaaacaatcgaacgttagacgtaattcgacagctacaaggaggagagagtatgtgctaacgaaaatggacataaaatctagtaatctttaactagaaaaggacagttgctcgaccggttccctatctcgcgtgcgtatcacatggcttgttttcaattcgagagatttcgttttgacgagacaggcatgacatgacagcaccccggtttagatttaaaatttagatactcctttttcatcacatcaatatgtcatatacacaatttcttagtcacatcatctttaattttaaccaaaatctaaactttacgttgaactagacataaacacagcctccattaatccggtcagagaggacagcgagatagaattattttttgccagccaccagtacgtgcaagcggttcggtacaaactacaaagtcagataatgctcgcaattgcgtaatgttggattaaaaataggctacgacttctgcagatagtacaacatttcttttctcccttggtgacaagcgcggggagccggggaggacgagtagtacggctgcacggcaccgcgcttggatgtagatgaatggaacttgactactaggtgtactcctacctctcttccgttcagctccggttccgggcaagataggttgtttgctgtgcgttcgtagtgttgttgcctgcgatggggacatggggtcacggcagaattttcctccagtggttggtagatttcaggttgccggtgtttgcccggcgcctgtggattaccaataacatcagggagggatatcagaactggatgttgattttttttatataaatagatttaaaaaaatcctattttaagaatagatctttttcctcaacatcagttcattaacacgaaagttcaatgcctcgacgccaataataactggcaccctaccatagccctctgtaaaagcaaagtcaaatagtcaatgatgcaaatgggatcggtaccaagaatattagcaccaaggacctactccgtatttataaaataaactagggctcggtttagattttaacttttttttttaaactttcaactttttccgtcacatcgaactttcctatacatttaaacttttaacttttctatcgaatcatttcaatttcttcaaactttcaattttaaggtgaaactaaacgcagcctaggtcctcaagcgccgactcctctacatctcggctgctagagagcaagggtgtcagtgtcaaaacattggatcttggtgccagttgtcctgttgccaagactatttatgaaatatttttttctaggggtttatttataaaataaaatttaaaaaggaccagaccaaaatgtcttggtgacgtgtgcttccgctattacacataccgatcacgtgtgcgcatccggattcccaagaaagaaaaacattgcataatactccctggattctagggagcttcgacacgaggaaatctgcaaaggacaatggctaacagcagttcacactgccgtcgaagagtcgaaggcttccccatggggaatacgagcatcaaacgtgcaaggataaaaatcaaaacttactacagtgttgaaggtcaggtttagcaagacaacacgtacaatcatacactctgtgcccacaaggttcctgtactacaaaagcgaaaattgaatactttaggcagaaaaagagagttggcaacaaaccaaaccaagcaacaagaacgagtcagtccatttttctgtccccagcggcctaatctagccaccgagtaactccatcttcttcactcgcagctgcaaggatctcgatacagacgtccaatacagcctacagaacatgcaaacagtaggaagctgagtacattagcttaagtgcttgcacatgggataggacacaatgtgactgtttcatttcgtggttggacgcatagtgtgctactgttttatacagaaaaagagcagtaacctacttaaacaacgttattgaagagggggcaaggggggaggagatgcatgaaataatagaaatcctctttttagaagcaaatggaaaagttcataccgatgaatttctgcaattgataagtttgcaaccctccaacaaggacccctccagcatccagctctcccaaacatcaaatgtatgacttgcaaacacaaactccatcctcctattaatcttcagcacatttaaaaaagttaaatgttagaacattagcaaccctgggtgtcgataagaaatcaaaacacttctgtttctcaacccattttactactggaaatggaaaagttgcactagtagccctataaatgttgcgcatttgagcaatcaaacttattacttttggttgggtgtatctgcttgtacagtgcaacttgtacaagtagaggtataaaacctaagcattaaatagaggcacggacaagtgatgaaacaagtcgaaggaacagaggcatcagattaactatggaaagtaaaatagatgaccttacaaagctaagattgaggcctaaatgactattcgatcatgagctttttgctaagtttcgataaatctgctaaaacaccaaaatagaaaagaacagattcataagttcgcttggctagaagtgtcattaatttcaaaggaaaacatgatagcagaccttaatatttttttaagcagtaatcagcagctaccagaaaaggagagatgatacctgcaatagtttaccaccagcgacgaaggaacgtaatcccatggtatcctgaaaggcaaattgggtcagtagaagtgccagtgccagatatgcgtcacattaaagtaaaatttgaatgggtaactgaagcaagcacaaaaagggaaaggctaaaactatattaccttgtttttgaaagtgactaggaactgagcagcagggtccctgtttgtagcatttgacacgatatcaaggatccaaccaccaccaccagcaagtctctgtcttgcaacatggaaccctgaattatcttttgttctcaaggctacaacaaaaccatctttgagtgtatcaggatatttccttctgagaactgtaggcaacttcgtctcagaagttatttccattggggattcagcaggagatttctgcttgtattttgagtcctcaggagacgcaaatcgtgaactggaactcaatacctggtcccttccactcattgcagtatcatcatctctgcgtgaggaataattactgccactctctacagcagataattcatctgttttctgttgagatctgcggcgagcaggtctctttttccctttctttccagaacggctgcgccttccttctgatcgggggacaatatgttgagatctagcagatgcttgaggctctttatgctgggatatggctctcctcttttcgtactccatttttaactgactttcatctgtctgctgctcagaataaaaaacttgtgaactgctaaccttttcttctagctgatcatcttcatttccagcttcgctaatttcctcatcttcatcagatattgcactacttggaacagcaccatcaaagaaaaaggactgcaatatcgtgattgctttctctcttatttccatccacacttcttcactgtagtctgcacttcgaggaagaattaaaacatttggcatctcccttacctatgtcaaataaatagtatccatcattttgctgaacaacaagttctttttttataagatggatgatgaacaagtggcaccaccatagcaatgcagaaaagggcacagttgtttgtcctctactactagcatattggttgttgctcttctgtacaatatgcagaatcaagagagttcaaagttatccctaaaatagtaagagctcaacaggtggagtgcagggaacttgaaatacttgatgctaaactaaattaaatatttactcattttccatatgtttttcctagagattccttttcaacatccggaagagcagagcattctaaatggtgatgttttgatcttagatgaatttcatccatcgcaaatggccacttatcaacaaaaaaacacatcaaaagctgatggacgtacccacgcttccatccattgtggaccttcagcaccatccaatgcacaaccagctattgtaccatcaatcaatagctgtttgagtgcacaatcatctataagttggcaacttccagtatttactatgaatgctcctgtgagataaacaagaaaattatactgtgttttacggctgaactaaaggcatgataagcattatttcggaatatataatgcataaagcagaagaaagaaaggggttgaagataaaccttaccaggttttacatgctgcagacagtcagcattaagtatatgcatcgcgtcatttgttaatgtgcagtgcagtgaaacaaggtcacttgctgccaacaaatcattgagagtatccattctcctggcggcagaaggaaatacaatggaaggccgctttgcttttccattagccttcagtagacatgctaattcagttagaatagtcaaaataatactttaccgcctagcatttcttaaaatcagtaggtcattgcatacaagtgcgacaagatatatatcatgaactttggacataaataatgtgaactggacatgaatttggggagatttcttaatgtaacagaaagttaatagcccatgaaaactttgggggggg

SEQ ID NO: 31701 - DNA, 4081 bp, Oryza sativa
  unsure (1)..(4081): unsure at all n locations
cgacggcggagagggggacgtgctccacccccgccacgccggccagcccctcctgctccagcgacgggtcgtcgaggcagttcagtgacaccaccagcggctggcccccgccgccgccgccggaggccgccgagcgggccatccctgcgcctccctctcggcgctcggatcgggagcgtcgcgtggcgcgggttttggtgcgggcctcccgtctccgggccgaggggggctttttgtcccgtgcaaagggaagaggaagaagagggaagaaatgctctgctgctactacgcttgtcagagtggtgggccgcacgggggccaccactcaccagctcacgagggaacggtgcgttgcaaaccgtcagattcgcattgttaattgtttgcagcttgtgcttgtgtctctcgcgccactgccagtgactgagcagatgcaaacaaatcttgaattatttctttaattcattgtgatgattcgaaaacattatttagcatggcaatatttatgaagatctagtagctaaagtccagaaaagatcagttggcatatccatcaaaataagagaagtttgtttcttcgtacttaatcatggagttttgggtaccaagtaaagcactctctgcttttcttccctccaagcaaagcctggtttagttcccaattttttctttaaacttccaactttttcatcacatcaaaacgttcttatacacacaaacttttaacttttccgtcacatcattttaatttcaatcaaactttcaattttaacgtgtattaaacacaccccgagagaaagattgcctcacatcatttagctgccaaggatagacagctgcccgccgcctgtgtacattgtaacaaaaatgccggactgaactcaagtgaagagttaaaagatagagacatagagttccatgatttccatcaagtaacccaacaagttagcacaacaagatcatgccatcgagcatcatcattcattatagtgcatgcgcttaataccctgaacatttaccaggcatgtgatatatcgtcacaatcaatctagaacagaaaaaagtatgcagagcgcaaccggcatggaggcatgttactcctccggtgcattgattctgctcaatcacacaagcagcagtacagcatggttgctttcttcagagccctcatgaagggggaagtaccatccatgcatctatcagtgaaagctactaacgaacagtatttgtcagtgaaagctactggacagctgttcagacaaaccaatttgtcactttacgaagctgacatggatttttccttcaaacaaaaatgcatgaatattaacagtaagagatgacaaaactgtcgtgtagtatgttctgaacttcgtgctgcttgtttgtcttgacaaccttccaacattcgcacattcactgagttcaacttatgcttcacttcgctatgctacttaacttcagaaacaaaatttgagtgtggctcaattaccttgcacttctattccttgaacatttcagtgttgcatcagaggcatatgcctaaaacacactttgaacaaataaccaagtcagcatggtattaaagttttttaatcaatcagacaggcacatagtacccctagagctaataatcgagtgttgttacgttaacggtacataatactgtctgcagctaccagctactactcaccagaaagagagccatcaacagagggggcacacaagttgttgaagcaaatagggtacatctagaagaaattgttcattctcaacctcaagcaagttcgcaaggtacccactgtttcacttttgtgctcatctcactaggaactgaggtagaccactcatccaagtttggaagaggacccgtcaatgcaacgtaatttacactctctttctctgatagtctcttccagttgagctgtaattcaggtttacgtcaggtgggcattctaacaacagtgacatggcattgctcgtatacgtagcaacccaaaacagttaaacaattaccattccatattttattgttttaaacttttccatcatctagtactagaaactatacaactacagcagtcaaaatatggatatttctgtggttcatgtataatcttacctgccccggaaatgcagcacagagtgccttaattgtggaattctgaacccaggacgaaaggcccgtatcattagcaagagatacagcagcatcagctccaccacagttaacaatgatcccgtccatctggcattagctttttcgcgatttccaaccaggtttcaacctgtaacaatgttgaaattaaatccagtagaaaataaaaaactgtggaagtgttccaaaaagttaaaagaatatagatatacaaaagtagcgtccaggaattttctctcagctgcacttttacatgttttgaaaaattgttcaaattatttcaattgcagagaatcatatcagccatttggtcaattaggcttgaaaggaagggtcgcaaaggagagtaatccatggatgccgaagacactaaggtcacgtaaggttttttgttaagaacactaaggtcacacaagtagcttacttttgttggtgtatccaaagcaccctctattgatattgggatgcataagattttttgtcgacaaattcacatatcactatagcaagccagccaaactaagggtaataaatcaacacatcatgagataaattaaaatttattacaaacttcaagatatgtagatatcaagtaatttcatccatgcttgaccatgcattcaactgatccaaggaataagaaatacatgctcaaaagcatgaaatctgatgcaaccaacgtagcatatagactggtaaaaaatgaatagaaagagatgcagaggaaatttacttcttgtagctgaggtatgatcttcccatcagcaaacaaatcaacaacaatacctgttcacattaactagatgttgttaggccaaaaaactttgagatgcatttgatggtgaagttgcaaggagtgtgtggtttcaaccccgacgttttttgttcaatctccaacacgctcacaatttctttttaaaaattgtttggaaagatgtcttttcctccaaactcttattttttaggccagaaaactttcaaagctttgaaaactcaaaaagaaaaacattaatctaacagtacatgctttccaatatactacagataatccaactagcatactccaaaaatgcatcatccaagagcgttgtataattaaatagtaccaagagagtaaagcatgtattccatttgcatcaggtagtaagcactcaccagcaaaccctccttcaattgtcagcgttgtataattaaatagtaacaagagagtaaagcatgtattccatttgcatcaggtagtaagcactcaccagcaaaccctccttcaattgtagctgacggagaaagtgcatcaccaatgcgcacagaaagtgaaccacctgattctgttgccttttctaaatcagataaaccaaaataatcccttgacagttcaattatctgtcattcagtaatgcaaactgagagtaagaaatgggcatatgaaaatggatgcgtggagcacaagggataagtctaaagaaaaataatgcaaagaggtgcttgagctagcttaacagccttaactaggaatatattactgaatttctttttgcaacacaataagtaacaatgtgaaaatatttcactaccatctgtgagcctgtggtcaccaaacaattaaaaagagagagaacaatgaaaagagtgttcaccttaggatcaatctcccatccaacaagttgcaaccaaggataaaattttagcatcagatgtgctgcagtcccagcaccctgaaaaagaaacaggggaaaagacaggaatcataatgtgctattgaatatccccaagcgtgtgaagaggtaagttgcccgtgaaaaaaatagaagtgagttgttcaaatgaaaagcctccgtaatgcttgtggatgtatgctggaattgtgatgtgtgctgataatctaattgnnnnnnnnnnnnnnnnnnnnnnnnnnnnnnnnnnnnnnnn

SEQ ID NO: 31702 - DNA, 2872 bp, Oryza sativa
  unsure (1)..(2872): unsure at all n locations
nnnnnnnnnnnnnnnnnnnnnnnnnnnnnnnnnnnnnnnnnnnnnnnnnnnnnnnnnaaagagagagaacaatgaaaagagtgttcaccttaggatcaatctcccatccaacaagttgcaaccaaggataaaattttagcatcagatgtgctgcagtcccagcaccctgaaaaagaaacaggggaaaagacaggaatcataatgtgcattgaatatccacaagcgtgtgaagaggtaagttgcccgtgaaaaaaatagaagtgagttgttcaaatgaaaagcctccgtaatgcttgtggatgtatgctggaattgtgatgtgtgctgataatctaattgcaattggtcggtaagacatccattcaggccttcccaaaccctctaagcatggcaggaattttgctttttatgcatagtagttatgcagaacaatgaagtatgatgaacaagataataggtgaatcatgcaccaagtgatttaccaatcctagaagagcaacaggaccacgtggaacaacagctggtaggctcacgaactcatcctgtacaataggaaaagcacaccgtattaagcatttacattgagcagccatttttaaaggatgaaaaacatcatttcaaacagaatagttggcgtagaaataggatgcgttttgcaaagaaaccaacccatcacatagataacaagtacctatatgagcatattatagtctttttttttttttggtactaaactgctatccaactaccaggagcctattactgtccttctcaaaaacttgtttatcatggatagttgacgggatagagcgtcaaattcctaatgcatacaaggcgctcaacaatattatgcttgtatgtcaaaatggcacattagtaatctaaattcaactcgatcagttcagattactcatacgataaatgcataccctgtcagcactcccgattgaaatcgctctcaaatctcacactcaactcaaactttcaactggatcaatttgggaacactggacgaacagcttgtaggcatgaaccttggtagacaaaggttttcgtgctttgctagttaatctgcagcttttcggttttcttccctccgttttgaacgacaattacaacaaggttagggccacgatcccatggtgcgctccgtgaccggttagtggtgaatgctatcccatacgccccgggtcacggcgcacgacggcacgacgcgctcgccggctcaacggattcagcaaaagcaggcgaaacaaaacagcaaacacctcacatgcaatctaaactacgctataaagattagaagcaaaggattacagttctatacccaatatgagttggtccagactccggtcttggggagaacgctgtgaacattccctgcacgatacaaccaatcgggagcacgaactcaccaaacgaatccaatttcgaggcggaggaagaaatcgcagtgtgcagcgcaatacgtacggttggtgtcgaggaggaggtagcgggtggcgggcgagtcgatgatcatgatgacctcgttgaagtcgctaccggtgatggcgaggagcgtgtactcctcctcctcctccttcgccgcttgctcctgctgctcggtggctggaggggcggagacttcgccgccgccaccgggggcgcagtacagcggccgccgcgccgaggccgctccccgtcgagggaggagggagactcgggtggcggagcggcgttggggcttggcttcccggcggcggtggcggtggaggaggcgaggcggggagaaggttagcggcatggtggccattgctgatgagatagaatgctaatgcacggcgagggattgggttcccacgatttcaagccggtgatggagatggcgggttaggaattcccttttgataactgcaaagcgtattagcgtaatcggttcttctcttaaaccatgattatttcttaagaggccttttcggatgaggcccgataagagaaaatttcagaggcccagcagatatagtcttacaatgttatgggccataattgggcctgagtattctagtgtggttggtttcatctgaaatcaaactgcgaagcaagcaagcagtaaactcccagaataatagcatttcaaacctgtacaagacaaacaatcttgatgtgttgtattgattcgaaacttcgaacggctgtttcagaatatgagcaattttttttgggacaggaagaatatgaccatagtacttaactttctcgcaggtaccacctactccaggtgattgtgcatgataaaatgaatctgcagctaacaacctagcctctccccaacttccaatcagtttggtcaattggagcctttggacacatgcatcggacgccaattgacctgtcgccggccgccgggagacacgccgcgacaggggccacgacgccgccatgacatccgtaaaaccagcaaagctgcaaagacatcgcggccgacactgacgcacgcaacggcgcacgtcagatgagcccacgttccttgagatcgccggcaaatacactgggaattcgatgtttcaccgatccgccggcgccgtctcgcgcaccgacgcagtttctatcaaccactctctccatccaccaaattagccaaaagaaaaaggttcggttggtacttggtaggctaagctttctagctcgttttctttgtgctttggctcgctatcaacgagcagcctcccgcacttcacggcctaatctccatcaaattgcagtgacaataatgtactcttaaacgtatttaatgacacgtacacatgcagcgaatcccgaggacgtggatttatactgcaactgtagttaacgtgtcagcgcagtgcgtgcatgcgtgcgtgcaagcgtg

SEQ ID NO: 31703 - DNA, 2597 bp, Oryza sativa
atcatctgcgccatcgaccgccggaagtcgcccagcgggtcgtccgactccgtcaccaccggcacgctctcctcctccagccgcccgcgccgccgcctgccgcctgacgatgcatcgctcgcgctcctcctgtgccgcggcggcggcggcgtcgccggcctgatcccgcggtcttcccggacgcccagcgcgcgcacgccgcgctccagctcgcgcagctgcagcaggagcgtgcccacgctcggcgtgccatccgcgtcgtgcacggtgttcggcgcgggcgtgggcacggtcaccctcgtcgtcttcgccgacgtcgcggtagcacttgacgtcatcgtcggtggcgtggtcgtggcgggcgagatattgccggcggcggagagccgggacacgacggacaccgacttggcgccgccgcagccgcacatgaagccgcgcgcggccgctgcgctcgaacccttcttcttcttcttcttcgatggtaggccctgatcggccatgccgcgacgtgtcgtcgctttcatgtccttgggttgagagcaagtgagcttgtgcgctgtttgttgtggactagctacaccagctatagtggggagctagggggacagacttcttaaagcctgggcttaacaagagccagctaggtgaatttcagacatgctgatgcagtagcagcaattactcaactacagacacatttataattccaagtcattaaccaaaaaattagtatcacgctatccgttgttaggaggtcagtgtcagattctggtcgatttaccagcggtaatcttgggtcaatccagggtgaaaacaacattgacttacaaagtatagctcaatactatttctgaccgttcagttaatcggttactactcctatttgtttcagacttatacgcttaccattctgttcgtgtacagatgtactgatgctttcagattttgcataactctatttgcaagggaagttattacaaaacgcacgcaaggttgtactgctacgtcagaaacagggcaaagaacacatcagacaaatgaaaaactaacataccatttcccaagcttgcgcgcgatttgcgcaactaaatcccagcgaatagaacaaaagagcagatgacacgagacagaggaaaatccaagggatgtcaaagcgaagtgacgggagatttggatgggcctaattaacagatttcctttcaaggtcagagaccctactgcaaacagcaagattacactacagagtacagtacagtgcagaggaggagagatgccttggaagatcacactgtgctgggcctggacgtttgtttgcttgcttgtcacatgcatcttctgctggtaatacattccggccacgctaggcaaagtgctccccgtgctctgctgctcatgatcatgatcatgtcctcaacagaaggccaccaaacttacatgcttgctgtccctgcagctaaccgagattgaactagtgaagtgaatcagactgtcaggaggtaattgatgcagtaggaacaccaaacagcaggtgtaacagacaagtgtgtcttctttagagatactgatcattagatgatggtaatgtggcatacatcaaaacgaaaaaaatgcttcattagactgctggcctattctgcaaaaaataaataaataaataaatcgcattctttttaaattggcatgtcctgcctttttgagttttgactctagcacaggcacttggtactcgatcaaacatgttgtctcctgataaaaggtggcaactcctgtatcagatgcatcctggggtgattgattggaaacaagaatagttgtcttcgatcgttgtgatggacaaatggtgtggaatctcaatgatgtcttgattggcttcatggctgacggctcatgtctacctgggtatcaggcatggagcattacgaccggactcaaatgatggtatcagcgccggcgaaggcaatgggccaaactagggtcatatccagagaagtctagccaaacactgatcttaactcagcccaactgattcttggcccagtactacatatcatttctcagcccatctagcataaattggtagaaacagcccaaatacccgcaaaaaacagaaagcagcccaacatctgccttgtgaaaattgggcctgaaatactaacaagcccattatatccacttacaaaggccctaagtggaataaataaggaataagttcatctgaggtcccttaacttgtcaatgaatccgatttccgtccctcatccggaaaaccagacacaacgggtccctcaactatcaaaaccggtgcagattagttcattcggtggttttgaaagcggttttagctgacgtggcgcctacgtggctaatttaactcggtcttcatttgacgtggcattaacgtggcgattacgtggcaattcgatccggaaaaataataaaacccgtaagacccacgtgtaagtctcacacagaaaataataaaaaaaagtggtgggacccacagtcagtccaactcacctctcctcttcttcctcctctctccccatctccctatcttcatctatctcttctctactctcctctcttcaggcgac

SEQ ID NO: 31704 - DNA, 3039 bp, Oryza sativa
  unsure (1)..(3039): unsure at all n locations
ccgcccaccacacgccgccactccgtttcgccccgccgcccgccatcgctccgcccaccgcccccctttgcgccgccgctcgccgttctgtaggggagagagagagggggatagagagaaaagggggctgacatgtgggaccacatgggccccaccttttcttattatttttttatagctgacatgtgggtcccatggtttttaattatttttccaggatccaattgccacataagtgacacgtcaatgccacatgggacgaggatctagtcaaagggagccacgtaggcgccacgtcatccaaaaccggacataatactgccgagggacattttctgcacggttttgtaagttaagggatgcgttgtatccggttttctagactgaggatgaaaatcaaactgggtgacaaattgagggaccgaaagtgaacttattccaataaataaacattcctgcttaacaatcctccagaaatagtttttctccgtggtactgggattgtagtcgtcatgctggttgtcatcctgggagcgaactcttgtgtttggaggtgttcgttctcgctcggtggtcgggttgtgactacggttttccaaaccctagtcacaattgtggccggagccggaataccatacggtaaccgtggtaattgtggcaaaccgtataaaatttatcaaaatttaaattatttttaaaatttatttaaatttaaggaggtttaccgcggtttttcttttaacgcaccccgtggtaagcgcgataactacgataaccacgtgcttaccggcggtttgggaaaacttggttgtgaccaaggtgttttttctctgttttcagaattgtgctgtcttgaactgtgtcttggaaaagctggttttcccagtgaatgatgccgtgatagctttctgtaaaaaccgggtcatatgacctactacacagtacgtatgttttatcgtttgtcttatttaaaaaaatatgttattattatttattttattgtgagttattttattgctaaaagtactctaaacatcgcttatatcttatgtatttagaaaaaaagtttaaataaaacgaatggttaaacctgtatacaaaagtaaactgcgtcatttattaaaaaaggaaggaggtgctttctaaaaagaacaatcttacagaaaagaaaataaatacggaccagctaaatatgttttagcagcccgccagtattcatggagtgcaacatcctacctgtataactatagccttgaatcttgatgtgaaaatggatgttctggccttacttagtttcaaattttttcttcaaattttcaacttttctatcacatcaaaacttttctacacatataaacttccaactttttcatcacatcgttctaatttcaactaaacttctaattttagcgtgaactaaacacaccctctgttcagaagagaaaacaggagttttgggacttagtaatgtctttccaacgccagcgccagcgtcaccatctttcttttccgatcacacggtcatcactcggtcaggttctcgtcttgcaaatccgctcgtctgctagctcacattcggtcaggctcctgccgttggaaaacgacacgacccaacgttccaacaagggggcagcagagtcgctccagttgggctgggagtctctgagcaaggcaaatcagtcttagctaactaaccagcagagacgtcaagcaattggtctcatctctttcagtttcataccaatctgttatcccccaaaaaacaagaagtttcataccaatcgagacgttttgtttgatgtcgcaacaatagtagcccggctcatgttctcccctgttggatgtttgcacatgaacatgctctgcttagcgatgccttggggagttgggatttttggcgatgtgggtttcgtacaccggcaggtgacgggtcgtgtccacccgatcgtataccgtcaccagcacgtccgcgtgccgatcgtgtccaccgaaacaacaacaactactactactactgtagcccaagtcgcagtcgcagccgcagcaggccatcgaccaccactacgccggtggcccaagtgatagtatttaggacgctttcgtcgcattgcattgcccgctcgcccctctgcttttgctgctgttgcgttgcgtgatacgctcgcctaactttggctaattctgctgatatttgctcttcttctgtcatatcaccttgccgctgcttctgatcatctcccgttcttgcattcttcttcttcttcttcttctccggcgtggtgtgctgctgacggctgacgctggctggtcgtggacatgtcgaaggtgaggctctgtcttttgctcttggattctcatcctgattactgtagtagcttctgtgggataaaatgatctctgcttctgaatccagtaaaatatacatgttgtttttgtccgttacacattgcgagcgttcgtataccatggtggtgcgtaaactaacactgatgtttcacatgttcctctgctgcagaagattgtggtgaagctggatctccatgacaacaaggacaagcagaaggccatgaaggtcgtctccacgcttgccggtacgcatcgtgttcgatccatcaaccgttctgcccgtgttcagaaacgatcaagagaaatgactgctgttcgtttatgcatgtcactcatgtcaggcatcgacgccatttccatggacatggcgtcgcgcaagatgacggtgatcggcacggttgacccggtgaacgtggtgagcaagctgcgcaaggcgtcctggccggcctacatcgagtccctcggcccggccaaggagccggagaagaagaaggagggcggcggcgatgccaagaaggatggcggcgatggcaagaaggagggaggaggagacggcaagaaggaaggcggcgatgggaagaaggaaggtgacggcaagaagggtgaggcggcggcnncnnncaaaaaagaagaaggcggccgccagaagaaagtcgcggcggcggcaccgatgccgatgccgatgcaccaact

SEQ ID NO: 31705 - DNA, 2630 bp, Oryza sativa
ccgccgccgccggcctacccgtacgcgccgccacagtactactacgcgagggacatgagcatggaggagaaccccaacccgtgtgccatttgctgatcgaatggtattcttgcattgcatctgatctgtagcaactagcaagtagccctacgtacattttctcgaacatgatgtgtatactgttttttttttttttttttttttttgagaaccgatgtgtatactgcatagtagtgtatctcgtgtttgaattggagggtagaagaatttgccggcaactttgaatttctgacgagaagggcggtatcgagtcaaaccattgcatggaagaaccatactaattcagatgcctgttgactgttgcccgtggtattaatggagaaattagccatctagagacactaatttcagccatctgctttcatttacttcgacaagaaaataagaacgaggaaatgaaagaaggtatagtaatgtgctgcaactaaagctcagctaggagcctaggacccatcagcaaaacagtcctaagcttttcgtttaggaagaaacagccactcgtaagcctgaaaattttagtgtcctttcaattttctagtgtatgtatctccacaaactttttcaactataaataaactgaagattagtcggcgagttctttattgcgcactggttttaggatcacaacaatccatagttaggaaaaggtttaagtctcaaccaaaagtttgatctgcgtatgcattttctcattaaaaataccgcacaccatgaccatagattatactagcactgaggactgaggaggcaaagaaagacggcagaatcaccggggcttcaaaaggtgggtagattttcatttccaacatgacgaaaaaactagcagaagaatattggcagcagctgtggttgtgatgtcccaattcccatttgcatttgcagatccattttgcatcctataataatcaaacaaacggggagtgaatcgcttgtcaatttttgcggtttgggtgagtcggatgatcctgactttctcgtcacccctgacgacagcattggcagctacctcttccaacgctgaaggactagagaaaggagctcaaccgttcagccaaaggcgacgcatctttttcgttttcgatgaaacagagccttcgtactccagatatatcacgaaacaattgttgttaattatagattgatgcagatgtgatcatgtgatgattaaaaatagtgattttgtgaggtcatgttcagcttccgatcatcaactcgcaaatatattagagcagaaaatacggaaatgaagctacgtgtgtgctgtggtcggtgaagatggcgatggaagaaaatcagaaataatgccattgaaaatttacctggctgcctgctgcggtttttatcatccagcctcacctgacccgcctctttcgttgtcgcagagggtgaaaatgaaatcgctccactcggcgacagaattttcttggacaaaactacatggacagttacctcatgatatcctagaaaccatcgtccgtataggagcagacattgacagataagtaaatttatcgccgtgtttagttccaaaatattttttcaaacttccaacttttccattacatcgaaattttcctacacacataaacttctaacttttccgtcacatcgtctcaatttcaaccaaacttctaatttcggcgtgaactaggcgtgaactaaacacacccatctttgttttctccagcacgagtctatgtcatatgactctgcatttttgtactccctgcaaaaggaaaaaagaagtcggatgaatgatcgcaacagcaaacaaaagcagccactgttttctggtttaaatcttgtaaccatcggcgcctgtatttgagctttgcggttgctatcatcgcactcaagcaaaagccgtatcaaatggatcagcctcgtaatacaactgaaatacaattagcagctgataaaagacaacttatcacacgatgaactactgtattaaacaaatgaactgaaaagattgcaaatagaaattaaattttgatgcttcagttcccatctgctaatgagttggagaacaaggaaacacaggtagtgcagctaactccagggcgatcgcctgtagcttccgtgcagcaacgccggtggacggctgacggagctccggcgaccggcggcgtggcagggagagccgcgagcagatcaaatcaaactctctcctccatccgggccgtattaactcatgggctggtgagaccaaacccgactagaatcgcattggtaccgatccggcccaagaggatgtgatggttcataataaatagcatgcaaaggtgattactattctttcttttatccggccaatcagattgcatcatgattgaatacatacacccatagctcaggtgtgaagccattacagtttcacaaaagaaagaactaacaaagttacactgccattctgctgctaggtttctcaagaacagagcacagcttagtgttacatagcctcccaatttcacattttgatcttattatatacttttcagcactaaaagaaaaggcacacaaccctactggtcaccaaagcatgtaggacacctattgacatcccaact

SEQ ID NO: 31706 - DNA, 4463 bp, Oryza sativa
tggtcaccaaagcatgtaggacacctatttgacatcccactgcaaaataaaaggtgcatctcgggaagggctttatacatgcatgtgagcatgtctacagttgcgctaagggtaaaaaaaaaaaaaaagcgctcccttttgcaaggattggcacaacaagatgtgaccccacagaaaattcatcaatgtgcacaagacaggaggccgatatcctttggtatcacctggagaaatggtgcaaacgctacaaagggggaactacatccaggagcattggatagttggaatactaaagatcacctcttctttgctgcttttgcgtcagattcagatttccacactatgtcttttaactctgacgagaaattgttgtagaactgcatgcaatttgatagaaatgacgttaatcgttctgaaatcatcaagaaacaactagatgctgggtactatgaaatgattttttttttcaatgacccactatgaaatgatagaatatacaaagtttgataacatacattgtgaaactccagcgtgtcccctccagttttacgaagctcaaccatgtggagtgatggagcaacctcgaaaacctgtgagatagcatgtgaataagttcttttattaaagcaaaatttactgaagcattgcacagacttaacaggatacatgtcaatttaatttccaatacctccgttgctacagataaatagccttttcttccagtcttatcaccttttaacttcatctggagcccaacaaaaaagaacaaatccaagttacttctgaatggcgaacatactgatgcaaattctcaaggaaactaacagaaacccacataaagcaaactagtcaatacatagccgtctaaaatgctacaaaccttataattttgtttccgcacattgaaaccaagaggtccacaagcttcctctattttagacatgatctcctgtggtgtacattgagatgtgaaggaagtttcccgcttcaccattccctatatatattaggtagactcagactatttagtaaacgactaaggagtacaactaataggatgataaattgatcaaaacataattgttctgtcggacttagcacataaagaaaagaggaaaacattagcaaaattatattaaccgatacaagcttccagaaagaagcactccaatctatctagcacataacatattctcaacatggaattataatattggactctatcaaaacctaccatcatttccttctcaaataaatttccaaggttgaatccctgtgaccttgaaattagagcaaatgcattcatggattcaggcttttctctcttctctgccacgagattctcctgaaaggttaaacaaacaaacgtaacaaacaaagaagtggttttaactcaggttacaaatcgtatttttgggaaaggatgcaggttacagataaatgttcagctagcattacctctgaacaatcgaatgcagcatcaacatcatcaaggctcacatcttcaccttgctcaaaaagtggtggtttgtaatcctttttgaaccaatcatcttccaaaatttgtgcaattgttattctctgcaaagaatatagctcattgttttctgacttctctcaaattgccatcataaaaggcttcaaagaggatatacaatgaaactcattggactagcagcagtcagctggtcaaactggttagctgaagatatatgtccttaattgtcacttactgtgcagggattaggatcaagtatgcgcttaatgaacttcttcgcacctgaagaaaaccaatgtggacaagaaacttttgccttgcagatctgtgaagagaacatcaaaagtctatcaagtttaccaatgaaattcacaagaaacattagaatgcgtgcatgttacacatacttaccagtttgtaaagggtcattaggttggggtcatcgaaaggtaaatatccagccatgaggacaaataagattatgccgcaggaccatacatcagcagccataccatcataacctttatcagcaagcacctgagggaacagtatgaatatatgattcttacatctttttggagaaaatacacgagtttaatcaaaggcaacatgaatcacctcaggtgcaacataatttggtgttccgcaagcagtatgcagaagtccatcctcctaaataaaacaatcaaaatagtttaccaaagttacttctttcaactttttgtcaccaaaacaaataattatgcgtccgaagttcatttgaggtaatagtgcaagttaaggaacaagtcaattaaaccagaaaaatgctagaaaacccaaacacatcacattaggataaagaaactggttaattttttaacaactacaaaaacatacttctgggtactagctagatatcatacttttgtttgtggagcaaacgcactaaggccaaaatctgaaactttaagagctccatgtgaatcaagaagcagattctctggctgcaaatggcacataaaaaatatgaatgagaatacatccatcccagtggagattacccagaaaggaggtaagcaggataattcaacaaaccttcagatctctatggtacactcctctgctgtggcaataatctactgcatttataagttgatggaagtatcttcttgcttcatcttctcctagtctcccagaattgacctagttgataataacatgatgataaatgggtcaacttgtatggtccaagaactgcggattagtcagtcagtatcaaaacagtcaaatgtgccggttcaacaagctactcttacagcatgtaaaagcaatttgtacataaacaaaaataagaatcgtgatatctggcacagaaagttcatgggccttacaatcttatcaaaaagctcgcctccatcaacatattcaagaaccatgtatatctttgatttgctagccatgacctgtcaaacacacattgaatgtaaaattctcattgaatgagatgagataaaaaaaaaaagaagggtatgagtggtaatgacgctattgttcctgcaaagatagcaaagtacctcatgcaactggaccacatttggatgttttattagcttcattgtggaaatctcccgtttgatctgatagaagtggaatatgaggttatcattcacaatcgaaagctcaagctggaaaacagaacagctcgagcagggacatttaattgtgccaacacatcatatggaaaatcacatatttaaccaaaaaaaatactagtttttccaccaaacaatgcatcaaccaatgagtgatctagcacggaatgtacaatacccgagtttccccccagtcagactgaatttataactccccgagaaaaaaaaatgaatctagaacaactcttgccactcctacgaacaccaaagctagcacagctttttgctaggcagaaagcatttgattaagacagggttggcatcaccgcatcggagatattgttatagttacatggcccagcttgataatctgttgttacatttccgattcaaacttgatacaattccatctaatttcctttagatcagagcagatttagcccgctggacaggcggacacatgacctttcttcaatcacaaacaatccaaacagacagaatcttgacaatggtagagacgtagtaagcgcatattctcgtttaatgtttattaatccccatgaaaatccatcttttataataatctagcatctatctagaataatttaggattcttaattcgatcccctccgagaaaagatccaacttgttattacctgatgtctaaaaaaagagataaatattcaattttgaggatgattaaggcggcggacctgctcgaccatcttgtggcgaagcacatggttgcggtcgagcaccttgatggcgagggtgtcgccggtgcgcgtgtcgcgggcgaccttgaccttggcgaagctcccctccccgatcgtcttgccgagctcgtagcgccccaccctcgtcgtcctcctcgccggccccgcccccgcccccgcccccgccgcctccgcctccgcttccgccatcaatccctcccgcagatcaatcctccaccgcgcgcctcgccgccttccgatgatgggatcgaggagtgcgcgcgttggtaggtcgcacgcaggctggatggcttgggcgccccgtgcgcgcgcctcaaataaggcggagatgcgttggtggcaggtgtggtgtggggtccggtcgggaaccgcgtgggacgagacgtaggcggcgcgcggcgtgcggcacggatgcgtgcgtgcgtgcgcgcgctatcgttttggccgtgtgcaacgcgacgcgattcacagttttcacaggcagtggcccgaactctatcccaatcccaccaccaccccggcaaaaaaaacgattaatcaaactcgaaagcaacacgcgtacgtaacgagcacgcgcgaacgcggcatttaacc

SEQ ID NO: 31707 - DNA, 1109 bp, Oryza sativa
  unsure (1)..(1109): unsure at all n locations
nnnnnnnnnnnnnnnnnnnnnnnnnnnnnnnnnnnnnnnnnnnnnnnnnnnnnnnnnnnnnntagttgcataaagaaaaacagatagcagatttggttgcaatgtaacttgttgggatcttcaccatagccattgtatcatcagcgtgacctcattgaattagaacagaagctctattgagctacatgttgctactgggcagcggtgtaatagccttatttaacctttttctgtctattttgcagctccaaggaagcagaaaattcaatattgatggcaaacgggttcagcttgtatcgtaaattacgaagccgttcgggtgtgacatgaagccattgtggtcatattaggctattcgtgcttctgatgagtgtacgaaagtacggagcacagtatgctctgcggtatagatgtaagaagtaatacccctcacgcatggggggtcaaattttgcaaaacttacgaacggctgagatgctaattgtgtgtacactgttgagcacatttgattttcatcgttcatttccctacagcaaatgtttggcagccggttctgaataccaatgcacgtcaatattgtaccttagctggtgtattagctggtgtatcttcaattattatacttctgtttggagcgtgtggtatatgattggagctagtttgtgccaacgttcaaaggcgctctacttttagaacatgttttttgcacattgattttgttattatctgaaaccggggccaccccctgatgattttgcctgattaattcgtcatgctagttaaaaatatattttatttgttaaaaaaaatattgttgtattgatatttaaatttactttcataaggttataatatatgagaagttagaaggaaaaagattagttttgaagaccgtatcaactttgatcgagctttgtattatattatggaatagagggagtagtactgttttaatttcaccagataagatatacacaaaccctggtgattgtacatttctactgacctgccacgtggcactttacattcacatattcagcttcgttcacaacggtaggcagcggccctgcgtcttgaggcgatgcgcattggtcgggggaattcgggat

SEQ ID NO: 31708 - DNA, 610 bp, Oryza sativa
aaatgtaagtcctttaaaagcaatgagttttgtttctgtaaataggggtcatagatccatgatctattgtcgcaagtaaccgcaagataagattcgtgcaggagccgtatccttagcaagatactaaatcaagtcagggctagctcagagtctcgatcattaagaagggacaattgccgctaatccgacagcgatcagtagcctgtcctttctgttaccagtcgtggaagagttcggattctccccaatttgtccaaatggagtggtatatcaaggtaagctgaagagagaggccggcgtttcatcatccattgttttttttcctgctgtatcgaatcgtacaaagaaacaaggagacggtctctttctagtatcgattaggctgtgacctcccataagtgatacaagaaccggcatgctgacatttcaagaggatgcagatgcagactgaaaactgaattattgacatatatgacgacatctatgtacgaaaaccttgagcaaattggctaagtgaaacagcgaaatctaagatctttttcggcggattgatggcgtttcgagggtggccaagggcccgtctttgctgttggttacggtcaaggtataa

SEQ ID NO: 31709 - DNA, 680 bp, Oryza sativa
  unsure (1)..(680): unsure at all n locations
nnnnnnnnnnnnnnnnnnnnnnnnnnnnnnnnnnnnnnnnnnnnnnnnnnnnnnntatctaaacaccatatgtagattatgctggagaaatataccagccaaatgtccttgcaaagtctgaaccagttccaagtggaatgagctgtcagagaaaaacaatccgcttcactaccgaacaaattccagtgcataaacaaacatttcagttcagaatagtctaatgcttaatttaagaggctagaagggtgatctgattggatagaatagctagaaactaagtacactcacaccaagcgctgtggaatgatcaggtccttgatcaagagcatggacaggacttcccttacagaagaagccattgacgacctgcacattccatccacaaatattaccgtatttgaatatcaagtttctggacaaatttagtacaaaggttgtatccatattgcaaaagtcaacacaaataatacctcatgaagtgttccatcaccaccaacagcaatcacggcatcagccccatcctttacagcctacatcatcatcatcatacacacattgtaacaagaaaaccaaaaggggaaattaacaattggatactggcagctataggaagcccatacacaccctcctcgtgatatctatggcgtcgaacggggccgaggtgatgcactcacaaatct

SEQ ID NO: 31710 - DNA, 707 bp, Oryza sativa
  unsure (1)..(707): unsure at all n locations
nnnnnnnnnnnnnnnnnnnnnnnnnnnnnnnnnnnnnnnnnnnnnnnnnnnnnnncaccaccggcacgctctcctcctccagccgcccgcgccgccgcctgccgcctgacgatgcatcgctcgcgctcctcctgtgccgcggcggcggcggcgtcgccggcctgatcccgcggtcttcccggacgcccagcgcgcgcacgccgcgctccagctcgcgcagctgcagcaggagcgtgcccacgctcggcgtgccatccgcgtcgtgcacggtgttcggcgcgggcgtgggcacggtcaccctcgtcgtcttcgccgacgtcgcggtagcacttgacgtcatcgtcggtggcgtggtcgtggcgggcgagatattgccggcggcggagagccgggacacgacggacaccgacttggcgccgccgcagccgcacatgaagccgcgcgcggccgctgcgctcgaacccttcttcttcttcttcttcgatggtaggccctgatcggccatgccgcgacgtgtcgtcgctttcatgtccttgggttgagagccagtgagcttgtgcgcttgttggtgtggactagctacaccagctatagtggggagctagggggacagacctcttaaagcctgggcttaacaagagccagctaggtgaattttagacatgctgatgcagtagcagcaattacttaactaccgacacatttat

SEQ ID NO: 31711 - DNA, 974 bp, Oryza sativa
  unsure (1)..(974): unsure at all n locations
aactagtatttttttggttaaatatgtgattttccatatgatgtgttggcacaattaaatgtccctgctcgagctgttctgttttccagcttgagctttcgattgtgaatgataacctcatattccacttctatcagatcaaacgggagatttccacaatgaagctaataaaacatccaaatgtggtccagttgcatgaggtactttgctatctttgcaggaacaatagcgtcattaccactcatacccttctttttttttttatctcatctcattcaatgagaattttacattcaatgtgtgtttgacaggtcatggctagcaaatcaaagatatacatggttcttgaatatgttgatggaggcgagctttttgataagattgtaaggcccatgaactttctgtgccagatatcacgattcttatttttgtttatgtacaaattgcttttacatgctgtaagagtagcttgttgaaccggcacatttgactgttttgatactgactgactaatccgcagttcttggaccatacaagttgacccatttatcatcatgttattatcaactaggtcaattctgggagactaggagaagatgaagcaagaagatacttccatcaacttataaatgcagtagattattgccacagcagaggagtgtaccatagagatctgaaggtttgttgaattatcctgcttacctcctttctgggtaatctccactgggatggatgtattctcattcatattttttatgtgccatttgcagccagagaatctgcttcttgattcacatggagctcttaaagtttcagattttggccttagtgcgtttgctccacaaacaaaagtatgatatctagctagtacccagaagtatgtttttgtagttgttaaaaaattaaccagtttctttatnnnnnnnnnnnnnnnnnnnnnnnnnnnnnnnnnnnnnnnnnnnnnnnnnnnnnnn

SEQ ID NO: 31712 - DNA, 1018 bp, Oryza sativa
ttgatcctggcgtggaaagcgataagcggtggtgtcgcgtcgcgtctgcagtagaaatggaagcctgggggctgtggctgtggcgtgggccaaagcagcagccatcaccagataaccccgcccgcatgcccccgcctcaggcccccctccccaacgtagtatattcacctcgccgcacggcagcggcagcagcagcgtgccacgagacgaccaccagctagctcgcaatggcgcagcacgagaggaagccagtcggcgaggcggtggacgtggaggcgggaggaggaggaggacggcagcgagctgcggcggcggcgggggagagaatgaggttgacgtggtcgtgcctccccgtggcggcgggcgtggcggcaacgggggtggcgggcgcgcccgtgctggtgtggtgggcggtggcgttccacccggcgcatgagcagctgtggatggtgcccgtcggcctcgtcctcctcggcaccccgctcgtcgcctggctctccctcttcgcctccggtgcgtgccgccgcctcggcagcctccgcgccgtccaggaccaggtcccgccgcccttcgctgccgagagatgactgggttgtcttcgatctgtcgtccgtccgtcgagtgtacattttcttagtcttattattcttcttcggtgttctttcttatcgtcgtttttcctaagatgatcggaatgtgatcagaatgggatccaaattctaaagaaaagttcttgctagtacaaacctgcagatttcagatgcttcgattgatcttgcagataagtttggcacttaattatattctagtcgatcaagtacgtgggaagaaattctcgttgtcaaggttttttattcagcgagttaacattgacagctccggatcgaattttgagagagagctatgcagctcagcccgacagcgatttgtcatagtcacacaaaaatgatggctcctttactactatcgccgcatagtccacacataggcacgagaaaagaaagtgttgttttctttc

SEQ ID NO: 31713 - DNA, 927 bp, Oryza sativa
taaaagatctctagattcgccaatgtacattcacacacttaattagtcattcgtacatgcagcgtgcttaagtttctaggcgcataaggcagggtcgactagtatcccttaataaagcttatggtgatatgatggtggcattgtgtgaactgtgaaggtgtccaattatcaagtgtacatggtagccggctcgcactgtctatatcatagctcctcttcttcccttctaaaattttggaaggatgccataatatggttttgaagtttcttggccgccaagctgaagccaccaccacactgagctgtcgatccgcgtgtatttgcagtcggtggtagtaacacgcacggtgcatcctgagccagtgagccgctttagcgacacatcacgtgcatcggattatcggaagcacacggtcaaggcaagacaggtattttgttagtcgcgattaatctacaacagttagggcatccacaatgtgctacaaaagtagtccatagggaataaactattccatttagccatttagtaacactgggcaactagtccatataaagaaaatagcaaaagatatccatatgcatatacactacctatatgacataaataatattatatatctctacttctctctcttctcctaatgttacattgtatccatatacattgtgagattgctatagttaaagtttatttatatgggtcccatctatataaaccacttttaacatatacattggtaatgcccttacatcatactactactacatcacgatctggtcaagtgcagagcattgcgcagccgcagcgcaggcaggcaggcaagcgcactgccgccacatggctgcacgaacaaaaaagctagtagctccaagcctccaaaggccggtgtggaagaagggagatttcacggttggaaaagcgacgac

SEQ ID NO: 31714 - DNA, 8537 bp, Oryza sativa
  unsure (1)..(8537): unsure at all n locations
tagcaaaagatatccatatgcctatacactacctatatgacataaataatattatatatctcaacttctctctcttctcctaatgttacattgtatccatatacattgtgagattgctatagttaaagtttatttatatgggtcccatctatataaaccacttttaacatatacattggtaatgcccttacatcatactactactacatcacgatctggtcaagtgcagagcattgcgcagccgcagcgcaggcaggcaggcaagcgcactgccgccacatggctgcacgaacaaaaaagctagtagctccaagcctccaaaggccggtgtggaagaagggagatttcacggttggaaaagcgacgacgaccgagagaaagcggcttttttgcggaggaaaccgtgtggaccccccccgtgcgcgcgctgccgttgctgccctgccacaccgagcgatgagtatcgagcaagcgactcgcgctcgccacgacgatggggggcgtccgggcgtagctccccgtgacgccttctcccgtggaagctgtgagcctctgtgaggcgaaatgtaacactgctagtagtagtggattattctattcggattctccacgggacgcgcgggcggcggccggtggtgccgaacacatcgcccacttttgttcgatccgcaagacgacgtgcctgccgcgccgggctgtcgtgaaggcgtagcgatggtcgagcgcgacacatggaatggatcgatcggccgattcggttatatcgccatcggttttgtctccgcactgatcctgcactggatttgggcttaatttgcagagacattgacggtcgttcttaagcgaagccatggcccgaccggctagctccaaggtcaattgcaacgaacgatcgagcaacacttgtcacgagcgtaggctggctgggccggagatgacgtgctgcacccggaccacgcagcacggggatcatccgcgtacatgtacgtacggactacgtactggactagttattcatgtcaccgaccaagcgcgacgacgtacgtacacctgcagaggtttcagaggaaatacagtaatttctgaattctaaccgagaataaggaacacacttgcagtttcaggccgtgacgccccgttcgcggtggcgcggtcgacacggcgagctagccgtcctcgtgaggccggcattgacatggcatgaaccactgtaccatactctctccgtctcaaaaaaaagacaaaccctagatttccgtgtccaattttaattgtccgtcttatataattttttttataattcatatatttattattgttagatgataaaacatgattaatattttatgcgtgatttgtctttttaatttttttcataatttttttaaataagacggacggtcaaatattaggcacgaaaaatagagtttgtctttttttttggtacggagggagtatataccactacggatgtgtgtaggactgactgtacgtacgcgcgtatcaatgccttgcttgctcgtgatcgatggccattgactactgggaggcaatgcgatttactgctgccgttccagtagagggtaaaagacgtcttcaagaagaggaccacatgggatgtggcctctgaggttgattagtcgccttccattcccaacagtacgcggtgcagcaacgtaccatactccagtaatttggtcgtgctctcttgtatggctacaggctacaggctacatcatgtgcaaacgactagacgaggatgtcctgcaggcttgccaacctcatcgtaatgaagcgcgtgtcagggcgatagatgcagagtttcttgcagcacagctcaaacgagaatttttgtatgaccacttcgaaagacttaatattcagccatgtagcacaaaggctttgtttagttgctaaaataaaaatttttcatccatcacatcgaatatttagacacatacatagagtattagatgttgataaaaataaaaaccaattacacagtttacgtgtaaattgcgagacaaatcttttaagcttaattatgccatgatttgatactgtggtgctacagtaaatatttgctaatgacggattaattagacttaataaattcgtctcgcaatttcatggggagtctataatttatttgttattagtctatattgtccgaatatccgatgtgacaatcaaacctaaaaattttacctaactaaacaattcctaagatacatagcgccaacatatgttcgattgatatttttctagcactttggcagtgtctccagatttgtttgttcgagctataaaaaaaagggtgtagctatatttatggtgccatatttttcatcaaaaaataatcggcatgtatttacattgtaagttcatagtgtatttacaatgtaagtctcaaaattacatatgtaagtactaaaattacatatgtaaattcaaaaaatacatactaattatatatgtaagtggggtgtaaatgagatataactactatgtaagtggctgaaaaaaaatcgactgtagcatatggcgccatatttctaacgactccggaaaaaaaatgtaaacaagaaagaatacatgggcttcagaaatcagaaacaggtcaagcctacagtctacactagcccaataagaaaacaactgaagccctactttgggccgagggggaacttaagcccaatttaaacagccaactcagcaatttggcctctttgtcctccgtttgaactttcaagggagaacggaagctgctacccgtaacatctctctctctattttttttctttcttcagagtttctacatctcttctttattgcatttgtgtgcatgcatctcaatatcttatcctcagactgtatatgcgtttctttttcaagaaaggaacagtacaatcactgaagactagctagctatcttgaagagaagagcaggaaaagactatagcgaaaggcaagcatacgtcaatgcagaataatgcacaatgggcacaattacaggatagaagagtcagagagacgaaagctagctagctaccagaggaggctgctatggatcgatcgcaagagcacccaggatcgagtgggctgcaatggatgccgctttttaacagagccttttcaccacagccatatattgttgtgtgaatggagatcatagatatacgaaactagaaagataaaaagaatggatggtaactttgcaggaaaagattgctcgcatgagttgagaactagctcgcaaggtgtgaatcatgtagatcggccgcccggcccggcctccgtgcgcggtgtgctccccacctcctccactgcgccgaaatgatgtaatgtacgtctccgacgcggaggaggagcatcaatcggcaaccgcccgtgtgcgcgcggtgtccagctagccagctgaatttggcagtgactcagtgagatcaaaggcaccgcccggccggccacccactgcattcagtgctgcagacttgcagaggcatgcaattgcatgcagtcgcaccttgtaagttttagtaactacatatcttaccactgaactgtcactagctaattgttgctctcgatcgtctatgtgatgaatggtccacttgtctgtctgccattaggccagatcagagaggatcttgtacttatgagctttgcgagctgctgctacggtttgcgagcttttctgtgccgtatcatgtcgtttctttgctcgtcgtcatgagagacgatcgatttgatagaggtagcgcgcgatcattccgctggttattagtccacgaaatccatcgatgcctcacgcacaccgaggggctgccagtttcctgaatgattccgttccagaagcgaacaacatggtagattttttggccacacagcagggaagctatcaagttaacaatcgaagttgattcaatttacttaactactctcatgcatgcttgtccggacaatgccatgctcacgccaactagcttttgagatcacaaccatggcactccataccctggaatggaacgggaatggaggccggcgagcaatgatagcaaggaagcatcgacaagccatgcatgcagggacagcatgtacagggaagagaaaggatgaagggaagaagaaaagaaaagaaagaaacaagcttgatgctcacatcacatgtatcaaaagcggtaagagtagtgtgcaacaagtatctatccctctatctatatatctatctatcctacatcagctgcccttttctcagtagccaacgtgttgtgcagtcactttccctttaccaacctccatatatggctgcagcctctgtccacgtaggagcaattcaatagtaactcgtaacaacctacgatatcgatccttctgatgatcccttgccgttcacctctcctcgcactagctagccgatcgatctgagatatactacatcaggcatgcatataagtcggctcatgtatatacatccatgtcacaccgcttcaaaattataagcgtgccgccaaatcaatcacacttgtgccgccagtgaaagtgagagtccagaaaaaaaaaatcaagcttagctttcttagtcagtcgggtcaccggatcagtagcatttttagcacgtcatcactcttacatcaaaggtaaataggctttttcttgaagcagctagagaggatgaaagcgcgagcatatgtagctaactagctagcagtacaacacagaagagaacaatttgtatgtgtgtgtgtgtgtgttactgtcacagcagctaggctttttatgcatgcactaagggagcaaacaagcatgctatagcctttttgccgcttacgccaaggatctcacacatgtattctcgctagccaacttgccgtatctttcctcaccaaacgatccaaaaggtctccatcccgtcgcacagatagaacctgtagtacaatgcgcggcatgcctgcctgctcaattctcggcaaaaccgcaaaagggagaggtcacgccggcgccggcctcgcgcgtaacctgcagctatagcccaccccctgcgcgggcgcggttgcgtcgtgcggaaaacaagcgagatacgcgcgcacgctggtggtggtgtacgtgcgcgtcggcgttggccggcacgcgaaacgcgcggggtggtgtggatatacgagagccgccgaggcgcggacggcgcaacgcgcgtacgagcggtggtggtgcgaggcggggcctacgtacgtacgcgcgcggggtgggggccggggctacccggcgtcgggctcgcgcgcaccgatccggccgtgtacgtacgtagcgatatatatctcgagcaaatgatgccgcgacccgcgaggtgctcatgattgggcgggcggatgggcgccgcccgggctaatctttcggaccgaccgatcgaccgagcgaggagcgcacgcggtgcatgggcgacgagccgtgccgtccccatccgcactatgcatgcaccgccccacttaccaccgttccattggttattgccccgcgtggttggataccagctgcatgctgttacagtccaaacttacagtacgtccggccagtgatctgcattggtgcatgcacgcatgtaacattatatgtatgactttcgatcgagtttgaattgtatatggggaccgtctgtcttttttcccatccagaaaccaatataatgttacctgccggggcggccgtggacgccgacacactatccgagtttaaatgggactttgtaaatgttatcatatgcttaggtaactaatgatgcaaagtgaagcagaggggttaactttgatagcaacgtttagcccgttactctggggctgcaggatattaaaatcagtcgccatccggttaagtaaaacgattaattaaccaaggtaagaagagttagttacagcatttcaaagatacgcatggtgccgaccaaccaatgaaagttaagtatgaaaaataactttttatgcatactccttaatatcctgcattcctgctcggtctgatatgatcttatagtaacaggctaacagcagatatgatcttgaacacagcatccatgtattgtgcccgtcacatcacagataaagtacagttctgaacaacttttgacttttctgcatcgccggctggcctgggccacaatggcgagtttctagaggcaacaatatgtgcctgccggtgtactgtactgtgaaaagaacaacctttccatgggaaaaaatctcagcgctttttagcgttctgaggaatagacgaaaggcaaacaaaacactgtattcactcgatttgtggcaagatagctaactttcattctgctttcgcaatatctgcatgcatggctgcatctacacatcaacatgctgatcatacaaatggcacattcacactgcctgcaactcgacgtctgaacacatttgtgcaagctggagtagctagcaactgctccaagcctgccacatgtaaaataacctgtcagaggttactctcatggacgtaccttcgtgcttacaagtggaaatcctcgtagcctaaaacgacgtcgagtacaaaaacgacgtgtatgtgtactttgcatctagtgtatcttgtacgtaaagcctttggatcatcgaccataccattagccaaggcagcatcagtcagctgcagctaggtacgtgtcgagttcagacgttttccatatgtctggacctctcgacgagttgcatcgtttcaggtagggtcaccattgtccatcggtgtccggccccaggcaatatgcaacttgacctccttttcttgtcctaccaacacgtctgtattttgcttgatgttgctacgtatatatgtaccctgttttatactacattactagtgctactgctatatactgctactgctaggagtacatagtttcagacacatggattcagtactgcaatgtgtgggcctaaaagtagatgaatatattgggagctagctagctagttctagatgcatcatcgggagtagcatgattagtatatacctggacgcccagttattggccacacgattgtagtttatgcttatgtacgggtgaggcgtaacagctgctaagcttatcctgttattgttaagtgcacttttggggagatgctgttacatgcttggtgggggaagaaaggacaagtcatcagccagccttaaccaagaaagaaaagaaagaaacatggcgtgccgttacagctttccgatcgattgatcagtctgttgttcctgtatgtttcgatcgcatgcagctgctgaagtgtatagtagtaatgtgcaaatatgtgtgcaatgccagatgaaaagcgcatcgctttaagaaatatgtggtgatcagctagctagcttcaatgctgctgcatacggtgtcaactgtcaagcacatgatgaattgaagaattagtacgtatattccatagctagaggccgggagatagaacattagcaaggttattaattagaagctgaccagaaaccagaacatgtcctctatctagatgatcaatttggaactctgttccacacattaaacctgccttcccttcaggtatatgctaattaagctgctaatcactcttcagcgcaggctaatggcaatgtacattcttaatataatgaactactaactagacagtaaggttaaagtgctcgtgtagaccaagaaatatcttaaatttatcaacatgtcaaccaagaacagaaacagcttgcagagacaagaaaagtgaacccgtctatacataatatcctactggcccctgttccctaatgctgcgccactctaaccctgcagcaagaacatgggtaacccagggcacacccactgaattaattagggtttaatcccagagtgatctgcagacgacgtgtcgtccggggagcaaaagtgcaggggaatgtcgtgctccagcgtggagagcagctcccatcgggattagcgccgcgtgagattgttttgaggttacatgatcattagcagctgctcgcctgctatgtcctacctgaattaattcctcccatttgacctctccatctctctctaccaaaacatttgtgatgaggaaacaaaagttcatgagaaactaatgcatgtctatagtagctagctatagatagatgaaggggccggcattattatagtcacccggccgcaagaacatgatgcaaacccaagcaatttgcagggctgctgggcccctgtgtccataatctttttccatctctcacactacctatccttattaggttttgaaagttctgtgttacgacattcatatggtccaaaaaccaaaagtgtatcattgttttgttccagtacaccagtgtctgctatatttattggaaaaaaaagagaacaaacatgtatgttatgctgtagctggactccatatatttctagctttttgttccctgatcacttgttcatcaagtactacaaacatgtatatatacttttcannnnnnnnnnnnnnnnnnnnnnnnnnnnnnnnnnnnnnnnnnnnnnnnnnnnnnnnnnnnnnnnn

SEQ ID NO: 31715 - DNA, 1816 bp, Oryza sativa
  unsure (1)..(1816): unsure at all n locations
gatttaatcctatttataataaataaacctactcatactactaagaagcaatgtgacagatcaacctaggatactcttcccatgtttgaaagggaagaaaaagcccaatctaacagaggacataagctaacacaaataaatttgaaaatttttagctatttgatctgcatgaataactagcttgatgtgcacgcactacacagaagggagaattctcatattaccttagaaggcagtggctcctcgaacagaaagtaccctgcaagacctgatgaaatgaagttggcagcaaaattggtgacggttgcttggagggatgacagtgctttgaggctgttcacatagcagccccacattgtcacattgaaaagtatcaccatgctgtatttcagaagctgtagaaggcaataataaagtcaagtctcaagtaacaaaatagcaggcagcactagactacaagtacactggtaggaggaactaatccggagtacaggttaaaccggtatcatttgatttgaggtattttcacaatctgatcctaaactaattgaaccacacatgatagttaacttttgatcagcaatttccacattatcccagttatacttctagcactaagtcattagctgaagggatcacacatctaacctcgaattatctgatgaatccgcaacttcggatccaagtaagtgactgtttcatgcccatgaacttggtaaaatcatttaatcgaaccagcatgaacaaattaaacccgaacaaaggctgaagcggcctattaaggttacagcggcagccttccaagcaaggtatgaacagaaaacagaatgttcagatcggagggaggtagagagagagctagtagagtaccggaggcgcgaagaacttggcggagatggcggcgagcgcggcgttgaggcccgccgcgagcgcccacccgtagccgcctccgcgtgccatcggagctggagctcaccggaggcggagatccactccacaactctgtagcagtcctctcatggtggagaaaactgaagacggaggggagaactgggccaacgagcctgggtttcgctaaatgggccttagttgcgaggaaggactgatgaggcccacataaaaaacggactacgtgggctttgctgggcctaaatgatgtacagtacaagaccgggaggtagagggattggggaagagaagcggcggcctgatcaggcgtcgtctcgccgactcgcggtgccgccgccgccgccgcggccaatcggccatcggagcgcactccggcggtcgcaccaatcctctcgtttccatgagggccggcgccggcaccgggcgtcaccgccaccaccggccgatcgattggcgttggcgcgcaccgccgccctagttgtactggtttgggcgtgtggcgagcggcgagttacgatccgtgggtggattttcagaagctgatccgatcaaccggagcaattcagcaggtacacccttgaatccttgatttctgcagtttttttttagaataggaatttctgcattattttgatcagactagttagtgataatatatattagaccaacatgaacagagattttagactgagttcattatcccggtataataattgattaatgggtagtaagcacgcactacggtataattaattagttgttgatcccttctacctatcacgagagaataggcctcctatttggaagatcatctgttgtcgtatataataatcttacggtagggatgcaagnnnnnnnnnnnnnnnnnnnnnnnnnnnnnnnnnnnnnnnnnnnnnnnnnnnnnnnn

SEQ ID NO: 31716 - DNA, 7202 bp, Oryza sativa
  unsure (1)..(7202): unsure at all n locations
nnnnnnnnnnnnnnnnnnnnnnnnnnnnnnnnnnnnnnnnnnnnnnnnnnnnnnnatctatgattatgtatatagcctgatcaatcgcacagccctcttgactagtgatcacaatctaaatttcctagagttttttcttgataatatttgtacaagttcaacgagttactagctagtgtgctgagtcagagtagcattttgttctgcacgcgcacctcttgctttagtcgtttctagcaagttatgctgacttcaaatattatgtcattaattactgtagagagtacagtgtactatatatgccacccagctgggagtcaaagacatttacaaagtgccaatgtaggatcacatcaactgggaaaaaaaaagcacattgcaatgccatgcatcttatgactctgcacaggggacagatcgattaaaggttacaatcacatttgggaacataaaaagaagcagaagaaaaaaaaagagaacaatttataaaaatttcagctataaccatatatcccatccggttgatgtgatgaacacatcgtgctgtgaatgctttgtccctcatttgtcaaacacacagattccgaggtcgccgtcgacgccgctcgcgccggcgccggagccgagcaaccccgtccacctgtcgacctcgtctctctcgtcgctgttgagaaacagcaatgctgccatgtcgtcatcgccgtggtccagcggcgagctcacaccggcgactgccgccgccgcggcttccgccgttgcctccatgctgccacactccccggggctaagctgcgacgcgacgaacttgtcgagcgctctccagtccgtggtcgtcgccaccttgtcgccggcggcgcgggctttcttggccctcctaccgccattatcgcccttgcagtcgtcgtcctcgccggcggtggccagctggctcgggttgggctggagcggcgccgcagccgcggaggggctctcgagctgcggcagctcggcgaggtggctggagtagtggaggagggctgtggcggcgccgtccagctccgcctcctgcttgaaccgcccgctcctgtgctgccgcctcatctgcgcgtacgccgcgctcggatcggcgaacgccgccgccgccgcggcgctcatgatgttgcgctcgtgcaaggagtagtcccacgtctccaccatgctcctcgccggatacgccgtcctcttcttgaatgctcggcacaccacccatccttcttcctgtagtacacacatgcaaataaagttagatacttaggtggtgtttgagtctcccgaagattaagattaaatatttcatgtaaaacgttgtggtaataacgtataattaattaagttttaattattataaacttgaaaaatagattaatccgatattttagaacaactttcatatagaaagttttcacaagaaacacaccgtttagcagtttgaaaagcgtagcacaaaaattcaaaatttaatccattgttttaagaggaaacgaacgggggggatgtgagctgcattttgcaaggttgacattgacaccaaagtatttgccaatcattcgtaaagttagctagcttcccactgtgtgatagtggaacaatacgagctgataacttttttagttttgtggtgacatgtttgccaagcagcatgcaatggttttgatgagtactagcacaagttgcatacagcttgtaaacaatatatggcgcatgttaggacgttcacaccaggggaaaccctaactaggccatgcatgcgcatgcaattgtctagggaaaaaaggttttggtgttagtggtaaggtcaggatggcatcaacactggatgcaggctacctttatttgggagagaatagaagactttggaaggctcacaaaaagggaggccaatgcaagacttatctttcaagaacaaaaagagttgtggtgctgcttagtgctactgatatattcctatctatatggtccattactagtggtacatgaattagacatgcttgcacgcatgtatatcggcggcagatctctgtgcgtgctactttagaaatctctgggcaccattagaccttaacctctaataaggcctaagctggtatactgcattttatcttcagttgcaagttgcaacacacatatataagtatataattcagatatattttctcagatatataagtatgcaatgtggtcactaacaaccttaaaaaatattttcttttttttttgataaacccagcctatacatccaaccggatatatacaactttttaaaattaggaacttagcctatcaagcatggaaccagtttgctagtttatgtagagctagctagcatgcagagaaaattaagaaaccaattagctagtgaaatcggtatatgtatatacctgtggcggcgcgttctcgtcggtctcgaggcggtactcgtgcatgatccagtcggtcttctggccattaggcgccctgcccttatagaagacgagtgtcttcctcatgccgatgagcctgctcttgtcgtgcaccgccttgtccctccccgtcgccttccagaaccccgccattgtcgccctgttcgtcctcgtccccgtcgggtacttcctgtccttgtagctgaagaagtaccactcgctttgctcatcgtacccgatcccacaatgttcttcatcaatcaacaaaccaggcaacacaattaggataaataatgccacaatgatcatctctgaaactcaaattaatcatacgatctctagttgtaccttggagatcccagggttcgatgcggtagagatcgatgtcgcggatgacgtcgaggtcgatcttctgggaggcgaccttcttgcggaggtagtagccgacgagctcctcgtcggtggggtggaacctgaacccaggagggacgcatgattccatggcgtccatatgatcaccaacctgtgcctgcactgcaattgcatgcaccgtgcatcagattcagcaacaccgtcttctaaatatccatccacacccaatgcatgcatgcatcaaatgatatagctcgcgagtggcactagtagtaaagaacacatgcaagtgctcgaatcattcggtgcaagcaggctggctatcttgcgattttttataggacacacaaatgcaaaagctatctgcacagaagggctagtagcattggtttggtctggatactgaatgactagctacagactgactgacaaggagtatactactacagtagtgtgtatgggtttcagtgctttggtaaaatttaatccagccatgttgggtttgcactatggactttctaggataaaaaggcaaagtacggcagagcctgggcaagaggccagcagggacaaatgtaggaaagctacaggcctgcgaatgatactgtcgactggtgatatctcagaggcatgtgggctatagtcagcaacgaattatagctgttgcagcagcagaaaaatggtctgctatataagagcaaggtcaatagtgtagccagctactagctccaataacatccatgtcattttatagccaataccaaaactaactagtacaataggttggctattatatcaacatgatctcattattcaaacaataaactttacatgtgcatgatcagaaacgccctcaactctgtggcttatatggccatttgtattatgtaataaatatgggttatctactactctacttgaaaaattaacgaataacaacacacttgataattcacatagtatatcacaacccactgctgcccaactgcataatctatacatgaaaaaaggagaagaacaaaagggaaaataaaaggagctataggaagagattagaacggactagatgcaacagatgagacgaagaatcggtagaacaaacatagacgacaagcattcaacagacagtgggagaagaaaagaaaagaattagaccaagccaattcaaatcaagaagttgcttattgctttgggtgccagttgcatgcccgcaccaagcgcctctcaatcctcctctcgctttctttgtcgctgagaactgggattactaactttttgggcgcactggagctttcacggcggagtttcacgtcgcgggagaaaattccggcgagacaggggtgagcggaggcggcgtgaagcggagcaaaatgcatcgggcggatcggaagaggcacaacagaaacaaaacgatacacgggatcggcggggtggttgcgggacccacaaatgcatgcgtatctgtgtatcgctcggcgctacatctagcgcccgctttgttccctctctccagttatctctcttccacgtgagaataatctgagttggaatattttggagcctgctgattagatttattgtaccttctctgattagtttgttcagagttcagtaatttgtttagagtaataaaattaggggccttaatttgtagcaacaattagtgtgacttttatactagagagtgctgcatatatgtttttgaagtgcatgtgtgcgctagatacacgctagtatagctagtacttaagaacctcaatatgcatgattttctactcattctgatcatacagctctcatgaaaatggattcatgcatggctcaatgcaaagcactgtacgcagagcttgccaggcctttattttgtacatatactgtacatagcttagatatacgtacgtactgtatatagcttagagcatcaagtatatatgcaatgcaatatatctgcaattaattctagaattgaatatatcttaatattagcagctttttatctagttcgcaaactaagggcccctttgaatcaaaggaatgaaaaaacggaggaataggaaaaacatatgattctgacaggaatgtaagtgtaaaacagaggattgcaaaccacaggaaaaacataggaatgaccgtttgattggaccacaggaaaaacacaggaatttgaggagagataaagactcgaaggatttcttccatgaggttctacctcttgttaaaattcctccaaaacttgtatgggaagaggcattccataggaatttcataggattccatagtgttcattcctttgattcaaaggtctttgtaggaaaaattcctataggaataaaatcctctaaaattcctatgaatttcctttgaatcaaacggggcctaatgccctctttgtttgggcttgggcttattggcttagacttttaagtcagcttattggcttatatgatttataagccggtggatttaatgttctaagtttaatggtggagtcatgcatctatctcacataagccaaaaaaacttctccaacctagattttggcttaatagtgttagagtggcttatggcttcaaaaaagccaaacgaaaaagctgattgtttgtttaggcttatattttttgacttataagttggcttataagcctaaataaaaagggtataaaacatatggcatttatacatggtgcgtggatgctggggctaagcttaaaacacaacaaccaaaacgagaaagctgcatcgctagcatttgccgggcggatgagcacgcgcctgcatgccgtggggcatgtaaaaaaatttgacaaattaaaggtggggctgggagcaaaagatggagagaataaaaacgtgaggagaggaagctagctagccaatgccggggatcggagggccctttcagcgatcaggcctgcaaattaaaggagaagaagaggctaaaaaagcgccactaacactcactcgatcactcactgctccgtgaaagctatagccatggcatgcacagagagaatggaaagctaacacagcagcagccagcaggggcacacgactatcggttttcttgcacggcctctgaccgttctgtctgtttgtcgaggaattccatggcacagcagggaccctagcttagctctggccttgcattgtgcattgtgggcgagctgcctactgatcctagctactagtagatgcgctcacatttgctgagatactgcttgcgaagttgcaacgctatagtgcatgccgatcgtactactggacggggagtgtcctgtgcagtggaggagtacagtacagctcgtagggcatgcatggatggtagctcttctgtagggtggacacagaaggtccaggggtagatcacaatcattttgtgtttcccctttggtttttagtattgtgatgcatggttgttgctagttatatagtacttccttcgtcacatattaagttaatttagtatgggatgtgtcacattctagtattatgaatgaacaaatttttgtctagatttatcatactataatatacaacatctcatactaggaaatactctttctatgttttatgtctcaccaaagaaaatgagctgataagcctaaatgtgagggagtggattttgaactgttgagaggacatcacctcgttgtttgcatatcatctaaataaatatgaaaattttgagaaaatagataatatatgatatatcactccacaaacatacaagttaaaatccaatttctacatgttgcaaaagaaaattaaactatagctagttaacatatattcatagccaatttttcttttgcgacatgtagaagttaaatttgacattccatgtgtcgtagagtgatatatcacattaatctatcttgttattttttttataaaaaaattataaccattagatgacatgcaaataataagggaatgtcccctcgagagcttgcaagagaaatgacaaattgagatcttgctcaatgcaacgaatttgaataacaggacataatgcatgattaattaatttataatatatatataagtatacaccattcattaatgtgctaatgaattgttaatttgtaaatccagtcctttcatgtgagatctaccctttttaattaggataaaattacagaccgcctataagtcccgatgtcgggtatatacctcatggcaatgaaaaaggaatgttgattttttattgatggatcagtcactacactaaagtattaatcctctagggttgttattatgtaaggatgtcaactaagatggtgcacgcatgctaccttgctaacattgtcacagacctcctatggtagtatatactataccaggttgggtaagaatggatagaaaggggatggtggtcctnnnnnnnnnnnnnnnnnnnnnnnnnnnnnnnnn

SEQ ID NO: 31717 - DNA, 2113 bp, Oryza sativa
ctaaaataatggtcacttgtaaaaaaaattcaaaaaaaaacattccacacttgtgtttttatatggtagtagaaattggaacaaaataagttatggaagatttccatgtagaccaaactagtacagtgctggtatagtttacatggcaaaaggctacattaatttatatttgtttttcttcaaattaatcagacttgggaaatttgcttgcattccgaccatttttccaattccagcctctgcatgcaaacctcatctagcttggtgcaacaaaggtactatgcgtggactgtatagcacttattagcttactcatataagggtgtttcgtgtaaaagaagtgttgtcaccccgtctattaattattgtacgacgacatatataagtggatataatttagttcaacatatatatacttcacagtgtgtaaaagtacatactatagctccagtagtatatagtgatctgacccgaccatcttgagagtgctcgtttaatttttatagcaccatataccaccatatccaaaaatacattggccaatctaaaaggcaatttcggtctatttgagtgtatgattcagatctttctttgggggtaaaatggaacaaaaagaaagaagaaaaaatgggttatgtatatgaccactgcgctttctcgaaaaggaaaagaggtagatcaattactatgatcatatagggggtcaatcagaaggatgcaatgtctctgtgcggtgtgacagtgttgtagttacatgtgaatgaacacatttatttgtgtcacatttattttttacagtccttaaggtaccacttttctcttgtaaaatttgataccttgagaactgtaaaattgctctatatacaaaacatatactaccgacacagagaattgtttgttttatgatttttattataaaaatattatgttgaagtagcaaatgtaattcaaaatatataactttacacacatactactatgtatgtagagcatgcaataaacagcttgatttttaatcaatatacatcatatcacatcagatgcatatgataccaataccagtatgaagaatttttttaagcatctgattatgatcaataaagatcaacgaagaaaagaggggaatgtaaaagaaaaaaaactgaaaaggttgcaaataaacagggcatatatatagccacatctttttccataacagaaatgaagaagtttctgcatcgagatgtatttggccacattcatagctacatcttgttcgactattttcagttcaagctagcaaagaggagaagagaagtgctagaattttttttcgaagaacaagcagctaaggatttttgcctaatagagaggagctagattgaacaaaattaaagaacagatcaagatgatcaaaccagcacagatcacagatcgatgaacacaccaacatatatagctaataactgatcgatcaaccagtactgaaactcacctcagatcaagcgacagcttcagttatctcgatctatacagattaggcgatcgaattcaagaaactctcttctccaaggagaagcacaaactcgtctgtatgttctcttctctagctgttggcaagaagctggcctgcgtgtgtggaagaataaatagcattggagaggaggagatggagtttgcattggagaagaaaagaggggtcgagaaggtggcgggtataaaaaagggtcggggtcgctctcctttccgtcgcgcgtgggtgaggggaatgaaggcccttgggccccacatatgggcccaccagctgacgtcacgtcgtcctcttcctcctgctgctagctgctactcctctttccctttcctctcccggcactgaacagtacagaagaagctctagcattcgagcatctatgtctaacctttgcatgtagctgatgatatatgtgcctattgatcaatcttgtagcggccagaacttaggcatgatccagctagggcctttgcatataccggctcttagagtaattcatacgtagaagcaggtgcaaaggtatctgcacctagctagtaactcatgcatatattacttaatttaagagagactaaacctagatctctcaatggattcggcggc

SEQ ID NO: 31718 - DNA, 715 bp, Oryza sativa
  unsure (1)..(715): unsure at all n locations
nnnnnnnnnnnnnnnnnnnnnnnnnnnnnnnnnnnnnnnnnnnnnnnnnnnnnnntagaaggaagcttagttgcaatcttactgatttttttcgtcattatcagtcccacacctcttgaatttactagtgcatataataggtaaatggtggagaatggaaaaccattcgtaaagtcactgcactatgcataggaaatgccaaatacttcggcggtggtatgaagatcactccaacagctgatcctttcgggggtgaccttgaggtgcctaaaaagtcatttttctttatagttttgagtaagcattaagaaaagttagcctttgttaatttatgtgtcatttcataggtcgttattcttcaagatttcaaatggcatgatttcctgctcaagcttcatagattgtatggaggaactcatctatcagtgactggtgtgtcatcgataaggtaaggggactccgctaatgaatcttagtgttgctctacttactttaaacaatgctgagttaagggttgtacttctggttggtttcatccaataacccttcagttgttatttggcatataggtcagatctccggacagattaatcttgttagcatcatcactggtagttttgcaatgacatgatggcaatcaaaattgttgaggaatatttattcgagctctatgcctctattgctttccttctgatatgtgtctcattagttctaa

SEQ ID NO: 31719 - DNA, 669 bp, Oryza sativa
  unsure (1)..(669): unsure at all n locations
nnnnnnnnnnnnnnnnnnnnnnnnnnnnnnnnnnnnnnnnnnnnnnnnnnnnnnntgatcgatggccattgactactgggaggcaatgcgatttactgctgccgttccagtagagggtaaaagacgtcttcaagaagaggaccacatgggatgtggcctctgaggttgattagtcgccttccattcccaacagtacgcggtgcagcaacgtaccatactccagtaatttggtcgtgctctcttgtatggctacaggctacaggctacatcatgtgcaaacgactagacgaggatgtcctgcaggcttgccaacctcatcgtaatgaagcgcgtgtcagggcgatagatgcagagtttcttgcagcacagctcaaacgagaatttttgtatgaccacttcgaaagacttaatattcagccatgtagcacaaaggctttgtttagttgctaaaataaaaatttttcatccatcacatcgaatatttagacacatacatagagtattagatgttgataaaaataaaaaccaattacacagtttacgtgtaaattgcgagacaaatcttttaagcttaattatgccatgatttgatactgtggtgctacaagaaatatttgcttatgacggattaattagacttaataaaatcgtctcgcaatttcatgggga

SEQ ID NO: 31720 - DNA, 1364 bp, Oryza sativa
cttagatcatgcattcacttttaaaacaatctggttttgatgtctcaatagatgagctcaagttatttactaattacaaaaatatgaactaaagttgcaaaacataattgacacaagttttacaaaagagtcaagttatggtcaaacataccacaagcttatagaagtacaaactgacaatgtgtgtcgtagctaataaaattttggccttaaaacttactctagtcagagttcagtttcttctcgatgcttgatttgcttaggataaaaacaccaacaatgataagactagcacctacaaaccactgtatgaacatacatcaaattcaaaagctgagtgcagttcagttacaattttgtatacatgtaaactcaaaagtggggaaagtgatgtatcagtattctacagtctgagatacacctgataatgcagtggcaaagggtgtgtggtttcaaccctgaggtcccgtgttcaatccccaacacgctcacatttcttcttgaaactgtttggagggacatctctccctccaaatgtctttttttattattattatattttacagactgtacataaattcagctgtacagatatagtaggcaagtgatatgttattattgttgtatttatgacagggtttggcttgtatttaactggtatacaagggggcaagtcattgctcatgatataaagcacaagaccatctatttctctatctgaaaaacggcatctattttagcataacaacctaaagatccagtgtgttttctttcctatcaaccaactgcatgcatctctcaagaattttttcatacaacagtaaattataagataatctttgtatgctatgtgacttttcaagcgagtaatatgaatccagataaagtggcctagcttaataactagatttaatcctatttataataaataaacctactcatactactaagaagcaatgtgacagatcaacctaggatactcttcccatgtttgaaagggaagaaaaagcccaatctaacagaggacataagctaacacaaataaatttgaaaatttttagctatttgatctgcatgaataactagcttgatgtgcacgcactacacagaagggagaattctcatattaccttagaaggcagtggctcctcgaacagaaagtaccctgcaagacctgatgaaatgaagttggcagcaaaattggtgacggttgcttggagggatgacagtgctttgaggctgttcacatagcagccccacattgtcacattgaaaagtatcaccatgctgtatttcagaagctgtagaagcaataataaagtcaagtctcaagtaacaaaatagcaggcaggactagactacaa

SEQ ID NO: 31721 - DNA, 504 bp, Oryza sativa
  unsure (1)..(504): unsure at all n locations
nnnnnnnnnnnnnnnnnnnnnnnnnnnnnnnnnnnnnnnnnnnnnnnnnnnnagcaagaagagcatgcggcgggcacgccgttgtcatcccctcaaccaccaccgccattacgactgtcgccgagacaactgcaaagatcgatggcacaacgaactggtcaaaaagctcatcttcttcagcctcatggcgctggcctcaccattcgacctggaatacttgctacatgcgttcgcctcccgtctcctccattgccctcctaccgaatgccgatgcatgagtctccctgtcgttccccgccattgctcttctgctgccgcgcatcactcttgtttttgtcgctcaatccaaagaaataaataggaatacgaaccctcgtccccaaagcccgggtcctagactactaccaatagaaagatttctacggatattcttcgtatcaattttataannnnnnnnnnnnnnnnnnnnnnnnnnnnnnnnnnnnnnnnnnnnnnnnnnnnnnn

SEQ ID NO: 31722 - DNA, 787 bp, Oryza sativa
  unsure (1)..(787): unsure at all n locations
ttgtatgtttaaatgagatgaaagaacttatatccttataaaaagaaccagtggaagtttttctctgttgtttaaaaggtgttcaagttttgttacccaatttttttgaatgacagaaataaacaatgatcctgctgctacaaaacagagatcgaccaatttaagagccaaggaagatattccaaatgatcatgaattatcaaatgtatttgtcggtgcaaaattctacaatgtgaggaagtctcctactttgcctaaaatttcaatcagcttagggacatcagataataaaagggcgacaagtgcttcaggtcttcaggagggaagctcgaggatatcacataataaaaggacgacaagtgcttcaggtcttcaggagggtattcccatggtaaatgatatttctcgttaagttgattgtttgtttagaattctgatggtaatcgtaacactagatcatccagaaattttacttggaatctttgatatttccacagagaggtaaacaagttattcttggcaacgttattgatggagaacaacctattgatcgcaagctggtacgttcttactacttgtacttctgaataataacaattgttactacttacttcaacaaaaaattcttcaaatatttttttctatttgccccctttgtattttatgttattgccaaagttatcccatttactttaacttttgtgctcaactattttctgttttgtagggcaatnnnnnnnnnnnnnnnnnnnnnnnnnnnnnnnnnnnnnnnnnnnnnnnnnnnnnn

SEQ ID NO: 31723 - DNA, 573 bp, Oryza sativa
  unsure (1)..(573): unsure at all n locations
agggcgacctcgagctcggtacccgtaggatcagacagaaaattctgatcagtctcgtgctcctcaccttggcattgatcccgcagccgctgcggagctcggccgcggaggagacgaactccctgccgaacttggccgccatgaggcgcttcacctcctgcagctccggcacgtcaccgcacctcgccgccgcgtagatcaaacccgctgccgcctcacgcagctcctcgggacactccctgctcgaaagagacaaaaaaaacaccggtgatcagcacggcgcaaagcatagccaacagacgcgatgacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 31724 - DNA, 1807 bp, Oryza sativa
accacccttccccctcccgtccgccccgtcccgtccggccgcgccgcgccgcaacccaaccccctcgtggcctcgtctcgcctgcgtcgctcgctcgatccgtgcgcgcgcgcgctaggtcgccatggcctcggaccaaaccctccccgtcccggtctcggtcgagctgccccccgccgcgcccaaccctcctgacccgaccgcacccctcctcccgcacgcggacgacccctccgcaccccccgccgccgccgccgccgcccgcaagctccccgtcaagcgccgctccccgccgcagagccccttctccccctcctcctccgacccggcctcctccgaccccgccgccaagcagcagcctcagcagccgccgtcgccgttcaagttccagcggatttggtccgagtccgacgagctccgcttcctgcagggcctcctcggctgcggggcgcaggggctcgtcttcccgcgggacctcaacgtcttctacgaccgcttctccgagtccatgccctcgccctacacccgctcccagctctccgagaagctccgccgcctcaagaacaagttccgcggcatgtccgcccgcgtcgcacggggcctcgaccccgcccgcctcgcgccgcacgaccgcgacgtgctccacctctgctcccgcctctgggaccccgccaacgccgccacctcgcccttcgccgccgccggtgacgcctcctcggggaacaagcgccgccgcgccgccccgcgcgccgggccgctcatgcccccggatccctcaggggacagcaattcccatgattacaacggcggtattagcgccggtacgcccggcgcatttggggatgggcacggtggtgaggaaatgatgtatcttgagcaggaaagtgggcactttggttatcatggagatgtcgcgattgcggctgacggaagccttgatgggattgtgaaggtgcagcctgagactcttcctgccctccccagtatcggggacattgcggttcacagtgagaatggcaacggcaaggccgtggtgccacgtagcaatgagcatcacatggcaaatgccgtgctggatatatttgaggagtgcttgcgagaggtgaaggccaatggcattacctacggggctaatgtgaatgggggcagtgaacttgcaaggcgatggagagcacagaggattgatgagcttgatgtgttgagccggaggctaaggttgcttgttgaggatgctgcagcggctggtcgctaagcggacatactggtggttttggtgacgtgcttccgcccttcaccccatgtgtataaaatattaaaatctagattattatgctatatgcttttgtagttcctcactcagcttgggccttgccttagtcagcctaatatgcctattatttatgcctatgtacatcgtctacggatattgccttttagtttaattatttcatcagcataatatatatggttccagcattgttatctatacagctgcctgctgttgcaatcgttttatttttaatttacgtttctgataacttgttcatgtagcttcatccattcaccttcttttgcttccataacttattacttataagctgtgaaataacagaattttgtttccttgtcaaccacttttatcctcttcccttggaaaaaaaccacttttatcaagagttttttcttacccaatcccagtgctatacctataattgcttaagctttctatactaactaagcatgaacaattgacgacattgcatagaaaatgttttatattataaaaatatgctcataatatagctct

SEQ ID NO: 31725 - DNA, 547 bp, Oryza sativa
  unsure (1)..(547): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatgctttctccacagtaaggcgattaactgctgcaagcacccagagatctatcaactgtgcagaccaatcactaccaagatccactacggaatttctatccgtgaactattggcaaatatataatgttttaactcaaaatacagttcacttcaaaatatcctagtcatggaaatattgttggatagtctgcgaggatggcagagcgattattattggcaaaacaaattctattcagcaatattccaaaaaacatctaactcagtaactcacaaacttgttcggattcaggcaagggttatatnnnnnnnnnnnnnnnnnnnnnnnnnnnnnnnnnnnnnn

SEQ ID NO: 31726 - DNA, 606 bp, Oryza sativa
  unsure (1)..(606): unsure at all n locations
nnnnnnnnnnnnnnnnnnnnnnnnnnnnnnnnnnnnttcatttttccatcttgcctgtactgccacatttgtactgatgaacctttattgaaagaaaaacgtgaacagcctgaactaactgaatgttgatagggtgaaatggacgttgtaacaaaatagaagtaaactcacgccactaaatgtacttcgagttgttcagtgctggttgttttgtatatttaatgttactatgcaatctgccttgatttttgttgcatgcagtttgtgagaagcatagtggattgaaagacaacaaccaggaaatttcaatcgggagtgagatacctgagaatgagcagggtgctgtaaaacaagaattgctttgcgtgctgacaaatccgagggggaatgaatttggtattgacaatttagaaggaaatactgagacagttcatcaggctgatctcaataatggatggaattcgatgccagtggaagctggagtgcatgcctctgaaacttcaactgagaacaatgaggagtggattcagccaggtgagctgagccagaaatcgaatctgatgccgatatactctagggagcatgctgatgaagaaattaaagagg

SEQ ID NO: 31727 - DNA, 522 bp, Oryza sativa
cctattgggccactgctctttattttttttcacttttttttctttctattaaagatcttttttttttcttgaggacagatgatgctttggttgtgtggaaagaaaaggatcgatcgatttggagatcgtttttgctactgtttgagtaaatttgtccaaagtcaacggtagatccgtttttttcaatacgtcatgcctgatgcgatattgctaacggatcctctctgcaagggatatttcagtgtgtttgaacgagaccagcacccgtaggccgtagcccgcgactccacgacgtggctttccaaaaatcaaagtgaaatgacttctcaagattgccgtcttgaattcatcggcatattggcaattggcatagcatttcgttcttttttggagaccacgagcacggacaactcgaggtttacgtttggaatgtctcgccgcaacgagatgtgctatttctgttcttgtctaaaatatataggtacctaatatcttggtgctacttctgtctaaaatatatag

SEQ ID NO: 31728 - DNA, 831 bp, Oryza sativa
gccgctcgctccgccgccatcccgctgcgcgcgctgcagcttgctccaccgccgcgccgctgctgctgccgccgccgagccgcgtctcgctgtcgctgccgagccgtgtcgcgccgttgttgctgctgtgccgccgcgccgccgccgacgcaccgtgctgcgttgctgccgctactaccgttgacgcgccgcgtcgcccctgagaaggaagagaggaggaaggagaaaggggaagaagtaagacgaggggaaaatgggtagtttggtccatttttatctggaaatgcatccaaggggtaagtagtggtatcttttgaatatgtgtgaaattataatggcatatttccaaatacatgaatactagtggtatatttcaaaaccataaaaattttaatggcatgtatccaattaacccttatttgaatataggttgtgtttagttcacttcaaacttccaacttttccgtcacatcaaatgtttggacacatgcatggagcattaagtgtagacgaaaaaccaattgcacagtttgcttgtaaattatgataccaatcttttgagcctaattacaccatgatttggcaatgtgacactacagtaagcatttgctaatgatagattaattaggcttaatagatttgtctcgcagtttacaagcggaatctgtaatttgttttgttattagtctatgtttaaatgtgtgtacacatacatcaaaaaaatttggatggggaactaaacacggccatactaccttcgtcttagatataaaaatctaaaatcggatgaaatatattctaatactacaattctggctatgtctttttttt

SEQ ID NO: 31729 - DNA, 2382 bp, Oryza sativa
cggtaccctgaaatttcctggttgttgtctttcaatccactatgcttctcacaaactgcatgcaacaaaaatcattgtttattgcatagtaacattaaatatacaaaacaaccagcactgaacaactcgaagtacatttagtggcgtgagtttacttctattttgttacaacgtccatttcaccctatcaacattcagttagttcaggctgttcacgtttttctttcaataaaggttcatcagtacaaatgtggcagtacaggcaagatggaaaaatgaatgccaactacagtctacagtaccaagcgatgttgcaatagctaaaatttgaaatctaggcatgggtattcaatgaacatccccatcacagtaacatgacaatttgcaagagaaactgcattaaattgtagtatcgaaatggttaacagaactagtatatatgtagtgaaaatggcggtacaattaaaacatatgtggcaaagcaatagcaggtgatatttatagccacagatttggtaaaccggaataccatgaatgcaagtttatcagaggaaagagtgccttacattgttgatgatcagcagctaagctctccgtggtttccccatctatctcgcagctgaatccatcctcaatacaatcctgagagaggactaacgcagtaatttcttcgtcgatcatcttactaaccatatcacccaccttgtcatcatcatcagaggacaccgcggatttatcctcactggtgttagccatgttcttcagcaccacattgcgctgcttcgaagttacatgatccattgcatcattcccttcaccacgggattcatatgatactgcactctttctgacatttgacaaatcagctgattcaagaggcaccagctgcaggacattgccaacaatctcggcacattgagctgccaagccagccatggcgccgatcgggtcctcctccaatggcttctcatcgaagagctcgatcacagggccctcctcggacacgaagaccagatcgcgattgagatttgccatgccggcgtctctcctgtggccacagtccacgtcgcacgccgccggcgcggggaacaagaacggcggcgagatgaagccgctctcgagcgcgacgccgcagcacgcgcatgccaggtcccgctcgccgagctcgctccgcctcatccacgacgacgccgccgccgccgcggaggcggacacgcagtcctcgcacatgtccccggcgtccgcgagccgccggtgcgcgcggcagtagccgaggcgcgacacctcggcggcgtgcgagtcgcacagcacgcggcacaggggctccgcgccggcgccctgcccctcgccgcggggctcgaagaggctgtccacgccgaggcgggagcagagggcgcacgcggcgccaggccgaagaaagcggcgaacctcgatatgaggtaggagaagacgccattggcgagaggagagctatcaggatccactcgaggagcgcgtaggcgagcacccgcgcgacccggttgctcctcttgcacagcgccgcggtgacgacgacggcgcccgccgccatgggcgcctccgagaccatctccccagctctcggtgttctcgccagccagggaacaaaatgcgatcaaaagatgccaaattcgcccgcccagaattcgccgtgtaatcgaagaaaagcacagaaattccttccttttggcgctaaatccctcggcgcccgtcgccaatcggattgaaacaaagcaaagaacacgatccaaccacgatttctcctagaacaacaagccactcccacaaactgccgatttcttctcgttcgatgaagagaaacagcaaataaaaacaaaaaacaaagccttgctcctccacttgctccttctaaaaagctgaacaagaacctcctcaagactatcaatccggattgcaacaaagaagactttttttacagatggaatctgggattgcgaacgagatcagagaacctatagagattgaaatctttgataacgcggggaagaagtgggactagtgacagggacaggatgatatcatctaagtattcacaagaacagtgagaaaagggggagaagaggaggaggaaggaaaggggagtttggtgaaaagctcctctataggcagagaaagccggaagccttggaagcagagaaatatcaccagtgggaaaagaaaaataaaagaaaaacaaagctctgtgtgtgtgtgggtggattggtgagctactaatccgcattattaaagccctaatggggcggaatcaagccgccctagacgagcacacagccgaacgttgggggtgacgccataattagctggtaattgctctggttgggaaaaggttaatgacactctttt

SEQ ID NO: 31730 - DNA, 7045 bp, Oryza sativa
gtgcgacttttggtggtgaggggcgtgcggatcagtggatgggttctgaattctgaaactgtctgaacattccgccagtcttatagatttatcttcagtattgctaaatctctgtcgccacattttgggttcgatttcagtcggatagtctgacccgcatgatgcgcttgcgagcgtcgtgggtgactcacgtccgtagatcacggccggcatgggcagagatatccctcgcttctcttttttagtttaactttttatatatttacacaaatttatacaatagttacattgcacttacacaccacttacatatataattttgtagtttacatatgtaattttaggacttacatatgtaattttgagacttacattataaatgcactaaaattacatatgtactttagagatttacaatgtaaatatatgccgactatttttttttgatgaaaaatatggcgccataaatatagtcactccctttatctttttgtttatgcttcgcttatcagcaaaaaattaaacttcgatcttaaatttaaagaattttggtttttttttcagtcgtagtttattttttttagcattttttttagatcgttaagattatatatatatatattttatttataaaatttttttgtttgtgaatatgtcatttcgcctttttctcaaatcagccaatcgatgtggctgttaagccacgtacatgcatcatgcaagtgtttttggtgggtggattggctgagaactttaggccaagctgaattttgtgctgaaatagcgcaagtgtgcttgaattgaacccactctgaatgataagagttcgtcccggaaagaatgcatgaacattataggatttattagttaattctcaccaaaaccttctgtttcaaagaaggcgttcagccctcaacagctcaatataaaaattttgggttatcaattgatagataatctattttttataactattaaccggtacgaacgaatgaatttaatattaaaaattatatataaaaagcttttgtaaaaaaaaaacatcgcttctaagaggcgtacgaacaaaatccagaatctacaagacatacccttggttaactctccaggtgagcttgcactgaaacgaacaattctcacgcacattcagctcaagcaaaaaatcacacttgggtaatttgggtacaaaggattcaatgttgagtaattcagtgatgagttgcgacaggtcaggtggggcgcgacatttgaatgcattggatcaagcaagcacgtggacgaacggacaaacggaaaatcaaacagtgaagagctggaatcaagtcatctgctgttggcagagacaaaaacagcggggatttcagaacccaagaagctgaactgccctataaaacacacacgtggtagccatttgtgtttgctgcaagttcggcaatctagaggcaagtttggtctgtcttgccgtattgcacgttattttagttacagacgaaaaagaattatttcttgttgcagtttgcagtatatgctatattttaccgtcaaagttttttttttttaactatcactaccaccaccaccattgacatgtgggaccatgaggtacgctacagcagcaccaccattgatatatggggtcatgaggtacactacatgagatcattgtactaagtaacccctaaaaaacaggtggtctacgtttttctttttaatatgaagaatcttatttgaaccaggtagagataagtattccctttttaaccatgagaactacttttttttctatcttctacaatccgttgcaacacacagttatttggctagttcttaaaatatagctaacaaaatgcaccatagagccaaacttgtccattataacttcgtaagtgaaataaaaagggcatatttatgccaaaatatgtcattttgtacatccaaacagtcttcagaatatattccgagcactggttctactataagatattagaaaaaaacatataaaattatagtataatattataaaacacttatataaattttacacataagatgcatttaatcaaaacatttagaaagatattgattctaaaaaaattaaaaataatgatttcaaatatgccccaaatcatatatttttataactgataagcatcttacgatagtaaatccatacgataaaatgtcccgctacaattggcatgtggggagcttcctgtaatttattttaaaatcaaaagcttcctcaaacaacataatccaaaaaaaaaaacgaaggcaaaagcttgtttttttagcttctccaaattccagcccaccagttgcttgttataatctaaatttaaagctcttctaactggcccaatatcttgatgccagccattcctctgacatcatcataagtgagtgaatgggaatgttaatagagaattggtctaatgctatgccattaataaaatggatatttatctaaagaaataaaatggatattgagggcccctagtatcttttgctttcggctactcatccatcggtgacaattgacgagcgcctaagtgtggctttatctgtagctttccagcgtccagctctctaaagctcatctttactttgctcgcacgtacgtattcccaataatttttttttaaaaaaaaactattaggcgtaacagggaccaaaaagaatccgcattcagattaatttagtatccctggaatttttctgtacttttcaaaacaggatgactcgagaaaaaaatatcacttcatcgaagatgtcgtgatggtgcatcattacaatgttagtgcacgcacgtgtaaagcttggaaaaaaatattaatgctactagtattattggaaacaggaaatgtacatctagaatcatgtcaggggatggtgagagtgtctgttttgttgtccaattcaacaaataacttaaaattatcagtgccaaaaaaagaaaagataattttgtttgcctataccctttcaaaatagagaagcaaatcaaacaaccataattcactaaagtttaatgagtcaatgacccaaccaaatccaatatcttcagctccagcactccagcatcaactggctttgtgatgtttataaaaggaataattaatgctagtattactgaaaacaagaaatatgtacacctagaatcatgtaaagggataatgagagtgtttgttttgttgaccaattaaactataatttagaattaacaatgccgaaaaaaactagatacttacatatcttggttgcctgtacatttccaaaactgatagcaaatcaaataaccataattaactaaaatttaatgagtcaatgacccagccaaaccaatatgtccagctccagcactccagtatcaactggatttgtgatgttcatttgttagaacttagagctaaaatcacattatttgttgaacacaatataatggttcaacacaatcaacaactaaaacaaaacggttttcttagaggaccaagtaaaatggtgaccgcagagcgagcagaacagcccagagcccactagacaaacgatttggacaaacaaattgaccatatcataggtttggatgcaaccggaccgactaccaaggacaaaaacaacggtcaagcacagaagggtagtactattaggattttaaatgagcaaataccaataaaagaggttttaacataggaataaagagtggccaatttcaggatctgatgtaattgtgcatctagtttactagttgtaaatttcattgtcagatgaaattatctatgtcactcagcatagttttttttttccaacatgtgggtcttccgccaccctcttcctccctggtgtcgcctctagcatctatggaaccgccatgccatatttaatcccctatgccgctctctcctcctcataacccaaatgtatcaccactttatcttatctgattccgatacttcaatttcaataacgagtttcactagttgccaacaccaccccaccgcccctcctcctttgccacggctaacgaggtaccaccgtaccacggccgcctcgcagctctgctatggccacctgccatccccctccccctttgcctgacctcaaaacctaacacttgagagctcaaactattacgactaaaaaaaagtgagatttgaagggagagacatccctccaaatatttttttaagaagaaaatgtgagtgcgtcgggattgaacacaagaccttagggttgaaaaccacacacctcttatcacccgcactattaaatgcatctaaaactactattccatctgtcccaaaaaaggtgaatctaagactggatgtggcatattctagtacaacgaatttggacagatgtatgttcagattcatcgtattaggaggtgtcacatccggtactaggtaggtttttttatgggacgaagagagtacgactgaagcatgaatcaaagaataaggggatgtttggttgatgcctaaccttgccataactaagtttaggcatggtggcacaaatgtggcttagaaatagttagccacaagtgtggcatacttagctctaaatttgagagcatgacatgtgggtcccaaagttaagaaagtgtggcataacacaattgcggcagcgaaccaaacacatgcctaaaaaactgtagcatgactaaagtgtggcgtggcaaagtgtggtaaccaaccaaacagcccctaaatcgcaaggttaacgatttcatgtggttttgcccaaaaatgtctgtcgaagcgatgtagagcatttccgatattagatctatcgttgttgtacgccagtttcaggatacatgtattgtgtgacttgtgtccaagtattcactcccaaaaatgaagacaagatttcctaggtaccgagaaataatgctaccaagttatagttcacagcagccgcacacctgacaactcaaaggtaatccatggaatcttcatcgcaccatgacaaattgacagttgacaaaaaatgagatgatctggcaaccttctgccgtatgagaccatttgcattatgcagttctgctcaagatgcaacaaagttacaacaggacattagtggacaatttcataactgggattgacacgcggagatcatttcaaattattctcgaaatgcacggactgcaaatcattttacatttgctacggtcaaacgtataccgaaccttacaggttttgactaacttcagtcatcactgccactcaaacgtatactcgattgatctgtttctttctgttgtcacaggacgggggaaaaacagattaaaactgcaaatggtgcatctttttatctttttgaacacatagcggttctcttatctgagtacatatgtcatgcttgaaattgtaactgtcgttcaagacctttggtcgattgcatggtgtgctgagaccactggaaaccaacagtacttacacaggaaaatacaccagttaggaaccataaaaaatatgaataatacatagtgcaaacaaaaacacattcgattgagagttgagaacatggatgtcccgaccttttgccaggtcaacaggacatttaaagtaaaccactgttcccaatatctcataataactgtacatgagccacaaatctgcctgccaaaaaaaaaaggctgcatggagcaccatcttactgaaaaatcaattcacttgcaaaacattacattaagcatgcacactgatatttagaatggcatgcttgtgtttagcacaaaaacatggaagagaagacagtcctctgacaaggggcctaacggagtgaaaacaaaagaggactgcattgctacacatcctgaaatggcacgcaaatgagatatgaagcttcatataagctaaccatgccaagcttcaattcaaaatagatacttcaaaagcatatcaatttagggactgtaatcagttatcatgagaaggcattctgatgttagtcaaactgggataccaaggcaccaattctacacattatcttcaatctgtgcaaagcaggtaatctgttggccctaatgctttctccacagtaaggcgattaactgctgcaagcacccagagatctatcaactgtgcagaccaatcactaccaagatccactacggaatttctatccgtgaactattggcaaatatataatgttttaactcaaaatacagttcacttcaaaatatcctagtcatggaaatattgttggatagtctgcgaggatggcagagcgattattattggcaaaacaaattctattcagcaatattccaaaaaacatctaactcagtaactcacaaacttgttcggattcaggcaagggttatatgcctctctaccctgttctccacttctcctcttggctctttcactagtataaatgtataatcaatgcaaaaccgtaaaaggcaactggtttaaaatggtcatctgatcgatgtcttaaagaatcaattagactcagcttacagaatgagctagaaaagaaacttttgactgctcctatcagtaccaaaacagaacaatatcattacttcatatgacaaccaaatgaaatgcagagacttcatactaactactcccaaatttctcacactcgtagagctatattatgagcatatttttataatataaaacattttctatgcaatgtcgtcaattgttcatgcttagttagtatagaaagcttaagcaattataggtatagcactgggattgggtaagaaaaaactcttgataaaagtggtttttttccaagggaagaggataaaagtggttgacaaggaaacaaaattctgttatttcacagcttataagtaataagttatggaagcaaaagaaggtgaatggatgaagctacatgaacaagttatcagaaacgtaaattaaaaataaaacgattgcaacagcaggcagctgtatagataacaatgctggaaccatatatattatgctgatgaaataattaaactaaaggggaatatccgtagacgatgtacataggcataaataataggcatattaggctgactaaggcaagg

SEQ ID NO: 31731 - DNA, 21154 bp, Oryza sativa
cggacgctaaacgagaccgcgacatttttaaacccttaaaccctaatcccctcctcgctcccgcctccatccctgctcacctgattccccgacaccatcgcacccagccgcatggcctcctcctccaagctcctagccctcaccctcacctcctccttcctccgctcctccctcctgcccgccccgtcccgccgcctccccaccggcccactcctctccctccgcttctgctccgccgcgggggatgtcgccgacgctcctgccgccgccgcagcaccagatcatccgtggcccgagtggggcgatttcctcgagaagcttcgggccaaggggtacttcgagcagcccaccctcgcgtctcgcgctgatgctgcggagggggaggtggctgcgaccgccgcggcggcggcggcggcggcgggggaggaccctggggcctcggccgacaattacccatccaaggacctgaacaggttgaagaacgcatgcctcaagttcggccgagagcgcttcgatctcctcaggttatttgcccgtgagatggatgccttgcaatttattatcgcctcggttctgtgcatgaactgggctttaattagtttaatactttgcttagtgggtgaggtttttgcgttagtcacgcacttgaaattgttgcggaaatgatcatgtctggtagaaaagcagtaagattcggtaacttggacattcgtgagctgagagtagtcaattgttctccctaatcccaatgtcccgagaatcccattagcatggcatgcagtgttgatttttctgtgtctacattttggttagtaagctaaatggtttgttttgcctttctcctctatgattattgtgcatgtttggtaagaacttgtcgatgatcacgtccctaagcatgaactcatttcatagtgctattttattaaatacaaaatacattttatccagagaagctataatataaatgaaagctggagtcatgtgtgtcagtggtataactgattctttggactgtttgtgcccactacttttgcaagtactcatttctttctatgttggttggatcttaatttgactggattattgggccagtgtccttcccaagcaggatatccgtgctattgttgagtgtggctgtcctaacatcttccggaagcctgtgaattctgcaaaaagactcagagagtttcttcagattgatgaaggagatgtaagttaattgttctgttctgaacatactgtattgccgttcttcctgtagtggactcttgatttttttcacaactgtcacatttctccctgcgatggacttttgacttttcctctatgcgtaacgtgctgcttccttttctcataatttactttgactttgcaaaaaacattcacaatattttgtgctttatacaggcctgtagtgcttgcaaattacgtggatcttgtgataaagcctatgtcattccgaacgctgaagacgaagctcgtactgtcgatgttatgcgcatactgctaaattatgcaatagatccaaccagcctttcaggagaaaactctgttaatggtggtgttcaagaatctgcgagaaagcttctttcagagcttactatgcttagcgacacaacaattgatccatcaattcctaaacctgtattccaaacttctagcaagaccaaaacttttgacaagggcattgcaaagcctaagttctcagctggaaagggtagggaaacaactgaaacagaaatgaagaagggtgattggctttgcccaaagtaagtcttttatggtatagtactatagtaactgggtgttatgcttccatgcctattgttatgaacctttattttatgagtaaattccagaaaaccttacggtttatggtcaaagttgcagaaaaccacaggtgctatgatttgtgacacttaaccacaggtcttatggtcaatgtttcataaaaccccaccttattcaaatcttgattagtttcagcatgtttgaaacatttttttcaatgtagcgaagagttaaactatcagccttagtcaagaacttaataattaaaattttcatatgcaccatgttttagaattttaagtaaatttgtgctcaacatacataggtcataggggtgaggatttgtgaaactttagaaccataatacctgagattatgtgtcaccagtcataatacctagggttttatgcaactttgaccataaaacatggggtttcctgaaatttactcttactttatttatatttaactgtcagattacaccgatacattatcatatgaaatatgtgaggggctaagggcataaattggccttttgatgatcccctcaggtagtttataaaaccaggaatcaataccattgttagcaccagttatttctgaccaggtttatcacattctgatgaattgctttacttttagtgcttgccacaagtaaaacaccatgagtttttagcttttcatcatgttgcagaagggcatctttgactaccattttggatttcattcttattcccatttgaatgctgttaactaattcatctaataagccatgccatgacattggtttgtatgcctgtttgtaccatagaaatgttgctaatcataatataatgttatgactacacttacaaaaacgatactaacctctgtcccaaaatgtaagggattttggcaatgtaaatgcatagctttcccttatatttttgggacggaggtagtacaactcctacatggttctgtttattgagtattgtactatttgatagctaagattttctttggacttagcttctctcaagttattaagctttctgaatttttgtttgagctgtgctgtatgtgtttgattcttgcgtaagctgcgagtgtattctactgtagaatgagaaaaaaaatagtgctaatagacttggtccaatatgcctggccgcttggcaataccatcaagatgtcactgtataatgctgtagcatatgttatctactgttctgtgttaggcattgggccaggaggccacggccgatgaccaggcccaaggagagccctcttcagatgacgtgaacagtacccgcaaggtactgtagcagctgttagagttagttgcttggagataagattagataggattaggtgccagcctatataagggctaagtcttttggaattgagttttataaagaaggttaaactctagtttccctcaagttctctccaacctataatctcctctcatcccaatcaatccgatgccattcggctatcttcccggtggtatttacccaatgaaatcccagcccacaacattctgcattattagcttgaagactatttgtttgtgcagaaacagcctatgtaaatttgaaccagatccagaagtactgattatttaaagtaaggcatgcttggaagtacacgtttgaaaattcatatctaatgttgtgatatgattacctgtttcctactttgtccacaatgctctgattattacaaggtggatactaggagtagaaagaaccatttcatactaatctaggagccttattcccgatgttgtagttaaacctataggattcattgtatgcttggttgtaacagtttctcaatgagtgaatccagataatctgggtttcggcttgtagtcgctctttggtactccctccgtcttaaaatatagcaatctagtactggattagacacaacctagtacacgaatctagacctccctatccaaattcatagtacttggtttctatattttgggatggagggagtacatttatagtgtaaatatgtctttgcttcaacaaagaaaattgcacggtacttaaagtaagtattgagttaaatggttggacaagaaacctctagtattactatggactttacaatatttgtaatgttctttgtggatcatagaggcacacctcttagatgatatcaggttatggttaactatggtgttagaagattatgatattatggtggcctcttttatcgtttacttcactgttattatttttattccccatccacagtgtgtgtgcgtgggcgtgtgtgtgtgtgtgtgctggactgttgatgcctggttatgccttgtgaatgaccctgtcctaacatcctctcattttggcagttgcaacttcttaaattttgctcgaaatcggcactgccttgaatgcaaagcagatggaccaaagaagatagaaacagctaccactgaaatgaaaacgggagactggatctgtccacagtaaccatcgaatgccatatttgttttcttgtactgttcaacattattatatatttgccttgataacttatttatttttgtttcaggtgccacttcatgaactttgcacggaataagatgtgttttaaatgtgaagaatctcgaccaaagaggcagctcatccctggagaatgggagtgcccctcgtatgttatacgactacctcaatctttcttactgttcatctcctcaacacgctaactagacatcatctcctcctatagatgcagctttgtgaactttcgacgcaacaaggtctgcttgaagtgcaagcatgaaggccccgaaaatgatacccatgacagccagcacggacacaataggtggaggaacacgagaggggctgacagaagtagaagttttgatgactctttcgatcgggaggacgatggctctgatccagacgaaggcgagcgcagacgtgccaaagtgcgcactagggcagcatcaaccctggggagatccactggcaagagcaaaatttttgactcgattcatgaggatggtaacggtagggaggatgacagcgaggatgtcctgccgtacgaagggcagcgcaggcatattgtgagcaaaagggcgacaccagcacagaggagattcactgctggtagaagcgaggatatttgatagtctgatagatatatataacttcgatatttttccatgtagcgtatagtttcattatgtactgtgtactatttactcgagcactttatggttagactagcttggttgtaattcatactgcttagttccaaataagttcattttttatcaatcccataaataccactacaaaacaaaaaaaaaactagaatacttctactttatcaaatcttaatgtaattatttcggattttggagctgttcagattgtagccaaaataaaccttattgaattttggcaatttggcaatattgccaaaattttagcagaatttcttatgtatttactaaaatttggtaaaaaaactaaatggatgcacatatttgacaactctaccaaaaaaatagtatggtttgaaatgacatcaatctgaacgagccttttatctacttctaatacagtatgttctactttcacaaacttcaatacaatgattactctaaaattaaatttattttgggacaaatggaaagagctaaaaataaacttactatggagtatggatggagcaagtcattttgatctccatatgctccgctgttgacatctaataaacatattggatgttacctgtagttcaggtctgcaggcaaacaagatttgagtacaagatttttttattttttcacgtcttgacaagttttgtttgtcgttgatgctgtttgtcgacgactccaatgactgccaatctgcctttagcaaatcttggtcgttctaccaaacgttttggactatatggtgtactccgtaactggcgaagttgacgatactctttcacacttgtctttcactagagcgtttgatgttggaatggacgctcaaataggacggaaaataatataaaaaaacgtactgcattgacgttgttaatcatttcccatcgcaggacaagacatgataaacttataaagaaatttacaactgcacttaacactgatgatgtggtgaaaggtaaatcttaacagtacaacccctctacaaaggaagtagagtagaaaggaacagggaagactgcaaattcatctccatgtagtcgtatttttaagatggaactacaaccagccttattaacaccaaaggaaaaacagagactaaaatctagctgactgaagtcacaagacctatacgcctataggcaacatcacaagtcgcaacggaagctctcagctggtcagctcatggatcaactgaagagctcagatggattccctcaggaccaggttgatgccgaacgaagccgtgcagatgatcaacccaaagatcgccaagaagttcagccccctgaagcatttgccaaaaaattaatccgaccaggttagaaccactatgatcgatcagaaaccaagatatgagatggttgacaaagtgataggtgtgccatttggtgcaaattcagatgaaacttcagttcaagtgatcctttctttgctactcaatgcaaaggacaccgatagactagactatcataactgtggtgattggtgcagggttgcaatctgcattacccactgacgtacgagtcaacccataattaatagcgatttagcaacgactcgagcagtctgaagtctgaagtctgaagtctggacacaccttatatatacctcttgaaatgagtaatgaaatactaaatatgtaaactttggaagtttcatcaacgtcgtgccaacaagtagctgcgatctttgacagattataaaatgaagagatggggacatttgcacgatccgtaccatgttgaatagtatactgtatgatccacttcaaagctactccacgttgtcacccactcctcaatcttgacatatcaccaattaaacacgcacctttgacatttttctttggtgtactacacctactgtatcctccacttaattgagcattgaccacctaccccacttaataccatcagtacttggggaaccattcataaatgaagtcaaagttcagacttcagagtgttggctgattggttattgctacccaagaaacgaacaggactagcattctagaaatcaaggttaagtttgaactagctatgcatacgaatcatctttcgttagagcgacagtttaattaccagcacagcacacagaataaatctccagtaggaaaattcgcaaaaagaaacgtacccaatcttgaggcggttgtccgggatgccggtggcgtagcccttgaagtagaagaacctcgcgacggcgtagaacaccccgagccccgcggcgacgagcgggtgctgcagcccgccgaccagcagcgtgacgaagaacagcggcatcatctccagcgagttctggtgcccccgctgcacacaccaccaaaattctcatcggtcagaagaacggatcgaggagcaatctcggggttgggtggggcgacagactgacagacctgcacgcagttgaagagcttggcgtccttgttctccgactcgaccgcgtacatggtggggtagaacaccttgtacctgatggcagcagcatcagccaagaacattcagagaaaatcccaatcgaaaattctctccaaatcaagacgagcgagagcaatgaaccaaatctgggaggggcgtagactcactttctgcgggccttgccgacctggaagctcatccagaagttgaggaacgcgtaggcgaccagcgccagcaccacgtacccgtattccttggtcagctcgatcgacaccgccatggccgtcaaattgttgcgatttcttcttcttctcgagagggaatggagattggagaggaggaggggattgtttgtttatggattataatgggtttttggatttggatttggaggctgtgcggcgtggatgcctatcttatacgggcagcgggtgcgtctagaaggttccagaatcttgttctgtgcctgccctccggcccaagaaagctctgaccaattccttggacctattgggccactgctctttattttttttcacttttttttctttctattaaagatcttttttttttcatgaggacagatgatgctttggttgtgtggaaagaaaaggatcgatcgatttggagatcgtttttgctactgtttgagtaaattttgtccaaagtcaacggtagatccgtttttttcaatacgtcatgcctgatgcgatattgctaacggatcctctctgcaagggatatttcagtgtgtttgaacgagaccagcacccgtaggccgtagcccgcgactccacgacgtggctttccaaaaatcaaagtgaaatgacttctcaagattgccgtcttgaattcatcggcatattggcaattggcatagcatttcgttcttttttggagaccacgagcacggacaactcgaggtttacgtttggaatgtctcgccgcaacgagatgtgctatttctgttcttgttctaaaatatatagttacctaatatcttgttgctacttctgttctaaaatatatagttacataatattgatcgataaggatttgtatatattcataataataagatatgtcacatttgatactaagttgctatatttttaaacagaggtagtaaattatttccatttatttagcagagggagagagtaatagagcctgagattacagatcagaagagcatgcagacgcatagaagctttggaattaataaggtgagtttttctctgatgagttcttcagaaaagataaaagcttgcctgctatatttctgattcatcgattaccagatcaatccatatttcgaaactatatatatgatgaaacagtatagttagtacatcattttcaagtttacgagatagactcgctaatttcgtgcctgcgtcatggctgatcgatgtgtgcttacggtaagacaatggttgttaagtcttccattggtctctcaaaatgtattttccacgcgcagctggtagagcagctagagttattaacaaccaaaccatggtcaatttgatcgtactcttgcagcacaagtcgcaaagagttctgtatgacttaaattttaaattcagaaaagcccaagccagtgtaccaaatgtctactctacatgatgccaaagaaattgacgggacgtcaacagaagatttggatcagatttagtaccaactaatcggctggttagtcatgtgacttacaattattatatctccatgttcagatcatcaaagtcctaagaacattcgtcagtgcgcaatgtccggtgttgcggtgttccctaatcggtaatcggcgttgcgctaacaaaatcaccatatactactccctccgttccataaaatagagaattttaagtttttgcttgcactgtttgaccactcgtcttattcaaaaagtttgtgcaaatataaaaacaaaaaattatgtttaaagtaatttggataataaagtaagtaaaaaaaaataattccaatttttttttgaataagacgagttgtcaaatagtacaaacaaaaactcaaaatcccttatattatgggacggagggagtaatagataacactaaggctgtgtttagttccacactaaaattgaaagtttgaagaaattaaaacaatgtgacagaaaaattgaaagtttacgtgtaggaaagttaaagttaaaagtttgaagaaaaaaatggaatctaaacatagcctaactgctatcttcgctaaagaatttgcagtagatatcatcatcagtggcaaagacagggacttctcttcagatttcagaacaaacgcatcttgtcagcgtcaacaatgcacacacaattggcaaaccgagtcgtgtcacaccggcatagaacagctagagaatcctctaatcaatcatccaaaatgctaaaaactgagaacgaaccggatggaacaagatagagagagtgtgacatttcacagcattttcgctcgatcgagacgtacgaaacagtcttgacatgtttctccctcagtcacacggcggtgacgaccatcttcatgccgaggttgcagtggccgtagcgggtgcagacgaagaagttgtcccccctggcgagcctgacgctgtcggagccggaggtgtagtacctcgagaacggcggcgggttgcagtcggcgtacccgtcttcgtcgacggccaccacgttgtgcatccacggcaagtacctgaacactgccatgtccgcaaaacggtttcagttacagctggctttgtctgatcgatgagaaaaatgttcagagattgatcgaaatgttcagagataagtactcctatgatttaccgaggatgtcgccggcgtggaacttcttgccgctgggccagctcccgctgccgagggaccagccgaggctgtcgccgacgtagtaggtggcggcgtcggcgacgccgcagccggagaggaagatgcagctcacgacgacggcgagaaacgcgacggcgacggcgcctcgcattgcactgcctcttccccgagccatcgatgccactatctcactggtcactcactcactcactgactgcaaccactacactggttgggtcttgagctcttggcctgatgcttctgcctggaaactgggcaaaggaagagaaatctctgcactagctggggcctggaggtaacgatgccattgccgttgccattctatagtgagctgaagtactcctacggaggctggagtgcagtgtcagtgtgtagctggaggctggctggttgccaatgccgggggagaaccaatgccaagtctggatttctgataatcaatgctgtgcagagagggcaagcagcggtgacagaagactgtaaaaagtgtagcagtaaatgtgtatagcttcaatgccgagcataggacacgggcccgtgatcacatgactcacgagttttcacagtcacagctgcagggctatcgggttgtagtccatcgcattgggtgctacggccgcgcagcgctacgagtaaagaagaaagagcaaatcttttcttgttgtcttcaagaaatatatccagtcgccggctcgccgccggccgacggatccgccggaagggcaccatggcaacagccgagcaacaatttgtcatcgcctactattccgtaccggcccgctacagaaacgggccgtgccgaatggcggcccaagcacggcacggcccacgagctcccgtgcccgtgcagtgctgggctgggccgttgggccgtatcctggcccattttgccaccaggatccctagttctctagtccctagtccctactagtggactggaccgtaatttttcagataggtccttgatccaacggctgaaatatgcaaacaggtccctgtggtcggtggtgtgggagtccgacgctctcccagctctccgcgcccctcgccgccggcggccgtttgccgtcgcggatgagatcgccatcggtttccctctccaaatcaagccccaatgccgccttattcttcatgcctaacgcagcccagctcagctacgcccggcacgcaggccactacgattcctcgttgacgacgccctcccttccccttcacgcgtcggcggcccagatccgggcgagtcctcatcgtggcgggcaaggggattcaaaggaaaatttgtaagaggttggagttcttgctagctttaatctaaaatctttataggattgtccatttcagaggagttgataggattcgatctttttctttcaaaggctcacagagaagttttttctatggagctgaaattcttatgttttgttttaagtcaaacggggccttaaaaaaacaacacaccaccctggtaaaaagaacagcacctggatcaacctgacaatgagtcaatgactcaggataaaataagccgatcagctgtaggaatttggactggagtggatgggtacgacttatctgatggtgaaattttcctttttctaaagaagatgggtagcgtacatggtgatggtacaaaaaattacccaaaaaaattatgccttctgaaaaggatccttgaaaacctccatggaaatacgatggatgctgctgcttcatacctcggacaaccaaaggggagaggagtagcaggctagcagccatggcagaaggtgcttttctttctagcctcgttgaccgtctaagcaccacagccttgtcggggatcacctcgttgtggggcgtgaaggagcaggtggattcactgattcacgagctccaggcagtggaatgcttcctcaaggatgccgacctgagggagatccgtcggcaagccacatccaacaacaactggttctggttacactccctcagagatgccgcctacgacgccgaggacctcatcgagagcgtggagctccatgaggggaggtatcacactctgaaccctctcctccagcccttgaactcttacagatttgccaagcaaatcaacgagatcaaatccagattccaatcgatcatagatggttgggccaagaatgcttccatgttacgtgagctaagggatatgagcagcagcagcagtagtgtcacgtctgctgccgattccttgtggaggcgttcttcttgccacctcggcgacgacgtcgttgttggtcgggaggaggaggccggcatgatcatcgatagattgctgcgctgcacagcacaccgtgaagtggttgggatagtggggatgggaggggtcggaaaaaccacacttgcatctctggtttacaataaggtttctgcaatccaaacagggggcacctcattgcgtcctgattcaccgaaaggaacgagctctcgaagtagtgtggagatgtattttgatgcttgtgcttgggttccagttgggcagaacgcagatgctttaggcctcttgaagatcacatcagctcaaattggggttgagttgaactcgacacaggtagctgcagccaaaaatgccatgttcaggtttctgcagcataagaaatacttgattgtactagatgacatatggacgacagaaacttggcttgaattaagcgaagctttccccaaatctacgaatggaagcaaaatcttgctgaccactcgctccaaggaaattgcggtttctgctgacccatcttcccttccctatgagctagatccactgagtgaagaattgagctttcagctattcattaccaaagtttttgggttgaatcatgttgacacaacaagttgtccaccacagctcaaggatgtagggcaccaactttcgaagaaatgcggagggttgcctcttgctcttgtggtattgggaggactattatctgggaaggaaaagcaattcgaagtttggaggaatatattgaagagcatgaagtggagcaactacgaagctgggaatcagtgcttggagatactggccttaagctacagctgcttgccttatcatatgaagctgtgtttcatgtatctaggtgctttcaaagaagaaactgaaatcagtgtctctaaactgataaaactatggatcggagatgactttatacctcagcaagatggaaaaacaagagaggaaacagcaaatgactatttacgcgaactcatacaaaggtgcctagttcaacctttgttgcctgcgcataagcagggtttcaaaagggtccgcattcatggcctattatgtgagctagcaagatcagaagcaagagagagtcgattcttttattgtgaaaatggtgatgcagtctcaagagcagaaggaaaatactatcgtcgtctcgctctccataccaaacttattgcatttcatgaactaagtaacagtgagaagctaagatctctgctaatatttccaggagtaattgaatcttgtgtgattactgttggtcatcaagcattaaggccttttagcagggcattttgtcacgctttctttttgtttcctctgtggggtttccagcacaacatcttggaacagttaacaagcatgcaatacataagagttcttgaacttgaaggacacgagagattggcatgtgatcttaaaagtgtccaaagtaatctgaaccatttgagatacatgagcctgagaaatactaatcttggtgaatttccatttccggaaagcaattttccgttgctacaaacacttgatataagggggacgtttattagaaagcttccaggtatattggagagccttgatactcttcggcacatctacctgaattggagggtatctcttgacataagacgccttaccaatttacaaacattacatggagtcataattctccccaattcacaagctgaaaggaacttaatggcattaacaaatctgaggaaactacgttttaggacctggcggggagttgaatacagaccagagtccccaaatgggtttgatattgatcggtacaatgcacaatcgagtatggggaatgaaaaccacgcactagccgaatctctgaggcagctagggaatctccattcaatatttataatgatgccgtttgcctcatttcaaccaattacttcagatatagttcaagcagtgacgagccatgagcaacttcataagctaaaactacaaggaagagtacatcgcaatctcctgctagaagatccacatttcagttgcatcaaaagcatcacattatctggctcgtggattgttttgagcccgatggaatcactaggctcactcacaactctttatgaactcaagctaaaggatgacgcgctccggtgctcagaggtctcatgtttacaaaacagtttccctgagctgcggtacctgaaaatcagtggactaaagaagcttagggtgttccatgtggggaatggctcatttccgaatctcacccgcttctccatccacgactgtacagaattccttagcacggttgaggttatggagcatgctacaagactgcaagttctgaaaattaaggaaatgccgtcagtcctgcctgatgttacagatttttgccacagcagaaacatcaaccttatcagctgatctggcatcaaagttatgtatagttgacaccattactgcaaacaccgtttatttttttatctcgttcctttttagtaaaattcagctcaggttcttctgagttctgatggcaagaaaaaagaaggcttagctgatctgatgacaagaaaccatacaacgttccaggagaacatgatccaaagccaggagtccagcacatgatagctgtttaatttctttgcttgagctcaatgtaacccaattgtacatggaaaaagagtaatgctagatatttggtgtaaactttgcaatattattgtctactaattattctctggagatagatgatgtcagtaaactgtagtagaattggtgatgagaagtgagagttgtacagttaagtgttgtggccacatgtttttcaggagttcagaaatgaactggtataccgaattggttcagaagttcccactgccgtcttgaataacagaaattgcatacttcacactatgagactcgagaacaaaggcttcattactagaaggcctagcgaatgaatagtaaaaaaaaatgtttcattactagaaggcttactagagcacacccgcgcacactgtagatcgtagtaaaacatacaagtattgtcatcaagcatttgcctgtaatttctaatgcttcgatctacaatgtctggcagagtttgcaagtagtcaatggacttgggttacactaggcctgaactgaacttgtagctatgaaatctgaattctttccagccagaacgagcataactataaaatagaaattgtttgttcttgtgtgaataaaattgctgttattcaagacggcagtgcgagcttctcaatgttgaaactaaacatttgactgttattagcttctgcaccaattagttataccagttcactgaacttcttctctcaactgccacagacgaatgtaggatggtacaaacatgcatgaaccatcgcattcacacaaagcaattttcagaaccttgtactacatatatacggctgggccagaacgcagctgtttggcttttattaaattcttctcaaaatacacatcacataaatcatatattcctctctatacttgccaacaatcaactaacctgcaacaaagcagaggcctaaacacgaagacggtcattcagcaacgtaggacactgacagaattattggatctacttcccggatatttagagattgccactactacattcgatcccgccggactccggcgaccggccggccgatcaggcggcggtgacggcgatcttcatgccggcctggcagtggccggggaagctgcagatgaagtagttggtgccgcgcgccagggtgacgcggtcgctgcccgacttgtacaccttggcacccctcggcgcgctgcacgacttgtaccccgccgcgttcaccgccaccacgttgtgcgccgacgggctgtacttgaacactgcaacacgcatggatacgcacaacattcgtcacattgatgagatcatgagagcgatgcgagatatatgcaatcgtgtcaagattattatctcccgattaacatttgattagcagtaatcatcgatctacagcctaatcacatttgggtattcaggcatgtaaaaaattcctcaagttcgttatgtgaggacactttgggcattcagaaaaaaatggatcggggtaacgacgatggtatatttttctaggataaaggttcgtcaatggcaaaacatcgaacatggcatttgtctgtggccgtgtgcttacaaggggaaaaatacaatgctctgttgcagcctgtagaggcagttttgtgcacgtcacacacagtagacgccgaactcgtcaagcgaaagagatatttacaaaaaccatccataagtcacttaaaacttaacatttcacattataagttattttattaaatacgcattgactactcaattttgttctaaagaccatcccactgcacacatgtttaaccatatcaatatatttttataaattgtgagccgtcaatacgatctttattgaatttaaatacttataggagtatagtcttgacctttttttagagattctacattgaaatatgaataataagtctaatgcaagtacttatccaagattggcttagctagcttaacctttgatggttctacatcagtgatacggggccctttcagttcagtaagtgcacattagtgttttttacaataatttctaggggtgaacagttgcaactaaataatttatggggcggctttctgtaaatttcccccaaaataaaagttgggatagtcgctagtgccaagcaaagcaaccagccaaccatatgcacacgccgagccgcgagtggttgctcgatcgaccaggtccaggtgcaatgcaatcggtcagttggtgactcattcatgagccgcagtgcagtagtcgtacgtgtgtcacgtaaacagttaggtagcgcaccacttacgcgccgcgctagttggcgacacgaaaacggtttaaaaaaagagaaagcgttcaaacgacacgatcgacgagaaactgaatcgatcgatcgaactcaccgagcacgtcgccggcgcggaagcgcttgcccctgagccagccgccggagttgaagccccagccgccgcggtcgccgacggtgtacacggccgactcggcgagctcgccgtggaggagcacgcagaggaggaccatcgccagcacggcggcgttgcgtcgtcctgcagcactgccccttccctgagccatcgccagtagctgatcgctttgcaacaattgactgaccgtttactactgatctcagctagggggtgcaagtagtgctgagcgagtgagtgtgaggcgagtggtggtagtgcccaagttctggcgacgcgagcttccctttataggggagtagtacaccccacccacccaccgatagccatcactgaacacacacttactcctacatgccatgaaataaataggaaattgattaattaaccaaaattagagcttgtggctgtcaattgtacatatgtgtgaaaactgtgaaactgagctcagcgaccgcgtgggaattgggaatgataggatctgcgacgcgccggcgacacagtgcaactagcgagctagcctggcagctgggaggaaaccacgacttagtgggagtgaattttaatccctcgaagagatattcctgtgtttttttcctttcaaattcgatacaaatagttaaaaaaaattataaaaaattgataatataaagtatatagtaaaatcgataggtaataaaaattaagtttaaatactcggctttagtgaaaaattcagatgtgatccgtataatactattcatatgctgatatttttatatctcgatatatgagttgagtttgaacttaatattttgtggggttatatagatatgttgtataagtgttattaaatttttccacaattttttatactccctccattccattatataaggcgcaactattttttttaaatgtttcataatataattaaggaatacatgaatacatgccattaactagcattttctttcgaatcctccatactcaatatatttaattctattggttgcatgagtgatccaaactatgagatgataataattatttcttggtctttagattaagagtggttgagccttttactccctccgtactcataaaggaagtcgttttggacagcgacacggtctctaaaatacaactttgacttcttatttctataaaaatatttattgaaaagtgatatatgtatacttttatgaaagtatttttcaagacaaatctattcatataatttttaaattttcaaactcaacaatttaagagttattcatgatttatatttccaaggtttgacttaaacattgtcctaaacgactatctttattaatacggtgggagtattttggaatggaggaagtaactatttaaataatttttaagcaaatgagggatatcccatcgagtgatcaaaatagtttcccgaactttggtagaccaaccacccacatggcggcaccgagaagtggacataacttttggactaataaaccacgaaagttgagcgcaagctggtcaagggccgatcgagaggaaaaacgacgagcaaaacaccgctgcgatgggaaaacgaagagacgacggtgcggggttggggcaattgagggtacgagtacgacgactaatttgtactacgtacgacgccggtcgcctcgctgtctcccggatgttgtctggtacgtttccattttggtagagacctcgtcgtagccagttaggtcaagtcggttcgctttgactttgtgggacagtcctgcttggttagactgtcagtgcgtggtcagcttacgtacgcgttgggctgcaaggtttgtgaactgaaaattgctcttatacctaaagtttagttaagggtgtgtttaagaggtgtgctcgcatttgtcccaaagtttggctttgtaaatactaaaattgtcccctagcttatgtgtctgcttctgtttaggactagtcgataaatcttcttctaaaaagttattaaacataaatacaatataattataattatagtgtaattatattttttaaactttatataactacattataatttatatatataactttagaaaagggtattagtgatgtggtagtgggttcatggaatcgaagctcttcacctatacatgtgccgtgttttttcctctttgcacgactatcgaagcaaatctaacaattcaaattacgtgaaggttacatacaagtaatattaaagttacatgcaaattataatgttattacattacaattataatatatttatatttgttaaattttaaagaaaatttgtcaacaaacatataacaaaatcattttgttttgccaacacaccatgtaaagcaccaaatttatcctcttcttcatcctttcctagctcatctccattctcttctcactgcctaactctatccatacacatcaccatcctcagttccaaccaattgtacatctcagctgcaggaagctcgttgcacgaggggatggccaggatgcccatccctacagctaaagctcgctataagggcaatagcagtgcgtctggccctcatcaagaagcccaagcttccacgtaggtaaaaagcaaatgaagctcccatctttcagtgtgcgtgtagttttggtgggcatgttaccatttttttctcagggcagccccaccatgaaatcactttccccactcaactctttcctcaatcgaatctcacacacctaccgcaccgcgccgctgctcctttcccaacctctataccgcgacgccactccttccccaaccttagcactgcgccgcttcagatcgatccagtgctgcagcttcctatcgtcctcccggtagcactactcgaggcaggaccgggccgatgagctcccaaagaaggcagagatcaggatgggtgagatcgatgcagccggcaagctcctggcgacacggattgaggcgggacagggccgacgagctacctccagggccgcagatcgggatgggtgaggtcgaggtcgtcgtcgccttcattcgtcggtcttcctagtatgcttcctgcttgcctccatggctccactgctaccaccatctcctgctcgagcttccaatgaattcggtcatggggggaggggccacacgcccctgggaggggggagggggaaccacaacgcggcaaggccatgacctccacaacatggcgcgccattctcttgcctgccctcaagttgttagagagccgtcgaaataacgagtgcccaaactaggctctgcgaactttgtttggtcacacgcgatgtctagctggccgcagatctccaatgtgtcgagggttggccgaatgacacgtcggagcactgtgaatgacctgaaagcttatgcaggctcccaacgaaaaagagggtacgcatgagttcaagtgtgaggtggtgctggtgaagcccatgctcagcatgcgtcagtggtggagcttggtaacggctcgatcagggtggtcagtagaggaataagatgaggaaagggggctttattttaagggttcattagatccatgccattaaaattttaccggttttgaaatataccattactatttgcgtatttgtaacgatgccattgctacttgtttctaatcttagcggcgccactgagatacgcattttgcatgtattggacaaaaataccctcat

SEQ ID NO: 31732 - DNA, 4997 bp, Oryza sativa
gcacagtttgcttgtaaattatgataccaatcttttgagcctaattacaccatgatttggcaatgtgacactacagtaagcatttgctaatgatagattaattaggcttaatagatttgtctcgcagtttacaagcggaatctgtaatttgttttgttattagtctatgtttaaatgtgtgtacacatacatcaaaaaaatttggatggggaactaaacacggccatactaccttcgtcttagatataaaaatctaaaatcggatgaaatatattctaatactacaattctggctatgtctttttttttcagattcataatattataaaatgttttctttggatctagattcatatatattttagaatgaagatagtagatggcattgttgatttttggctaagtttaacattcatattttttttaaaaaaataaatataattgattttagtgtgaattatattaatattaattagacgtactttaagcatttcttatatttctacgtatttactaaaaaatttagtaagttgaatagtaaaacgtatatctaaaattcacggtgtcatccattaaaaatcatgaggagcatttcacctggtttctggcaaaagaaaagacgtacagacaccttaactatggagtaattttgcaaaccaatgagttaattatttgcgactcttacaagtggtgattagaatttgtcactggacccatatatcatagacacatgaaggcccacatgtctattgagtgacaaataattaagagcaaattgcaccggctgtacatgaacttgtcgggtgtgtgcaatctagtgtatgaacttgtaaaatactcgttttggtatatgaacttatcttgtgcgtgcgaactaaggtcaaaagtacaataaatgcacgattaattttattgatttaggtgctgattaggatactgcgtaaatatatatacgagaaggttgctacttagacatacacctattcaataaaaagataaaataagataaaatgagatatagcgattgtagagaaagatataaaaaaactgagcaataatacaaggttagaaacatacggaatttaagataaagtagagaataaatttataaatatagtatgttttatgcatactcactgtacgtatgtacgccaccttctaaccaacatcagctaggtaaatttaaccttgccaagccattttggcacggattagataagttcgtgtactaaaataagcattttacaagttcatgtattaaattacaaccacctaataaatttatgtaccaccaatgcaatttactcaataattaattgctacatcttaaatttacgaaaagttaaatttccccaaatgtaagtacacccttcaagtttagagtttagccatgaatgtttggatgtatcttatgcactttgcacctgagataggtctttagttttaggatagcgggtattgtatttgtatcatctcggctggaaacgaaacttccattaattgagtgattatggaggttgccaattcaatactaatgcacatttaattgactggttgcaagctggtagtggtacaccacttgccactgccactacatagtactagtacatatattcgatttttgtaattgttagttagggcatgtctagatcccgcctcaaaattttacaccttatcacattgaacgtttaaatacatgtataaagtattatatataggctaataaaataactaattacacagattgtgattaatttgcgagatgaatcttttaagcctaattgctccatgatttgataatgtggtgctatagtaaacatgtgctaatgacgaattaattaggcttaataaatttgtcttacggtttactgacggattctgtaattagtttttttattattgcccgaacaccccatgcgacaccctatataatacccgatgtgacacgcccaaactttacaaccttatatctaaatacccccttaattaagtggatgttctattgtactacagcatactgcaccctctgcatgcccatacatcataaaaacactatgaagattttgtacagaactaagcagccttattttttcgcttatgcttatgcttttacttattagctatactttaaatttttaaacttaaatttagagttgattttgaggttttctcattaaagtttatttttcagcatttgcttttagattgctaagaacatgtatataaaatttttatttataaattattttttgtttgtaaatatgttgtttggctaaacgatgggagacttcttctgtgcgtgcatgtcactcgccaactactaactgacttgctttggatggactccttccagaatgtttaccattccacgctcaccctattttcttgttacgcttaatgggaaactgccaaagaaagcaggtcaactcgagtccccgaagtccaaaccatttgagtgcagtttccaaatcacattcatgacgaacggttggatcaatgagctcccatactgcaggcctttcgcagcacgtctggtcctgaaaagaactttgaagtggttggctgcacgaaagattggcacagaagaactcggtcgatcgtgtcgtctctgaattgttaggtgtcagataaagtactcatgcgtaagaacacagcatacctaccgcatgagagggggttccattgctccaacgcatactgtagatgttttatttgtacatgttgatcattcaacacttccagtatgtgccacactaatgaagaagtgacctttgctaggtcatgtagaaattaaattagtcccggttcgattagaaatcgggagtaaaaatatctttagttctggttttaaagctcacagatactttttgatttttagtcttagttggtgttaccaactgtaactaaagataatttttagtaccggttcaatagttgtcaggtcccaacgaacttaccaaccaggactaaagatagatctttaatcccgattggtatcaccaaccgggaataaatatctctctcccacatcatccccatctctcgctctctcttccttatctcctcgttgcgcacacgcacgcctcctcttatcttcttatcttctactccttctcctccttccctccactctcctccgatcctctcttcccctccacctctacgtcggcggcaggcagcgccagatggcaggggatgggaggcggggggagacagtggggaggagagggcagcagacgcgcacggatgggaggcggcgggcaacggcggcgcacacggaggggaggtggcaggcggcgggcaagccggagggaaagcgatagccggtgggatgacttttagattttgtgatgtaaatttgtggatgattttagatattttttgaatttgtagatgattttgtgatgcaaatttgtagattatttttagatgcttttgtgaagttgcggatgattttgtgatgtcaatttgtggatgattttattattgagttcggttcaaaatcaatatacaagtagcaaaaaataataaaataaataaaataaaaagcgtaggccacgtggcgctaccatatttagtcccggattcggggtcctggtttgtaaccttggactaaagaccacttctccagtagtgccagttcgatagtactccctccgtcctattttaagtgtaaccataagtttctgttgaccatctgtcttatttgaaaaaattttataattagtatttttattgttacgagatgataaaacatgaataatactttatacatgacttatatttttaattattttaaaaaaaaattcaaataagatgaacggtcaaaattgtgtacgaaaaattatgtctgcacttagaatcgaacggagggagtagctacgaaggtggagatatttaaccatttgccacatttagatgtggcaattaactttttgccactggacccacatgtcatacacacatgtgggtccacatgtcattgagataggggtggcaaatagttaaaagcccccgcccaaatgacacaacatgcatgcaggtctcatcagtcactgtattggatggaggccctgtttagttcccaaaaactttttcccaaaaacatcacatcgaatctttgacacatgtatggagtattaataaatatagataaattaaaaaactaattgcacggttaggggggaaatcgtgagacaaatcttttgagcctaattagtccataattagccataagtgctacagtaacctatatttgctaataacggattaattaggcttaaaagattcgtctcgcggtttccaggcgagttatgaaattagttttttcatttgtgtccgaaaacctcttccgacatgcggtcaaacgtccgatgtgacacccaaaaaatttcttttcgtgaactaaacaggcccggataatgcttcaggaaaggaagaagagaacgacagttcggtacagtgtcaaggcgagaagaaacagaaccatgctgttgtaagagcagtagaaagaagagaaaacacagtacaaacatatcatttcattattccagttgtaatttctactggatactaccagtaataaaccgtcgtaaatgttttaattgtaatacttcctccgtactcgtaaaagaagtcgtttagaacatcgacacggtctccaaaacacaactttaacttcttatttctataaaaatatttattgaaaagtgatatatctatacttttatgaaagtatttttcaagataaatttatacatataatttgttacattttcaaactcaacaacttgagaattatttattgatttatatttccaaagtttgacttaaacattatcctaaacgactttctttatgagtatggagggagtatatggttctattgttgttgaaatgtccttttggatcgatccaatagctagcaactatctccttttcagattataatacattctagcattgtccatattcatatagatattactccctctggg

SEQ ID NO: 31733 - DNA, 22134 bp, Oryza sativa
  unsure (1)..(22134): unsure at all n locations
agacacacatgtatcttgattcattaacatatatatatatatatatatatatatatatagacaatgttagaaagtgttatgatatgaaacggagggagtaatatttgcactctggccgtccgacgtggcacactgtccacacggtgaatctgtgacgagtgacgacacgcttccatatgagcgtattagaatacagacggtgtttctcctgtgatgatgtgaacggtgttgttgaactgtttggacgaggtacctaaaagtaggaggaaaacggtgcgctatcaagccaatatatagtgcttccagggtcctgtttggttccataggctaaacattagcccccaccttttagccatgaattagccctcaaggatccaaacaagtgggctaatttttggctaaagtgaattagcctcctcaaaacattagcctctccaaggggtgctaatggggctaattttgtaggggaccataaaaaggcagccctctctctccttctctcacctctctttgtactctctctctccaccttttagtcttgaattagcccatggatccaaacttaccactctaggctaatgtttagcctaccaattcatgactaaacaatagctctcaaaattagccatgagctaatctttcaaacagggcccagatgtatggctagaattaatgcgacacggggacagggagctaattaaacaacagttcttaggccctctttgtttaggcttataagccaacttataagtcaaaaagtctaagcctaaacaaacaagcagcttttccgtttagcttttttgaagccataagccactctaacactattaagccaaaagctaggttggagaagcttttttggcttatgtgaggtagatgtatgactcaaccactaaacttaggacattaaatccaccggcttataaatcatataagccaataagctgacttaaaagtttaagccaataagtctaagcctaaacaaagagggcctttaagtgtgcaattaaagttcatgtgtttcggtgtgctcgatcgattaatctggcccacaaacacaaaggaaattaagatgagaaagctaaactggactgcgcattcgtatagttctttttttaggagggttaagaaattaagagcacattcatatagtaaaacacagttgcttggacctgggctgagctgaaatccaatgtgcgatttcattagtactacctataccaattacggtcctcccgttcctcacacctacctggctacccctacttacaatactctctccgtctgtcttattttaaatgcaactatgaattataaattttagtgctcaactttagtcgcttatcttatttaattttttttaattagtactaccttttgttgttatgagatggtaaaacataaataatactttatacgtgacttatatttttattttttaaaaaaaatttaaataagatggacgatcaaaattgggcacggaaatccatggctgcacttcatatgagacggagggagtagaatacattagcattgagccccaggtcaacagataaacatctacttcctccgtttcacaatgtaagtcattctagcattacccacattcatattgatgttaatgaatctagacacatcttgatgttaatgaatctagatagatatatatgtctagattcattaacattaatatgaatgtgagaaatgctagaatgacttacattatgaaactgagggagtactatttttgtctcaaaatataagaatggaacatatcctgtagtacgaatctggttagagtatgtttaaatttacagtgataggatgttgtgttaaaaatagtgataggatatatcctatatatatatatatataattctagtttcttagtacattttaaaactgatgcagtaggtattatatagtagactcataaaaccgtgcaactcctcgagcccatcttacgcatcattagcatcaagagcggctgctatatatatacttattgcatgcatgattagttacctctgctaattaatctccacactagctgtgatgcactgctggtagatgcttcctgatgcaccggttgatcatcgatgtagcgcactagccgagcaagcaggacgttccacgacgtccacgcatccgtgatttgtcccggcccgacgcaaagtacacgccccaggtgcgcccacttggctaaccatgagtttattacttgctcgcgcgcgcgcgcactaccaccaccgccgtgcgtggcggggccggcgggcatgcgtcgccgtcgtcgtcgatcggccttttgcccggagaagatgggagagggggcagagcgcgacgcggtgcgcgatcatatcggtggtggtggatgggagtcggtgtgtgacggtgcgtgcatggcgcgcgggcgtggtgcgtgtgtcggcgtctcgcgcggtgccggtgcgcacacatgtggcatctcggcgagccgaagcgaatagctagcatgcgcagcgcaggaggcgccgcgcgagcgagtgtagcccgtactgccgtcgcttcgcggcgttgcgggttgcccccgcgtgcgtcatgatcacgtacagcctgctaacgactactgactagggtgtacttagttcacgtcaaaattaaaatttacattgaaattggaatgatgtgatgaaaaatttagaagtttatatgtgtaaaaaagttttgatgtgataaaaaagttaaaagtttaaagaaaaagtttgaaactaaacatggcctgcagagtgctcgcgagtgtcaatgtgtcatgtacaagtcaacgggggcgaggccgagtatacgggtcaaactaggcccatgtagaaagtttaaaccgtgagcggaagcaaaggaatagtttacttcgaatccctcaaattatagtttaaacctgattcatttctctaaccatcatactggatttcttgatgcttaactattaaggccatgtttctttcagctcagaattattataatccagattattgggagtaagctgaaagaaacagacaacttattaaagtagcttattataatctggagcccagcttattataatctgataagctcatttaggtgagctttttccagattattggatgaaaaattatccaccatgccaccccactccctctttagacttgcaaacctaataatctaggctctaataatctagaaaagaaacaactaaccacttattctactacagattataacaatctagcttatactaatctgactcaataatctagattataataatcccaagctgaaagaaacagggcctaaaacatgtataattggactcccgcatcagcagttttcactgacgtgacgtgttgacttggtccgcatgtgttgacgtggtagcccaatcacaaaatagaagttcggcccacatgtaagtgatgggaaaaataagaaaaaatgtagggcctacttgcagtgcccttctcctctctctatcctttttctccaaccactccacacctggcacagcttaggtccgacccgtggtggccatcgtcggacaacacagcgacaacaaggctggtgaacgccgtggtggccacctccatgccgccggatgtgttacactacttctgaagtctatcctatcctccacgtcaatcacatgcaaccacgtgcgatcatgatctgcagttagagatagagttcctattatctagttaatcttgttttgcatgcgatgtaatctcttccaggttgttaggtagctccctggtgatcgctcccaggttgttgggcaacttcctggcgcacatgtatagccacaatcggggctgttccgatctaattaacacgaacgctccgcacagcgtgagtgcgagagtttccatccaatagagaaaactcacatggtatcagagcgttgatccaatctaccgaaaaatcaatcccttccacctttccctgccatggcgtcttcctctagtaataccggcaattccttcctaggccaccccgtgagtgagaaacttgggaagaacaactacgcgttatggagagtttagatcagcgctgcagttcgtggtgctcgcctccaagggcacctgacaggcgcgacgaagaaacctcaagcgcagatcgtcgtcacaagcagcgacggcaagacaacagagaagaaaaacaatccggagtttgatgattgggaggcctcggatcaacaggtccttggctacctcctgtcgtctctctcacgagatgttctcatgcaagtcgcgacgtgtgaaactgcggcagaagcatggacaatcatcgagcaaatgttctcgacgcaaacgagggcgcgttgcatcaacacaagattcgcgctctccaacaccaagaaaggcaatctctcgctcccggagttcttcgggaagatgagagctctaggagatgagatggccaccgcatccggcaagcggttgacgatgaggaactaatccagtacatcatcactgggttgggcgaagactaaagcgaagtgatctccgccgtgtgcgcacggctagaacccatgacggtgggtgacctctacaatcaagtcctcaattttgaggcccgcaggtctctctatcgggggactcaagaaaacaccgtcaacgtcgccaacaaaggaggtggccgcggcagctttcctggccgcggcggaggagctccacgcggcggtcgtgcctttcctagccgcggcacaagcaatggagcgcgcggtcgaggacgcgcgcaaagtggggcggatcgcagaccgatctgtcaagtttgcttcaagaggggacacaccgccgtagattgctggtacaggtatgacaaggattatattcctgacagtaagaatattgctgcagtagcaacaagctcctatggcgttgataccaactggtatatcaacactagagccactgatcacatcacaggagaactggagaaactcactgtgaatgacaagtataatgggggagaacagatccacaccgccagcgaagcaggtatggatctaagtcatattggcaatactattgttcatacccctagtaatcgtgatatccatcttaaaaatgttctatatgttccacaagccaaaaggaatcttatatctgtacaccgtttagttgatgataattctgcttttcttgaacttcaccgtgattatttctttcttaaggatctggcaaccaagagaactcttcttaaaggaacatcacaccgcaggctttatccccttcccaggtcatccttgaagcaagcctgcagtgccactaagttgtccttgactcgatagcatagtcgtcttgggcatccctcctcctcagtcgttagacaagtggtcaataagaataatctcccatgtttagattctattaatgagtcagtttgtaatgcttgccaacaagctaagagtcatcagttaccttttcctgtttcatcaagtgtctctcattatcctttggaacttattttttctgatgtttagggcccagctccagagtctgtaggacgaaagaagtactatgtcagttttattgatgattttagcaagtttacttagatttatctcttgcaaaataaatcccaagtttttgagaaatttaaagagttccaagttatggtagagcgcttgtttgatagaaaaattttagccatgcaaactgactggggaggggagtaccaagctttaaataatttcttctccaaaattggcattgttcatcatgtgtcttgccctcacactcaccaacaaaatgggtctgctgagcgcaaatatagacatattgtagaagttggtctctccttattatctcatgccacaatgccattaaaattttgggatgaagcctttcaagcagcaacctatttgattaatagggttcctagcagagttatacaaaatatcagtcctttggaaaaattattccaacaaaaacctgattattcctctttgcgtatttttgggtgtgcttgttggcccaatttacgtccctataataagcacaagttggaattcatgtctaaacggtgtgttttccttggttttagcaatatgcacaaaggattcaaatgcctataaatttctttaggtcggatctatatttctcgggatgttgtttttgatgaaacggtattccctttctctgagcttcatgcaaatgcaggcgctcggcttcggtctgaaatactcttgtttccgtctttgtttactagtggggatgacaatgtattacaccatttgactaatcctataaatcctgctgctaatgagtttgctgatgcaaatattgagattgatacagcacattccgtggccacagaagatcccgcagggattgattttgatgcagattcggcagaacaggagcctgacaccttcctgtcgccagggtctgttcacacgcattcgcctggacctcaccattcaggcgctgacacgcggcagcatcaggagacacatgctggcgacagaattattcttccaggaacagctcgtcaggaggcacagggggagcagcggtcatctccctccgccgatctgtcctctgctgatccatcatcatcgctgtcaggtactgatgaatattactccctccgtccataataggtgacgtttttgactttttatttgcaacgtttgatcattcgttttatttgaacaattagtataaatataaaaaaagataagtcatatgtaaagtacttttgataatagagcaaatgacaaacaaaataaataataattccaaaattttttaaataagacgaatgatcaaacattgacaaataaaaacttaaaaagacaagtgatatgggacggaggtagtataacactaacagtgatcatcccgagcaggagataacacaggaacaggagcttgcaccgcaagtccgacccagaacaagattacaaagcggcatttggaaggagaagatatatactgatggtacagttaaagtactcttgttttaccaattctggagaacctagtaatctagtaatgatatagaggctcttaaagataaaaattggaaaaatgctatggaatctgaatatgatgccttaatcagaaataatacctggcacttagtcccacctcagagagggaagaatgtcataggatgtaagtgggtctataaaattaaaaggaaagctgatggttctttaggtatgtaatagattatgaggatactttcagtctagtggtcaaggctgctacaattagaatcattttatctatagctgtgtctagaggttggagccttagacagttagatgtgcaaaatgcttttcttcatggtcatctagaagaagaagtttatatggaccaaccaccaggatttgaggatgtcactaagccacactatatatgcaaactagataagtccttatatggtttgaaacaagctccaagagcttggtttgccagattaagcaacaaactgattgatcttgggtttagtgcctcaaaagctgacacatcattattctttctgcataaaggagatattgctatttttatcttggtatatgtagatgatataattgtagtaagttcctcagagagggcaacaacagcattgttacaggatctgaaggtagaatttgctctaaaagatcttggtgagttacactattttcttggcattgaggtaaacaagacacacaatggcattgttcttactcaggataagtatgctactgatttactaaagaaggtagggatgttgaattgtaaacctgctaccactcctttatctgttagtgagaagttgtctttacatgagggatctctcttaggacctaatgatgcaacacagtatataagtatagttggtgcattacagtatttaactctcactaggccagatatagctttctctgttaataaggtgtgttagttccttcatgctcctacaacagtgcattggacagcagtaaaaagaatattgagatatataaaacagtgtactagtatggggcttaatatagacaggtctgggtccacacttgtgagtggattctcagatgcagattgggctggcagtgtagatgacagaaagtccactggaggttttgctgtgttcataggctcaaatctagtgtcatggaatgctagaaaacaagccactgtctcaaggtcaagtacagagtcagagtacaaagccatagcaaatgcaacagcagaaataatgtgggtacaaaccttattagcagagttggggatcaagagtcctcgagcagcaaagatttgatgtgataatcttggagccaaatacttgtcagcaaattcagtttttcatgctagaacaaagcatatagaggttgattatcactttgtcagagaacgggtgagtcagaaattactagaaattgattttgtttcttcaggtgatcaagttgcagatgggtttactaaaccgttgtcagttcgactactggagaattttaaaagcaatcttaaccttaaacggttatgattgagagagggtgttacactacttctgaagtctatcctatcctccacgtcaatcacatgcaaccacgtgcgatcatgatctgcaggggaaactattctaatccctcgaggggatgttccctcgtttgtttaaaaaccatccaaacggttatgaaaaattctggaaaaatttgacaacattcatacaacacatatatacaactctataaaatcttaagttcaaattcaactcacacgtcgagatataaaaaagacaaattcagcatatgaatagtagcgtactgtttatatctaaatttgtcgtttttgtttctagatgtgtagatcgagtttgaacatgaattttggtggactagtaggtatcattatactctacattattaatttttttcagatttttttacaactatttgtattgaatttggaagaaaaatgtatacgagaggatatcccctcgagggatcagaatccactccctgatctgcagttagagatagagttcctattatctagttaatcttgttttgcatgcgatgtaatctcttccaggttgttaggcagctccctggtgatcgctcccaggttgttgggcaacttcctggcgcacatgtaaagccacgatcggggctgttccgatctaattaacgcgaacgctccgcacagcgtgagtgcgagagtttccatccaatagagaaaactcacaggatggaaccgtggcagagagcacgtccaaggagctgtccgccataagcctgacgcgtgcgtccgtcgaggttgtcgcaacattagtggggagaggagcggatggagcggacaagttaaacatggagacaagaggcattgagggagaagctagcgagttctctagcttgagcggggcaacgatttggagacaacggagctctctagcttgagcggcgtttgtatgcgtcgcgtgaagggggacggcggtcggtggcttcgacaggccaggagcttggcggtgccgcggtggcgcgcgtggatgtagcatctttagcggttctccagtggaacagaagagatgactctaacaacgagatgaacacagcaagcaaaaactccacctccatgcttcagagcctcgatctgccccactgtcgggaagccagctgctccaatcttgttggccacacctgcaccgcttccacccctattgaattcgagctatgcgggaagggaggcagtggcatcggcagtcaacgagcccagtcgaggtcgagctcgccctcccttctatgacggcgcctcgctcagcaagaagagcatgcggcgggcacgccgcggtcatcccctcaaccaccaccgccattacgactgtcgccgagacaactgcaaagatcgatggcacaacgaactggtcaaaaagctcatcttcttcagcctcatggcgctggcctcaccattcgacctggaatacttgctacatgcgttcgcctcccgtctcctccattgccctcctaccgaatgccgatgcatgagtctccctgtcgttccccgccattgctcttctgctgccgcgcatcactcttgtttttgtcgctcaatccaaagaaataaataggaatacgaaccctcgtccccaaagcccgggtcctagactactacgaatagaaagatttctacggatattcttcgtatcaattttataatgcttatcacctccttctgagctattcccacggtgccttcgggtcaaagcttaatccttaatagccaaccgatgcctggcaccaccgctaagcacaagggcaagaaaaagattggctttaaaagatccaaatacttccttgtgggtttataaaaaaccatatcatatcgaagaacttgatggtctttctccacccgttcgattacttcttaaaaggattagatatagaaaaaaagtagtctactcaggagaatgagataatgctcataatatcgctagtaaccaaccacaaaagtaaaccaccgtgcaaaggaaatatgggaaagagtgaagtaaggaaggaaaggagtcactgacatgtggactttatatgttaacttacgtggttggactaggtcaatgaaaaacaccttcaaaaccactgagggagtcattttgcattggttttaaaagtttggggatcaagatatccacggttacggttgagggatataaatagaattggatctatattttgagggattagaagtggactaattctgaaagcaaactagtgtactccgataacaaagttcacacctattttggggaaatctgtgcatctagaaacctattttggtccacacttgagacgccggaaaagctaaatcgcgcacgtttccgggagcagcctaactaattgaattagttttagactcctaactaactgaattagttttagataatgacgataattaagataagatttttcttttttggaagattttttttactaacagattaaaaacttttatgttagatttaaaaactttcgacttaagatttaaactttgaagttgaattttaaaaactttcaactgaaactttgaaaattttcaaatcaaaatttaaatttatacgaaaaattttgaaaactttaaaattagatttgaaaattttcaactcgagatttgaaagtttcttcaaaatgaaaaacttgtaagttaacatttggaaactttcggctcaaatatttttgaaaacacgtgtgctaacgattaaaagtataaggaaaaaaaaggaaatacgcgtgaggggaggaagcgaaaaagatggcaaaaaaatgcgtggggagagtgagctcgagcgccaattagcaacccctagacgctgtgagtaacggcctaaggccattcacagtgcaagcacctcatttgcgttacctcgtatgccacgtaggatagatacacaacgaatccatacctctcacagtgcagggtacgatccccaaaccaaccaccccaacctattctctctcccgctttcccctttctctccttttccctttccctctcctactttcactcccaccgacccgacagagccggagcgcgcggcggtacaggtcgtcgtcgcccacgggggcgcgtgccgtccccgcgaatctctcggtggcgaccagaaggcggagcgaggaggacggcggcggcgcggatctggagcggcggcggcgcgaggggacaacggcggctggcggattctggagtggagcggcgcgcgcgtcctcgtgctcatgctcgtggtcgtcgtccttggagtggtcatcggagtggtcatggcgggcggcggcggcgcgtcgtcctcggagcggtcatggcgggcggcggtcctcgtgctcgtcgtcgccgtcctcggagcggtcatggcggacggcgccggcacatcctcgcccggctctcaacaccgcgtgccccaacgccaagcggcggcggcatcctcgggacctggcggcgcggatctggagcgtcctcgccgtcctcctcaacgacggcggccggtggtggcgcgtcctcgcccgccctcaccggtgacagtggcgcggattgaagctggagccggagtcgtcggagtggaaggagttcctgctcgggaatcaaggtcggccttctgcacggcgcgcgttctcgtcctcgcatctctgatcggtgggccccgcgctcgactttttgagcgaggctctcattccttcgctaggaaccgaagaagctagtgaagctatgggccccaccaacttttttcaccacgtaggacgaagtacgctccagctagatggaggaacgccanctgtgaagggcctaagcaggggagcattcagccagaggggtgnaggggacangatctttagtgggccaactacgaggccattttagcgcagtagtgtcagacccaaaggccccagatacatctcgaatagccgtaaattgaggccagtattggaattttccgcttcccgtggttgctgaatgcggcatgccgccattgcacagcagcagaggcaggcagcccaagtgccagtatacactctactctgctgagggccacgaacgtagaactgaatttgtatcgggtgggtagtgccattattcttctggtttatatcacaaccgtcgtgaaatgtaagcaagtatttctagctcttcctgtcgcagtgtacaactatacgagcgatttcaatatggagtattctactcagcattagcataatggatgatttggtgcgacacagctgagtagattgtcggggatgcggaatctagatgcatgcagacatgcagtcctccgaaatggaaaaaagttgacacgagaacttccgtgcagaaatcagcctcgtctttgccattaaaatgcgaataggtatgagcttttcttctttcgatggtcatcaacttaccgcgaactttccacttttcctgcgctgcctctgtttttagtgggtttttcattctcagcttgctctgttgtccaattgggtttgctgaaattccgtatcacgtccatttttttatgttcagaatgaactttaaccgaaagcacacggagcgcgtccatggaggacgaagaaaagcaccaattagctggcatcaccaacaccaagtccggagagacggcaatgccatattgctaatcatatattcctacatctcttactataaaccagcggctaaaaacgcagttagcgagcggagcgtaaaggtgggtgtgcctcgcttccgtgcagcgagcgccgtccgccgccgaggcgtcggctgcgcggttgcgtggcgccgtcgcgcctcgcgttctggaagacgtgagctgtggcatgctggcaatcgcccgctatccgtggtaaccccatttcattggtaatctgggcttacggttaccacatgaaagtgagggcccctttgaaacgcaggattgagaaaacacagggatagaaaaaacgtaggaatagaatgtcatgcttattggattcctataggattttgaaaacacaggaaagtctctaaactatcatttgattagcgcacaggaaaaacgcaggaattttagacacatgaagaggaaaacatgaggtgagacctcatgcttattttcctccaaaattgatctagcaagatccattccataggaatttttaaggaattggtaagaaataatcctttgtatcaaaggactctatacaataaaatcctataggataaaatcctctaaaattcttatgatttttcctttgtttaaagggggcctgagtattttcccgcgggggacgcacacgacttgcgacttgacccggagaccagggcaccctgaatccgttgagaaggtcagctttgacatgtggcacatgggctcccaaggtgcgatcgtttcagcttttcaggattagattctcctcgttttccgttagcattgttaaacggtatatttcgtgtgaaaatttttttataacgaagttattaaaaaaatccaacaaatttattcataaaaatattatacattaatacttaattaattatatattaatcgtatttctttctcgttttaagtgataaacacagtgataaaccgttggatctagagatttttagacgcgtgtctgtgctgttcgtggaagggcacgagaagaggcgacctgtacggaccaaagaaacgtgcaattgcgcgtactgcggccattgacatggtaactgatggggaatggtcaggtacacaggtgtgccaactgaacgatcaagtggcgcacggaacaaaccactgtactgtgtcttcgaaagggacacttccgacgcattatttatggatcgatcgctagcgtagccttaactgagttggctcgttttttcaactttgaaagggaaccaggattgcatatctcatgaagcattcaaaaatgacaatgacattgaaattgaagtagagtttcctaaatagtttagaaaagtagaaatgagtgtgtagcggggacgtgcaatcagttgttcttttcttgactttaatcgatcgccagtgtgcataataacagtcgttcatactgaacaagacgtacttatctgctagtcctggcctcctggcatcgactcgaacaaggagcaaagttaataacaacctccaatttcggggcatacgtgatccgaatcaaaaacctacaggatgctgatgcataactcatcttctgtttgaagtgtctccgtacaaccaagatcatatcaccgatgaaattattcacacgactctaattaagattcgacttatgtattttagttttttttccggtgatgaaaagttgtcatttgaatgtgtaccagtaccaaatcagtcctctaaacattagcatatactccctccttcccaaaatataacaatttatccaccaatattctcttcccaaccaatcacaatcctccaccattcactttttccacctatcttcactactcattcaatcacaatcttccaccactcacttctacctattttttttaataattgtgtataaccctaaaacttcttttatattcgggtaggaagggagtataagcaaatcatcgacgtacgtaacccagacaaacgatttatcccggtcactcaacagcccagtgtgtcatgagtcatgacacagccgtaccccgcgcccttagagtagcaaacacgccagcctcaaattgtactaagtgtaacagcatcaatgacgaagaccgtacgaaacagtagtcatccgttttccctgatgccaaccacaagcagtgctagcatgaatggcgttccaaccacccaaaaaaaaagggtaattacgaatttactactgatttaaattattattgtaagaatatcgctagaaaattacaaaatgcaattagaatggtcattcgattcgagtggcattttacaaatttgcaaatgccccgcaaaaaaagcagtaatagtaacaggaaacgaaccttgctagaccgttgactcccaattttctggcgcgcttttcagatttttcaaccacagccgctccaacgtcgttttccgcccaccagtccgttttactgttgccaatcgatcgattacccggtcaaactcaaaaccgagacgaaggaaatcagaatcacgcgccaccacacgacgtgccggcgcccggcggtttggcgtccggctgcgtcgactcgcgcaccacgcacgcccccaacaccgcacggaccacacggtcacccgaggtcccgagcggctgcctctgacccgcgaaatctccgctcggacaaaacccgcgggccgcgccgcgcgttgcatgcatgcgccccgtgctgcgcgagaccaacgggctggatggcatctcggcatctcctgcgcgcgggagcccgcgtggtgcgagcgacccgcgggaacgtggtccatgggagattgtgaaccagttctgtgcgaggacggctgcacctgcagctgcacgggtcatacgactcacgagcgcgagcgggggccgcctggccccagtggccccgcacgcgtcttgcttactcggaacggctttaaatacacgtcgcgctcgacgtcgacgtcgacaccgaaatcggacggacgccttcgccacaaagcaaacccgatctaatcaaccgtgacatcccctcgcctcgggtccttcgttccctcgcattttcccttccattttcacactttcacacacccgcgccacacgagggggtacataagaccgagctcgaagtctcaggagagcgtggaagaggaggcagttgctcgtttttgtgtgtgagagaggggagaggccggcggcgatggggaggacgctggacgtgttgctggggcggacgacgaagcagacggcgaggctcaagtcgatgctggggctggcggtgacgcggctcggcgtgctgcgcgggcacaggcaggtgcggtgcgcgcaggcgcgcggcgacgtggagcagctgctccgcctcggccaccccgaccgcgccctgctccgcgccgagcaggtcatccgcgagcagaacacgctcgacgccttcctcatgctcgagtcctactgcaatctcatcaccgagcgcgccgccctcgtggactcgcacaggtgagggacatcaccggaacacgccaaaaaacaaaaaagaaaatcaaacgctagccatgtccgtgatgtcatcgcgtctgttggctatgctttgcgccgtgctgatcaccggtgttttttttgtctctttcgagcagggagtgtcccgaggagctgcgtgaggcggcagcgggtttgatctacgcggcggcgaggtgcggtgacgtgccggagctgcaggaggtgaagcgcctcatggcggccaagttcggcagggagttcgtctcctccgcggccgagctccgcagcggctgcgggatcaatgccaaggtgaggagcacgagactgatcagaattttctgtctgatcctactagccgagtgtaactgacgccctgaacgaacgaacgggttgttgcagatcgtgcagaagctgtcgaccaagcagccgagcctggagagcaggcagatggtgctccaggagatcgcggcggagaaagggatcgccggcgtcgtggtgcacgtcgtccacgagccttcttcccacgacgaggactcgggcctcagccacaggaggcgccggtgcgccgcgagaggcggcacagggtccatcaaccccaggtcgacctggaggaggacggctcttcgaggtacaggaacgtggaggccccggcgcaggccgcgttcgagtcggcggccaccgcagcagccgccgcgaaggccgccatggagctctcgcgaggcgaatccgggggccgcgacgacgacaggagacggccggaaggcgcgcagttcgacagggccgacgaagagacgctcgccgccggcgaggtttcgggtgatggcaagaaatctggcaggatcagacgtgccagcctcggccggaactacagttcagagatcgaggattcagctgaggatgatgaagtggtccgccatgagatcactgcagagagcgaggtgaaaccgcggggtctgaccaggagcgtgccggtatcagtcagaacaaagagggtgagttagctgcaaccagatggcaacaagagtgatgggagatgatttcttgaattcgtgatattagcagctgctattatatttttgcagattcatcgttcgttagatcctaggcctgtaggccattgcatgcatgtaattaaatggagccaaacaaaaaaaaaggaaaaaaaaacttgattcagattttgttcatcggttagtaggagggagcaaaagtcagcattgtatattgatggcaggtttcatcattgattgtagatatattagaggatggattgattttatattacaacaactgggaccaaaatattcctctaatctcgttacctctggggaaataaactaatgcagcgatactactaacttatatgcattaactagaaatttcaacagcagatatgaccgggtctggactacgagtattcatgaactgtaggcctgtagctggtaaaacttctctcatgtaacctacatttgatttgagaaactcccatgctggatgatcagcgggatactttccttcttttactgagactcgtcagcatgtcactgtaagactgcaagttaacaccgacatcttcatcatactcgagaccaagctcttcctgcacagatacatattattcattaaaatgatgaccgtgctggatgctagcaattggtaacttttcaatctttttttgcagggcagaaatgagaaaatctgacaactaaaaattatctttcctgttgtattaagagaagcatctagtgtgtattaactactaagtgcaggtaaatgtaaaagaaagaagtgcatcaaaaccttaaattccttctggtctttagggctattctcagtgatattatcccatagctccttgaacatcctctttcgctttctccactggttaactttctcagagaagctctcttcaataatcttcttgtcctcaggtttcaccaagataacaccattcctcaatttatttagtttctcttccatttcctggacctgcaaaaatacaagacagccattcttaaaagttaatacaaggaagacattgaaaccataaaagataaaaaaaatcgcatatatacataacggaacacgtttatgcacatacttctctttgcaatttagcttcctttgacttgatctctgctaaagtcaagtttgactgcagacctcgtacctctgcaatagggtttgtattagacatttccatactatgataatggcactcagcattgaaataaaccaccaataagatcatagcatgaaatggaacctaccagattctacctcactaattgctttcttttgatccgcaagttcttcctgtagcttgatatttgctttcttcatctcctcaagttcttccccatttgggatgttgaattgatcttgacgagcaagatatattttctgcttgccatactccttgaaggaaatctgtccactgtcagccaatgcatccaatgccttttgcactgcggtcttcttgaggctaaacttttgcaacgcatcggctacattctgagaattcaatggcctattttgctgaagagtcaaggcaataatcaacttgacagtatacaaagtttataaagaaacaattggacttattttacaacaatactagaaagagtttgaaatcctctaatttgatcacattgtactcttactcaaatcttcttttttatttcataaagtccaagtgctgcaaacttattagtcatacaagtaaaacagggttaattgtgaacaaatcatggtaagagtggtatacaaaagatgccaaatatagtttctctgtcctatctctactcaaaaggaggaaaaaatctgctgtcctgctcaggaaatggatgatatgttaagcaaacatactggcgatacacagggttattgcttcctaaagcaagtgacaccctgtgaacctgtgacaggaacagtctacatgaggagtgaagactaaaaactcacctaaaaaagctcacatgccagagattcgatttataagcacctcagtgccttctttctatgcacaatcttatacacaacctcgcacaaaagtttccacacaaggatgctgccgagtagagaggatactattgaaaaacttgaacctttttgaaatcaacaaaaaaggaaataaacaaagttggccttatttggtaacaacaaaacattactcttcaatcttatcaaagaacatgcagattttagtcctagcaatgagcatgcgaaccatatcatggctgaacagtggactagttaagttactacgatgtttcacatctgaacacatagtagaaagcagattatcatgggtttcaacaaatccgtactctgaagtagtagatcatcaatttgcatctcacagagctaacatggatcagaagattcagaaccaacatacagtaactcagtagaaacaacccctcaaaacacaaaccaatacggagtatgcgttactctctctgtccctcccaaaacaaaaacgtctccgtcccttccaaaatttagcaacttcttcgcctacttactcatctcaactaatcctaaccatctctcgtttaatttatttatcttactttctcaactcgaccaatcacaaccatccctcatttaacttcacatctccttaatctccacacacacacacacacaaaaaaaaaaaaaacctctagagtgttctattttgggatggaaggtgtagcaatttattaattattattactatcatgcagcgcagggcaccagataaaacttgaaacaaacccatcaccgtcgcataacaatatgacatgttagccgagtccataaaatatctaatcaggcaagggcaagcgcagggcaggaccagagcagccaaattagccggtggtcatgtggggttttggaggaggggggccgttacctcattgacgaagctgaggacgattcctgcaaaggagagaagaggatgaacaggggcgtcagggatcgtcagatgcaatcgatggaattgagcaggcgaaatcgatgcgagttttgttgcaaaatcgggggagctagaactcgagcccgtttcggttagaatggggagatggattgtacgagcggggcacgtaccttcgacgctatcagatttgggaggcatcgccgccttgttgcgccgccgccgccgccgccgccggcgaagggcgaaaaggtttgggggagaaatgaaaaggagagggtctttgcgactcctttgctattgttgatgagagtcactgcacggtggggcctaccgaaatcggtgaccttggggttttcccgccaaaggacaacgctggtgcgcttgggcgcggcgcggggttccagaagcagctacatttggtgaaagcccatcaaagcccacgcaccatggagcggtccatggtcgacggcccaatgctaacaattttcttaccgttgtgtttcatttagtattttttttaaaacttagtatcaaccgttaacagcttgtttggcaacttaagagaagatgatttttttatacgtaaagtgagtatctttgtattaggattgaggatatgaccagcaaagcgcatatacctatgtattaggattgaagattgaccaatatctcagttatgcacaaacggaatttaaagagagaaagcagatgagagggaggaagagaagggtcaaggggtgctgaaggcaatatctcccaaagtctatgctacttttcatcaatgtcttgttttctcttcccaacaaatcacaattctctatcattcaatttttccacctatctgcacttttcaaccaatcacaaactctctccatttaattttacctactttcttaataatcgtatccactcctaaaacttattatattttaggacggaggtagtagcatttgctcgtctttgtaacatacatgtgtatcaatagtttatggaaaaagtacaaattacccccgaactattatgggcgatcgaattaccccccccccccccaaactcgaatacggatattttacacacttaattatgcaaaccggacaaataacccccccctggctcaatccgggatggtttcagtcctacgtggtagtccagtcagcaatttttttaaaaaaaatagtgtgggcctcacctgtaaggctctcgtctctctttcccctctaacctctcaatctctctctactctctcttcctaaatccccatcccctctctctcccctccctccctgctgcagcgagcaacggtgattgcttggttttttcctcgccatggcggtttcttggccatggctgtttgatttcttggttggcccgcgcgtgcgcaccaacttcccccatgacgatgtcaacgaggccgcgcagccgccgtcgcctcctttcgttcctctccacggcgctcgtcgccaagctccaccgttccaacctcgccttcgtccaagccgcgcagcgcgataacagcaatgactcctccttcttcttccttgcttcaccgggctgccgctcaccagccatggctgcacaccgtcgttcaccaggcgccgccgttcgctgcatcaggggagggaagagagaggggatggggatttaggaagagagagtagagagagattgagaggtt

SEQ ID NO: 31734 - DNA, 28012 bp, Oryza sativa
  unsure (1)..(28012): unsure at all n locations
tagtttccaagccttgtgggtgcccatccaccccgcccgccatggntacatcactcattcggttacaactggcttcatctggtcacactcgcgcgaggaagaagagcaaagaaaaggaggagagaagtccttcctctgatccctaaaatgtggacccccacctgctgacttagcaagtcaacaacagtcaacttgcactggtttttgaagatggggagacatatccaattttcgggatgagggagacaactagcaactgtgaggaggcaaattagacttgttctaattagagaatatagagaggggtaaccgggaatatgagatgaccatggtcgaggcctccagggccccatgctatgaaatttctcatccttgtgtttcattcagtacgattagttaagaaatattaaaacagaaaaaaaattcgaaagtgaacaatcttattatgtatgtggcataacagagtactgtgggtattgctgctcctgcgccagagggacagtaatgccaacagattagacaagttttaggttataagatccctatttggttaagttaaaaaaaaaggcgcaagaagaacacctagatgtatcataatactaatttcacttgccagtgatgaatggatggctgagtgcttctggcacagtaatcctcttctttggatctagcacaaatattttttccaggagatctttgaagctggaaatcatttttggatcatcgccggggcagcttgaaattgcagaaccaacaccctttggtttaatgttcaaaagcaacctattcacaacctgcaacagataaaggtaaaattaacaattaaatttatttaacagacaattgtaaaaagttatcactgtcagtgtaaataaaaggcgtaccgttttcgtgataggatccttctttctagcaagaaagttcaagttctggtcgaagtgttgcattgtgaaggcaccctgtttaattaggaacacacatcagtatgactgtatgagcagtttaatattctaaaacaaatatgcagactaccatacatattatcttctcggtatacacagaaatccaaataagtaatggaaatctaactttttttaaataaattcttacctttcgaagcatcttcttagggaaggggcccttcaattccatgtgaaggcgaagcatgtcattgttcgttgaaccatcaaataagatttttcctgtttaagttcagataagcagcacccagctgaccacatatccagtggatgatcataaggcaacccaagaactgcaggaagaacaagaaatcactaatctgtctgcaaaccattaagaaaccaagcattgaaaagaggggatttgttttgagtttgactgcaaaagaaaacagtgtcgaagtcaagaaagatagtcaaataaggaacactgaacaagtatgtaactcacttatttcaggtgcccggtagaagcggctcacaagatacggtgtgatctcattatttccagcagacatagcactaccgaagtcacacagcttcagcaaattgttatctttatttacctacaaaatgacaaacatcaaaaaagctatgctaaataattcttctaccatatatacaaaagaaaagggggtgtaagtcatttttagccttttcctttctcggtcatcaagtacataaaactagtcataatttgtccaggaaaacaataagagtagactatgatactcagcaagattacataccagtatattgtctggtttaatgtcacagtggagaacaccacagtgtcttagatgcttcaacgcgataaaaatatgctttgtgtacgcccttacagcagtcagtttaagcccagtgccatgaccaaatttctttataacctcacgaagattcatatgaagagattcaagaactaaacacagatgattttgatgcataaaactagaaataatccgcacacagtgttgtttgtcttcacgatctgcagttcccaatttttccaatatagaaatttccctcttaccagacctgtacctgtatagtgaatgcccaaggtcagatggtactcttctctctattagatatattgccacaaataatgaataatttcaaagacttacttttcaatattgttgcatataattttgatagctacttctctacatccatccttttgagctttaagatccttcgcatgaacaacagtcgagaaaactcctttcccacggcgtgctgtaatttcataacggccctgtagcacttctccaaaatgataaactgtaaaattgcccccaaaaataagtcaaataatatagaacaaaccagtatataacttgagaagctgcaagattgataaggtataaatagaagtcagtacttactgtaatatccctcttcatcttcccagttgtcatgaagagtgtttttcttggcaagcatactgttttcattgccctacaaaacacaaaatagttgagcacaaaagttaaagtaaatgggataactttggcaataacataaaatacaaagggggcaaatagaaaaaaatatttgaagaattttttgttgaagtaagtagtaacaattgttattattcagaagtacaagtagtaagaacgtaccagcttgcgatcaataggttgttctccatcaataacgttgccaagaataacttgtttcctctctgtggaaatatcaaagattccaagtaaaatttctggatgatctagtgttacgattaccatcagaattctaaacaaacaatcaacttaacgagaaatatcatttaccatgggaataccctcctgaagacctgaagcacttgtcgtccttttattatgtgatatcctcgagcttccctcctgaagacctgaagcacttgtcgcccttttattatctgatgtccctaagctgattgaaattttaggcaaagtaggagacttcctcacattgtagaattttgcaccgacaaatacatttgataattcatgatcatttgtaatatcttccttggctcttaaattgttcgatctctgttttgtagcagcaggatcattgtttatttctgtcattcaaaaaaattggttaacaaaacttgaacaccttttaaacaacagagaaaaactcccactgtttctttttataaggcatatagtttcttcaatctcatttcaaacatacaaggcactgtgtgaatctattacttacattccttgtttacactcatttatcacatattctttattttacattgatcactgaccattatctttcctatttccaagacattcaggtacaaacagcatagtcattcgaatatctctcacatggtttcctctccttaatcattaatcaagataagccttataaaaagaaaagaagggtgtggggcagtaatttaaatccaaatgacagtttagggaaatatgttacctttattgtcaatgtaatgagcagatttttcctgttgcttccgatcctcgatgttctccaggtagttctcttcatcttcctccctgacatagtttgaagatgatttactaaaaaaaataaagcaactaaagttaacaaatatgatatacgagttaatcatatgagaaacctcacctgtaaggttctttcttctcttcttcaggtctccttttgcatttggcctttgtatcatccccaccaaagcttgatccatctttgtaaatgccagacataccatagtttgcatgcgtgtagctgatactcccttcgttcccatttactgctctagaccaacaagcatccatttccttacccctaaagcctctcttatctctcttatctatactatcattgagtttctcctctccatatctactgccaactctatctgtttctttgtaactgttcctagccgtatcatttttccgatttctccattcttcgtctttcttccttgtgctactattccatctatccatctccctaccttctccatgcccatgatgtgcactcgccttttgatcaaatctaccatcgccacttcgtctctcatgataagcaaggccatgcaaatcaactttcttttctaccaaactgccatgttttctctcgtccaggtgtttttcctcgctattacagatgtcagtgtgcctaccaatgtgacagccactctttttccttttcttatagcaccctctttcttcagtctcccacctcctgtttgaatacctatccggctcaccatgtctgtcatcaatcccatgttcataatcaagcctcacactgtttcttgagccatcagtttgaaagccagtttctctgctagcatgacaggatcgtaagcagtccttggaatgagcttcattatggtttcttgagccaggagatcttctagaatgatattccacaatggcttcatgagcagcatgatctgactttgctggataatcatgctcttgagatgggtttctagctagctgggaggtatgcaactcatttacatgtatattcaagtctgcatcggagttatcaccatgctcctgtattagaaatgaattaaaatgtaagtcaccatagaagagaaaattcaaaagcacgacgtgaccagtaaaaaaggaagcaagggagatctccctccttaacacaatgttcattgattatgatactacaaatttgttcgtaagcagttcaagctttatgtcaggaagcttggagcttctttcaggtaaacatttgctatcagcagcgcagtggagtctataataattcagacatgcctaaaattactttttttttttgcaaaccagtgaatattaaaagttgcatcaatgtggcaatagaagaacagaataggctgcggtgagacatacagtactttgaattcctgttacacaaaagttattcccttattcatagttcatacaggacgtgaattaacaatcatggcaagctagattagcttattgcttacaaattagtttagattaaattaacaattgtgtttaattttaactcaggacaaaaaaaagtgcatgccatctacccacaaagactgaggcatatgttactaataaaagttataagtaaaagacttcgttgataagtaacaaatgcagacatgttcttcacaaaagttaaattaaatttgattgttttagttcctatttcctagggtggtcttgcctgtgctctgacaaatgataacaaaacacaaatgaataggtgatcgagcatgccttcattgcttgttagttgcttccttaatataaactctacctccaaaattgttcgtcctatgactcgtattcctatcgctaacaacagcataccgccataccctacgcgctttgtgtacgattaagtccagaacaaaacagagcaaaattcgcccaaattcacatgaaaattaagaactccggaacaaaggatcaaggggtaacgaaaataacctataaccaacggcaacaaaatggatggggggcttggaacagaccggagcaggtagaacaccttgcactgagcccgtctcaccggcatcagcatccagccccctccccacacccacacccacgcccgcggtggactcgtcccgtatctcaccgtcctcggcctcgccctccgccggatccgccgcagccggcgagaccctatggcggtggcgatggtggccgcgcttgtggcgcttcggggaggaggcgccgtcctccgcgtcgtcgtcgtcgtgcggcgagcggcggtgcttgcgcggggagaggtgcgagcgggcggcctcctcgctggccatggagacccgagggaaccagctagggctagggtttggtacggaggaggaggggatcccgccccgcggcgaggaagggtatgttggtttggagttggaagaaggaatcggatcgagcccgggaacgaattcccctcgtgatcaattcggccaccgttttgtaggaggaacggtcgattggagcagaccgttcgagttagacacggatgaggattgaggcggtgaggcctcccttcgagcttacagatttggggagatttcaaatagttcgattcgaaaaatgaaattgggaggttctttgataattgaaacgcagagatccttaagattattttatataaaaatagttcgaatcgtacaaaatccttcaaaaatttcacgttcaaacggacttcttagaaagcaagggaaccattggcttgggccattgtttcctttccggaataagttcactttgggtccctctatttgtcgcccagaccgattttcgtcccttgaccgcaaaactgggtatgacccgtcccccaacttacgaaaaccggggaaacatggtccctcggcggttttaaaggcggttttggctgacgtggcgcatacgtggcttgtttgattaggtctccgtcccacgtagcattgacgtggcgcttacgtggcaactatatctcagcaaaataataaaaagtgtggccccacatgtcagctgcaaaaagaaataactttaaaatggtggggccatgtgggccccatatgtcagcatcactcctctcttcttccctctcccttctctctcttgttccctttcctctctctctcttcttcccgggcagaggacggcgcgggtggacggtggagcaggcgagctccggcagcggcggtgggcgtggtcggcgccctggaagatgccatcgatgccgccgacctccacgcgcgccaggacggcatcgccgagcgcttctacaccgcgcttgtcgtcctcccgccgcctacgccgcgctagagccatgccgagctccctcctctcccgccagcgagctagaagggcggcggatggctaggcgagctccctggtctaccggcgagcgcgcgtgagtcgctccctcctctcccgccagcgcagagagatggggagttgacttgaacatataataaacattcaatgatgatacaaactgcaaagacagcttgagaggaacactagaacactgaactctgaaccattctgcacgaggtagtacattgtcataaacaaacgtcgcaaacgaccagtctaatgcgtgctctaccactcaaagtggcaaccaaatcgatggcacaaccaatcgaccaaacaaattcatatctcttcctctttgatctcttctccctgctcaatctcaagaacatacattatgtgttcaacaaattttcatcaaaaaatctcaagaacacgtcgtgttcaggcaaaagaacaacagagacaagaggcgatcgatggcaatggccatggcgaagctgttcatcacagggctgagcacggtgatcgcctactcgtccgcggtggtgttcaagggcgccgccatggctgtcgtgctcctgctcatgctggtccagctcccgggctacctcagctggcttctcctctgcgccatcagagcagccgtcgagagggccgtggcggccaccttcgccgccgccggggacgccgtctcagcggcggcggacgctgcagtggggtagagggacgccgcgtcgtcgaacagcaccgcggcggtggcattcgtgtaggccgccatggggaggcccaaggcgctgcttgccgagatgctcgccatattcggcctcgacgcctcgctttcttgcagtccagcgacgacgaggaggaagacttccttgttgggtccgccccgggcgctggcgcggaccgccgccaccttcttctccggcgcagatctcgctattcccttctctctatccctctctctctatcctctctccttcctcttctctctatcccccctctctctccctgagaatggtgagtggcgacggaaggcgcacaggggccgcgacggagctgagacttgagaggcggcaggtagcttgtggagcggcggctggaggacaaccagcgcggcgtaaaggcactcggcgatgccgtcccggtgcgcggagggtgtctgggtggtcggcggcggcgacacggatagtggcgaagcgacggagaagaaggtggcggagaagaggagagagagagagaggaaggagagaggatatagagagagagggtagtgaggatgacaggtggggtccacgtgggccccaccattttttttaattattgtgtgtgaaactgtcatgtggatcccatagtttttaatatttttcggatcaaattgccacataagcgtcacgtcaatgccacgtcagatgaagaccgagtcaaattagccacgtaggtgccacctcagccaaaaccggggtcaaattcttccgagggaacttatttaaacggtttcgtaagttgggggacctgttgtacccggttttgcgatcaagggacgaaaatcagactgggtgacaaatagagggacccaaagtgaacttatccgacatgcctaggcgtcattcgggtgtcatttcttaaaataggcgtaactttctcatacggactcggaatcaggcaaatgatatatccacggacatctacagaaaatgttacatccgattctcctcagctctctcccaaggggcgacacaacacgagggacgcagtggcgtgagtcaaaagagagagagagagacaaaaagagattccttcctttccacgggctaaaatccttggcccagttaggcagaccatccagccaacccactgaacagcccatgccatgacggagctgagacttgtcggtgactcgcgacacgaacgttctggctagatcgctggacctgaccaaaccaagaccaagcccaccccgctacgtgtccacccacgattggacccctcacgtggaccgttttcacggtgccttgtgatgtggagctcgtacagggccagaacactccggcgagtcctactccgatctcctcaccataatccagaacctatttaagccccccgcatgtacagcaagcatcgaccgatcacgatcattctccaagcctaaggctgtgttcgctatgggttgttcccaatagcacggaaaacggagcgatccattagcacgtgattaattaaatattagctatttttttcaaaaatggattaatttgatttttttaagcaacttttgtatagaaactttttgcaaaaaaaacaccgtttagcagtttaaaaagcgtgcgcgcggaaaacgagggagataagttgggaaaatggacgtccgaacacagaccgactagatactccattacacagcttcaccaaatcgcacatcgtagagacaagtgttgcatgagcagagcaagaaacatggcgagagataagcaatctgctttaatcgtcgcagcgttcgtactcctctgttcaggtaagcaccatggaatgatgcttggtttgatttgttttcaaaatttgcaatgtgctcaaatttgatcggttttttacttctttttttttttggttcctgtagggtgtttgtgcggagttgcagatggggcgaagggagggaggaagacgaaagggccggtgatcggcatcgacctcgggacgacctactcgtgcgtgggggtgtaccggaacggccacgtggacatcgtcgccaacgaccagggcaaccggatcacgccgtcgtgggtggcgttcaccgacgacgagcgcctcgtcggcgaggccgccaagaaccaggcggcgctcaacccggaccgcaccatcttcgacatcaagcgcctcatcggccgtaggtaaatgttcctcactagcttttcttcttcttcctgagctctctcgatgcaaatggagaagctagccgtggttgattgattgatttgggtggatttttccggcctgtcgccggcaggttcgacgacgaggaggtgcagcgagacgtgaagtatctcccgtacaaggtggtggacaagggcgggaagccgtacgtcgaggtgcgggtcaaggccggcgaggtgaaggtgttcagccccgaggagatcagcgccatgatcctcgccaagatgaaggagacagccgagtcctacctcggccagcgcgtcaccgacgccgtcgtcaccgtgcctggtttgtaatgcgaaagcttctggccgccgctccagaggttgacgacgacgacgacttatgctaagtgtgctctgcttgatttgcagcgtacttcaacgacgcgcagaggcaggcgaccaaggacgccggcacgatcgccgggctgaacgtgccgcggatcatcaacgagccgacggcggcggcgatcgcgtacgggctcgacaggaagggggcgggggagatgacgaacgtgctggtgtacgacctcggcggcgggacgttcgacgtgagcgtgctgagcctcgaccacggcgtgttcgaggtgctcgccaccagcggcgacacgcacctcggcggcgaggacttcgaccgccgcgtcatggaccacttcatccgcctcgtcaagcggcagcacggcagggacatcggcggcgacggccgcgcgctcggcaagctccgccgcgagtgcgagcgcgccaagcgcgcgctcagcagacagcaccaggtccgcgtcgagatcgaggcgctgttcgtcggcgtcgacttctcggagacgctgacgagggccaagttcgaggagctcaacatggacctgttcaagaagacgctgggacctgtccggaaggccatcgccgacgccaagctcaagaagtccgacatcgacgagatcgtcctcgtcggcggcagcaccaggatccccaaggtgcaggagctcctcaaggagatgttcgacggcaaggagccaaccaaggggatcaaccccgacgaggctgtcgcctatggcgccgccgtccagggcagcatcatcagcggcgagggcggcgccgagaccaaaggtaacgcaaatgcgtttgaattaccagcgtgttcggctggtcacgccatgagtcctcctcacacattgctgttcttggtgaccagacatcttgctgctcgacgtgacgccattgacgctcgggatcgagaccgccggcggcgtgatgaccaagctgatcccccggaacacgaggatcccggtgaagaagtcgcaggtcttcacgacctacgaggatcaccagaccacggtctcgatcaaggtaagcacatttcagctcgtgcattgacctgataacattgattcttcagttcttgagactgacgaagctctgaatttctttttcaggttttcgagggcgagcggagcttgacgaaggactgccgcgagctggggcggttcgacctgtccgggattgccccggcgccgcgcggcgggccgcaaatcgaggggacgttcgagttcgacgagaacggcatcctgcacgtgacggcgtcggacaaggcggcggggcggtccaagtcgatcaccatcaccaacgacaagggccggctcagccaggaggagatcgaccggatggtgcgcgaggccgaggagttcgcggaggaggaccgccgcgtccgggagcgcgtcgacgcgcgcaaccgcctcgagaactacgtgtaccgcatgcggagcgccgtgcgggacggcggcatggccggcaagatcggcgacgacgacagggagaggatggagtccgccctgacggaggctctggagtggctggaggacaacgacggcggcgcacggacggcggagaaggaggactacgaggagaagctgaaggaggtggagcaggtgtgcggcccgatcatcaagcaggtctacaagaagagcggcgacgcgtcggccggcgccggagacgacgacgacgtgaatgagctgtagagcattttcgctgctccatgtatagtgtccgccacttcagaaaggaaagatgttgtgaagtgtaaacggatctcttaatctcttatcattagacactaatcttttttgtgttttaattaccattaatcttatctggaatgcatcaatggacaaattttgaggtatccctatctaagtctctaagctgttcatcagctagaggattaacgaaatgcaagcctcccactacgataactttgtgtttgctcctacacttacacgggcccacgtaatacaattagctaacttgctcgagctaacacgccagcaagttgcaacaatcttggatccgtaatactcgatccgacacacgagatgacgaggacgcactcacgcacaccgacatctacacatatgcatctgcggccgcgtggccaaggcaactcgcgtcgcgtgctcaaccgcacccgtcatggcgcgccaccacgaggacccggcggctcggcggcgggggcgcgcgctcgtcgtcggcctccgggccgaacacgaaccgcgcccacttccttgcccgcgcctccggcttcggcttgggctccttccgttcccgcgcgcttccagcccccgacgccgacgcgagcaccgccgcaacgagcaccacgacgagcaggggagccaggagggacaccacctgcgccgcgctcttcgcgatcatcgtcgtcacagcgagcgagcgcgcgcagccgtcacagaggagacgcagcagcgtgtgttcggctgctcttcccgggcgtctctgcggcggaggcggtcggcgccccactacatatacaggttcgccacgcgttagttttctcgtgcgcaaccaccgcgccatggatcgcgtgacacaactagcgcgcgcctcgccgtctttcggcttgccgggtgaagaaaagccaaaccaaaagcctgggaatggagaaaagcagccgtctcatgcgtgtttgtgtccctcgtcgtcagctttacggttgcctgcgttggcgggaattaactctgctcccggtgatcctcggtctcatggggtaactgggtgatgcaattcattactggttgggagtttggtagtagtcgatacgcgcaatacacgagccgcacggactgaaaactgatgcagttcttgaattcgcaagaattgaaacagaaaccgagactgctttgttgctgtcgccgaaatgttgcattggattctgcaggtgactacagcggctgcggaagcacttcgtatagaaggagatttgccagattctttcgataattagtaggaaattactttgaaaataattgtcttttaaactatattaaacatttaaaaattgtctataaataatatctactttaaaaacataggataatatgtatagattaatcttgaaaattacttcagtataatcatatatatttattaatagccctacatatattcagagtcatttttaggataccgtgttctcgtctaaaacaattttttttttctaaatcgacattttttaaaaaaaatctggagagactacagagtatacatgcttcgttgactgagcccctttcagttgaagtatgcaaatcattcaggcacaacaagcatgaataaaacccactgctgaatttcataccgctatcatctatattcttgttttctgatctccaacataggatcatccaggggaaatttagtacacaataatcgccagctaattatcataaaaactacccctttccagctgagtgaatcttgttcttgtaccatcacgtacatgtcttgctgacttgtagaaccctatagctccaatagccaaccttcatttttccatttccgatgtcttcccgacgtcctactcaagagccggtgccacctcggttgggttaccttcaaacacatcagagcctgatgattctgactcttccgggaactcctgtgtttggaccgattccttgtaggaaggagtttctctgaagtctgtcgctccttcgttatacgttgccacagcgaacccacatgcaaccagctgcaaaagtatgcaaggtcaacagatacaaagtgagaaccaacatacaattgtaattttatcaggtcctcgagagataacatgaatataatcgatcaattgatggtaagaggatggaatggcatgcaaagttatctctgcagatcaggcggagacatgctgagaataatgttgaactgatgcgtgtcaatgaaaaagcaccaggtgctatcatcagtttaactcaattaagaaatgtcagatgatgtcttgctaaatagcatgtaaagaaataacttcatgtattcagcggctgatttatttccactattgaaataaatgtattcagcaaccgagcaacacacactttcttttccatccactagatgactagacactgcaatggaatcacttgtggcaagtaatcagtgtgctaagtgctaacaagcaatgcgatcaaatcctatatatatttttagaaggcgcaaaagctttgtgcgtcaatatattaaagatcaaatcttacatatgaatgaccgtaaatgaatttgaatgagtatgatgtctgatactctatattttagttggaacatcaagctcatacaatcactctaaaatttgaaacttgtaacttcagccccggacagtgccatggcatctcttctcatcacattgaagggcttgtccggaagttgtacttcattatcgaaggttttgtcgcatgcagatttcctttttgcacaattgcacattttgaagtttcagaatagaagcgtatcaattagctgaaatctaagtttcactaactgcaccaagctaaagatttacttctgagcacttgagcatggattattgataacaagttactagtttcccaacagcagtgcacaaaacgcatcaactgcagtaaagcggcaaagtaatggaggaggaggaggagcaagaggaggaggaggtgctcacgccgaagaagacgccgaacgcccacatgtactgcacgaagaagccgagggcgtcccactggggcccctcccagaagtcgggcttctccgggtccggcagctcgggcatcggcgtcgtcgacacctcgaaccccagcggctccccttcccagtccaccccttccccggcggcggcgtcctcgtccatgtcgggcggcgcgggcgccgtgacgctaccgcctccccggcgcttattcttgccgcgctcctccaggcgccgctgcgtgcgggacgagacgccgcctctgcgcgcgcgcgccacgtgcagcgcggcccggctgcccaccagcgggaggtcgagccgggtcgccgcgacgccgaaagcgggaggggcgcggcggcggacggccgcgccgccgaacggcgtgggcgaggtgagtagatacatgagccggcgccggcgatgtcacgtggaggctcgagaggctggagctgctgctgcgagcaactcctcttcctactggctgtcgacgcttctcaggatctgtgagggctgggagtgagagggagatgagataagattttcattttttctttttctccttttgttttctagttccgcttctctatttttcgtttttcatcgtttcagtcgtgtagcaggagcgctaaaagccatgaagaaactcgggtgttactgcattagatttcgccgaaaaaaaatcatgagctagttttgtctggtactccatttcaaaagagacaaaattatatgacattcggtgatttaggtacttgtataattaaagtaccctctctatttcatattataagtcatttttccttatttttaaaccattctttcttaaaacttcttaaaacttctaccaggtttatagaatatatatatatatatatatatatatatatatatatatatatatatatatatacaccaccaaatcaattttattaaatctaacattgatcaaagctaaagaaacttgacttttaaaaaaaaagttaaaacgaattataatatgaaacggatgtagcaattttttttatcaaaataggtttgtttaatgcaataagtttgtaagatggcccaatagaaatatttttcaataaacaaatctaacatgttatttttatgtttttaaactactgtaaaattcattagtggttaaaaattttagagtttgactagacctaattcaaaacatcaaggatttatgattggagaggatagatttattaccataatataaatatagtgcttacgttgaagagttcattcttccttccttaaatataccagaaaaactatagaacggtctcccgttctaacggaatgactcaatataatagagcacgactgttttccagatccatttctcagatccgttttcttccccatctttccctgagctgatcgccatcctccacctccctcccttccccgactcctccaacccatatcgatcccatgtccggtcaccggagaaccaattgacgtcgttcctaaccctaaggcgtccttcatcctcctccccccttcatacaccagattggacatcggtgagagagatcggcgaggtcatggggccatcgggaaattggtgacgtcagcaagcggaaggtcattgcgacagcaagatcggcgttgtcttcgttgaggacggagaagaggagagaatgcaaggctgagagtgagggggacgcgcgaggaccagtgcactgacgacaaggtgcttcctacgcgtctcgagcttgccgcactgtgctcctcgctgctcgtctccattgtttgcaggtacgtcatcctcagttgataccgggtaccaggcctgatacctcaggtgtcaggtactaggtatcaagcatgatacctcgggtatcatccttgatacctcgaggtatcaagcctgatacccactggtatcagacttgatagccaggtatcagccgatacccataggtattaggtgccaagtactaggtatcaggtatcatgccacgaggaggaagcgcgggttgtcacttcctaaccagccagtgaaccatttaccaccgatttctcctctcctcttctcactcctctcctgttctccctctctcccctcgacacgctccctcctttactactgttgatgcggcccgcgaggggggtgagggacgtattaaatcgttctaattatatttgtgcttatattttttaaatcatgattggaagaatgattataaaaaattgtgattctaagggctcctttaaattgcaataatttaaaaatgtaggaatagaaagtgataatatatgtaatccacaagaatatgtcgaacatgtattgtaggaattttagaggaagaatattatcaagattagacttgaaaggagagatgatgcattggacttccaaaaggaaaccaaaaccaagaggtttgggctcatgtttgaaattccccaaaatatagaggaaaaaaggattcatatgcaatttttctagcaaatcctccaaatggaagggctcagaaaaattcctataggaatttaatcctacgaattttctataaaaacaatgtgttccaaagaagccctagacatgataatattttagtttcatgccctgataatatatatttttgtctctggtatatttgacgtttatgataagatttagataaacttcttcaagaaaaaaaaaggcatcaatagtttctcaaataccacttaatttaaaaagagataatcgcaacacacataattttcacatagcaccatccaaccaccattcctctgtgcccaatcgctggcaaaacaggttatccatgatcgtactgaatcaccatacagttatacattacacatgactctgcgaagggagtcagggtgagcatccaccagacaaccacacccaaggctacataatagctatgaaaagaacaaaacaatggcatcaacgacagctttgtcagcagctgcaaatatgaactccagttcagtttcaccagtctaggctaatgctcctcgagaggaaaaggttgtcgatgtagtctatgatagggctagaggcatcgatgtatctcctcatctccttctgcacggagcaatctgcagtagcaacacagcaccatttaaaatcacaagaacgcagaaagatcttcacccaaaggagaaatactcatttaaattcctgacaaacaacattcagggatgtcgcatttttgcgtaccagtttcgttgagcctcacgatcagctgctccctgcttggaagagtgtacatcccagcaccaacagccttcctgaccgcccagctgtgaaacggcgcgcaaacctgcccgtaagctgtcgtagcagcatcatacagcgaacattccctgcagaaaagaaaaaaaatgaatgccagaaaggccgtaagctgtcgtccattagagcagaacagaactacctgtcaactgtgtcttatatgagttacggatgccaactggccaataattctaccaacttagccaccatcggctgaatctgaatgtatatgtagtactaacaattgtcgccggccagccttgcctcagaggaggacaaaaggcacaatgaacaagttgatgaatatttattggtacgagacaagtttcagactgtcctggaatcgcctgatatgcttcagatttcatttcgaattgaaaaaaaatatggtgtgcttgggtgagagggaggcgacgtactgggtggagaggaactgctcgaagagaaccttgatgaggccgaggccgaggcggaccctgcgcaggttgcgggagtggctgccctgcttcttgacgcagtcgttctcgacgtctttgtccaggatgtcgttcagcgtgccgtacgacttcgccgctccgatgaggtcgttcacctgcagcagcagcagcagcaggattggtcattcacaagggaaatcgccgttagtacatttcttgccgccacaagtacatttcttgccgccacaagaattcttcgtggccaatcagaaaaaagaaagaaagaaagacgcaaagtcgcaaacgcgttttcatggagcatcgttgagaagtttcggtttttttttcctttcttggtttgcttttctagcgcaagaaaataacggaaaaggaatattccaaatcgggggtaggaggtgaacgctgcaagatctaatggggaacaggggatcaaacaggaataaatcgaaatttaaccagagtcaaaagcgaaatttcttgatgcgttgtgatgaagagatccaagaaacaaaataaagaatgagaaagacaataaaaattaccaagaaccacaaaaccacgaacgagatcgagagcggtgtgggggatggacgagggtttaccttggcgacgtactcgatctcggcgaacctgaaggccatgccgaggcagctgaagaggaccgagacgagcgcgcacgtgtcgccgaagggcccgaggcggagctccctcgcgtgggtctacatgctcggggccagctcctcgaacgcctccgccaccgccgtcagcggcgtctccatccccttccgcgccgccaccacggccgcccccgcgtcgccgcaaatcggctccgcccccgcccccgaccacggcgtctgcgacctgaacccgagcatcctcttcctcctctccttccctccctccctccccgcgcgcgccggccaaactagccaaggcaccaccaccaccaccgttccaccatccgcgcgccaacggacggtgcggtgcgagggtgcccgaaggacgcgcgcgcgcgtggctcaggtggtgggattggacgaaggctggcaatggcgtacgcgccgacgcctatgtatagaaggagcagaagagaaagccggcagaaatgtagaatctctttgcccgtgtgggagacgaggaggaatggaacaccagggggtgagctggtcggcagatcggacgcttcctttatataggcatcagcgtcaagattcgtgctgggatataggagtacgtgccacgagcacgagtgcacgaggtggagtcagccagcgaaatgggaacacacaaaagtcacggggtcggcaaattttacacaaaaatataaagtgcatgttcttacaaaagggaagcattgcctttcatatacttgtcactcgttactatccagtttttaacatttgggacatgttcactttaatgacattttcaaccttaccaagttttggtatagttgctaaaaagaatggctacatttaatttgctgccaaattttaataactatataagaaatcttgccaaaatttggcaagttaccaagtttttggcatcaaagtgaacaggccatttatcactcatcttctatgtagaagttttatagtactatatacttagattgagaaaaaaatatttcttaatgtgatatccaccgttctttttcgcattattcaaacaattttaaaaatttaaaattaacatgataaataaatattaaatatatcatttcataaatatataagttcagatttacaatatttgagttgtaataaaaagaacaaatttatatgtaaacagtatatacaattttttttatatttttaccttgcatgtttataaagtgatatattatatattaatctattttgtttctttttgcaatttttcatgactgtttgaacgttatgcaaaaaagaggggatatgcattaacaatataaattatagcataaataaaactttcaagaattttagttaatcattttaaatgtattaatggttaaaatcgaaacactaatgttcaatgtaggagagtatatgaccttaatttgttactactgctactcatatttttctacgagtaaagaaaaaactaagggaagcttccgaagatgtttgcattgagccggaatcgaccgttgaataaagcacggagaatcggagatgcatctgggagcttcttcctaaagtgaccttgactagtgtaaccgtgtgagccatgacctgtacccaaagtaatctaggagcatcaaagcgaatatacttctctgattgcgcaaaaacctttatatgtttatggacctgtctagatcctatttcaaatttttttactctatcacatcaaacgtttaaacacctatatgagatattaaacatagattaaaataataactaattgcatagtttactactaatttgtgagacgaatcttttaagcctaattgctccatgatttaataatgttgtgctacagtaaacatttgctaatgatggattaattaggcttaataaatttgtctcgcgatttactgacgaattctgtaattagtttttttattagtgtccgaacaccccatgcagatatgctaaaattttacatcccttatgttcgtgaatgtactcgttcccccaaaaatattaaggaaaaaacaaacaaacaagagtactcgttccagcatgaaagcaatgctaaacaggcagtagacagtactactaatcattatatgtgttacactaaaaatgtagttttatggaaccgtgccagaacttcagaacgggtccggctcctcctgcgcctcgttgtgaagcaccactaaaacagtctggatatatcattgtcgtgtacaaaaatgattacgagtcaagaaaacgacccgaaataatgaaaaacaacatgatataacaggtgaagattcaggcatttcttaatgctcgagagcttcgcaacgacctggatttctttttgctacctatcggtttcggaatgcttaaaaactcttgaacatttcgcatcttcgggcaggcgccgtcgtatgatttttccgacgcaaccgcaacttgcacgctggaatgctcacgcgcgaggcccagtgacaccgcgaaaagcacaaccgtctaaactgtcgatgagctggtagtgtacagctgcacatgctgcgcattattgcgaaaaattctgggcaactgttattgagcggtacgaattcaaatatcgatgaacaggttatttgttctattttttaagtttggtttagctatgaagcaaaattcagaccgcatatgctttttgtttagtggtgattcacatcggggtgctttagacccagtttgaagcaagcaaaataggagcatgaaacaaaatcaggagaagagaatgcctcatcagttccgttttgtaacccttttattagttccgagttgcaaaccggaccacgaatccgagaaccgggtgaaataactgggattatctttagtcccggttggcggttggtggactaaaatggtagcaccacgtgcatattggtggtttttttctttttttattgtttttttttgctgtttccatcgaatgaacatcacaaattcacatatcaagatttctttcatttttttttcttaaattcacatatcaaattcacaaactcacaaatcgaacatcacatactcaaattcacagatcgaacatcatagttcaaataaaaaaaaattactgatcaaatagacactacaacagattcacagaacatatgataaaaatgttcatctaaaaacatctaaagtcacaaattcacaggccacctgccgccgcccacccccctcgtgtgccgccgccgccgcggcccgcgagaggggaaggggaggagggtagggggcactgtcgctgccgacgcccgccgccaccaccgcggccctcgaggggggaaggggggagggggggagatggcaaggggggtcgctgccaccgctcgccgccgccgccgtggcccacgagaggggaaggagaggagggcaggggagccaccgccgctgccgacgcccgcgagagcggaggaaagggaggagtgaaggagataagggagagatagagtgtgggaggcgtgcgcagtggattccgagaagataagggtgagtgagaggtgagcggcaacggttttgtttttaaatttttggtatctggatacaccaatcgaaactaaagatttaaataatctttaatcccggttggtgttaccaaccgggactaaagtgaggatcttttgtcccggttggtgccaaccgggactaaaaatccttagccccttgacaggccgttgaaccggttggtatcatatagtccctttggagtttttttagtccggttaccataggaaccgagactaatttgatttttggccaacccagcaaatatggtttctccagcagtgaacggaactccaaatcggaaatatttgccgggagtgaattgtagtgcttccttcataaagaaaaccttaagcataagcatatttcatttttctgtttctatataaaatgagatggtcatttatgtggtttttgtgtattcgagacttagataagaaaatgtgtttaaaaaaatcatctttccatttcgtttaatagtgctattaaattattgatcgaaacttgtacagttatttattttattacttgttttttacatttatgtacaattttgttttcttcattactcccccgtctctaaatatttaacgccgttgacttttttaaacatgtttgaccgctcgtcttattaaaaaaatttataaaatatgtaaaactacatgtatatataaaaaaatatttaaccatgaatcaaatgataggaaaaaaataataattacttaaattttttaaataagacgaacaatcaaacatgtttaaaaaagttaactacttaggagacggagaaagtatatgcgagcgagatattttttttaacgaagaaatatgtaatttttagattgaggagaatatatacgtacatccacgcgttgccacgcgccccagcggcgtgccgtggagggatcgaaattcgaaccacgcaacacggcaagtcggctaccgaaagtgtcaaactgtcatcaaccacatttacctccccggtcacgatgtatacagtatacgtataggtgctattcgacgctgtttgtttgaaattgaacgctagctagcgcttgcacgttcactgttgtgcacttgtgctcacctgtactccatactttttatataaaaaacaatttcttgtttgacattttttttagaaagttcatcgggggagattttctacctgaattttttttagattggaaaaaatacttgtgcgtcacaacgggtgaaaactattttaatcttattattgttatagttaaggtgaaatatattgtgataactcgtttggatatatatatatatatatatatatatatatatatatatatatatatatatatatatatatatatatatagaaaatcatgagatgtaattaggagtccgatcgtcttaacttagtatgcgagttttttaaaagagattatacgattccttctatatttttaaaagcgaacgaatttaaaaccgatttaaatacggatctgtatttctaaaaacgaacaaacttaaaaaagacttattcacggatggcgtaccaaagtactggcaaaaacatctttaaaggtacttgtttgacgtgttagaagtggtttttatagaatgaagagaatatgcacaaacaatttcatcacactcattattaacattgccttacaaacatgcaagccatataatattactatactataaaaacattttaattggggatactggtcaggatctgaatactttagttggagcattgggagtttgagactatcgtcaagtgtgtccaactcacctcgacaaaatgaggggaattctgctgggagactgggaggtgagccatgccaattgccacggttcttgatagtaagtgctctctctctatctctaatacaaaactatagtatgacacaaacttttatttagatttacagtattagttttgtttttatgagacggacggagcgtacatcttctatcaaatatatacttccgtcattttagccttttttttcaaaatgtatgtcgttttcatatttcaaaagtacgtattttagacatgaattttcctttatgaaaatattttcgaatgtaaaaacagcatacattttaatcgttactttgacaaagacaatcaatagcgtgtggtttttgtttcgactttcagagcagtcagccagtcacaactcagaaaaccgaaaaccagagtcctgataatgggactgcatgatgacgctttttgggccatcgacaccctctcgcctcgctgcctcctggtgggtttgaaatctagagttgctttctcagattgggccgagagttgtgcatatgacaatttggcctcaatagatctaagcaaccgtttaatagtctaaaaacattctgcatcttcttataaacggatacaaatggtttataagtcagacatactaatgcatataagtatgtactactactagaattatagcacgacagtactaccatgaaaataaaaagaaaaagagaagcgcaaattcatgccttctcaaacacgctgccattaattaggaaaaaatattagcatacgaagaatttctcaatactccactgtatggtactctccaaaggttacttctgctacaggtttctttcatttaccgatttcctggcaaactcaaacagaaatctcgttcacaaatttccgcgcctctgattaattacacatgaatgaagtgctgcagattcctgcgacaaaacatttaaaacccttttgttccaaatgagtactatattttgatgacttattttcttcagagttcagacattccatgatcctttgaaatgcaagattgtaaaatcaaaaaaacataaatgcgcatggataaaatgtcatacgcccattgaattcggatatagaaataaaagacaagtgaaagttttcatatgaaatatcctattacatagaaattccaaatgaatctatattcctttgttccaaaggagcatattggaatcaaactcttcaaaaactcttcaaaaaacaatttaattttctctcgttacaaaggtgcacttttacgagtttctcttaacccaaatctaacagtgacaaagtgagcgtagctcgactagttagatccttgttgtggcactagcctatatggattaaaattctagacttgacagttgacgttagtacccgtatttatgactaattattctttcagtattaggcgaggtacctgtcaataacaatatgcccgtcatgtctgggggtttataatgtgtttttttaaaaaaattaacagtggtttttatactactagtatgctggtacacggtcggtgcacttgtttagccgcgcataccacgtgacgcgatcggcgcacggttccctccccggtccgtaggccgcagccacccccaccccttcaggtcaaagccgccggggcagccagccagagcccggccggtccaatggcgccttgccacgtgcccccttcctccccaccggtccactgcgcccatcccacgcagcccccctcttctcctcgcgcggactccccggtttgaccgcgcatcccacgcgtcggctcaccattggccggggccgcgccaaggagaggccaggcgagcttcccgaggagccgcacccgacgatttctaattttttcttttgttagaccctctctctctctccggtctccactccctctcgttctccgctcctcgcctcttttacccgctcttccccccgatctccccggactcccacagccgcagcgaacaaatcccgcgcgggttgggaagagcgagctcctgaggagagcaaagggaaagcgcgagggggaaggaggaggaaaggtgatctcttctctcccccctttttcttttttttttttgcttgtctcgctttttatttttttgctacctttacggttgctgggatttgggggagttggtggttggttggttggttggtggttgcgtgaatcccaggggtgaggagaaggaggtggagtgttcgttcttgatctttcccgcagttgcacttcgatttgagattgctcggtacggatctgcagctgttgtttttgtttggaatcgtgttagatctagggttggagggtatggctgtgtggggttcgaggtcagatctgatgcgaaagtttagggttcttggtgactgtgagatgtggctgtgtttagttcacgccgaagttgtaagtttggttgaaaattggaacgatgtgattgaaagtttgtgtgtgtatgacaggttgatgtgatgggaaaagttagaagtttggaaaaaaactttggaactaaacacacctcgttttattttcttgccatgtttactggagatcgtgttggggactgtagtgaagactcgagatctgcgtggaggaagcctgtatttgattattcacacgaaatatgcacgcatagctgttcccctttcgagctaattcggttcatcgatctatcgtttttttacctattagatgcagtatgcctccgttgaactgcagatctagtcatttcgctgctgttcatgttgttttgaactgttagtctgtctgcttgctcttctgtggaagaagcagcagtggcgctgtcgttttcttagcttgaggtctggtggtattggactagatcactggtttggcagccactttcttgttgatttgtctgacggaatcactcgaaaagtaagaaaataaaatggagaaagtactctagtgaaagggggatggactagaatatttagttgcctgagaatgattcctttcgttcatggaaaaggcttgcgcttgttgtctaattgggaaaatgatgtgccatccacttggttggaatctggcaaagtcgtgtgatttgtatgatcttcttgggtttcatccattgttccttgggtggatggtgtctattatgcttatctccacttgggctagttttccgagaaccgtatatgttcttgtaaatggtccacaagtgatatagtaggttgtatctgtgtaagtgctgatatgcattatttgcaggtgcacaaggtcagactaagtttgcgttgaagaacaaaggagaggaaaaatgtcgcctgctgaggcatcgcgtgaggagaatgtgtacatggcaaagcttgccgagcaggctgagcgttacgaggaaatggtcgaattcatggagaaggtggcaaagaccactgatgttggtgagctcaccgttgaggagcggaacctgctttctgtggcttacaagaacgtgattggtgctcggagggcatcgtggaggatcatctcttctattgagcagaaggaggagagccgtgggaatgaggcatatgttgcatcaattaaggagtaccgtagcaggattgaaactgagctcagcaagatctgtgatggtatccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 31735 - DNA, 612 bp, Oryza sativa
  unsure (1)..(612): unsure at all n locations
atagggcgaattcgagctcggtacccatattgtaatgttctttgtggatcatagaggcacacctcttagatgatatcaggttatggttaactatggtgttagaagattatgatattatggtggcctcttttatcgtttacttcactgttattatttttattccccatccacagtgtgtgtgcgtgggcgtgtgtgtgtgtgtgtagctggactgttgatgcctggttatgccttgtgaatgaccctgtcctaacatcctctcattttggcagttgcaacttcttaaattttgctcgaaatcggcactgccttgaatgcaaagcagatggaccaaagaagatagaaacagctaccactgaaatgaaaacgggagactggatctgtccacagtaaccatcgaatgccatatttgttttcttgtactgttcaacattattatatatttgccttgataacttatttatttttgtttcaggtgccacttcatgaactttgcacggaataagatgtgttttaaatgtgaagaatctcgaccaaagagccagctcatccctggagaatnnnnnnnnnnnnnnnnnnnnnnnnnnnnnnnnnnnnnnnnnnnnnnnnnnn

SEQ ID NO: 31736 - DNA, 424 bp, Oryza sativa
atatataaaaagttaaactaaaaaagagaagcgagggatatctctgcccatgccggccgtgatctacggacgtgagtcacccacgacgctcgcaagcgcatcatgcgggtcagactatccgactgaaatcgaacccaaaatgtggcgacagagatttagcaatactgaagataaatctataagactggcggaatgttcagacagtttcagaattcagaacccatccactgatccgcacgcccctcaccaccaaaagtcgcacaaggaaaggagtggcttgtccaagcccctcctgctccagcccggtcaaatgcggcaggatttcccccttaatcgccgccacgttcttccggatcgcgactccttcaggtcagggcagcgctagaacaacggacgatccactgatccggtcgtcttcggctac

SEQ ID NO: 31737 - DNA, 686 bp, Oryza sativa
  unsure (1)..(686): unsure at all n locations
nnnnnnnnnnnnnnnnnnnnnnnnnnnnnnnnnnnnnnnnnnnnnnnnnnnnnnnnntagctgcctctatcttctttggtccatctgctttgcattcaaggcagtgccgatttcgagcaaaatttaagaagttgcaactgccaaaatgagaggatgttaggacagggtcattcacaaggcataaccaggcatcaacagtccagcacacacacacacacacgcccacgcacacacactgtggatggggaataaaaataataacagtgaagtaaacgataaaagaggccaccataatatcataatcttctaacaccatagttaaccataacctgatatcatctaagaggtgtgcctctatgatccacaaagaacattacaaatattgtaaagtccatagtaatactagaggttccttgtccaaccatttaactcaatacttactttaagcaccgtgcaattttctttgttgaagcaaagacatatttacactataaatgtactccctccatcccaaaatatagaaaccaagtactatgaatttggatagggaggtctagattcgtgtactaggttgggtctaatccagtactagaatgctattttttaagaacgagggagtaccaaagagcgactaccagccgaaacccagattatttggattcactcattgagaactggtacaacca

SEQ ID NO: 31738 - DNA, 599 bp, Oryza sativa
cgactctagaggatccccatgtaaagggataatgagagcgtttgttttgtttttcaattaaactataatccagaattaacaatgccgaaaaaaactagatactgacatatcttgggtgcctggcatttccaaaactgatagcaaatcaaataaccataattaactaaaatttaatgagtcaatgacccagccaaaaaccagatatggttcccaaggcgtttccccaaagggcaaacctttcccccaagggtgaagtttccaaaaaacccctttggggggggggggaaaacttgtgatgttcatttgtagaacttagagctaaaatcacattatttgttgaacacaaaataatggttcaacacaatcaacaactaaaacaaaaccgcgttccgagaggaccaagtgaaatggtgaccgcagagcgagccgaacaccccccccccactaggacaacgatttggacaaaccaattggccatatataggtttggatgcaaccggaccgactaccaaggacaaaaacaaccggcaagcacagaaggggaggactattaggattttaaatgagcaaataccaataaaaagaggttttaacatagg

SEQ ID NO: 31739 - DNA, 615 bp, Oryza sativa
  unsure (1)..(615): unsure at all n locations
ggccgactctagaggatccccgatcttcacccaaaggagaaatactcatttaaatttctgacaaacaacattcagggatgtcgcatttttgcgtaccagtttcgttgagcctcacgatcagctgctccctgcttggaagagtgtacatcccagcaccaacagccttcctgaccgcccagctgtgaaacggcgcgcaaacctgccccgtaaagctgttccgttaggccaaggcccaaattccaattaacccaaggccgggaaaaaacccaattttttttttccccccccctgaaaaaaaaaaaaatgaatgcaaaaggcgaagctgtcgtccattagagcaacagaactacctgtcaactgtgtcttatatgagttacngatgccaactggcaataattgtacccacttagcaccatcggcatccatccgatgatatatgnagnactaacaattggcgccggccagccttgcctcagaggaggacaaaaggcacaatgaacaagttgatgaatatttattggtacgagacaagtttcagactgttctggaatcggctgaatgcttcagatttcatttcgaattgaaaaaaaatatggtgtgcttgggtgagaggga

SEQ ID NO: 31740 - DNA, 547 bp, Oryza sativa
ataaaaatagcaatatctcctttatgcaaaaagaataatgatgtgtcagcttttgaggcactaaacccaagatcaatcagtttgttgcttaatctggcaaaccaagctcttgagcttgtttcaaaccatataaggacttatctagtttgcatatatagtgtggcttagtgacatcctcaaatcctggtggttggtccatataaacttcttcttctagatgaccatgaagaaaagcattttgcacatctaactgtctaaggctccaacctctagacacagctatagataaaatgattctaattgtagcagccttgaccactagactgaaagtatcctcataatctattacatacctaaagaaccatcagctttccttttaattttatagacccacttacatcctatgacattcttccctctctgaggtgggactaagtgccaggtattatttctgattaaggcatcatattcagattccatagcatttttccaatttttatctttaagagcctctatatcattactagattactaggttctccagaat

SEQ ID NO: 31741 - DNA, 747 bp, Oryza sativa
  unsure (1)..(747): unsure at all n locations
ctatagggcgaattcgagctcggtacccatcccaaaccttttgcattcaccagactatccagatattaaactgcaagtatcgtagaaaaaatcattgcatgcatatcgaactaatttgactttctgtgtactgatttgatcaactgagcttattcagattattatttgtttgacctggagcttattcagattaatattactggtgtgagatagattctgttccatcttcctggaaccattccaaaaggcaagcggtaaatcggacgcgtccgttttagatccaacggctgagatccgctccgaggcagatgactttttcaccctttccgtcattcccgtcgatgtctggaacgaaacagaggaaggcatagcagccgcctcactggcgatagtctccccactggatgcacgtgactgaccattggcttcagggatttggaccaaatgcaatatatatatacagcgtttttgaaagatatatatggtagtactccttccgtttctactccctcctttttttaaaaaatctgttatccattttttatattactgtaccgtgcatttgcgacgggatcagaagaaatatggtgtgggaggtgcgggccggtttgattttcacgggcgctgcgcatggtagggaaggaaggaggatgactggatttctaaagatgtagagatagtgtacgannnnnnnnnnnnnnnnnnnnnnnnnnnnnnnnnnnnnnnnnnnnnnnnnnnnnnnnnnnn

SEQ ID NO: 31742 - DNA, 612 bp, Oryza sativa
  unsure (1)..(612): unsure at all n locations
actatagggcgaattcgagctcggtaccctcacaatgttgttctaaatagatttgttttatccatcacattagacagatctatcggctcatcgagtattagattatcgtatataatctcgtgctgtatcggttaggttcgacctactatattgttgttgataatataaatcttgttgaactgataggttcatgctttatcggggtgctagccgataagttatctggatgttgcatcggcttataaggattacatataagttgggtttagccaatcgcaacaaatgttacactgtttaatctaatcttgtggattttacgacatcggacctgcagccgatgtatgctttaaccgtcggatcagtgcttattctatcatgtcaatgtcagccgattggtttatactggattaaattgttgctttcttgcattatcatcagccgattgcctttatgtcaatatctacattggacatatagccgattgctcaaaatcctatcgctatcggctggtatcggcatcggttggaattaatacatcggcttgtcannnnnnnnnnnnnnnnnnnnnnnnnnnnnnnnnnnnnnnnnnnnnnnnnnnnnnnnnnnnnnnnn

SEQ ID NO: 31743 - DNA, 1308 bp, Oryza sativa
  unsure (1)..(1308): unsure at all n locations
nnnnnnnnnnnnnnnnnnnnnnnnnnnnnnnnnnnnnnnnnnnnnnnnnnnnnnnnnnnnnnatgtgacaatcgatgttagagtgagggcatattcagcttgctgtatgggggccaatgacctattgcagcagtaagcatttgataaaaaatgtgttgacgcgaaaaaacacacactggccagggagatctgcatagctccagtgcaggaccaaatgttggtgagatgtgggcataccagtcagtttgaccctacaactgataagatatacaaatagcagatcaatgtgccgatcggctgacaagccgatgtattaattccaaccgatgccgataccagccgatagcgataggattttgagcaatcggctatatgtccaatgtagatattgacataaaggcaatcggctgatgataatgcaagaaagcaacaatttaatccagtataaaccaatcggctgacattgacatgatagaataagcactgatccgacggttaaagcatacatcggctgcaggtccgatgtcgtaaaatccacaagattagattaaacagtgtaacatttgttgcgattggctaaacccaacttatatgtaatccttataagccgatgcaacatccagataacttatcggctagcaccccgataaagcatgaacctatcagttcaacaagatttatattatcaacaacaatatagtaggtcgaacctaaccgatacagcacgagattatatacgataatctaatactcgatgagccgatagatctgtctaatgtgatggataaaacaaatctattagaacaacattgtgattgtagagatatatcggctaagacagaagatcggacctaactgagacagtcccaactaaactgatgcgtctctaaacacaatgcaattagagatagaattgagatatcaggtaggcaaatatatcaaccaaaccagagcgatccaggagatcaaagcgatgcagccttgaacaacaccaacgcagccgatagattcgccagggccggcggaacgtaggacttaccccttcgccggagatcgaactgaaccgatatagccccgcgtcaggtgccaaattccgccggttgaataagaaaaaacctcaaaaaagagggtggcgatgggccgagagtagttgtattgatcgagagatatttgtacaatgaccccgggtgtacatatttatacccatggtaagatactagtccttgtaggacaagaaagaaactttcctaaaaaaannnnnnnnnnnnnnnnnnnnnnnnnnnnnnnnnnnnnnnnnnnnnnnnnnnn

SEQ ID NO: 31744 - DNA, 9005 bp, Oryza sativa
  unsure (1)..(9005): unsure at all n locations
acatcgatgctctttggtcattgagactcggttggtagcagcctaggtgatatgcgcacaagcaagcagccctagcatatggcccactaagggctagacaaaaaactcgtggctcattaacttactcatctcgtgactggctcacttcgctcgggtaggctcattgggaattactaacaagtcaagccaagtattttgctcgttaggcataacgagctaactcgacttagcttgcaacctaaatgagctggaacccaacagcaggcaaccatgaaagcatggcctagtaacagcccaatcagccacaaggcccatcacaacccaagtaacagtgtcaaaaccctatgcaggcaaaacaacagacacaaataaaaaatgcggccggtgctggaaagtacaatcgcaaagagcatcaactgccacatacccttctgaattactatagcatcgatttgtaaaaatacaagtctcgtgatcatcacttttcctatctgaatgatgcgaaaattaactattttaaaattctaaaaatcatcccaactcggtttgatattgcaacctattttgtttggcatatagcaaaacttgctgcgacggtaattaaacatcttttagtaattctatctatggtatctcactgctgaagaatccttttgtactccctgttcataactgccaatagtcccggttttccaaccgggattaggaatccgggactaaagatgcccatctttagtcctggttaaaataacctggactaaagatgccaaccatgtttagtcccggttgatgttaccaaccatgaggactaattttttttcttttttttctccttcggttttttcttttatttttcctcctttcatatcttttagtaattctacctatggtatctcactactgaagaatccttctgtactccctgttcataactgccgatagtcccggttttccaaccggggctaggaatccgggactaaagatgctcatctttagtcctggttaaaataaccgggactaaagatgccaaccatgcttagtcccggttgatgttaccaaccgtgaggactaatttattttctttttttttctccttcggttttttcttttatttttcctcctttcatatcttctcattcacagcacgattcacagattcatcacaaatacatcacaaattcattcacaaacatcacagattcattcacaatatcgattcacatattcattcaaaacatccacaaatcaccacatccacaaatcataaacaaaataaaaaaactaaaaaaaaaatcaaatcaccgtccgaccaccgcccggcctcccatcctgccaccggccggccacccatcctactacttcccctccggccagatctggaggaggggagggcgaggctgccggtgaccagcctctatcccgccgggccaccgccggccggcctccatcccgctggcctgcgcccggccacccccagcccgcgcccggcctccatcccgccgccggctgcctctgcttccgccgccgcctgccggagggtagtagggggagggggaggggagggaaggggaggaggagaggaggngagagaagagcaagggtaggatggaaggagaaggatggagatgagggaggagaagaaaaagagataaagatgggagatggaggctgngcatgcacaggatggaaannataagcaccggagatggtgcactcgtgcgggtggacatttttcttcctggttggtgttaccaaccgggtataaagatcaacttgatcttcaatccctgttggtgttaccaaccggaactaaagtttccatctttagttacggttggtaacatcaaccggactaaagatcccctggggcctgacaaactctaacacaatcccaactgggactaaaaatcatccgagtcctaattgttattaccaaccgatactaaagatcgcatagtcctggttggtattaccaaccgggactaaagatcacatagtcccgttgcacttataaactggaactatttagtcccggtttataagggaaccgggactattgtgaaatttggtcgaccgaccaaatatcatttctctagtagtgtctccaaaagaagtgtcatgactatacttctataagtatttaattttggtaaaaactatattcataactcacattttatgagaacatattgattcggctaagcatgtttgaactggggtggttttacaccacaactaagtagtagggtggacatttgtaagaaaaagacttatgaggtagaatgtcagaacttaagttatttttagagtggtttttataactttaagtcacttgtttcattcctactatgttttttttccctgagggtttagtcgttatcatagtgatgtctctctgccgcttcaagaataaaaaacgaaattataatttattttccatttctttaaattaatcattttcaccatttaatagattgattgtgggcctcctccgaagaggataaattataaaaacaaacgatattttaggtccattgtacatgagaacagtgtaatgcacattttcgtggcggaatattatatacgagtacctattattacaggaaatcgtcggtatcttcttaaacaatgtacatatatagactgataaattaaatcatacaaaattttacttatattaattcacggctttcatatcaatatcagaaagttattagtaaagctacaaatattcatacttattttgcaattagaaatctttgttttaatcgggtaaaaaatttgaaatcccatgttaaacaggaatacaaacatgttataaaccacgcctatgccattttttatagacatgaaaatttgattgttggatccacagaaaaaattatagcatcgattcctagttttgtagcactactacgaaaacattttttttctagatgataccccgcacgttgctgcgggacatgctcaaaattcagctattggttaagtaaaaaaaaagaatatgctatccattgggtaggacatgcatcctcaagctggaaaatttaaaagataataataaatagattttttgaatcaatatttttttagtagaggaacagaagttcttaaaaacaatatatgttaacacattttagctaaaacttcaaaagatgcgatattgtttgggatcatgagttaacatacaatgttgtgtgtttactcataaaacgttgtcacaatgtagtttacattatagagggatagtttacattgtacagtgacaatttatattgttctgtgaacgctagccaactaaaactcatttcaccgtcttcctgttaaatggtctacatattataattttggtgaggctttcaaatttattgtgtggatctacatataaccatgaatccaataaatattatttattaatccataagagaaaaaaatcaggaaatacaggaatttcagtaatacactctaatggtgatgacaccacaacacttaatcaacatttaaattttttattgttgggatctagggaacacataaaaaaggttgtggtaatctgcttgctttgttgcactgctccaactctagtatttgtttaaccgttcaagaaaaaaaaaactctgtttaatgaagagctgaaaggttgaaacagaggatcgcataacgataagagacggtggtacgaacaaactgaaaagcacagtgcctgcaatttcagaataacatcagaaattgacaacaatatatagaatgtgcaagcaatttaacatgtaaaaaagataaaattgaagcaagaaataggtgaatgcaaagcaaatatgtggccaactaaacatctaatagaaacttccaagtgatcaatctaacgaaaacatgcttcacaaaagataaaactgattggccaagcatgatcacaagtagcgatccatgcgcaatgggagatcgaggaccgatgaacgaacccgtgcggccgtgccaccgattgagcaaagaatagcgtgtgaatatatcccactggttccttacattggcgtgtgggtgtggatgactcatctggtcgcactttttataggttatgggtgttgccgtcgagtcgaatcctattgcagttacgaaagtccaatcaatctctaatggctaacggttccaagaagaggaagcgcaagggaggagatgggggtggcagaaaggcggtagccgaatggcgcggttggcggcgacgctcgcacgcaggcggaaggatgctttgttgccgagaatagggaacggcataagggtggtgggctgggccgatgagcaagatgggctaggagagaaggggaaagggaaatgggcttggagaaatacactggatggagcgatctaggccatccaagcttcatcctatggctaaatctaattagggatggaaaataggtattaattgcagtttttggatcaattgtacagatatataggatgtacgggcaaaaacagtttttatgtgcggaggtggcgcccgtctgcccggaagtgtcttcaaaaatcagggattctctgtgcgggtggcgcacccaaatgcggaaattggatttttgcgtgcgggtgcttatgtcgaccgtacgcgaaaataaaaatccgaaaaaaaattaaaatcacgaaaaaaaatagaaatcgcatattgccgttttccgatcgttactgcgctgctttaaataataaccgtcacctccaagaaacttcacaccgtcacttccgttttcaccgcctagaccatagctgtcttccacctctccggcgatcccctcggcgaagaaagcaatctcaaaagcaactcccgttccagcaaacttctgcctgcaacgatgtcgtcccccgctagttcatccgcagctccatcgcctgagtacgcagaggtaagcccttaccggccaaatcccttttcttgtgcagcagatcggttttcctcctctcagtttgttttcttctttgcatctgtagcacctttcaaatttggttgcgattccctgcttagcccacgaacatcagtttttcctcggtccgattagtgatctagatccaacagagctcatcatcgccgaaaccagtaggatctcatacagaataggcaaccccaacctaaaccattggaaaaacattttcaaatcttggccctcattggagaaaagctggcccgcatggtataagcatgtatcggctagcaagcaggttcactggaatgaactaggaatcagccaagcactagcccttaccctggaaaattcagctaaggacgaaactttgatggcttctgccacgtacttctggtccaacaccctcaacgccttcatgttcaaccaagggccgatgtcacgccttgaaaattgcataatttaataattcattctttaatgcatttttagaaattattttaaaaacctacaagttaaactctaattatctaggaaaaattgcaacataaaattgagttagataaaatttctttaaatactttgcatgtttatctattttctagatttttctgggaattatttgagcaagtaaagtatttttaataaatgaaacattatttcactaattattttaattgaaaaagtttttaaatcttcccctaagccgttgggctgattccacctcatctccctcctttaggtgcgcagctgtgcagcccaagtcagcccagccgagcttccccttctctttctttctttgttttattttcagccagccaaaactgaaagtctactttgcctccctttgcactgttcttcttcaacctctggcagccgatatgagaccgagttggttcggtttttctcctccaaatccggccttttctcttgtgttttcctaaaattagttgaggggaaatatttcccttatctccctctttcgtttccctcaaaaaccgaagtttaattccttgtattttacccgaatcaaattcgttttcgagtttatttctccaaactaaccatcggattttccggctcaaatcctctcgtatggagtccgatctccctcacccatgcctatataaagcatcccctagtcgtcctcttccgtttgcctcaagtcttagccgcagccgttgcctgtagcgccgccgccacgtgagccctagcgtcgctgccgccgtcgctgcttcagccgcgccgcagctgtggtcgccgctgccgccttccgtcgccaccgtcgggttcgccaggtggaggagcatcccgtccgccccttcgccgctgctgcatctcgcgtgagcgccgccgccgacatcaagccgagccgtgccgctgtcggagctcgtcgccggtcgtcgttcgtcgtatttctttgcaccggtgagttcgcgtcgttgtcctcttcgtgtaggtgccttcggtttagccgcccgagctctctatcgtcggcggagtcgtggtccagtgccatggctgcgatgatgtcatcgatgacatcataattcccttctaaatctctaaaagcttttctgtattagatgaaatctgattaaaacttcggaaattcataactaaatcatcgtaactcggattcaggtggttcaaattgctaatttcacctaaaatcgagatctacatgataaaaatatccacatgtactgtttatgcttgtttttttactgttttattgattttattcatttgctttagtttccgacgttccggaggagagcgtttacgttgaggaatgttcagaagcgtttgaagaagatcaaggcaagtcacacagatcccaaacaaccctttgagcatgttgaacatgtttaaagctaatgctttatttcaacttatgcattatttttcgaatgtcatcgggtagtgagactttcccagttaattatggccgaagatgactttattttcctatgggtaataaattgattagcttgaaccttatatattggtttggttcagctaaatgctatatatatataattgcttagccatgcttagaaacattagctcattaatgggatgattacactacattattacacatggatatatttaatggtagctcacgatggttaatcgtgttatgaaaattaattgataattaaaatttaatgaatgatgggttgtgagtacatggttttgatggtcatgctcagtcgtgagctactgttgtgcaacattaaccgtaccaacctcaagccagcgtgggcaacggctttaccttttgtgtagcatggttcattacggggtgccagactgagaagcggcaagaaatccatgggggtcgctggggagtccatgcctttggttgtagagggggttattatgattcaggtatggtgcactatggtgagttgtattgtacgaggggtactgtcacagttcctttccgaggtaccgtggtggtattgaggtgcatggtgacatgttgtggagctgtgtcttgtgggtacagtggtacatctctggctagagtaaaactattcaaatagccgtgcccgtggttatgggcaggtctaacaatgtttttcatgattagtctcacactacttatcattggtgataataatgtgataattaatttgactcctggtttggaatggtatattcctggtatggaggtttgatttgtacagccggggttggttgatttgtactcctggctttgttgtatagtgtttatttaatattgcttaattactcaactgttttactattctctcaaatgtttattaaatgttgtttatgcaaataagctatattgtgccatcctttgttatcttgtgcacttgcatatttgctgtgtggcttgttgagtatgtcatatgatcattcttgcaatattcattcatcagagaaggagtacttcagtgaaggtgatgatcaggaggattaggctttgttcgggtcaagttgcttgtggagtggagtcgccatagctgtttagtcttttgtttattttccgctgcgtagaattttattcttttgaggatgcaactatccacctctgtaataatttattattttgcgaatattaattagctgtttgatagtactctattatcaatttgttattgtgtgcctcggctgattcctggacgaggatttaacacacatgtaagcttttggaatttttgatagaaattctgggcgtgacaaattggtatcagagccaccttgaccttaggacaagtcaaatggtaaatcttaagtagccttcaaaatattttgaaaaataggactgctcttctctattatcttctaaattaattaagttggcagcacatgcaagttaggtacaaaattttctaaatcctactttaccaaaacagaacctgttcttttctaaaaaaagactttactgttcagggtattaaatagtttaattttatgatttcattggttagtcggcactgtagtatcgattcaatcaagatagcactagtactactcatccctgttaatggtgacactgtaccgtgcttatgatagatcctaagtatttagttttattttattaatttatctaaagcaatttatctctgtccattgttgatttttttcttccaaaacaaaaaattttgtttcgttatgttctggcgagtactgtacaaaaaaaatatatttgcttctttttgtctacttccaaagtctatactcctgtttaaataaaattctcgggaaaaaaagttctgaaaaagaaaaaaagaaaaaaacgaattgatttctgagaatttatgtttcggtcagaaaataaaaattcgaaatttaattaaaaaaacgaaaaaaaaattagttttgtttgctccttttcttttatttttctttttggttcaaattaattgagtctagattgtgcagctaacttaagtatatgcattaattcttcctttctatgttcctttagatgccgccccatccaccggaaagcttgatcgatgcggtaggattcgtcagggagctgagaatgatggcatttgaagtaggctacgacgttgcccccgagtatcgccaaatttatgtgaacccaacgag

SEQ ID NO: 31745 - DNA, 9787 bp, Oryza sativa
  unsure (1)..(9787): unsure at all n locations
nnnnnnnnnnnnnnnnnnnnnnnnnnnnnnnnnnnnnnnnnnnnnnnnnnnnnnnnnatatgctttgcgccatggatgcagttggcgtggagcgggagaaagcagctcatgagagggaaatctggaaccgtggcaagattttcaagctagagagcaaggtgtatcgcttgcagaaggaacttgccaagctcaagagagaagcaccgccgtcaactaccccaaaggaggaagatccagaagaaagagagctagctaccccagaggaagaagatccatctcttcgctccgacgcaaggcgggattagtgcctcgttagaccgttatcgtagttcgttgtgttagtttgcttgtgcgtgtgtgggtttagcgtgttgcttacatcattggtgggatgtaactacatgagcttagttcttttgcttgtcagagagtaaatttgctggtgagatagtgttaattcgatttaaatgtaatcatacacagttaagaacaatagaaattaaattaattaagttatccgttctaagggtatctctctgtcgttctcccctcttgcccgtgttttcttcagatggtgaacactcgcaccggaggaagtggaagtggaagtggtaacaatgaaggaattcctttcccatccaaacttatcttgctagaatccaagatcttgatgttatcttagggatggatgggctaacctgtcacagaggagttatagattgtgctaaccataaggtgactttatccagtagcaatgggcaaacagtgtctttctttgtgtcctcccctagatctcattgtttgacattaaatcaagttgctttgcatgagatcccaatagttcaagactatccagatgtattccttgaggatttgccaggtatgccacctaagagagacatagagttccggatagacttagtacctggaaccaaccctatccataagagaccttacagaatgggagctaatgagttagtagaggtaaagagacaggtggatgatttgcttcagaaaggcccagtacttcatcgtggggagcaccagttatcttcgtggagaagaaagatcatacccagagaatgtgtgtggattatcgagcgttgaatgaggtcactatcaagaataagtatcctctacctaggattgatgacctgtttgatcaactggaaggtgctacagttttctccaagatagatcttcgttccggatatcaccaactccgaatccgtgaggaggatataccaaagactgcctttacaacacggtatggtttgttcgagtgtaccgttatgtcgtttggactcactaacgccccggcctttttcatgaacttgatgaacaaagtgtatatggaatatctcgataagtttgtcgtggtgtttattgatgatatccttatctactccaagacaaaagaagagcatgaagagcatcttcgtcttgctttagagaaactacgtgagcatcagctctatgccaagtttagtaaatgtaaattttggttgcccgaagtgaagttccttggtcatgtcatctcagctggaggagttgtcgtggatccaagcaatgtggagtcactgctaaattggaagcaacccaagacggttaaagagattcgtagtttccttggtcttgcggggtacaccgcaggtttattgagaacttctcaaagattgctagaccaatgacttgactgcttcagaaggatgtgaagcataagtggacggatgagtgtgagcagagttttcaagaattgaataaaaggctagtgactgcgccagtgttagtcttgcatgatccatggaaaggtttccaggtgtattgtgatgcatctagacttggtttgggttgtgttttgatgcaagatgggaaggtggttgcctatgcatctaggaagttacgccctcatgagaataactatccaacacatgatctagagttggcagctatggttcatgcattgaagatttggcgtcattacgtttttggtaaccgtacgaagatgtatacggatcataaacgtttgaagtacattttcactcaacctgatctgaacatgcgtcaacgaagatggttagagttgattaaggattatgatatggaaattcattatcatccaggtaaagcaaatgctatagcggatgctctcagtaggaaaagctactgtaatatgtcagaaggacgacatctaccttgggagttatgccaagaattgtaaaagttgagcttgggaatagtcaagaatggttttgtggccgcttgagaagttcaacctactctttttgatcaagttagagaggcaagtgaatgatcctgatatccaagaaattaaatagaacatgagaagagaaaaagccatcggttatatagaggatgagcaaggaactgtgtggctaggagaaagaatttgcgtgcccgacaataaggagttgaaggatactatcatgaaagaggctcatgaaaccctgtattccattcatcctggaagcactaagatgtatcaagacctgaaggaacaattctggtccgcatgtgacgagagatagcggaatatgtggctctatgtgatgtgtgtcagcgagttaaggcggagcatcagaagctagccggtctgctgcaaccgttgaagataccagagtggaaatgggaggaaatagggatggatttcatcaccggtctacccagaacgtcgacaggacatgattctattttggtagtggttgacaggcttactaaagttgttcatttcatacctgtcaaaacaacctacttaggaaataagctcgcagagttacatatggcaagagttgtatgttcacatggtgttcccaagaaaataatgtcagacagaggtagtcagtttacttcaaagttttggcagaagctacaagaagagatgggtactcgttttaatttcagtgctgcctatcaccctcaaactgatggccagacagaaagagtgaatcaaattttagaagacatgttgagagcttgtgtttagatttcggtggaagttgggataagaatctgccgtacgctgaattctcttataacaacagttatcaagctagtcttcaaatggctccgtatgaagcgttatatggtcggaagtgtcgtacaccgcttcttcgggatcaaaccggtgagcgtcaagtttttgggacagacatgttgcgagaggcggaagaaatagtgaagattatccaagaaaggttgcgtgttgcccagtcgcgtcagaagagttatgcagacaatcgtcgcagggatttgactttcgaagaaggggattatgtatacctacgggttacgccgctgcggggagttcatcgttttcagaccaaagggaaattgtcaccgcaatttgtgggaccttataagattgtgagtcggagaggtgaagtagcttatcaactagagttgccttcgtcaatggcgggaatacatgacgtgttccatgtttcgcagttgaagaaatgtttgcgtgtacctacggaggaagcagatcctgagcgtatagagcttcaagaagatttaacttatgttgagaagccagtccgaatttcagaggtaaatgagagaaataccaggaatcgcgtcatacggttctgtaaagttcagtggagtaatcattcagaagaagaagccacttgggagcgagaagatgaattgaagtcagctcatcctcatctttttgccagttcttctgaatctcgaagatctgcttaacttcagtgcaggtccaaaatcttgcctttaggttcgtgagcgtaccggttgatttgatcatgcaatcaacaagaaatcgtttgtgtagtagtcaggggtttttatattccgattaatattcgtcaccgtattcgtttcgcttcgtattcgctccgtatttgtatttgataatattcaatttcgtttttatatcagagtttccgatttctatttcgatttcgaacaaaatataaaaacgaatatgatagagctagtttctaaccgtattcgatccgttttcatccctaaatgcgtgtaggctgccctcttttttctcagttggatgggatgctgctatcgtcgttattgctgtcagtctctccagcccagggttttctgtttcgaaaaagcaagaaaatttcggtgggcaccgaaattctgaaattttgaaaaattcggatattccgcacgaacttttttgaaatttaaacacatttttactgaatttgattaaattatgaccaaattcacaaatatttggaaaaaaaatccgaaatttcgcttgaaaaaatctgaaatttccatccctgctccagcccaccatgtcctcatcctctatgcctcatatcagccacactggagtcctcatcctctacgcctcctgctccagtcaccggcaaaaagcgtcctcagcgatctctggctgcatgtgccacgctgcctgccaccaccagccgtgagctcctatttctgcctccgtcggcttcacctgcagatgcacactcgctgctgccaatgatattggaatgtaggatgcctccaccactcgccttggctctttctgccaccgccctcgatcgactccggccatcgtcgccacacttagtcagttataacattaatattagcaactaaattctaactttcaacgaccaaaatttcatgtcattattaccggcacttgacaaatagcatctgtgaaatttgaatttaaacctggatccattactgaaataacatgaataacagaaatcgaaagaatatttgatataagtatatatgtagatggattgccatgttggctggaaaattaacaatcaaggtctagatgggaacaggcttgacaaagagagactcaacgatctccctaagaagtgtgccaaatgtgtatgcatccttcttgtcatcgtagaagagtgccatggaaacggtaaagttcacaattcgctgcaccatgggtagcagtgtacgatgctcaagtcgggtctggttcgtggatctccattcgtcttcgactagtgcattaatcttcgcaaaggcagcctcacttgtgaccccattctcattcatgtagcactctacggagctcgcgacatctctcttattctttccacgcttcacgtgtatattacatataaaaatataaaaagaatagaagtttaaatagaaaataactattggaaggcaatatttattttacttgttttgttcgtaatcagatcatgtttttaattattatatgtagtcaaggctcaaaatataactcactaatatatgcaaatatattaagatttattatgtgaaaatgccattataacttgtatgcttattgtaacaaataccttcatattgtaatgttttcataattttcatgaacatatattgattagaaatggcaatgttaaaaatgtgtattaattagaggttattgatttcataacacacaactaaaatagaaatgcaaaagtagtgacatatatgtaccttaaatgcagcaatatcattcatgaaacgcccaatcttagcacatgctatgactgcagcgttgccactagctacccactcgaatgcttctgtcgtcattgtcccaccccagccaaccatagcagccacacacaataattgcacagctgaggatttggtagacaaaaccacctggtctttgaagccaggcttgtatttctggttcgaccattcagcttcttgcagataataagtggactgcttttgaaactataagcaaaaaattaaatcaaaatcaataactacaggataatgccatcagaacatatatgtgcaaaaaatagtcttatctccacactcgaaaagtatgtaatatctatattttggtgtgtgtgcgcgcgcgtgtgtgaggaatatacagagagagagagcgtgtgtgtttctacctcttcttttgtgcaagcaaccatgtatttttcattgtctgtcacttgatcctgaaactccttaaagttgatcagcaatttactataatactttttgaggtactccggcagaatagaaatagcactcttgtcccatctgcactagttttgcacgagagttagtcgtgctagatacattatttctcattttaatgatccctcaattctttctttcttgtcaattaagacatttacatcaactgatccagagcatacatttaatcattatcttttctaatgatatgtccatacctcaaagtatttgaaatataactgcatgaaagtatttttcacgacaatctaatactccttctgatcccaaatataagtcgttttaatattcccaaatatttgccaaaatacaattcgtttcaggaattgtatgaacttcttttatattttcttacctcgacaattctctcacaaataattgacgatttctttccaatgcagaataaatgaaggacaacaaagtcatttgaactatttattagttcttgtatccaagtctaaaacaactatatttagaatcagagggagtaatgtcacgccatagaaatttgatatcttcttcgatatatttattagtaggctaagatgttacaatttgtcttcacttgtcaggatgttatctattttggaatggataaagtaccaataaacaattaaacatactgaactaatcctacctttgtatcgctgtgttaagctagtggcattcctcgatggtggcatgagcatcatatgtatcatccatcacagtaaccagtgcaattaatttggcaacaaacattctcgtgaatgcaaagccttcctcatagaacatcatgtaggaccaagtgtacccctctattgtacgatccctaatgtaacttagccccatgtatccataaagatctttccaccatctggaaaataatcattccaagagtgtgcttagacctttagttatatgaacagataaggagctaatcattgttttacagtgctagcttgtgggtattgggtatcccatggataatttttcaaaatatatacaatgtcagtgtagttttgcacacaacaagagcattcttctgctccaagataataagtgtatttactccgaataaaattgaatgctgaggtgacatatattcttaagaaccagatagtatatgataacatgcattcctacgaacacctcttgccatcaagtacatatgtgaaaggcatggactgttaatttatttgcacttaacaattttagttatttagtgcattccaatattatctcaaatgacctgttaattatccttttagataatggataaaccagttgttgtatctaagatgcacaaaaccatctatcatttatctatagtcaacaattatcaaagagatcgatcgacaggcatactcagaaattgctttgagttctttcaagtgaatatgttgcaggaggttaaaatccagccttgcgagatcaagaagaattgggatatttccttcctctagttggtactccaacatgtagcaaatagtctcaactctcttgaaagtccttggcagtggtaaggtaagtgcacgcctgacttggcaagctaaaggagggttgagaacattgtcttgactcatcaatttaaggtgctcccgtgcgaaagtgattgcttcttcaagctctggctcgccatgaatgaggaggtgagccgcgttgtataaacttagtagcccccttgggtcattcgctatctcatttcgaaacctcccatcatctcccttaaatttgttgaatgcatctgcatgacaaaaatatttctcattgataactagaaggttgggttattttttatccataatgcgactagtttttcccgcaatctacaaaacgctttttgctgtacccaacatcaaattagaaccctctgttaattttcttacgttgtgtaagctgtttgttttagactgacaaaaataaattattgtgtcttaaacaaattaacaaaatgtaagttttagcaactatcagcaaatgcaaagataaaaatatctaatcagggaataataaattgttggtatatataactgtagatacaaatagaaagagctgcaaacatctcctaaaaaaagttttaggttggctactaataactgtatatttgatcttattgaactacagaagaagcaaaaaccagcaagacctgtcccacaaagtttggatcgtctatggtgaatcagaatcaataacgatttttgttcggcacaaatttatctgttccatattcgtagatggatgtatgcagttggatacctggaggcacccaaaacccatgctccctaagcaggcgaaaccgaagagcaacctcatagagactagagcttgtgaattcactctcatggatgctcattagagcatcttctatctgctcttggaagaggtgaacgattccaagatgttgaatggaatccactaagttcatcctcgccgaaatgtcattgcaggtcccaaacaatgtccggatgtcccctttcaacttctcggccctctcctgcatacatgtctctgatctctgcttgaaattaagtatagattcatcagaacagttagttagcatcgcattaatcagaatgcaagggcaatgcatatatgggaaataacagtgtggtaatgcctgtaatggttgtggttcatagttgataaagaagtcgccccacacagagggctcaaagccgagtacctcctcatggacagcactgtctctcgacaccataatatgtaatacttacgagcaaatatgagagattagcttgatctttatgaatgcaaatgtgtggcacctcaccttatatatagacacaccagaatactgtagttatgtgctctgtccgtttttgttgtatgacgtgcttttgaacatgacattcaaccgtttatcttactcaaataaatattgcaaatatgcaagaatataaatcatgttgtttgtcaaagaacaacactgctcttaaggatatttgtaaggaaacaactatagcgtattatattttcaaaaacctgcttattatggaaccatgggataatcctagagtttcctttacaagttgttctacattaatatcaattgattgggaaggttaaatggatactcactttctagccttcatggatctagtgggccgtagctgagctgcttctttttgatgggcaaagctgaaagctactttcctgtggccaactcatccgtagcgatcttgcccgcctatggtggttttcatcatcttcggtggtgcttcaccatctttggtaacctttggcatcctcaatgtccttggtagccttcgccacctttggctgccatcattacctctggtgggatttgccactcttgatggtcttcgtgatctttagtggtttcgaccatcgttagcggtctttcttaccttcggcctctacattcccttcagtagctgccagctgaagtagttcgtgacctcccaaaacaatgctaaaggacactgaatgataaaagaagtaaaagtaataataatatgggtggtcagacatcatgtccaaaggtgaaaaatgttatacatttgtaaattagagttatcactaattactttaaaggatcgtcaaagcacgtgtaggggcggcttatgcgggtgggcagccaattattgcttgcttgtaccattacccatacatgagagttgcaatcatgtcatatatcgagtcaaatgcgacgtctcttgtactccctccatttccatctaattacgattcgagccacccaaaggccaattaagagggggcctgacaaatgactttagaaagctgtcatgacattacatatgggattgtcaggaatggg

SEQ ID NO: 31746 - DNA, 4233 bp, Oryza sativa
  unsure (1)..(4233): unsure at all n locations
nnnnnnnnnnnnnnnnnnnnnnnnnnnnnnnnnnnnnnnnnnnnnnnnnnnnnnnnnnnnnnnnncaactcatccgtagcgatcttgcccgcctatggtgggtttcatcatcttcggtggtgcttcaccatctttggtaacctttggcatcctcaatgtccttggtagccttcgccacctttggctgccatcattacctctggtgggatttgccactcttgatggtcttcgtgatctttagtggtttcgaccatcgttagcggtctttcttaccttcggcctctacattcccttcagtagctgccagctgaagtagttcgtgacctcccaaaacaatgctaaaggacactgaatgataaaagaagtaaaagtaataataatatgggtggtcagacatcatgtccaaaggtgaaaaatgttatacatttgtaaattagagttatcactaattactttaaaggatcgtcaaagcacgtgtaggggcggcttatgcgggtgggcagccaattattgcttgcttgtaccattacccatacatgagagttgcaatcatgtcatatatcgagtcaaatgcgacgtctcttgtactccctccatttcaatctaattacgattcgagcaaccaaaagacaaattaggagtgtgattgaaaatgactttagatagctgtcatgacattacatatgggattgtcaggaatgggagcatgggcgaatttaatgttggggcttgttggggctaaagccccagctccaacaggacagggaatagcgtgtgctagagcacaaggcaggagaagcaggttgcagggaggagcactaagaccctgtttagatgagactaaaacttttaagtctctatcacatcaaatgtttggatactaatgataaatattaaacgtagattattaataaaacccatccaaaatcttggactaattcgcgagacgactttgttgagcctaattaatccatgattagcctatgtgatgctacagtaaacattctctaattatggattaattaggcttaaaaaattatctcgcaaattagcttttatttatgtaatattagttttgtaagtagtctatatttaatactctaaattagtgtctaaataaaaagactaaagttaagccctgaatccaaacaccacctaagaagaagctggtcaactagtttgctagtaggaagaagctggccaggctccatagcttggctttatccatttagacctgctaggcttatagggtgtaggtcatgataaaaatatgaaatcatttttttgggctttaggcataaacaaacaactaatttattctttattgtcaacatcacaaaccatttttatcttttttggtgttttgatactgatttgaaaatttgagtattacgttgctagcgtaaaaattatcttatgttatgtattaaactcaagagccccagcttaattttcattctagattctccactgattgggagagtgattgagaatatgatggagaaaattttgaataaggagaagttacattgcaagggaaaaatattactgtaagaatatgcttattttagaagaaagttctgatctaaaaaaatgcactttattagaaatgggtgtagcacatgaaacatcttcaccgacagctgtggatttttatatgcttttaattttggcgagtagctacaggagacaggcgactaaagtaacaagatacaggctgcacacctgatatgattggctgaatgttcacacgtgatatgaatgatgtattgtttatagctactgacgcggacggcgtctgctggcgtttctcggtgctgatcgacaggccgcctaccgatttctcaatccagcactacttaataaaaaactaatagaagacacccatatatatttggggaaaatccaaatacccccctacaagtcactgctctttctactctcccccctacaacttaatattgttcaaaacactacacataagttaatttctcttccaatttcccacccctattcggttttcacgctttctcgtgatgcgctcaatttctcgttatcatgggccttcagcgcaacccatggatggagttgcctcgtgccaccttggcggcaaaagtgcgcgcatctccatccgcttttaattctgcgagccatacgggtaggacgacatgacgctaacataaacacaggaaaacaatttttagtccaccagtgcaaaacaatagtgtctgcctcatgatttgtgattccacatcaatatgaagaatggcaacaccaagtcaaaaacacattccagaatatttaagacatgcttattgaagtagaatccccttaaaaatcacaattcaaatctgatagttagaagtacagaaaattatttgtcgtaaaaaagctggtactgagattaagaagggaccaacatcccctactaattgtagctaagaattttgatgtaaataatactactgcataaaaataggagatcagtttctcctaatttgcaactttcttccagtaggaccgatataaggcccatgtggcacatgatggtagagaccaacaccaaatgcattgtacatatatactggtggctatgtggatgttgttggaatatcatctcttgaactagaactaataggctgggaattgctcctcttcttcctcctagttatttgtgttttacactgagagaaacagacaacaaattgtgagaagtagcaaagtacaatgtctttatatgataaattagtagtgtactcacattttgagatgaagaactttggttgtcttttccatgctttctgctgttatgaccaaactctttgcagacgctacatctaattgttgtctttgcaaccgaccttccttgaaccctaggttcatcagatgctctagttctctttgtttttggcctccctggttgtgtcctagccacaggtgggtctacatctggaaatggagttttttcccattgtgtctcatcaggaacgggataaatcatcccacaatatgttctcgcatatgcatcctttgtcaatatgtcatcaacatagctctctggcctttgcatgaagggtaccgagctcgaattcgctgaaacagcatgcaaacatgggattccagttaaatcccattttctacacccacaagtgtgcttgttcaaatccactacatattgattaccaaatggggacacttgccaaatgcccctaccagcacacacagatttgcaatatcttgcctcgttcttctctgcctcaagcttctttaatatatttggtgggatttgccaattgtccctttctgcaccttccctcttattattgaaatcacccttcatttttgtccttatgtgctcaaccatggtaattatgggttcatctctagctcccagtatctttgaattgtatgtttcacttatgttgttaagaagaagatctgtctttgctctagaactgaacatatatctacaccaatgcttagttggaaccttgcttagccactcccatgccctcaaattgttagcctttagttattgcatagcagcattgaactcagattgtctatatgcatatgctgctcgttccatcaaacccttcagatattcccctctaaatcctgcttgggaaaaattggcatgtaggtgcctaaggcagtaacggtgctcagctcctgggaaaacttcagccactgccttgagtagtccctatatatggcagcaaaatgttaaaaaaacagttgacatgtattaatgcaaagtagacatatatgatagctattaccttttgtctatctgacatgaatacccagcccccaaactcttctccttttccaatggccttctccaaacatagtaagaaccatgtccaagattctgtgcactcagactccactaccgcaaaggcaatagggaaaagattattgttggcatccctaccttgtgctgctagtatttgagaaccattgttgagtttgatgtgacatccatctataccgatgaagggtctgcaaccacctaagaagccagtaatttgagcatcaaatgacaagaacaacctttgaaacctaggccttatttctggctcaggtgatacttcgcacttaacaaaaactttgcttcccggattagcagatagcacagcatgagcataatcttgaattcttttaaactgcaaatcatgatctcccataactttcttgtaggcctccctccttgccctatacgccttactt

SEQ ID NO: 31747 - DNA, 2558 bp, Oryza sativa
gtgatttcccacagctatgttttgaaacatacttctttattttaaaggtgtcttcaccaggcaattttgaagcatatatgtaccaaggacagttatctgccttacacttgacagaaacttgattcctatcattcttgcccttgaacacctccctccccatgttgatgatcatattcttcaaagcagctctaaaaagatcaacattactgaacaacatgccaacttgcatgtgtggacgccgtagggtggactcataaaaaattatatcttcaattcctcttgatctgtgcacatagataggtgcttcgtcattgaaatctattgtgtcatcattgggctcatctgacaaataatccacctcagctgattggcctatatccttctcttttctcttgttagtttttttccctactagttctttttcctgtgtagtttttccccgatgtggttctgcttggttaacctctacatctacctggttagtaccatataggtcctcagtatcagagtctccttggaagaacattactggctccttgccaataacaggttccttgccttttttcttttccctcaactgttgctgtacatactcttcatgcaatatcaaatcatctttatcaaaatcacctgggacactattatgatgtccaattaatgggatactacttgggcttacaaaccttgatgtgcttccattatcagtcaccaattcccgaggccttgcaaaaaagtacagtgagcactctgtttccgtcttatgatcatccaacatcatcttgatttgttcatcatttagaatctgtacaagaccttgtggagggacataagaaggcttcaagtagtatacaccatctcctttttgatatccatgtataagcaatgactcctccaaatcgataaatttcagagaatccctgtctaaaagataaatcgatgaacaaatcctttccccaccagatttcctagagcttccaccagttgtacaaccagtatgaacaatgaaggaaatactagttcgacccatctgcagagattataccaatttattggtttgcaacctaaatcaaagagcaaatattcgatgatctgaatctagtaagacaactacatgcataaaacatgatctaaccaaaaccagggagaaaaaacgaacctgtagaatgaattgacgaggtgatcgaagtacaggctgctttagtgcttccttctatgacttctcttgccgggcaggagatttgatatcccttctctgtactatgcgatcatcgtcgtacttcgccgttgtaccgctgttctttcgccgccttagtgttgcagtagagatcgcgaaattaaagcagggaaagatggaaagtggaaggaggtgcgcgcgcttttgctgccaaggtggcacaaggcaactctacccgtgggcggcgctgaaggcccacgataacgagaaattgagcgcatcacgagaaagcgtgaaaaccgaataggggtgggaaattggaagagaaattaacttatgtgtagtgttttgaacaatattgagttgtaggggggatagtacaaagagcagtgacttgtaggggggtatttggattttcccctatatatttcggttcatctaataccagcataaatgaggcttttccttgttctcctgaccccttaaatggatgtaaaactaaaaaccagcacctatatataacactttcaagttgaattataaaaaaaaaccaactataataataaaagtgctatgttttaataaaccagcatctatataagcgttggtttaaaagaaactaacacttaaatggagccaagatgagtcgagtgcgtggagtgtggaagaaaaaaataattctttgttggtcttatccttatcctcccagagtattctcattcttatcatctccatctcacttgatccccccggcacggcgaggcctccttgatctcccaggtgcagcggtgtccgtgtcttcttccgctgcttcttcctctcccctgcatggcgaccatcgaatcaggctaatgggagctcgtccttactctcccagtcaatcttccctctgtcaatcttccctctcttctctagtgaggtagaggaggaggcacgggtgcctctggtggtaatgacagcttgtgctgaaggattgggcggcgacggcggcttgaacaggcaggatctagcggtggcgggggttctcacgtgtggatatggcggcaacgacaactctattagattaaatgggccaagcataatttaattctaataaattccatgccgcttaattaatgttaagggaattataccaccttagtaatcaacatggagggatctcaactaaaataggctgctatccgagggtaactgttgagcgcttgatctggtggtgggactgccacatgtgcacgcatgcgccgagccgagctgagccgtgggcgagggtgaggtgtaagggacgggacgagacaggacgggatggattcctctgtcgatgttatgatgagggagttaggtcccgatcttccgatagatattgataaacagtcgatttgggcga

SEQ ID NO: 31748 - DNA, 8096 bp, Oryza sativa
  unsure (1)..(8096): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagggagccaagtggtcgagtgcgtggagtgtggaagaaaaaaataattctttgttggtcttatccttatcctcccagagtattctcattcttatcatctccatctcacttgatccccccggcacggcgaggcctccttgatctcccaggtgcagcggtgtccgtgtcttcttccgctgcttcttcctctcccctgcatggcgaccatcgaatcaggctaatgggagctcgtccttactctcccagtcaatcttccctctgtcaatcttccctctcttctctagtgaggtagaggaggaggcacgggtgcctctggtggtaatgacagcttgtgctgaaggattgggcggcgacggcggcttgaacaggcaggatctagcggtggcgggggttctcacgtgtggatatggcggcaacgacaactctattagattaaatgggccaagcataatttaattctaataaattccatgccgcttaattaatgttaagggaataataccaccttagtaatcaacatggagggatctcaactaaaataggctgctatccgagggtaactgttgagcgcttgatctggtggtgggactgccacatgtgcacgcatgcgccgagccgagctgagccgtgggcgagggtgaggtgtaagggacgggacgagacaggacgggatggattcctctgtcgatgttatgatgagggagttaggtcccgatcttccgatagatattgataaacagtcgatttgggcgaagtcacgacacaactcgatccggcttttgaacgaacacgctactgagccctacaatcgcggcaccacgtctcctctggttatcaaccgtaccaaaacccggttgaactcaccaagaaggctaatcgctgcatgcgaatcgaagaacacaagcaagaacaagatagattgcaaccaaattgcatatgaatgattaagcactcgaatttggggttccacaaaccgatctagcggcgaaactgttcttgacagaataatctatgcaaaacccaactctaaatgatgatggctacaagtatgattagggacgtcctagggttgccctagggcgcacacccccatgggctaagcccacgacacaattaaaaggcccaaaaccgaaatcagattcggactggatgaaatacgtggcttgttttgcagatttccggcagctcggtaggaattttcatgtgggaccaaaaccatctgaaagtagactccataagctttccatcaagtactcatgggccccaaaattccttctagatcagcggctaggtcggtttgaagttgatgctgtcaggaggcccgaatccgaatccaaaacgtgtagaactttatctcttatcttctatggaccaaaagtgacgtggtgagatggaagtggacttggagaaggtcttggtttggtccccaatcaacttcttcaatcatccatgcattccttacgcttggtctcttttctttcgcccaagcaagtacctctgcgaacgaaaacacacgaaactcattgtgtagcaacgtttgttcaaatatataacaagtaaatctaatatagaatatatgcacctttggttgattaatacgcaaggtagtcatggttatattcgagctagttgtgtcctcatcattctccccttcttgatttgaaaccgtcctcagttttaccttgtcatagagcgtattgaacttatcattatctgtctcaacatccggtgaggaacatttttcgatggccatatggttggatcctgaaatcttggtagtcgaaaaaccaccacactccccttcttgcagactaacatgtaactcatttaaacagctagaggaactagatagagaattacttatacgcatgtggtcctctagacaacacatttcatcatcaaaaggaggtatagtcaaattcgaacaaatatatactcgatgcacattatattctcctttactatcataattgccaataatatgaaaaatcacatcagaagggcatggcagttgagtggacaaagataatcaaattaaatataaccccaagtatttaaagaagatagcaatttaagctcttcattctcgctagcaatgtgaataacatgtttaaaatcaacacatggtggctctactatagaactaacatattcattcactagttgtggtatggatataagtgaagcatcgcacaactcttctttatcacaagaaacatgaaacaaattgttttgtgacaaaggtatttcaacaattgtttccactatgggttgctctaatgtagcataagtagtggacatagttggcacattataactatgcataccttgagcagttgtagcaccgttatctttaccatttttctcatcttcagaaattgtaggcgcttggtcaattaaacattcctcaagcatgcatgaagctatggataggtttttttcctcctcatctttcttctcttcctcattaccttggtttttctcagatgcttgcaaaatattagtattcaaagcaataggcacaacaatacgttggtttggtaataactcatacttagttaaaggcatcgcaatattagtatcattccaaatatctctgaaagtctcattgattctattcttcaacctttcaagatcatctttgaaaagtttagaaacactcattggtactaattttatttttcgaccattatgcctaaatgtgtatgtattggcaatatcattatgcaaaacattattatcatatatccatggttgacgaaacaacaaagaacatccttgcataggtacaagatcaaaatttgcaatatcatggtaacttccaatcgaaaattttattctcacagttctatttaccttgaacttaccacacgagttgaaccatttgatgtaatatggatgaggatgcagttgtatagacaactcaagttcctcaaccaaatctgaactcacaaaattattgcaactctcactatcgattataacacgacatgctctatccttaaccacaaacattgtttcaaataattcgtgatactgcctttgctccgctttctccatttgagaacttagcatttgttgcaccaaagtactttcatcacgtgcatctgcggaaggtgatgtagcagctatggtttgtctcccatccaactttatctcatgtccataagagatgtaacatgccattgtcagtagaaaaaagagaacaacataacattattgttcctattaactatagaacatggattgtagtggaggctagcaaatggaagcgtcttaccgagctcttacaagtgtcttaccagcaatgctaaggacagtacaaccggtggcaggttagtgacaccttgaaggacgtgatgtggcgattgcaaggatcaaagcggtgctgaccagaagaatatatgtggagcttgggaggcacaatatatagtagaaaaggaacgcaattgtgctaataagaaaatgcaaagttgaataatagttcaaagtactagtcaatgtgctggcctagcctagactcaactctagctcaagcaagcacccgacaacactaaggactagatatgaatcaatgcacaactctgcactctgaaaacatactcaaaggatgaatgattttttttctttcttggtgcaactttttttaagcacctttctgcctttttttcttttctttaggtgcggatttttctttctttttctttgcacctttctgcctttttttctttttttttattttttactattttttttcaacaagcactaacaactgacctcaaacagggactcaaatgtaaatatgaatattatagggactcaaacgcaaagtgaaaaactaaaattggatcacctcaaaaatggaatgctcatgtcacgtaggttctgtttttataaaaatatctctattctacaaccaccaaaatacccaacaatgtggtgaccgaggaggaggcagggaagaaaccgtgaagaggaggtggggtggttggccgtgaagtggaggtgttcggccaaagaggaattcggcagaagcactggcaaaccctagccgcaactccaaactcgaccgacaaaaacttctgaaaattacaaaaacggaatctcgacgacgaaacgattcaatatttcaaggtcccggcatcaactgacgacatacaaaactggtcccaaactgacggataactcacacgggcttgagtgatgaaccctagacctaagtgaagaacatatgcaatactcaaaagtagaaattaaatctaaaaactaaaccagcacacgacacgacgatgcaatctagaattcaacaaagcaaaatctaatagaacaatgcaactgctcaaattgtctaggtaaagaataactatttttgtgtgacaattttctggttatgggaagataaattacctaacgggcaacaacgctctgataccaactgatgagggtgttaggccccgatcttccgataggtattgataaacaaacgatttgggcggagtcgcgacacaacttgatccggcttctgaacgaacacgctactgagccctgcaatcgcagcaccacgtctcctctggttatcaaccatgccaaaacctggttgacctcgttgagaaggctaatccctgcatgcgaatcaaagaacacaagcaaagaacaagatagattgcaaccaaattgcatacaaatgattaagcactcgaatttggggttccacaaaccgatctagtggcgaaactgttcttgacagaataatctaagcaaaacccaactctaaacgatgacggctactgattaagtatgattagggatgtcctagggtttccctagggcgcacacccccatgggctaagcccacaacacaattaaaaggcccaaaaccgaaatcagattcggactggatgagatacgtggcttgttttgcagatttctggcagctcggtaggaattttgacgtgggaccaaaaccatctgaaaatagactccataagctttccatcaagtactatgggccccaaaatttcttctagatcaggggctaggtcggtttgaagttgatgctgtcaggaggcccgaatccgaatccaaaacgtgtagaactttatctcttatcttctatggaccaaaagtgacgtggtgagatggaagtggacttggagaaggtcttggtttggtccccaatcaacttcttcaatcatccatgcattccttacgcttggtctcttttctttcgcccaagcaagtacctctgcgaacgaaaacacacgaaactcattgtgtagcaacgtttgttcaaatatataataagtaaatctaatatagaacatatgcacctttggttgattaatacataagatagtcatggtgatatccgagctagttgtgtcctcatcacgttacgatttgctttgatgaacaacaacgtaatctggtttctcgggaaaggtctctgttcttctgttcctgagttgcgcatttgtttccccggtgttcttgagttgtgcatttttttcctcagctccgagcatatatgcatacatgtacacaggatgagcaggcctctagaactccgtctgcttgagtacatgtataggtaggcagtcgatcaagtttttgggagcacgttctccgcatgactgctcgcggtactgcatcttgttcaccaaggtattctcctctacatcacgatgtctaccaccagcgctggcgctactggaggaggagggaacattagtactggaggaggcgaaactgagaacatcaacatcaacagaggcaataccaatgcctcatcatcctctgcagcttcactggtactagaggaggcgaaaccgagaatgtcaacatcaacggaggcaataccaatgcctcatcatcctctagagcttcactgcgtatttcactaccctcatcttagtgctaaacatattttcagatgctttgttccagctagcatattcatgtttatcaccatactaggatctagtgtttatgtcatatttattatactaatttctagattgtaatatgttgaattatgactagatttccgaaagactcgtgtggccaaattagttggcgcctggtgagctattgcggcggcagagttccccacagctgtggaggcatgaagttttgattgttgtattatgtgagtgacttcgtgatttgtttccttgcactggttgattcacatatatgctattgattgtaggatattcagttctgtgattgattatatgcttttgttcttgttcttgtgctttcactactaaaaaaacgttcactggtggccaaaatagcttgtcactggcagccgactgtaccgccagtaaccaaaggccagtgaaaataaattcatttgtgctgacggtacagccggccgctagcagccacgcaaagacagccgctagcgaaaatcgattttcgctggcagccaagctaagacgaccaccagcaaaaataggattttgttggcggcaatgttaagatacccgctagtgaaaatattttcttggagaaaaaataattccaatcacaaatccccaatccccaatccccaatcacaaatcacaaatcacaaatcacaaatccccaatccccaatcgccggttgctgtcgtcgagctgcgacggcaaaggagggagctcgctgcagatgtcgctgtggctgccgcggttgcaattgtcaccgtccgcggagccgcagttgcctcccgccgagccacggtcgtcaggtggccccgaactgctgcatcgtcgggagaggggagggggttggaggatcaatcgccgcggctgaatccgctgcccgcgccgctcccgcagccatctggcggccggtcgaccatcgccgcggccgaatccgccatccgcacgcttccctccaccgcccgcgcttgtcccgtgactgaatccgccggctggatccgctgcccgcgcaagccgcatcggctccacggggatggctcgacgaggaaaggggccatccaccgtcgccatcatcgtccctgccttggccgccgagaggaggaggagaggtgcggccgtgggggtcaaggacaggaggagggcacaggggagagggattggggtgaggaggtgaggcgcagggagagaggggttgaggaggaggagtcgaggaaatggggagatgggggaacgggaaaaggtgtgagtgaagttttaatgtagtgaaataaatatttgttggcagtggccattagcagccacgagcgaaaatcatattttcgttggcagtaagttaagaggtccacttgtaaaaatacctctatttttgcaagcggatctcttgagtgaccgccaacgaaaattgattttgctggcggttggtaaccggaatccattttcataagcgcattttcataaaacccgtcggtaaaaatgaaacggtgatgctatgaaaaatgatttttttagtatgtttcgttctggatgtggaagatgaatgtttggttgtagagatactccaagaaatgccattgacaagcgtccaagtcccagaaatgccatcgataagtgtaagttccaagaaataccatcgtacaaacgattttgtcccaaaaatgctatcgtcgttagggttctgtccattttgcgtcgttaaatacactgttcatcctatagaacttaatggcgcgaaatagacggaaccctaacggcgatggcattttttggacaaagtcgtttgtacgatagcatttctgggatttagacacttgtcaatggtattttttggattatctcttgattataggatttttcaatttatttttagtggatttgatgcatggagcctgctttttttttcaaatagtacgaaccagatgccttggttcttaaaccggcaccgttagacctcttatcagtcgcctgacaggtgctagttgt

SEQ ID NO: 31749 - DNA, 2189 bp, Oryza sativa
  unsure (1)..(2189): unsure at all n locations
nnnnnnnnnnnnnnnnnnnnnnnnnnnnnnnnnnnnnnnnnnnnnnnnnnnnnnnnnnnnnnntaaaaaaaaaagaaaaaaaagaaagaagaagcttcagaatcgatcccactattgaggaaaaatacaataatattattttctatatcaagtaaacccgtgcatattaccattacatgcaacacagacaaaatgcattcagaaatacgtctcattgcaaagaaaactatagaatgttaacatccaaatttaacatctaagcacgaaataggaaatcattcgaatttggaaaggactgagttttcttcttggtgatagtcagaccgaagcctatgggctagtctgactagctggtggtgtgcagtggggctggtcggacagactgtatgtagctggtcagactagctaagttcggttccaagtcgaatttcatcaggtctagagttttcttgcctgcactgaggtttttcgagttctacttgatctctaccacaagtaaaacatggagaagaccatgcagaacagcagaaagcaagactaacccctttgtaagagctatgaccggtataatcgagcacacattctacttccaacttagccaattgaattattttttcaatattgtatatttttcttttgctagttctagtctagattttgtggccataaaagttgccaacacttaattacttaactagtggccatattacaacacgaaaggataaactatcatgatccatcacaaaatattgcactagtacagaaaccccctataggtgccggttgggaaccggcaataggtgccggtttcctcgccggcaccaattggtcggtaccaataacactaggttattggtgtctgtcatataaccggcacctttgtgctctccccgattaaaaaaaaaaagaggaaacctactcctagccgagccgatgctttaagtctcacagatcacaaatcaaatccatcacagatcatcatcaacaacaataaagctttcacagtctcatatatcacaactcatcatcagcaacagcaataataatccctaatccaatccatcatcaattatagatgaacaacaatccatcaaccaatcacagatgaacagcaatcactgatgaaagaactacacaattaatcaaagatgcacgaaatcactctcgctggttcttggttgtcgttgttgggatacgcgtaggctacgatagcataaatcaaaattttctatcgcgtaaaccaggaaccatgcaagtattagatcatagatcattaccactcgacgcgctgtgcagcggaagaagacgccgagaagtcgaaggaactctcgcgaagtagcgcgcgtcgatgtagaggaagtagtcgatcgcaccggctcgaccttctcctcctcgtgcgttctcctcgccgtactctcacgccgatcagctccgcaaaccagcggcacctctaccggtatccacacgtacagggacggaacgccacgcacagatgtgctagcactcgcgcgcggctagagtttagctcggggagggaagtgacggctagggtttctcacgtggtgcaatacctccgccggtcacacccctcacgaatatataggatccatcactcgggcctccaaggcccgtaggactcctattcggatccttatccgaattaagctcatattggatctctatccaatccccttattccggcccattaagcgtgcgaccctataggttcatatatactcggctgtaacccgaaaactccttttcggtccacgcgtcaacagcggcccctagcagaacgtattgacccaccgggcatacataaagatcatatcggctgaacctctagtgcatatttgtatgaacccctttgcctcacgatatcgattaagctcaaggctagatatgtgtcatcctctaatagctcaatcatttactcgaatctgttgatagattatataacttgtgattgactcctaaatcacctttggcatggccatgcacttccatatctacaacatcgaggggcccagagatatctctccataggaggggtaaatcacatcttgattattcatatcccactacatgtttcatagcatacccgaaaactacttttataattacccaattacggagtagcgtttagtagtccctaagtaagctactacacatgttgagagccatgataa

SEQ ID NO: 31750 - DNA, 7539 bp, Oryza sativa
tattaatttggtatctctataccatgatccatgagacatgatcatcaattaatacatgtgctgatcatataaacatatttgttccacatatgatatttgatcagggatcctttagaaatagtaacaaacaacataaagagtctcatgaaagaatcacatattcattaaccaataaggagctatctatttcaaggaacaatgtcggataaatatgtaaacatagtatgtgatataatcatctctatgattgcctctagagcatatcactaacagtcgtcaatcagccggggtccctctccacgcgaggtcgccgccggccgctaggtctctctccatgtgccgctggtgggaggccaacgaagatgaagaatcgcccgtgggccctccccgcgcgaggtcgctgctggccgctatgtccctctccgcatgccgccggtgccaggctgatggagagggagaatcgctcgtgagccctctcctcgcaaggtcgatgccagccgccgggtccctctccacgcgccacccatggggaggccgccgattgcgcgtggcggaggggaagagggaggggagggtggcggaggaggcaaggggggagggggcggaggggaggcggaggggaggcagagtaggtagaggagggtgcagcagaggagggggcccgaggtgaggcggaggggaggcagaggggtagaggagggtgcagcgagggggagggcgctgcgacagagtaggagcgagctagggatggcaatttcccccgtggggccggggacccgcaagggatccgcccctacgggggcggggacgggtggaattttcaacccgcgaggagtcggggttggggccccggccataggcggggatgggggcgggggaggacaaccacccacgggtgacccgcggagccccgagggtgtatattagactattgatactaccatattgcaagcccaaaaagcccatctaacctatcatatataaaccaaaccctaatatttccaccaccatctacccatcctcttttcctcaccacccatttacccagccgtcactctccagtttcctccaccaccagcgcttcctccggcggccaggctcgggcgatggcgtcggctgccaggcgcgagcggcggcggcggtggccaggctctggcgacggcatccaggctcgagcggcgacggccaggcgcgggcggcggcggcggccaaggcgcgtgcgacggcatcggcggccaggctccggcgacggcgtccaggctagagcggcggcggccaggcgcgggcggcggcgtcgccggccatagcgcgggcggcggcggctgccaagcgccgtcatctgcgtcggcgttgatggccatggagcttgtagcggcgggagtggcgacggcaaggggcgcggccaaccgcgtcggcgtcggcgtcgacgtcaagggcaagcatgtgcagcggcggcgccggcattcctcatctcgcgaccacctcgtcgccgtctgccatgggtggtgcgggaccccgctcacccgcgggtcccctacgggggcgaggacgggtgatgtttcccacccgaccacctctacgggaccggggccggtgggagaagtcggggagtagggcggggacgttctagcccaacccgcccccaacccgccccgttgccaaccctatggcgagcgctgcgcgtgtaaataagggccaaatgggatcgacgcgagtggataaggttggtggagatcgcgctagtggatctgtggaaataggcggccggctcggccggctcggctcgctcgtgtcggttcagtttggtaggcactggttgtttaaagaaccagcacctgtaatatattaataggtgtaagttcttttaaaaaaccagtacatatagtattggtaccggttttaacaaataaaccggcacctttaattattaattattaaaggtgtcggttctttatattttcatcatgcgaggtgcaaaatgcctataagtgtcggttttaaatgaaccgacacccataagatcgacccctatgagggttttttagtagtgttgatccaaacatgatggatgtcataaaacctgtctggaaatataggatcaataatgtgtcaataatgtaggcattaataaagtgtcaataatgatgtacgttgtaacgggaagaaaaaaacaagaatgtggagagacagacccttattcgaacaaaaaagaagaacgaggatatatacaagagagtggtcatatacggccgagtgagacggcgacagcacgctagatcgatcctagcttagccaaggagagcgagaaggggagagtaatgcgacgaaggaattaaacatgcggaataatagtcctaaattatatcacggttagtcaggaaatgatcatagaggaaacataacattgaatttgtcttgaacttttcattggtcagcaaataatttcaagtcataataaaattttctaactgaacttttcattggtttcatttagtaaaaaataattttaaatctggaagcaacattttatcattttccctgcaattataaatcgtcaggacagatggaagtagctcattctgtaaatagaaaaaacattcaatcagatctacaaaactaatctatctatttatctatctatacctatattaattgaacactttgcagaaatccccacgttagccaaaaatatctagccattgactaataaatgatattatcgtcaccatagattgtaaaatccattcctgttttactttgtgagccacgtgtaaaccaatcttaaaaacaccacgtcacaaaggagctgattttttttttagaactacaaaggatctgatataagagagtgtggatacgcgagacgcaagataaattatttgtattgctgtcgatcattaggaacatgattagatatgtttaattcacaacacaagaagagacgaagaaaatcagcaaagcatgcaacaccttgcagcaagacgattagttcttctggcacgccgttcacgtttatggaaagcacagcgatcgatcagcaatggtgttcagaatgacgttcacgaagcggcatatatacgcccgatgctcacatcaagtcacgctcgacgccgatgtcgccgagtcggctcggtcgtcttccgccgcgctgccatgtccgtgccagcgccgacgtacgccgaccgcacggacatatgtccatgcaggctgccgctgcaggcagatgcatattctttttcatcgtgagtaatttctctgtatcaccgttgaggcagatattattaataatattaatataatcattagttgtaaggttgatgttaattgatattattagactttgatccttgatgtcatttgtcacaaaaagtaataggttaactttgtgccatcatatatcacaaattaatttgtgcatgcttcatcgaaattgagttgaacaacttttttgtttagaaagtacatgattcctctaacaaatataatttagcaatctaatttgaacacttttcttttatcaaagttgatgtttaaacatggcgaaaagttattatttataatccaaaaataatatatgagagtttatgtcaaataaaccatgtcatcgaaaaaaatatcatactaaatttttctaaaatttactaattactaaatacataattaatacaaattgataaaaaaagttatatccaacttggactctccattaagtattttattaattaggaattagtaactttggtgaaaaactagaattagtaattaatccgtaagttattagtcatacaagctcttctttcaatttgagccattgtaattttaatctttgtaatgtatcgataagttgcatgggttgacggccattaaacataattcagcgcacaaactagtgagcggcatatgcatggcccacttaagctcttgggcccattcgagtggcccaggcagatgcccccagctcctgtccttttctgccactacgataaagccattcttatactctccctttaatttcacaaatcgactataagaaaaactatatgtaaaaggttttgggttgttcggtgaagaccaaggatttaaatctctggttaagaaatactacctccatattttaatgtatgacgccgttgacttttcatcacgtttgaccattcgtcttattcaaaaaatttatgtaattatcatttattttaccgtgacttgattcatcatcaaatattctttaagaatgacataaatattttcatattttcacagaaattttaaataaaacgaatggtcaaacgttggtcatacattaaaaatacggagggagtaccacttttgccgctacataatctactacgctaatagctgggcttagctggagattcggccttcagttacaggtagcaaaaacttttgttctgggctgaaattagctacgggccaaggcccatctacttctcctgtaacgcttgttcgccagcgcccacgcttttcccacacgcgtttgagcgcaagccgtccgggtggggcccacctgccagccggagcgagaggccgatgcccgtgctcccaatcgacccgcgccctttgctcgcgcatgcacgcgcacgcgccgtcttgggccgtcgccacttggaccacgcgggcctgccaagccgagccaaccaccatcttgggccacgtgcaaaggctcgattggctcggcctccctgccaaccaatcacagcacacgtgcacccttgggccagctaggcctgccctggcatccctgccagcctagcacgtgccacgcagcacacgtgcacgatggcttacgacagtacacacgactgctgtagcaaccatgcaattcctccaattttcgtcgcgaaatccggcacttgcacatccgaccatgtgaaaccgttgcgaagatctctccagaccgtgtcagtctaccgtgtgccaccctgtatccaatcttgttacttggtttcctttatcgttctggatctcaactacttcccgagtctagtcccgatccgctgttgacctaggttgaccacgaaggatcctgacgttagtcccaccttgtcatatggcttcttgaccgtgccggacctctgctgctccttgagcatggcctcggtcctcgctattgactaaggctgacttcaatcaaactgcatgcatgtaaacaaacaaccaatgtcttggcacagatattgcaacttgacccacaaaaatcagttaatgcacactcctacatttccggcactgcactagccaattttccatcacacgtgaatcaaacccacacatggtttcacagttcgagtatacacaagattgaacttgtgttcatttgtacacgattgaacttgtgttcatttgtatattggatcttttccaaaatctcatagcaccggagcggcagatttatttatgatcaattaggtgttagctaaaaaaacttgaaaaagtgaattaatatgatttctaagcaacattcatatagaaattttgaagaaaagaaacactgcttagctgtttaaaaactatgtgcgtgaaaaaaaaagagaacggaagttaggaaagtgtactaccaaaccctaggtatggtcattagatggtggtccgccatcctgagacttaaaaagaaattctgggtcccactgctatgagattgattccaacgttaggggtgacaaaccctagcttaaaaagtaattgtacaacgatataaacaatgaaatacgcaataactccatgtcatctagaaattggcaacaaaactgaccaattgagacacgattagagagaaaaagagagggagagagatcaggatattattacaagtagttacgaacaatatgagactattttctgccctcgagagcaatacactttatttgttgcctgtgatcaaagtagtctttttttttcctcaaaaaaggaaggtgaaaaatccaggcgctgctatgggaaagtttttttaagttagatttgtagtttcactccatttccatgctttattaaattcacacctatcatcaatttcaaatgtttaaaataattgagaaggtgtggcttcatgggagacaagagacacattgaatcgcatatcaatcatataaatgctaaaatatttttgatgatatagcttcatcagaggaaaacatacaatttgcctcattgatcaatcatcaatagctagaagtaattagtgtgatatggattcataagaatagaaagaaatataattacttagtgggaggcaacttaactatataatgttttgaaataatcagacaatatacatttttctccatatatacctccaaaagttaaaaaaaaagagaatatttgaccatacagtctacataagaactatatgggaatgggattgacaaagagactcctaacaatctcttgtagatgtgtggagaatgtgtatgcatcctttctcttgtcataaaagaacattatggaaatagccatgttcagaactctttgcactaccgggagtagctggtggtgttcatagcgagcgtggttcatggttctccattcatcttctatcagtgaatcgagcttggcaaaggcaacctcacttatgaccttgtgctcattcatgtagcactcaacagtgctcaccatatcgcctttgttcttcccacactatatgaatgtcaaagataaattgcaatatctcatcctccactctagtttagcagttgtacaagatataaagagttgtatcatctctttttgaaggaatcatgtacaattgcgtatagttaaatgttgataacaatgtttttagtgtactagtgtgatttttttatgatttctctatatgatgagttggacaaatattgtgatcacttaggaacaatgtcattgtgggcattgaaaatgttacatttaataagaaaatgattagttaattagattgtaccttaaaagaggcaatgtcattcatgaaacgtaatatctttgcacatgatgtcacggtactactgcttgctgcccactggaatgcttcacttgatattgcgtcaccccggccaaccgtcgtagacacacataacaattgcaccgtcgaagtctttgtagacaaagccacctgctcttcaaagcttggcttgtaattattatgtgaccattcagcttcctggagaaaataatgggacagcttttggaactgcacccaagcaaaaggaaattaattaccacaaaattagcaatacatggcaatattgttgttctgatgggccactcacaaacgcttgcacatctaacacacactcaaagatgctaagaccagcggcaactctctagcctcacaaaatcatattgaaagtgcagtcgattatccataatatttgtgggcataaggacctctagttggtgaagtcatacacacacatcttcaccatcacaccaccaatacatcccacctccattttttgcttgacttcatagaattcgtgatgtcaactaacgttgatcattatttaaaaaagagtaaatttcacagaactacatgttttgtagtccaagttg

SEQ ID NO: 31751 - DNA, 3099 bp, Oryza sativa
tcacacgaaattaataggatgccacgtcctcatcctagatggaacaaccatgtcatctcacgggtaaatccattcatcgatagtgtggttttgtgaaactaaactaccaaaacatatgtacttaagtgccaagtgtcaaaatgtgtgtggttttctgcaacttgaaccataaaacatgtagttttgtgaaatttattctttaaaaaaaggctaatatgaaaaatataccattatattgtttgctatgaaactcatagtgtgaagtttatcatcatatatttattaagttatgaaaaataatagtcaaatttgaagatcaaagttggctgaaagtcaaagaaacaaataagaaagcaatcccaatatagacagatcaaaaatatatatcattgctgtacctctttcttagcataagcaacccggtacttgtcgttgattgccacttgatcctcaaactctttgaagttattcaacaattcattgtagaacttttttaggtactcaggcaggagaaatagtgcactctcatcccatctgcaaggcacacaaattgttaatatcaatcaaaattagtcgggcaagcatatataaattagtttaacaaatactaatacaaagaaaaaacctttgtatggcttcatttagcttccgacattcttggatggtggcatgggaatcatatgtgtcatccattataaccatcaatacaattatcttggtaaaaattatccgtgtgagtgctaatccttcctcgtagaacaacatttgggaccatgtgtagctctccaccaaacgatccctaagataacttagccccacatatccagtaaggtctttccaccacctaaaataaaagcacttaattaggtacaagcctagatagtatgtttaagattattattagcattgcacataccaattctggtaggatcaatatggacaatacacctttgtcagacatgtatgttcaacacattgtttacatataaattatatgtatagtgtattaagctttaataagattgagatgaatacatactactgcaatacttattttctacttggtgggtatatatcaaagagattccatactcagaaatagctttgagctccttcaagtggaccccttgcaaaatattaaaatccacctttgcaagatccaaaagaaacgaaatatgcccttcctcttgtccatactccgaaagataatgcaatgtttccactcttttgtatgtcctcggtagtggtaagtgaagggcacgcttgacttggtcagctaaagggtgtttgaggttaccacactgcatcattgattttagatggtgcctagaaaaagagatggcctcttcgagttctggttcatcgtgaacgaggaggtaagctgcattatataaacttaataaactgcttggttcatcagctatttaattgatgaacctcccatcatcatccttgaatatgttgaatgtagctgcaagataaaatatgtaatttgagactaattgattcattttagacttgtctgtgcaactaggtgactagccttctcttataacggaccagaaatttcttttgataaccacttatgactctttaatttgttgacaatagaaaatccaaacgtatatagattttccgtgtgtcatcagtaatgtagaataaaaaaaatttaagttgttgctgaagctgtatagaattttcccaacctacaattattaaatccaattcatattttgttaccaaatggctagctagtgatgagtatgcgagttatgtcagtattacttcagtccactctatagaccgatagatacctggagatacccataggccatgctccctgagcaagcgaaatcgaagagcaacctcgtaaaggctagagctagtaaattcacttgcatggatatcacttagtgtggtgcttatctcttcattgaacaggtgaccaactcctagatgttggattgaatccactaacttcatccttgcaacaacgtcacccgaagtccgaaacagtgtgcgaaccttctctctaagattatcagccctctgcctcatccattcctccgatctctgcaggctttcgattgttagcaccaaccaaatgaagcaatattagataataatgataatttgtcaaaacgcaatgcaaagcatatttcgggtggtcctcaatccaaaccaatccattttaaactaaaatctcaactcacacatttggatgggtcaagatttcatccggtttctaaccgatcgacttccttaataataatatatagagcatgcgtaagatgttaagataaattcataaaccagacagtaatagcaatataacaattatgtgtatacatgcctgaagtggttgtggtgtgtaggtgatgaagaaatccccccagactgagggcttatgattagaaacaccagattgagggctcaagcatggtgcaaggctagtggtagatctgctgcccgtgctggaaaacatttgcacgtgtactgtgtacttgggctcgatagaatgtttcaagctcagacctcagatgctagtgagcaccgtacccagccctttatataggagtagtacccccctaccaaatactacttgtcaagtggggattagtcatatttaaattctgatatgaccattagtttgactatgaatttataaatatctaaagaaagtaagcattttttaaaatacttaaatatttaaaagtttttaatgtgaattaagaaagcaggtagaattgaatggtaaaatgttatgatcggttaagaaaataaattaggtagaacaattaaacgggagatggttacgattggttgagataaaaggttagatgaaaaatagctaaattttaatataaatttgaactctacaaatagctatattttaggacagataaagtatattactatatattaaacatgaccgtacaatttctgttcagccaagtaaatacgataagagtaaatttcacaaaactacgggtattttgaccaaattatcacaaaactacagatttaaggagttgtatcataaaactacatatttagcaccaaatttatcacaaaactacagattttagattaagtatc

SEQ ID NO: 31752 - DNA, 16092 bp, Oryza sativa
  unsure (1)..(16092): unsure at all n locations
nnnnnnnnnnnnnnnnnnnnnnnnnnnnnnnnnnnnnnnnnnnnnnnnnnnnnnnnncataaaaatgcatattgaatagtgaacttatcacaaaactataacttttgaagtttaaatccctagcaccattgttatcgtggagctataaacatcattactttgtgattaaattgattctaaacctatagttttgtgataatttagttagtaaatacgtagttttgtgacacttcatctttaacgtgtagttttgtgataaatttggtgttaaatgtgtagttttgtgatacaccgagttaaatctgtagttttgtgataatttggttatagtatctgtagttttgtgaaatttactcacacgataaataattttaaattattgacgatcaaaattaagttaacactaataaatgatgaccaaaaatactactttattacatttgtttacttttgggtttggacgttatatcttcgtattataaaactatatatacctgcatttgtttatcattggcctgtgtttttacatattacactaaattaaattgatgaatgattaaaagtcaactgtgtcgtacactatctctacatctttagaaatccagtcatcctccttccttccctaccatgcgcagcgcccgtgaaaatcaaaccggcccgcacctcccacaccatatttcttctgatcccgtcgcaaatgcacggtacagtaatataaaaaatggataacagattttttaaaaaaaggagggagtagaaacggaaggagtactaccatatatatctttcaaaaacgctgtatatatatattgcatttggtccaaatccctgaagccaatggtcagtcacgtgcatccagtggggagactatcgccagtgaggcggctgctatgccttcctctgtttcgttccagacatcgacgggaatgacggaaagggtgaaaaagtcatctgcctcggagcggatctcagccgttggatctaaaacggacgcgtccgatttaccgcttgccttttggaatggttccaggaagatggaacagaatctatctcacaccagtaatattaatctgaataagctccaggtcaaacaaataataatctgaataagctcagttgatcaaatcagtacacagaaagtcaaattagttcgatatgcatgcaatgattttttctacgatacttgcagtttaatatctggatagtctggtgaatgcaaaaggtttgggatgatggccgccgtcggtgcaaaagtttgtttcgattttttggaaaaggacgaacgttgaatgagagatataactagcatataattaatcaagtactaattattaaaaacttaaaatatatttatttaatttttaaagcaacttctgtatataaaatttctcgtattaaatgtatcgttcagtttgaaaagcgtactaacgaaaaatgataaagtgggtaaaccaaaacaaagtttagaatagggccttaggtttaaatttgaaattcatgaacgacggtatattttcttgcaacaccatatgtaataggtgtataaatttatgttctatttttttatacaacagacacaagtaaatttcacaaaaaaaaaatcccatacagtgtgccatgtgtgacacaaaatctcgtcttgtgaatttatttattgaactccatattttagggcaaaaagtttcataaaatccaggtcattaactatgccatctattttctttgatatatttgtgcaggatgctatatttcataaatttatatatgttattttaggagcctataaatctctggctcctgccagacaccaacttgtttgatcacctcatgacactaacatatatgggaaaacatgcagtgcataccacatatatgatgaaaacataaaaactaccattggataaaagaaatgaaagtctaatatttgttcacgtcacgtagagaaaaaattttactccaagttcaaccatgggtaacgtagataaatctcaaacgtccatttttaatcaatggtagtgaccaggttttcacaatatacgtggttagtactacatatttccaacgaaaataaacataccattaaaatatactcaacgttagatttaataaaactaatttattattatagatgttactatagtttctatagatttgatcaaatttagaagacttaacacaaaatgacttgtaatataaaatgtacggagagagtacattatatcgttgcaacacatttgggggggtggggtggggggcgcctaattttgctaagttcgtcttagaatgagaaaaaaagagtgtggagagttagaatacttatatatagcgtatcagttggcataactatatgtttaggaaacataaggttctctaaaacgataaataacagaacatatgttttttttccagttacatggaagatgctaatggatgtacacaccactgtacaaacacagcgacgaataaatcccttttaacacgtactgcctccatccaaacataaaaaaacaactgctatagtttgaatttgataagaaaataccttcgtacctacttttcacacacgaatcgagaatatttttatcccttagataccacttaccaactcacccttgcatacaagttttacatcaatgaggatctcgccttgccgccacgctcgcctcctccgccgccgcttgccacccagccgccgctcgcgcccaccccctgcaccaccctgcctcgccgccgttgctgcctcgcctctccgccgccgcgctcgcctcatctcaccactgccctttgccgtcgccatgatggacaagagagagagagtgagagagattgggaaagagagggagagagagaaactgacttgtggggtccaccaacttttttataaaagaattgttgattggactatcatgtagaccaaaaccactgcggattggatcgaggagggtaattcgtccggttttcatagttgggggtaaagaatgtccggttttcgggttcagggggtaattcggtcgaccgcgatagttgggggaggtaattcgtactttttcctttcgatcatttaatatggttaataaatattttccagttcactttataatcaagtaggataatccgtttcgataaaatggtgaataatctgaaaataacaaacaagaaataaagactcgctcgtctgcttacaaacttatgtcagaattttcctaccaaagattaatcatctgctgcctggcctgacaagccctctcatgcagaaaaacaaatgcagtgaggcggtcttaagaagcctgaagtgactgatccatccacatatcggacacatatatatatatatctatatgaagccaagccttcaacgactcctcgaaggaggatatcagcggtgcaaccgtgcaagacaccgtacccaccgcacgccgccgacccgacctacacaatcaccgtcgataggaccaccccaaagcaccgagaaaagaccccatcagtatggatggtcaatgggccgctcggcacggcctgaaccggacacgactagggcgtggcccaaggcatgtcaggccagcacgcccggcatactcctcgtgtcgtgtcggccaagcacacaggctaaacctgtggcccaagcacggcccattaagatgctgtgccgatccgaaagcatgaccggtctatcgtgatcgttttgaaataagtctatattgcatctctcaactatttgggccgtctttctacatggttgggataagtccattttgtgttcctcattttcttaggtttgtgtcttgtatatggctggagtaaggctccgttcgtatgcgcgagtcctgatcccgggtcatgttccgtgcaccggaagcgtggtcccgcacacagtaccagaacggcggcttgtgaggcggcgttaacggatgtgagatgtggccattgcgcctcagcttttccgtcggagtcaggtgtcacgcccagaaattcactagtaatttctgaactaatttgtgcatgaaatcctcatccaaaaatcagccgaggtacacaaactgacaatttaatatatagattcatcataataataacgtacatacttacaaaagaaaagaaaaacagcagcggaattacggtctagcgaagctccggctccacagctcccacaggcagctcaactatgatataagccaaacgtcttctccttttggatcctttttcttcaactgaggttgattgattattgcaaggtgagcatataacatcctcagcaaggcacacagcaaatatgcaagtgcacaggataccaaaggatggcataatataggctcatttacaaaagcagcatttagcaaacatttgagaattgtaaaacaatagagtaattaatcatcaatattaatcaagggcgggtcagcggctcccggcgcagcggcttctctgtggctccctggcgcagcgggtgcgctgcggcgcctcgacgcagcggctgcccggtggcgcggcagctcgggattttgccctgagctcgggacctccacggcggcgaggagcagcgctggcctccctctcacccctccctctcctctcatctcctatgtgatgtgatttattctgtgatttccacctcttctctcatcttatgtttaatttattttgtgatttgcaatttccaattggattgcttcatgtgttggattattttgggatgattttgtaatgattccaattggattgggatttagtttttgtgatgatttgggattggcgccaagcacttcgcagccgcacgtcaccagcaacccgacgtgcctcctgctgcctttgtaccacggccttggggcagcagtgtcctcggcctgcgatgatttggaaattggtatcgggttgggagggggaatcgggttgggatgctattagttttcttgtggggatcaattttcgtgttgtttttggttgtctggattgattgatttggggatcttgctcagggttttttttttttactcggactcgaacgaaggaaccaaaattttgggagtgacggacgaaaacacaatgacagatacatgtgacgagtagaaaaatccaaatcttttaattagttaagatattatgttaagaaataccgcgtccttaagaaatggttttttgctagtacatagcacaattacgaaattcaatctacatacaatctattattttaaacgaaactacatgaaattgaatccatatgaaattactactgtaatgcaattcccgtttcttctcaatttttgcaaaccggagtgtgctttcttgtgtgcatctaccaattcctcccacgcatttacaccccctgcagcgcatccggcggtaatggcagccatcctcctctcgccgacagaaagtgtcggcgctccaacggcgctctgtggaaatacctaagtcctgtgaaatttcaaactgaaatcatataaaccgtatattttcttgtaacatgtgtaggtgctttggtattaattacacatgttgcaagaaaatataccattcatatgatttcaatatgaaatttagatttctagatttagacataaaattttctagcagatacatcggttcaattcacgggtcgacgatgcatgaacattaaccggtcggcaagtaggggtgggcattcggttagaccgaaaaattcagttcggtttctcggtctttttaaaaattcggtctttagaatctcaagaccgatcggtctccaacaaaactgaagaccaagaaaattggtcttcggttagttcggtttggtctcggtcatagaccgaactaaccgtgacaaaaatttatcagcaaaaaattggtacaagataaatgaattaagcaattaggccatacacaacacactgcaaattgatgtcaccactcaccagcaaatcgagcactacttagacaaaaaaaaaaagaagcaaatcaaacacgatctagaaaggaaatcggcaaatcgaacacaactggcgcacacagccacttcaacttcagcctccgggatgtagccgaccggctagatgtggagggaggaggcggcgcccggcgcggtgcaggaggcggcgccggcgcggtggagccgtgagggcaggaagcggcgctggcgcggtggaggctggaggcgccgaggcggagggtggaggcggcgagctcggtgaagggaggaggcggagggggcgccggcacggtggaggcagcaggcggcgccggcgctcggtggagggaggaggcgagctcggcgccgggcggaggtggcgagctcggtggagggaggaggcggatggggcgctgcgcggtggaggcagcaggtggcgccggcgctcggcgctgggcggaggcggcgagcttggtggagggaggaggcggagggggcgccggcgcggtgaatgtgaggagggagtacgacgcctaagggacagagggagttggggtagggattctagggtttttttactgggcttaattgggcctctaggtctattgggccaattcggtcatcttgggtatttcggttaaccgagcccaataaccgaaatacctgaaataaattcggtcttttgctagctaggactgtatagctacccgaatttttcggtctcggtcccggtcatttcggtttggtctaattctgcccacccctatcggcaagagccgaaatttggatccttgtcccacacttgcacggacaaccgcggtataacaatcttttgcgtcacaatcttgagaaaagtcttttcatatatactccatattcgagtgcataataaatatacataagacacaagttgcctgggttggatattggactataaataaagctggatgacttaattttcatcccctcctacttttcttcgaccggctggtcggccctagctttgccgacgtttccgtcgatgtctcgcaagagacgggaggcagcgacgggttgggatcccctggccaaccagtttagtttagttggattaatatggcaaaaatagcacagccatcgaataattagtttgtacggctgagatggattgcccgaatgcagatgagtattaataattagtttgtcaaactaaactaaatgatccagcagaaacccaaaaggtaaacatagatgctcatgttctttgtcattattgatttttaacttccgatcaaccttttttatgagaaaaatatctttctctcctaatggattcaactacagagtacatgaataatgtccggctgctcatttatttattctctacttgtcttctcaaatcattacaacaattatttgacatctcccatgatagaaatgaaatgtggagcagagtgtgggttgtaaactctgaagttgaaaccagcaatgcaatcagatattactgtcagaaaccaatatatagtgctaattgaaaaggctcagttgttttagatcaaatcatgctgctaaagacccctgcttgattgcggtcatttacttaggaaattctacaatacatacatgttacctcatagcctcgaagtgttgtttgataggttcttgcacatcctagtgtactgctccctttcagacctatcagcaacgatgtcttcagccactacccagtggccagtgatacccattgctccgaccgtaccagcacgggcgccgcgcgtggatgcgccaccactcgtcgctccgcagcttcctctgcccccaccacgccggctctgctcactggtttctggtcgccggcagccggctacccttcgccactgctgccacaggataaagaaatctaaaagaggaagtagctggaagcggtggagtgttaaatgccgattttttttttcggtttgatggaacaggattctctgaatctttctcctggttgtgggctaaggggaaaaaaaaacaagaaaacgctaggattgtgccacgtatacgatcggagcacgtggggagcaggcaagcccgtcgctgcctcccgtctcttgcgagacatcgacggaaacgtgggcaattacgatgagtttgaggaatttggacccaatgcagatgcttttccttttcatgtttttggtcgatctgaagatatttgttcgttcaagcatggtggtagtcgatccggtatataaaggagggtgctggagtataaaaaactaagcctgaaaccgcaattcagccagagccccagtgatatcgatagtacagtactgatcaaagaacagcattatgcaaatagtatcaaatatgggttccgccggcaagtgcgcgccaagccttgcaccaacacatataggacttggcatgatggggaagatcgctgtgagcccatccagcgttaggcctaggcctcgggccatggcttcccacgacgctattgctcctgagaagacgaccaactatgagccctcagtctggggggatttctttatcaactatagaccacaaccgctccaggtatggatgtgtatatataaacatatatatatagttgttatatattagtgcaacagttatacgtatatgctaattatatattgtctatgcatgcatgtacatgcaaatatttttatgcatatgttctgttaattagtactggatcaataggaaacttcattagtcaataccgcagctcatgcatgtctgactcgagattttaattttaataatatcaatatcggcccatatgtggatagcgccatatcgaggccatttagtggagtcctaagtttgccgccattattttatggcaaattttgctacatgacactgctattttgtggttttagcctacactgtccaaactcacttttggggaaaacactccataaacgtggtaatttgccagtggacaccacgtcgattaaaataataatttttggttgaagagaaaagatatcacgtgaaatgtcaaaaatgcccttgggcccacatgccagctcctccatctctattccaccacgagcgccgttgttcgcagagtggagcgccgacagcgctgggagtcgtgcggcaacggcagtggcggagtgtagcactgggagcgctgggagtcgtgcagcaacggctgtcccggttgcggcagcgacgccgacgataaccacgacgacgcgcggcgatggcggctgcggcaattgcagcgcggcggtgactacgccttcgccgcgtggggcgccggtggcggagggtggggacgacaaccagaaggcggtggcggagggtgaggacgacaacgaggaggccatggcagacggccccaagatcaagatcctggcgcgcggtggcggcagtggtggcggcggcggtggcagtggtggcggtggcggtggcgcttagtggtggcggcagttgcggcagctttgacggtgccggtggcgaggcggtggcgctgcgtgcaggtcatggtcgccgttggccatggcggctgcgtcggcatggtgacggcgaatgcagtggcgacgacgatgacgacggcacgaagacggacggtggtggcggccggccggaggagatcgagagagattggatagggaggagaggtcacgatggggatcggctggagatggaagagatggcatgtgggcccaagggtatttttgacatttcacacgatttctctccccacttcaaccaaaaattattattttaatcgacgtggtgtccacttgcaaattactacatttatggagtggtttcccccaaaagtgagtttgggcagtgtcttagggctaaaccacacaatagcagtgttctgtagcaaaatttgccttattttatactgcttatgtgcatgcgcactatacttttgctggttttatcaatccaaaccatgaatgctgcagagatcagaggaatggatgaggcagagagccaagaggctcaagatgaatgtccgcacactattctggacttccaatgatgtggttgtaaggatgaacttagtggatgcagtccaacgtctaggaattggtcacctcttcaaagatgagataaggcgcacactaaatgatatacaccaaagtgaatttactagctctagcctccatgaggttgctcttcggtttcgcttgcttagggagcacggcttatgggtatctccaggtatctattgttctatagagtggacttaaactaatgttgatatagcttattactttttatgctcattatccatttggtaatgaaatttgaattgcatttaataattgttggtcggaaaattctatacagctttagagacaaactttattttttaactatacattaatagtgataacacatgtagaatctttaagtttctccacgtttgatttttctattgtcaacgaaaaaatcataataggttaaagctaaggctgtgtttagatccaaagtttggatccaaacttcagtacttttccatcacatcaacctgtcatacacacacaacttttcagtcacatcatctctaatttcaaccaaaatccaaactttgcgctggactaaacacagcctaagaaagaaattttggttcttctctgtacaagagaaggctagtcacagacacatctcaaactaattagttacaaattaaatattttgtcttgcagttacattcaacaaattcaaaggtgacgatgggaggttcatgaatggaatagctgatgaaccaaggggtttattaagtttatacaatgcagcttacctccttgttcatgatgagccagaactcgaagaggcaatctctttttctaggtaccatctaaaatcaatgatgcagggcaataacctcaaacaccctttatctgaccaagtcaagcgtgcccttaacacaccattaccaaggacatccaaaagaacagagacattgcattatctttcggagtatggacaagaggaagggcatatgtcaattcttttggatcttgcaaaggtggaatttaaccttctgcagggggtccacttgaaggagctcaaagctatttctgagtacgtgtgcctctttgatatataccaaactaacaacaaaagtactacaacagtatatattcatatcaatcttaatacagcttcatacactcatacatatatatgtaaatgatgtactaaacaaacatgtctgataaatgtacaatatccggaagagctctttgcaatattaattagtaccagtaataatcttaaatatactatctaagcatgcacctaaaatgcttttattttaggtggtggagagaccttaatgaacatgtggagctaagttatcttagggatcgtgtggtggagagctatacatgttcacacatgttgttctatgaagaaggcttagcattcacacggataacttttaccaagataattgtactaattattatgatggatgatacatatgattcccatgctaccatccaggaatgcaggaagctaaatgaagccatacaaaggttttgtctttgtcttagtgtatgctgacataaactaatttatatatacttgcctgactaattccgatgtaaagttaacaatttgcctgccttgcagatggaatgagagtgccgtctctgtcctaccagagtacctaaaaaatttttaccataaattgttgaataattttaaggagtttgagaatcaagtggtggttagtgagaagtaccgggttgctcatgctaaaaaagaggtacaacagcgatataactatgttgggactgattccttatttgtttatttgattttcagccaacttaggttttcaaatttgactattatgtttcataaatttccatcaatatgtgatgataaaattgtcatgactttcacagcaacaaatatgatggcataattttcatactagacttttttttcagtaatgatcaacattagttgacaacatgaattctatgaagtcaagtaaaaaaatagaggtggaaagcatcagtggtgttgtggtgaagttttggttgcatcattccacccaccagattgatggctcaactcttcataccaatgaatattatgcaaaagcgggtgctcttttcaaaagaattttatgatgctagggagtggtcactggtctcggtctctttgagtgcatgttgggttgaatatttgcgggtgtgtgagtgtggtttggaaaatcaaagcaacaatattaccatgttttgttaaccttttgttatgaatttctttttcttgggcacagtttcaaatactgtcccattattttctccaggaagctgaatggtcacataataattacaagccaagttttgaagagcagttggctttatctacaaagacttcaacggtgcaactattatgtgtgtctactacggtcggccggggtgatgcaataacaaatgaagcattcatgtgggcagctagcagtactaccgtgacatcatgtgcaaagataatgcgtttcatgaatgacattgcttcatttgaggtacaatttaattaattaaacttgttcttattaaatgtaatttttcaatgcccagaacaacattgttcctgagtggccacagtatttgttcaagctcatcattatagagaaacggtaaattttcacacaagtaaaagaaaaacatggtgctcaacatatgactatatgctactatccatgattcccttaacaactactctataacaatgtactttataactttttacattgttaaattatgggtggaaggtgagaaattataatttatctttgacattcatacagcgtgggaagaacaaaggggaaattgcgagcaccgttgagtgctacatgaatgagcacaacatcataagtgaggtggcctttgccaaactcgattcactggtagaagatgaatggagaaccatcaaccaagcccgttgtgaacatcatcagctactcccggtagtgcaacgagttgtgaacttggctatttgtataatgttcttttatgacaagagaaaggatgcgtacacattctccacacatctacaagagattgttaggaatcttttcatcaatcccattaccatgtagttccccttttagactgtattgtcaaatattatctatttttttttctttttacttttggagggatagatgaaacaaaatctatattgtatgattttttcaaattaacttgcctcccactaattaattatatttcttccatgccatgtcacccttcttatttgtagcattccgttgattgatcaattacgcaaattgtgtttttttctctcatcttatatcatcccaattattttagcctttatatgattgatatgtgattcattgcctctcactacaagaattttgggcttctgtgacgataacagcatgtttcctgtcactacccgcctgctgtgacgaaatggctgtcatcacagaaggtgggtcactaaccagcttctgtgaccaccagaggacatcgtcattgaaatagtgatgatagttctcctgtcactgatgaatgacgagacaaattcgtcataacaaattgaaccaactaacgccacgtgtatgatgacatgtgatgttgcagatgacaaggcgagtgatgtggtagatgacgtggcaattcacattcggcccatatagcatgggcttttttattttcaattacaattggcccaaatattttttgacctagctacaaatttgcttttacatttttttcattatagtccaaagtacaattcaagcccatattatgggccagcccaattaaaaaagcaatcacagaatataaaccacaaccatttgcataatcatattataatcacattccagccataattaattttccagcccatacaaaagcaagttccagaatacagtttccaacatgttccatacaaaagcacgaaacatgaatacaaaatattccatccaccatccaactacacaagtcccagccgactatgaagttcctacaggtagtgtcaagttcctgcaccaaaaaaattccacctagcagccactactaagttttggcgtgcatcttgccagcagccaggaaaaaaattccaccaagcagccactgcactttcggcctgcatcctaccagcagccaacaactagtgccaaaaaatcctgtgttctagcaaccaacgcaaaaaaaactccagccaccaaaagtgccaacccgcaagcaaccagcagctagcaccaagttctagcagccacatacaccatacaatagcagccacatacaccaccaagttctgaagtaccaaaagcgatcacagcctcgaagttcaactacactaacacgagccatcaaattccaagctcagccacctcattcctgccatcaaaaggtgcatgttttcagttgatggtgaataaaaagtccattttgtttggacttggaggcaaacaaatgaacaaatagtgtttagagtaataatccagcaggtaaattgagtaataacaatatattgatatggctcttttccgtaaagtccaaacaaatggctcttttctagtcacaactaaatccaaacaaatggctcttttgcagctaataatccagaaaaaaatagagtatctagatcgatcaatcaaatggctcttttccagtcacaactaaacaatatctagtttcatagtaacaacaactataaacaatccagcaagtaaattgaaataggcagagtaataggcaattttgatacacaccatgaacaaaaaattcagccaccaatgaaacagtacaataggcttgatatggatgcaaaagcacaagagacaagttaaagctgtgcacctgagcatacaactagcttagggaggactgatcagaccctgtccaaatgctatcatttgtcgaaggaggccctgatgatgaagtgagggtttcccgggcatgcatatcctcctagcaatgaaagcaaggtttcagttttgcattattatataaataaaggttcattgcataaggtacttaataaaagaaggaaagaagatgtaatagttcagtacttactatagctttctttacaggttcactaaaacctttagtttgctgcaatgcaactcattgaagagatcaattacagtgggctcactgtcaattgcagtgcccatgctcttcccccttggctccacttgtctactgccaatgagggtgcctaacataaaacatttacaagtgtcaataaaaagatcctgcacttgatatgaaggcataacacatgtaaggacaaaagaaccaagaatccaagttacttgccttgttcagtagagctcaatcccattggctccagttctgtacttaaagtgaggtcgctcaatcccattgccgccacccaatatggccacccagggcaaaggccccatctgcggcgcaagaaggaagggttgaggatgatggccagctgcggcgcgccctggttagggctccacccgccgatgctcaccagtgccaccggatcttgcagtcccgaggccctcattcctgtagtcacattctgcaagacagatgaagaaaggatcagaagaaaagatcacaacattgcattagagttgcagaagcttctaactagtaactgtttttgctaggcaaatctgtgagttgagtaggattttaaggaacatatactctttgagcaagtttatggccaatttagtaaaaatctcacatcttattaacattcttaaggggatatttttgtgacagacattatattggattatagaaggaatcaaagagatgctagccatgacctttcttctcaggaggtgatgcttcccttttaccagtgacaatttctactttatgaactacaaactgaggtggagatgcagcagtagcttcccttcctacttcaactaccaactgcactaaaggatccaagctagaaaaaatttcttccttggagatatcatgatctatatacttggattgaactgagttcaaatcaatgctaccacacctaacattaacaaaaaagaaggtgtttgtttttcaagaagaatgcatgtggtaagtttggtacagagtagagatcaaaacagtaaacagcagctgtgatcggttgggcaggcataaacatcttcctaattataattagttaaccatacatttttgaaacatnnnnnnnnnnnnnnnnnnnnnnnnnnnnnnnnnnnnnnnnnnnnnnnnnnnnnnnnn

SEQ ID NO: 31753 - DNA, 2107 bp, Oryza sativa
  unsure (1)..(2107): unsure at all n locations
nnnnnnnnnnnnnnnnnnnnnnnnnnnnnnnnnnnnnnnnnnnnnnnnnnnnnnnnnnnnnnntcaaacatggatcacccatattttgttaaagaaactatgcaatttaccacgcttgacctaagaagctagaccaatccttgataatactaacatgcctaaccatgctcctaatgcttaccactccaaattcaagtacgaaagctattctgttatgtaacctaaaaataatttcgaacttgagaatcatcgatatcgacactagaatacaagaagagagaagcttataaattttaagtactaattgtatgactgtcaaaaacaatcagaactatgtactgctctaattttcacaaaacaatcagaactaattactgctctaattttcacaaaggaaggatcaataggagaatggaaaaaaaatatttgctaatcactactccatttcaagactgattcacacaaaaaactgtctacgagagaggttgtgacctgcaaaactgaatcctctactcgccgtctttatctcggctacaaatcgctccagcagcagcagcaatcaagcaccaacagaataccccaataaaccaccagatccgcgaaagccagcatctcttctaccgatttcccaactcgacaagggagttgttaccctcatccagatcccgacgcgtcgctggcctgctaccctgcacccctgccccgcgccgcgtgcccccgcggcccgcgccacctgcccgccttgcgattgcaagtcgccagccgccgctggtcattgtcatcgtcgtcgtcgctgcagcactgtagccgtcgttgcagccactgtagccgtcatcgccacagccgccgccgccgtagccgctcgctccctcctacctaagcctgccgccgccgctccgtagggcggaggtgggtggatctgcgtgttgccggcgctcccactcacgccaggccgctcccgaggacggaggccattggattcatgcgccgccgtcgctcccgaggacgggaggcggcgaatccgtgtgccaccgtccttccctggctaggggagcgacgtggggaaaggcgaagatggatggaggaggagagggatgttggcggtgagggaatggatggtggcggcggcggcatatggatttagtttgggctaaggtttgggggagaggttatatgggtaggaagcaatccaacgggagtttaccaaactgtccctggtatgtcaacagtagttatgaaattgtatgaacaaaatggacatttcaccttaaatttatgagaactttaaatttaattttaggctgatttttgtgtttcaaatgcaaaaatcataaacaacaaaattgtaaaactcatcgagatctacaactactgtattggtcctttttacaaataagtttatttgaacaattcaaattttgaattttcaaaatttgataacgtcaaacaaaaattgaggttaataaatgatttaaaatggaaaagtcaccaaaaccaaagttgtagaactcattgagatgcaaaatttttattttggtcatttctccatctgactctaattaaataatttgaaatttgaaattcaaactttgagaacttcaaatagaattttttattagtgaacgacttcaactgaaaaagtcatcaacaacaaagtagtataattcatctagatctacaatttttattttggtcatttgttcatccgataaagtgattttaatattgttcacaaaatttacatatctctcttatagttttataaaccatataagagatatgtaaattttgtgaataatgtttttatcactttgtcggatgaagaaatgaccaaaataaaagttatagatattgattagttatacaactttgttgttgatgactttttcaattgaaatcattcagtatttgaaaatgttgtttgaagttgtcataatttgaaattcaaattcaaattattgaacacaaagtcatatagcaaaatgaccaaagtaaaaattatagatattaataagttatacaactttgttgttgatgactttttcattcgaaatgtcgggtcccaaaactaatgattcggtaccgacatgtttagactgtatcaagc

SEQ ID NO: 31754 - DNA, 7977 bp, Oryza sativa
aaccgacatgtttagactgtatcaagccctggatcagtagattgatacaggttcaacaatctggctcttcattgcatacatttgaacagggctctagaggagttgttattacaaaatatatgggtatttacaaacttgtggctaactaatacagcagaagctatagaatgactcaatcctaatgttttgctatagacttaaaccatctaactaatctagacttgagaactaggttgaaatgaaactaacttatatgattgaactctcggcttcggcaagaactccaaattaattctgaaagaagggggttaaagcaagggtgagtacaacgtactcagcaagttattatattcaagtatgaatgtatgaaataatagtatttgagtagagctagatctaattgcagaaagctgagaaagtagaaggagaaagtctataatgttttgaaatgcaacaatatttaataaaatctggagttatatttctaaccaagatgccatagtgagtcccgatgctcaatatccgtgagcatggctattcgaatagtttcagagatactcatactgtagtagatgtacactttacccgcaatccatgacatgctaatattcatcagcttagtcatggcaaagcttttcagttcctaacattagtggtacctgttccatgaactatagtcctcatacgctctgaacgtaacgttatcagcagcgagaggagttctggcgttcccgaggtttttagagagaactggttgagagacccccgtcatcccaaccaggttttcacaatacacacacagcgcgcaataatcaatatatttacctacgcctcggtaaatattataatcgccctgctcggcgtaaatttgcctcctgcgcgaggacttaaagaagaaccactgtacaggggtaccacctttgctagataacatactttgctaagtctgtccccattctagaagttgcggtcgtactcgctcgttcttcacatgtacttggcaatcttatgtcggttggaacagtactagccacccggaaatcaaccatttctaccgtactgttccaatctaagttcattatattttatgcaatctaactaggcatggctaagcaaaatctagcatatatatctggtttgctatgtgttcaagttatgcatttaaaatcatgaatggctaatgcatggaataatagggatatagaatataggataataatgctcaaaggggaggaataataacttgccttgctccaacgcaaacaaatccgagataggcaacctgattatctgatcctcgaaacatcacaggttgccatccaaaagataatagactctactaagaaagacgaagaactaaattcaataaaagccataaaataacaagaaaacgataaatggttaggagggctagggtttggttgtgtgctagtcgatgctagagcataacgactaggtttggtatcttctctagccggtgtcaacaggcagcataacggctagagggataggaggtttgtgtgggtttagtggggcggaagtgttactccgacaaccgtgagtggcggtggagcggctaggatcacacagagcccgagagctaactgtgcggcgtgcaatggaggtcgaggggataatgaagctccgaccgttgtacgcatcaaggcgtggggtgccaggagcagcacttcgaccttgggtttggcctttgccaggctttataaccaacagttcgacgtcggggatagaaaaccacgaacgtccccatggaaggcataaagttccaaccggcggctttttagtggctaaaggggtaatttgggacaaaagaaaatatttgaaaaggcaaatataaattcaaacgatatttgaataaattcaaataaaattataaaatagcaaatttggtgtcaaaagatagggtttaagtttcactggaatttgatctacggtttaggagatatgagcttctaaagattgggttttgaattaaatctagaaaatacgaaaatgtactgttcatggacccagacatgtacctgctcttttccttttctctctctctccttcttctcgtcttcttcttccttcagccgatagaagggagagggagggcggttggggcgacggcgctccggtggctgactggctgcgacgtcggcgtccacgcgtgttcccgagcacgacgcacctggggagggcggtggctggcggagagagtgaaggagttggccggaacggcgacgacaggagctcgaccgtggcaacaaaaggagtggcggtggtggcttgatgtggtggctaaaagagaggggaaaggggaaaaatgggttcacctcgtcgaggcaaacacgatggcgcaagggcttggcttgtggagatgcggaagaggagatcgactgatggtggcagtggccggtcaaggcaggagagagagaagagagcttcaagctctgatgtggggagaagagggcgatctcgccggctatttataggcggcggacgtcggttcacgaaggtcggttcgccggtggtagatgaagaaggcacggcgacggtggcgtgaggaagagggacacggcgccggccctgtacgttgattggttgatgatggcggttcgtctgctgttgacgtcagcgggatgatgtgtagttgacgtcgggcggcggttccttcgcgtcgacggaaagaagacagcggtggcagagagtttgtgggcggtgttgagaggaccgaggacgacggcgcacaaatggcgcacggcggcggcgactgtggcgagggaaaagtcggctctgagagggggaggctgggccgacttgggccggtctgagaaatttggcccaaaagcgaatagaagttatttttcaattttggaagatatttgaagaaggaagtttgaatccaaattaatatttggaaggaaatttaggtggctaacttttgaaatgaatctatttttggagataactttcaaaagagatatttcctaaatatttgagtgcaataatgtggtctaaatattaaagcactcaaatgggagggaattaatataattcctcaaaatatttttgggaatgaggcaggaaaacaaggagggaaataaataggatttttagccccaaaatatatggtatggattttagagaagtatttgaggctaataggaatttggattcgtggaagagaaggataaaatatatttttttagcacaagagcaattattcacaatatctgtaataatattattcttgtgccgaagaggaaatcaagctataggaattaaattggcggctagattaaaaggaagaatttggatacttgagatttcgaaagggaactaaggataggttaacaattaactccaacaaatttggaattgcttcggtttaggttcaaggatagtgttggaggatttcttggaccatgattcataaaagtaaaaagattttcaaactaaatttgaataaaaggaattttttcaaaagaaggtttttaaattaaaacccaaaatcaagaaacaccttaatttaactaaatatatttttaaaggaaaggcacaaaagaaattaaataccagaaagagattttatgcaggttaattttaggaggtctctttaattataatatcctaggtttaggaggttaataaaaacataagaaccggtatgatgcataattagaaaatagctaattttttagtatgttacacgaaatcattagtatttgaaaatactatttgaaattgtcataatttaaaattcaaattcaaattattgaaacaaagtcatattgaaaaatgaccaaaacaaaagttatagatcttaataagttatacaactttgttgttgataattttttcatttgaattcatttactacccgaaaagttatttgatttgagaggagggaagtaaaatggacttattggcgagggaggagcaaaagggcttggccggtggcccaaagagggaggaggagggagagagaggctgtgggctaagggagggagagagtaatacttgggccgaaaaaggcccaaggacagcgagaggaattttaatttgtttttcatttattttaataggttaaataaactttgtggtattaaaattagttattgagctccgaaaattcacggaaaattttaaagaataatttagaccaacttatagccattttagtttgtttttttaagttttttcattcaatcataaaatgaaacaccataattctgtttttttattcataaaatgagactagacatgacttcaatcctaaaatcctaaaatgagagactagaattgatgtagacaagaagagttcacctaggacaaacgatttatggtctagtagcaatgtagtataacaagattttttttgtttttaaaaaatataatagttctatattttatgacgatccattattgtcatcgtgctatcgtcacagagcccatgcagagtatactgtgacgatgattatgacagatacacggtttgatcataaacagctgtcatcctgtgaacagtcgtcataaacagcctctgtttatgacagatatgtgttccgtcatcaggtaatcgtcatagaagcccagatttgttgtagcatgaagccacaccttctcatttatttcacacatctaaatggttgacgatatgtgtgaattgaacaaagcatatggagtgaaactacaaatcttatataccgattgcaaggttaaaaccctagatgttaattgggccacgtgtagggatgaaaacggatcggatacggacggaaactagctctaccatattcattttcatattttttttcggaatcggaatcggaatcggaaaccccggatacgaaaacggaatcgaatattgtcgaatacagatacggagcgaatacgaaacagaacgaatacggtgacgaatattaatcggaacataaaaaccactcaaactaagcatcacaaatcaacaatgaaatataacttgttattttttctaatagaacatatcaacatttccaaattttagtgttaataattttgctatatccaattttgtggttgagggtgacggcgtctgcaaaaatcgacctttattttctcatgcggctccttaagactagtttatcgtactcatatgaactccaaactggatgattctttttcctaaatgtttgtaaaatcatgctctattgtgttattgtgttcttactgctattattttggccatatttttcttgtgactttgttttatcaattaaaattttgaatttcaaaaaaatgacaacttcaaataatattttgaagcggtaaataatttcagctgaaaaagtcatgaacttaaaagttgtagaactcatcaagagctacaacttttattttggtcatttcttcatctaataaagcaatagtaacattgttcacaaaatttacatatctctcttataacttatgaaaccatatgtgagatatgtaaattttgtaaacaatgttactttcgctttgtcggatgaagaaatgaccaaaataaaagttatagatcttgataagttatacaactttgttattgatgactttttcagttgaaatcatttagtatttgaaaatgttgtttgaaggtgtcatattttgaaattcaaattcaaactatttaagcaaagtcacatagaaaaatgacccaaacaaaagttgttgatcttgatgcgttttacaactttgttgttgacagtttttttcatttgaaaacatttactacccaaaaaaatatttcaatttcatatattttaaaattcaaattttatatagttcaataaaactcggatggaaaaattaccaaaataaaaatggtagatgtcaatgagttctacaactttgtttttgataactttttcatatgagttcatttactatatgataaaattcgattcaaagtttttcattggattaaagaaggtgggtcccaactgtaagtgtcctcctcttccttttctttcccttcttctcttcctctttctctctctttcttatctccttctctgctctcttctcccctttcttctcgattctccatgccaaaggggaaggggcgggcatggcacacggcggggtggcggcctggcaaggggcgcggcggcagggtggcggcctagcacggcggggtgccggcctggcgcggcgggagtggcacaacgcggcgggcgagacggccggcgccctccccctcccagatccagcggcggcgggctagggaggggccggtcgtggccgggagcggcagcggcggcgggcgggagctgcgcggcgcggcgtgagcggcatggcagcggcgggggatctccggaggctctgacaacaacgatgggaggggcggctctggtggcggcggcggcgagcaatggcgacggcgacaacgaggacaaggacggctgttgaggcttcgagcgacgtcgacagcgacgaggatggcgtcgccggcggtgagctagggtttcggcatttttgagatttttatttttttttcgatttttaatgtggctgatttggatttggctgttgattttgattcggatatccggcaaaaaaagtccggatagtttccaaccgcaaccgaatccgagttctgacggataccatcgctactgtattcgaatccgtttccaagaaaaactatccgaattcgtatccgaatccgaaaatatccgaaaaaaatccgaccgaagcgatccgtatccgaaaacacggtcggaattcggaaattatccgtacatccctagccacgtggcaacaaacgtcgaactcagcccatcttgccgaggaagaggcccaggcacgacccatttgttgggccaagccgacacaggtccaacaacagtcgaggggtgtcatgcggtccaggccaaaaatctctgttctatgggccggaccattgggctacgggtcttttggccaactatacaccacaggcagccgagtacgagcgaaggggagacaaggtcatactgtcgcagcaccatccctctgctgcaacagccatcgcaagtgttccatatcggccatgccagattgtcgccgctcaagtcgtctttgactcctcgtcgacgccccgttagatctacccataggcgccgctctatgtgccgatgctgcatcgtcgtttccatcctgactcggtcgccgtcgttgcaaccgctcctccgaacttctattactagtatgccactccaacggttttcaccacagcccatgggatgccctaccagatccaatgcctgggcgttgccctctacacccttggtagtggcaaaaatgtcatgcgccacaactgcaccagccagcccagctgccgcttgctaacgccaagtctgaccgcatctaccaccactgtcctgagccgtggagatgggattgaggccctctttggatggggtaaaaaatctttttattccatgtcatatgggagtattaaacatagactaattataaaactcatttcataactttggactaattcgcgagacgaatctattgagcctaattaatccatgattagcctatatgatgctacagtaatatttgctaattatggattaattaggcttaaaaaattgtctcgcgaattagcacttatttatgcaattagttttattatcaatttatgtttaatactccaaattagtgtccaaacatccaatgtgacatggactaaattttagtccctggatccaaacaccaccagaaagagcccatcaccaccgtctttgcactcacttggaacttcggcagcggcaaggtcaaggaaggcaggtgtgcgtcgcttcagctagattgagatggtgcgcaccaaaacataacccatacatagggggtgttttagatacagggggtaaagttttggcgtgtcacatcaggtattatgtagggtgtcgtaccgagtgttcgggcactaaaaaaataattacaaaatccgtcagttaaccg

SEQ ID NO: 31755 - DNA, 9762 bp, Oryza sativa
  unsure (1)..(9762): unsure at all n locations
atgtcatatgggagtattaaacatagactaattataaaactcatttcataactttggactaattcgcgagacgaatctattgagcctaattaatccatgattagcctatatgatgctacagtaatatttgctaattatggattaattaggcttaaaaaattgtctcgcgaattagcacttatttatgcaattagttttattatcaatttatgtttaatactccaaattagtgtccaaacatccaatgtgacatggactaaattttagtccctggatccaaacaccaccagaaagagcccatcaccaccgtctttgcactcacttggaacttcggcagcggcaaggtcaaggaaggcaggtgtgcgtcgcttcagctagattgagatggtgcgcaccaaaacataacccatacatagggggtgttttagatacagggggtaaagttttggcgtgtcacatcaggtattatgtagggtgtcgtatggagtgttcgggcactaaaaaaataattacagaatccgtcagtaaaccgtgagacaaatttattaagcctaattaatccgtcattagcaaatatttattgtagtactacattgtcaaatcatggagcaattaggcttaaaagattcgtctcgcaaattagtcgcaatctatgtaattagttatttttagcatatatttaatactttatgtaggtattcaaatgttcgatgtgacaggatgtaaagtattgggatgggatctaaacagggtcgtacttgggagttttatgatacactaggaaggtagcccgcgcgatgcacgggcatatgtattagtttgttaaaaaccggtctaacaaattaattttaacttaaaagtaagatgtttttcattcgactttttctttcagtgagccgagtcaaatgatgtggtgtttttttaatttgagttagaatcgcgcgtgctctctctcatgaacagaacatatacgtggagtatgtgtggctgaatcatggctggcatcattaagcaatggtggacggaatcatcttgaagtttttaagtaggttaagattaagattagatctaatgattgaaaatattgaaaaggcagtggttagattttttttaatataatttctgtgaattttacacatgatgataattacacgtgattataattacatgttggtttaggggcattggtatgattgccacgtgatgattttaggggcatttaaaggatctaaatttaatatttgtttaatatggggcttaaaaatttgatcttaaacatttatattagaagtttgagctatgtatatggatctcgaattatgtatttaattataaatgacacaataattcaaaaaaataagaaaaaatgtaacttgatatttatgatcatttagaaatctgattattagtttttgatagattgagtgttaacttaaaaagtagcaattagcttaagaaataggagagaagaggagagttaggagggtggagggagaactcaactacgacgtaggtgcgcacatatggaggtggcggtgaggatgcatgtattagattttctttttagatgaagatctaatggttaagattaataggtccatcaatttttaaaagaataatcgctaaacatttattagaatttttacgatttttttattaatctattagctagaaaattaaaagaaggaaggaaggaaagaaggagggatgtacgtaccgtgggaggagccccgggaggaaggaggcagtggagatgggttttggatttttttaaagatagatctaatggtgtataatattaggtccatcgtattaagtgaaaatcgagggcaagatgttttttttcctcataatttttatgatttctctaatttattaaagcgtcatgtgaccagttaggagtgtttataggaagtttaatgggctttagctaaataataggaaggggaagaggagaggagaaccctgagcttttcggagagggaagggtcgatcgatttaaataaaaccgatgatcatatgcatttttcccctaaaaaataggttttttttaaaaaaaaaattatatgtgaaatgtgaagacatagaggtgttgtaatggacacctcatagatgatgatacgatatatgttgtcaatttttatataacgtttcattgctgcttagttatcacggaaaggatatggattcatgtctaaaaatatatttatcatatatcaagaaaggcctatatggatcaaactaaaaactgaatatatttaaaaatataatcatttagctatctattatttatatataatcatttagactatctgacgattggccaccagctatgcctgtaacaaaggaactcacatcccgtaactatatctcaaacagctttttttttacccattagatatgagataattgcagatgacccatcggatgcctatttctatataaaaacatagtaaatagagtgaatatatgacttagctcattgattaatttaattaaaaaatacaatcattcaagcgtattgtaaaatcaatgtatatattgtccgtaaaaaaatattagtgcttgaacgttgcacagacagctcgatgctccatgcaaggaaagatataaccatttacaataataagttatagtgcatatctcataataactaccttaattagaaaaagaagaaaaaataaagagaaaatgaggggagagggattttattttgatatgatgttttaaattaccggtgactattctaaatgaaaatcaacagtttgattttttttttctcataatttctataacttcttttttttccctttactttatcgcttttatcacataagtctgtgcttatgtttttcttctcgtccgatgaacagtaggtaattaagcttcatcgtttttctttcaaatgtacataacgtactgaatacttttttttttcccttttccggcccacaggaggaaatcattaccttttttaaataatacattcaatctaatggtttaaaatacagggtccaccaatttaagtgaaaatcgatgatgagattaaacagtgcaatgtaaacagtgcaatgtggcgatctagagatgtttgtaggagcgtcacgtgacggcttcagagcgtttgtagggagtttattaaacttttagtatataatagatagatagatatgccgtaaaacctagggttctctaaaatccactcaataagacgtgcattagccaaatgtttgtgtccaaatctcactaagaactgaatacaaaactaccagcgcaagaatagatttcaaatcaaaaaattggattcaaaatttatgcagtaaattaataagcgaacgactagccgattactagtttttactggtttctttatagttgaaagcaccaagctatatatctcaaaggggaatgagtcgcatgatccaaattccaaaatagcaaggatcgttgtatgcaactggttaaaaaaacacaccgctggatactattgaaccaatcaggaggctcacatgatctacgagagaatccatttgaagcaatgaagaggcttaccagaacacccctgttatttttaactctatgtttggttaattaatcaggtgatcaaataaagaataaaaatgaagctttgaccttgaattcatacgaattcttttcctggacgtgcacatacgaacgataagtcctacatatatatttactgcgcattgagattaaaaatatatctatatttacatgtattttctaatgttctcaaattaccctatgtaggataccaagtgtttgaaatttatccaaatattcataaagtactatttgctcccatcaatctcatatgtcactacttccaattacatctcaactccaaccaaccctgactaaacgagtaatataagtctttttcttttctcaaccttaatctttattaacaacttataaaaatccttatatttaaggacgaaatacagttctcacataaaaccggccccaaaattatcaacttcaatcgtccactcgtatacgtagaaccaagtcgctagtctttttctggaaatgtaaaacaatactgttctctcacaaggtccaaccgacctttcttaaatgaagggcccagatttgcgctaattcacagatggctcctctgcagcagcaagaactagagctggggtgtgtttagtccacgctaaaattaaaaatttggttgaaattaaaactatgtgacggaaaagttagaagtttatgtgtgtaggaaagtttttgatgtgatggaaaagttggaattttgaagaaaaattttagaactaaactcggccctaatgcagagtttccgcttctactaccttcaacttcaagtcattaacaaatccacaactgggccacttaagcagtaatttaaatcctcatcccgacatatgattgatttcccaccggccaaaaccactgcacgcgccgatgcaatcagaatcaatttctattaacattgacctctcgcagctcgcgcatgctcatctcgtcaactaatgatgaatgaatcgtgaattctctctctctataaatggctactaattcgatcatcccaaggcaataatccacagacagcaaaggatgatgcaagccaagaagccaagatcaccattgatgatgctcatcgccaagaagccgctgctgctgcttcttcttctgctcgttctcctggtgttggagccaagatcatcagcagaagctaacctcgtcggcgtcaatggcggagagacggatgagaggcggcttgagagcttggtttacgacgagctgcccttctcccagctcggcttgggattccctaccaccgtcgtcgccggtggctccgaggtacgttaattacgtacttaattagcgcaaattcaattgctgtaagaaagaaaaatcactcaaatgagaggttaaatttttttttggggaaaatgagaggttaaattaggttccaattgactgaaaatgcagcaaagttttttttaattgttcgagcaaagggatttcttcgggtttttgtgctcttagatgacattggtgagcgcgcccatgcacgacacaatggcatgttcagggagtttccccgcacgcactacgatttctttaggaatctttcgcatctcaaataatctagatttttacatggattctgaagattgaaaacctaacattttgagattcttattggatagttattcgataggataatagttgcttcgcagaatctcaagcaatccaaatgggacctatatatacatacatataacggctcaattttccgttatacaaatacgtttgtgattaaaaaaattagtttaaaccaaaatgggctcgcaagttgtcttttgagaaatttcaaaccctgtttgtcgctaccaaactctaagggctctggtgatctgttgcgcgaatatcatcctaaaattttgccgaatatttgacacagaatgatgtggaggaagttgtgcaagcatggtacatggacgacgacgacaacgcggaggaagaccagaggcttcctcatcgccgccagcctgatgatcttcttcctctcgccaaattgcttggtatatatatttatctacatatttatcgagcttttttttaaaaaaggttaattttgtttagcctcgtaagcttgttaattaatttctttccagtggcgccgatatccatgcgatgtttaccactagtgtgtatgtatgtgtgtacacacaaagatgacgagtttttaattagtttttttgcaatttgcagacctcggactcgttgcaatgcgattagatgcagataaccatgagcacgatgagaaccttaagataatgcgtgaacagagaggctacttgcacatggttagtcttcttgctattaggtcaatctttacttttaaaaaaagatgcatatgcatgcttaaattagtttttgtttctgctttcaaaatatacttgctattaggtcaatatttacttaaaaaaagatgcatgcatgactaaattaggttttcttttttgtctgctttcaaaatatactcctcatatagacataaatattagatgtttacgataggaactggtcaaactattgaaactgttcatctattttattttaaataagtttatcaaatctacttctgctccagaatataaaaatttttagagtttgatacggttattaagaaaataggtagaattatatggggagaggttgtgattggttgagaagtggaggtatgtggaaaaaatgaatggtggagggttgtaattggttgggagagaatattgatgaagaaatagttatatcttagattaaattctaaatgctagaaattgttatattttaggacggatggagtaataagtttatggtggtattgtgatagcccttttcaagataaatatatacatgtcattttttttgttactaagtattagagaagttggtggtgtaacttttaaaatttagatcaaatcttgttgtaaatgtcaaatatttatgagagggagtagaagctttgaaatgattaccttgttgttacatatctatactatctatatagttgataccaactaactcctaaaacttaacatctaaatgtgcaacattatcagccactagcaattactccctctattttttaatatataatgccaatgatttttttaaatacgtttgatcatccatcttattcaataattgtatgtaattatgatttattctattgtgacatgatttataaccgaatgttctttaagtatgacttaaaatagttttatatttgtacaaaaattttgaataagatgaatggtaaaacgttgatttttcacatattaaaaaatggagatattattatctagagtattttaaataccatgcaagcatggcatcttatttataattttgttgtatttttagaacttgatatacaagcaatgtcaaatcattattttcatattatttaaatgtatacatctatcatttatataatgtataacatgcattcatctacatatcacatagcaaatcacggggtatcaactagtatatactaataagtaaatccacgtcctatcacttaattttttggcatatccatatgccattcattattatttatatgaaagaaaaataataataatgtggtttacctctttcggaaggcatcatagggggtgtttagatccaagggtgtaaagttttggcgtgtcatatcgggtattatatagggtatcgtatggggtgttcgggcactaataaaaaactaattacataatccatcagtaaaccacgagacaaatttattaagcctaattaatccatcattaacaaatgtttactgtagcaccacattgtcaaatcatggagcaattaggcttaaaagatttgtctcgcaaattagtcgcaatctgtgcaattagttttttagcctatatttaatacttcatgcaggtgtttaaacgtttgatatgacaggtgtaaaattttgggtgggatctaaacacccacatagtttctctttgcagcaaagctgtgattaatttgggccagctctagttagatctcaatggccatggattgtaatcctacttatggctaataatgatcaatcgattatccaatctaaaaaatcgaacttaagtatatgcattttttgcattttcgtaggacatcgttgaattgaccccagagaaaatgccaaattatgaggtgatgatcaagagattcttcgaagaacatctccacacagatgaagaagttcgctattgtcttgatggtagtggtatgtgcgaacaatttactttaccttgattttttgttataacgaaacctttcatctcaaaaaacaaagaaattttttatttcactatattgctgattttgaattttggaattaatgaaggttacttcgatgtgagagatgagaatgacaagtgggtccgggtttcagtgaggaaaggggcactcatcgttgtgccagccggcatctatcaccgcttcacacttgataccaacaactacataaaggtaattaaagggcatagaattttcaattaatggaaccaagaaaatgtaatctgattggtttctggtttatttctacaagattttatcagatttaacttttgaaggtagttgtgctaactgcatcacattagctccgaaaatagccaaagcgatgacaaatatctctactattggattcataaagagcgaatatatagttggtcagcaaattccccttggtccttaacaacaattttatcctaaccatgatcatgacatggtaccctttcaaatatttgtagtcattttcttttgtttctgagtgggtatcaaaagaattccttgcagttcagtaatcctttcgtgattaattaactgacagatggggcctgggggcctcttgtttgggtttttacagaccatgcgtttattttcaggtgggccagattggacggcttacaatcgtcctcatgatcatctgcctgaaaggtactctatttcactatgcagggataaatttcggggttaatctaagctaattaacctgttccctccctctgttttttttttcttcaggaagaagtatctagaagcgctgcataacaggaccccgagatttggacaactgcatcgaattcgctcaaaaatggagtaatttttattttgaaaatagcattaatatatacccatctttcctcatcattaataaattttagattttctgcatccgtcaactgatgttgcgaagtgattaagatggtggtgttagatagggtgcaatgggccaatgtttgatctcttgatcaagcaacgacaagatatatatggatcatgtatgtatttttttttaaaaaaaatgtatcatgtatgtagaacaattgctccaatgcaagtgtttgcactactgtagacctcctcatgtataacatttcaaaacaatctatctataatgggtatgtcaactgatacacattccattgatcaaaggaacccttatctatatatagcggctcagaattacgaacccttagatttcaggatttgtcaattgacgttatacacagatatactcttgttagtaacggctatacaatggcctattcatacctgccgttatagatgagaggtaataggtgacgtcgaaacctcatctataacggctaggtattagcaaccgttacagattattataactgatacccttaaaaaaatacaagtacttgagcatacctgccacgattgtaatggccatcacggcaccatcgcccttgttccactaccacttgtcactagatttgtaccctctaattaagcatagagcggcggattcacatattccctccgtttcacaatgtaagtcattctagcattttccacattcatatatctatctagattcattaacataaatatgaatgtggaaaatgctagaatgaatatatctatcgagatttattaacatcaatataaatgtagaaaatgctagaatgacttacattgtgaaacggaggaagtagttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 31756 - DNA, 720 bp, Oryza sativa
aacccatttttcccctttcccctctcttttagccaccacatcaagccaccaccgccactccttttgttgccacggtcgagctcctgtcgtcgccgttccggccaactccttcactctctccgccagccaccgccctccccaggtgcgtcgtgctcgggaacacgcgtggacgccgacgtcgcagccagtcagccaccggagcgccgtcgccccaaccgccctccctctcccttctatcggctgaaggaagaagaagacgagaagaaggagagagagagaaaaggaaaagagcaggtacatgtctgggtccatgaacagtacattttcgtattttctagatttaattcaaaacccaatctttagaagctcatatctcctaaaccgtagatcaaattccagtgaaacttaaaccctatcttttgacaccaaatttgctattttataattttatttgaatttattcaaatatcgtttgaatttatatttgccttttcaaatattttcttttgtcccaaattacccctttagccactaaaaagccgccggttggaactttatgccttccatggggacgttcgtggttttctatccccgacgtcgaactgttggttataaagcctggcaaaggccaaacccaaggtcgaagtgctgctcctggcaccccacgccttgatgcgtacaacggtcggagcttcattatcccctcgacctccattgcac

SEQ ID NO: 31757 - DNA, 688 bp, Oryza sativa
ccatcaatacaattatcttggtaaaaataatccgtgtgagtgctaatccttcctcgtagaacaacatttgggaccatgtgtagctctccaccaaacgatccctaagataacttagccccacatatccagtaaggtctttccaccacctaaaataaaagcacttaattaggtacaagcctagatagtatgtttaagattattattagcattgcacataccaattctggtaggatcaatatggacaatacacctttgtcagacatgtatgttcaacacattgtttacatataaattatatgtatagtgtattaagctttaataagattgagatgaatacatactactgcaatacttattttctacttggtgggtatatatcaaagagattccatactcagaaatagctttgagctccttcaagtggaccccttgcaaaatattaaaatccacctttgcaagatccaaaagaaacgaaatatgcccttcctcttgtccatactccgaaagataatgcaatgtttccactcttttgtatgtcctcggtagtggtaagtgaagggcacgcttgacttggtcagctaaagggtgtttgaggttaccacactgcatcattgattttagatggtgcctagaaaaagagatggcctcttcgagttctggttcatcgtgaacgaggaggtaagctgca

SEQ ID NO: 31758 - DNA, 805 bp, Oryza sativa
agcatcgggactcactatggcatcttggttagaaatataactccagattttattaaatattgttgcatttcaaaacattatagactttctccttctactttctcagctttctgcaattagatctagctctactcaaatactattatttcatacattcatacttgaatataataacttgctgagtacgttgtactcacccttgctttaacccccttctttcagaattaatttggagttcttgccgaagccgagagttcaatcatataagttagtttcatttcaacctagttctcaagtctagattagttagatggtttaagtctatagcaaaacattaggattgagtcattctatagcttctgctgtattagttagccacaagtttgtaaatacccatatattttgtaataacaactcctctagagccctgttcaaatgtatgcaatgaagagccagattgttgaacctgtatcaatctactgatccagggcttgatacagtctaaacatgtcggtttccgaatcattagttttgggacccgacatttcgaatgaaaaagtcatcaacaacaaagttgtataacttattaatatctataatttttactttggtcattttgctatatgactttgtgttcaataatttgaatttgaatttcaaattatgacaacttcaaacaacattttcaaatactgaatgatttcaattgaaaaagtcatcaacaacaaagttgtataactaatcaatatctataacttttattttggtcatttcttcatccgacaaagtgataaaaacattattc

SEQ ID NO: 31759 - DNA, 991 bp, Oryza sativa
aaaataagtttggttggctccttttcctttaattttccttttgggtcaaaataaatggagtttaaatggggcagttaacttaagtatatgcattaattcttcctttctatgttcctttaaatgccgccccatccaccggaaagcttgatcgatgcggtaggattcgtcagggagctgagaatgatggcatttgaagtaggctacgacgttgcccccgagtatcgccaaatttcatgtgaccccaacgaggagaagtgtcgtgttcacgtgacattgactagtgatcgtgaagaccttccgtcaatgatgtttgaagctgggggaagaaagtacagtcatgcttgtcaggaggcagccttggtggccattcgagagctacgtcatcgctttgatgaggaattagtcatcagctttccagtatcatccacacaagcatcatgatcaaaactatggagaatacaactgctctgaagatgaagatagcaccactctgaagcatgccgtgtatatgctttgcgccatggatgcagttggcgtggagcgggagaaagcagctcatgagagggaaatctggaaccgtggcaagattttcaagctagagagcaaggtgtatcgcttgcagaaggaacttgccaagctcaagagagaagcaccgccgtcaactaccccaaaggaggaagatccagaagaaagagagctagctaccccagaggaagaagatccatctcttcgctccgacgcaaggcgggattagtgcctcgttagaccgttatcgtagttcgttgtgttagtttgcttgtgcgtgtgtgggtttagcgtgttgcttacatcattggtgggatgtaactacatgagcttagttcttttgcttgtcagagagtaaatttgctggtgagatagtgttaattcgatttaaatgtaatcatacacagttaagaacaatagaaattaaattaattaagttatccgttctaagggtatctctctgtcg

SEQ ID NO: 31760 - DNA, 746 bp, Oryza sativa
  unsure (1)..(746): unsure at all n locations
nnnnnnnnnnnnnnnnnnnnnnnnnnnnnnnnnnnnnnnnnnnnnnnnnnnnnnnnnnnnnnattaccacactgttatttcccatatatgcattgcccttgcattctgattaatgcgatgctaactaactgttctgatgaatctatacttaatttcaagcagagatcagagacatgtatgcaggagagggccgagaagttgaaaggggacatccggacattgtttgggacctgcaatgacatttcggcgaggatgaacttagtggattccattcaacatcttggaatcgttcacctcttccaagagcagatagaagatgctctaatgagcatccatgagagtgaattcacaagctctagtctctatgaggttgctcttcggtttcgcctgcttagggagcatgggttttgggtgcctccaggtatccaactgcatacatccatctacgaatatggaacagataaatttgtgccgaacaaaaatcgttattgattctgattcaccatagacgatccaaactttgtgggacaggtcttgctggtttttgcttcttctgtagttcaataagatcaaatatacagttattagtagccaacctaaaactttttttaggagatgtttgcagctctttctatttgtatctacagttatatataccaacaatttattattccctgattagatatttttatctttgcatttgctgatagttgctaaaacttacattttgttaatttgtttaagac

SEQ ID NO: 31761 - DNA, 3539 bp, Oryza sativa
  unsure (1)..(3539): unsure at all n locations
nnnnnnnnnnnnnnnnnnnnnnnnnnnnnnnnnnnnnnnnnnnnnnnnnnnnnnnnnnnnnnnnnattagaagatcaggacctattgcctcatcagagtcagtctcaacgactacatatgccattaggaataccaaatgatgacaattaattgcaacaactgctgccaactaagctatgattattttgacgaaaggaaaagctatgtcaactttgtgtcgatggttgaaacacttcaagctacagttgatgaaatagttcatcgtaccttgttcgatcaatctggagttttgacggatatattgcaaaattcgatcaaaaggatagttgatgagttaattgtccaaagacgccagctcgggtggcagattgaagaacaacaacaatatcggctcggggggaaaacatatcagtatcagcatgatgaggcatatcaacaatatcggccagaaggaattcaaagacatcagtgtggaggacatttggccaatagaattgcaaagataatagaggagtagtttggattcaagcctaaagaacatacttcagtgtatcagctaccatatcctgagtggtttgatagggttccatttccacaccgatacaaggttctagacttgtccaagttttcaaggcaagacgatatatctacaatggaacatgtcagccgattcttagcacaatgtgaggaggcatcggctgaagaaactctgaaagttagatttttccgattatccttgactagatcggccttcacatggttttcttctttaccatcaaattctatcaaaggttgggccgatctagaaaagcaatttcatacatacttcttcgctcgcatcgatgagatgaaactttcagatttgatatcagttcagcagcaggaaggagaatcggttatggaatatattcacagatttcgtaatgtccgcaaccgatgttatagtttaagtctaagcgatgagcagctagcagatcttgcgttccaagggctatcaacacctatcagagaaagattcttttgccatgagtttgacagcttagcttatctaatgcagacagtatcggctcatgaaagccgattggaagaagcaaaggaagatcaattttggaggtaccaagatcggacagaagataattttgaagcatgagacctcatactcaaaaattggggggcatgtgttaacgccaaaatttggtaagcccgaagtcaccatcggcctagagtcagtgtcggcttcagagtcctgggatcggccgatgagagttatcaaatcgcccgttgtcggattcttactatattcggttaaggaaattaatctactaaaggaagcttatccagaagtgatcgaattcaaggaggatgcggcatggcgagttatctattaattaggaatagtttgttagtttccttttatccttaggaaagtgtgtttagtgtcctataaggactttatgtttttatttttttaggaaagtttctttcttgtcctacaaggactagtatcttaccatgggtataaatatgtacacccggggtcattgtacaaatatctctcgatcaatacaactactctcggcccatcgccaccctcttttttgaggttttttcttattcaaccggcggaatttggcacctgacgcggggctatatcggttcagttcgatctccggcgaaggggtaagtcctacgttccgccggccctggcgaatctatcggctgcgttggtgttgttcaaggctgcatcgctttgatctcctggatcgctctggtttggttgatatatttgcctacctgatatctcaattctatctctaattgcattgtgtttagagacgcatcagtttagttgggactgtctcagttaggtccgatcttctgtcttagccgatatatctctacaatcacaatgttgttctaaatagatttgttttatccatcacattagacagatctatcggctcatcgagtattagattatcgtatataatctcgtgctgtatcggttaggttcgacctactatattgttgttgataatataaatcttgttgaactgataggttcatgctttatcggggtgctagccgataagttatctggatgttgcatcggcttataaggattacatataagttgggtttagccaatcgcaacaaatgttacactgtttaatctaatcttgtggattttacgacatcggacctgcagccgatgtatgctttaaccgtcggatcagtgcttattctatcatgtcaatgtcagccgattggtttatactggattaaattgttgctttcttgcattatcatcagccgattgcctttatgtcaatatctacattggacatatagccgattgctcaaaatcctatcgctatcggctggtatcggcatcggttggaattaatacatcggcttgtcagccgatcggcacattgatctgctatttgtatatcttatcagttgtagggtcaaactgactggtatgcccacatctcaccaacatttggtcctgcactggagctatgcagatctccctggccagtgtgtgttttttcgcgtcaacacattttttatcaaatgcttactgctgcaataggtcattggcccccatacagcaagctgaatatgccctcactctaacatcgattgtcacattgctttgattagatatacaaattaaattgtaccaaagtacccctaataacaaaagggttggctaaatcggtcctatattacaccatacattacattagaagagaagatatgaaattacctctccatcatatattataaccatagtcaaatagcaaggagatgggggtcgacaagacagagcagtgggcagctacaaacagcaatgggtggagatctctgcagccagtcggcctccctttgcaccccagctgcgggccgcccttcactagagagccaagtcgcacataggcctccctctgtccaaccccaccccttccttcctctgttcctgcgatcggacgagctccgaatgcgctcacgcccgcaccagccaacttccctctgagctcgtgcgcactgagctccatccatgcccgcaccggctgagctccctccgccctgtgcccacacctggcagagctccgtccgccttcgcgaccgtgcacctagcatagctccatgccggcgaccgcacactgcatcttgctccgcgccgcgacctccctcccggccacacgctgagccaccaacacttcgctcaccttctgctcgcctactgcccaaagcctagcttcgtcaagtctaatatgggatgacggaagcagtggcgaatctatgatgaaaatgtaggtggggttttatttatcatcgtaatataaaataatcatatatctttgatctatatcaacaatatttgaaaatcctacacggatagaaaaaaatacagtggattaaagaatgaagggaactgaagagtgaaaaagattaaaagatatatatagggatgggctacacactgacagctactaaaacacgaaagtaaaagtaatccacatcgtttc

SEQ ID NO: 31762 - DNA, 4248 bp, Oryza sativa
ctatagggcgaattcgagctcggtacccatgatgaaaatgtaggtggggttttatttatcatcgtaatataaaataatcatatatctttgatctatatcaacaatatttgaaaatcctacacggatagaaaaaaatacagtggattaaagaatgaagggaactgaagagtgaaaaagattaaaagatatatatagggatgggctacacactgacagctactaaaacacgaaagtaaaagtaatccacatcgtttctttcaccctgaacatctccagccaaatatagtcatcatcggttggctgtttgctgtaattaattttgttggcactatgaactcactagtcactacacatagacatagatatctgggatcaatccctgtcagccagagctggggctggagcctcaaccagccccaacagtggattcgccacaaccagccccaacattggattcgccactggacggaagggggaggaattagaatccacccactcctatgttatttcctaggagcatttcagtctttcatcctgaaaatgacatacacccctaaagcttggtttggaaagggtcagtcggcaggtttggtattttaaaccggggttaaataaccaaagtttaaaagcagggctaaactcatagttaggttttaaaataggtacaatggtgccattgcccctactaattatgaaattaaggattacgtgaccaaggaaatctaaaattaccatgacttaactttgtctttaaataatattgttcatatgtccttaaatgttttccatctatctatctataagtttactaatttgactctgaataagctcctaagttaatcataaatatcttacgatcaattagtttgatcgaatgatcatggccttagatagtcaaattcgtataaaataaaaatatataccttcaaagataacaccaattgaaaacctatgcatacggtttaatttgaattgaaaacctgtccagaccgaaaaatcatgtataactttgtcaaggttggccaaactaggtatacgtagtcataagccaattaattgctatagaactagatctttgtctgaatcaatatcaactatatcaactattcctaattaatcttagtgataggtatgaaagattaatctatctgctttttatttagaatgacttgaccgaattcatttgtgttaactaaatataccactgaaaatttcaaactattcagattttttatatatgccgatacaattaagaaaaacaactaatatttttactaaatggttaaatttttaatatattataacattcacaataatagtccatgtaatacttagtctggctactaatataaataatgtatctatacaaatagcccgtgtaaatacatgggtttctgatgcttctactttggtagtacactcacaatattcttgaatagatgttactctaggatatgtgtaggcagaaattgaaatgtttaataaatattgtacaggaaaatattaaggtttgagacatagatatgtaaaatagatatttatatatttataaatatagctactcacttctagaaatcggcaataagaaaaaggggtggcatacgaaatctaaaagtggataagtaaatggaataatgatttagacatgcttaaaccttgtcgacaagaagtaatactctactcctgattggggattgtatccgtcgagtgtgtattgatttgacaatcgagtacgttgtgaatatgctctttgagggctccctgtccaccttatataggatcgagggcatggttacaaagaggaaagcttagccgaacatgagattggtttccatgccgtgggaaagaagggaacataattctcatgtcttaaagaaattacgtaatacatggatccagctcacctcctatctctctttttagtagtcttttttaatgttgatttgagaaaaaataatgatggaaaagatgcatgtcactactacagaaaatctcataggttgggaatgggctataggtgccagtttcccaaccggcacagattggtcggtacctattctcgaaattattggtgcgggttgtagagccggcacctatgaggcatatggaaaaaaaaaagagaaagaaacgccaccagtctccgccaccctgccgcccgccatgcgtctcgccttccgccaccgccgctgtaggccatgtgtgcggccacttcactaccttctcaaccaccaccatcccatccaatatcacatcatccccatccaaaaatcaacagcaaactactaaacaagatggacatggaggaggagaaagcaatggagaactcaagaagtcaccacctcaccgaacgccacatcgctcgtgccagcctccaccgccgccgttgccaccgccgtcgcgggatccggcggttgccgccggccaccgcctcgctgccttgccacctctccacgcgtgcgccggccgccaccacccgggcctgcctccgcgtcctccgtcggccgccgcaaccacctcgccacgcctgcgccggcctccgcgtcagccgccacccgggcctgctgccgctcctccatcgaccgccaccactcctccgtcagctgccgcgccgttcgataggtaaggggagaggaggggcgaaggaggagaaataagaggcggaagatgtggataagagaaacgataaggtcgttgtggataagaaggagctgcgaggttgcattatatgctccggtttttttaataggtgccggtttttcaacagagccgacacctatgcttatattatatgtgccagttttctttagaaccgacacctataatataagagtaggtgtcggttctattaaaaaaccactacctacagtattggtgctggtttttctctagaatcaacacctatattaattaaaggtgtcggttctatatttttttcatcgtgtggaggtgggaaaaggctcataggtgccggttttaaatgaaccggcacgtataaggccggttcctattagggtttttgtagcagtgtgtattgattagtgcttgtaatacttctactcgatccctctatgacggaaaaagtctagtacagaagatggatgtaagttcagattcatctatggaattgaatactctctccattttaaaacgtttgacaccgttgacttttagtacgtgtttgaccattcgtcttattcaaaaatttaagtaattatttattcttttcatatcatttgattcattgttaaatatacttcatgtacacatatagttttacatatttcacaaatttttttaataagatgaacggtcaaacatgtgctaaaaagtcaacggtgtcaaatattttgaaacggagggagtatttttttacgtagggaagtacatggagtctccttactgaacatatggaactcaattcctgattgaacggtactggcatgaacggtagaacgggacagtagggataaggatcaggaagttcggcagagatgtttccacgagtttagtacggtagtattgttgatccacatcactaggcaccggaatttctgcccggtcattctcctccacacaagagcatacaatttctccggaaaggacccggaccagtagagattgagttggcgtgtagctcttgcctctcaaactctcccaatcgttgtacttagctcaggtacaggcactgtatttgtgtctctcatactctcacaatcatcgtattaattagcacaggtacaggcatactgtacgttcttgttctggaagacacgtgctttaggtttatcatgcacttgccagctggttcggtagagcagtagccaacggcaacttccttcttatcacgagcacgtctcctgtatgtttttcgaaaataacaattatgaagaagttcttttcaaataccaaatgaactattttttaaaaattttactagttaatacttagttagtttgcctcgtttcatatatcaccgacttatcaaatcctactgctctatcgaactaagggcatcagcaatgtatcgtttaccaactaccactactacaaaactgcatacagaggtcggcgctaaagttgctagaagtgttaaaacctgcacttataggtcttctcccactttcgcggccttagaaaacagaaaacaacacctttaaatgattataggtgccggttttgtttaaaaaccgacactatactacatgtgctatgttttattaagaaaaccggcacccccataaaatcgag

SEQ ID NO: 31763 - DNA, 5543 bp, Oryza sativa
  unsure (1)..(5543): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaggaagagcattgctgagaaggagagtgaagggcctgaaggaatgccttttccgcggaaccggcatttcgttggaagggagaaggagctaagtgaaattgaaggaatgttcttcggttccacggtggatatccaagaggttgattgcccgaggggttccgctgcgaatgacagatcgagtggtgtgtctgatgggtttgctgatgaggagagtgacacagtgaggacatcgaatgccaggtatatcagtttggagatgcgcaagtgcaaggagccgacattggaggcctggattgatccagttatagagttatcatcgggtaaagggagaaatcttcagaagcagagatcaaagcacaggaggtcaaggtttcggtgcaacagcaaaggatatggcagtgccagtgtgctctgcatcactggttcttcaggaattggcaagactgaactggcattggaatttgcttaccggtattcacagcggtacaagatggtcctgtggattggaggtgaagctcggtatttgaggcaaaacatactcaatttatccatgaatttgggattggacatcagtgcagaggctgagaaggagagaggtaggatcaggagctttgaggagcaggagtttgatgcttttcagagggtgaaacgggagctgttccgcgacgtgccgtacttgcttgtcattgataaccttgagagtgagagggattggtgggaaggtaaggatctccatgacttcatccctaggaacactggagcgacacatgtcattgtgaccacacgtttaccacgtgtgattaaccttgaaccgatgcaactgccacagctctcatacaatgatgccatgatattgataaaggggaagcagaagaatgactatccgcctgaggaaatggaagttcttaggaagcttgacgagcggttaggtcggttgagctttggcctgtggatcgttggttcactgctgtctgagctcatgattacaccttccactctgtttgaggctgtcgagagaatatcactgaatgagagtttgttcccacttggtgccaatgacgatggcttctgtcgtaacaattctttcctaataaaggtcctggtcttttgttttgcattgatggaccgagcaaaaggaggaagccttacctcaaagatgattatcgctggttcttggttagctcctgctcctgtgtcgtctacgctattagctgcaacagcgagcaagctaccaatgaaaggcagtatgcacctgttgggtgaatccctgaagactgcatttctatgcggcacacattgctttctagctccacatggtcgaaaagctgaggtggagtcagcactcttacttgtcaagcttgggctggcaagaaaggcaactcgtcatcctggctgctggatccagttccacccaataacacagctctttggcaagattaggggaggtttggcaccaacaactgcagcagtgaacggcgtaatgagggctggtaacccctcagtgtactcggaccacttatgggctagtgcattccttgtgtttggtttcaagtctgaaccaccttctgttcagctcaaggcagtcgacatggtgcatttcataaggaagacggcacttcccttggcaattgactccttcatgacattctcacggtgcggctcggctttagaactgctcaaggtgtgcaccaatgtccttgaggaggtggagaagtcttacgcatcgcggatccaggacctgaaccgtgggtcgctttgctggaggaagaagctgcaaccgaatcaccgtgtcgatgagtttgtctggcaggaagtgacgctgctcaaagcgacactgctcgagacgagggcgaagctgttgctccgaggtgggctgtttgacaccggcgaagaattgtgcaggacttgcattagcatccggactgttatgcttggccatggtcatgcccatacactggctgctcaagagacattggcaaagctggtcagatacaggagtaagatttgagatcatatctgaaacccttgtgagttgctgcaatgtactgatgtgtattcctttgttactgtcttatagagggtgatcagaagttttcatgtctcggcatttctgaatctgtgacgccaacaagttttgttagtgatggtcatatgatagccaaaagcttcacggtgccatatgaatgtaacttgagtcgctatgtacagtacagttcagttactatttcataaaacttttaatctctttactgttgagttttctggattcaactttcagaaagggaaatggctttatttcatcaagatagtaactttggtgaagaatgttcactgaatcagttcatttagacgaagcattgtctctagctgataagcagaagatgttctcaagctgttcatgctttctgagaacctgcacctattgactaatctaatctgcatgattggtaaatgttttttgtttgtcaggattctccatatgagtatacttattatcagtcatacgcttgatgcagcagtatatactaatattttcaagctttcaagattcagcatagaacagtgtccagtaacctgtccaggtgagtgaagactaatctcatctgttggatgaaagatatgtacataatcctgcattcatggtctaatctgggcctgaaatataagtccataaattccatgtttgagtagattttccttgtatgtatggctacaattacatcaaatgaacaaccttgcttcctgattcatcttttgaggcaagattgtcaggaaaaatggtaacgtctgatgagcaccccagggatctttttcagtgacatttcaccgaacaattcatcctttttcctgggaaagcaatgctttgactgatcactgaaagcagtgaaacatctttttcttggtcaaaatacttcagtttttgcttcacgcttggtttgcaaccacagaaagaaaaaaaaagctcctttctagcttaatgcgtctagtgaatagtgacaggacgacatgctgaaatagtgaaatattacgcctttttatcgcaacaatgaccaccaatgtttatgtggattctccactgaaattatgacgtgctaagcaaatactccaagcaataatgtgggacaggtaaaacagaaaatattgcaaaacatccaaactgtttcgtcatgacacaggaaacaaataccatcgttgatttaaaatttgaaattcgattttatgatttcttcgccactttagtgcataggtttattttcatgattgctaagaaggtaagtaaacaagcacaaaattattcgtaaaaactaaatttcatttaaaaaaattttataggaagctaatccaagcacaatatcgatattttccctctgcaatccaatttccaaagccataaaaaaaacacccataagttgtctgaagttttacattccaccacataggtaagtttgttgcaaatgcccacccctatttagttttattgcaaagaccaccccattggcacatgcttaacctcatcttattttcactaatgtagagccacccataggctaaactaccttagtcatcttatccaagtacttgtattagacttacttttcatgtttcattgattttctttttatatagagaaactcagtgcgacatttaaattttcattggcaattctactcgtggaatctccaaaaatacatcgagactatacttgtagaagtatttaatttggtagcgaccacattgataactcacaatttacgaaatgttgattggatttaagcatgtgcatactagggtgagttttgaaaaaaaaaactaagtagggtagtgggtatttgcgacaaaatagcttgtgaggtgaatatcaaacttcaagtgattaatggtttgaaaaaaaaagaacatgttcaagtggttttatgccaacctaagccaaccatagtgaatggacctggcaggtgtccactaggcccaagtgcaacccggcccaaccaaacctcccacccaccaattgcaactacaaactctctcgagggctaatctgcaaaaaccgccacgcgcgaacgtgccttccccttctcctacctcacctctcgccatcgccacccccaaccgccgacgagatcgaggccaccggcgagatccgccgcgagatcctccccttcccctactccgatgcgatcgcctcggttctagatccccctcgctcgcacgcggcggggcatgatggcgcaggcgagcgacctggagccgctgcggtcgggggcgggggcgctgccgtcgtcggcggacccggactcgccgtcgacgccgaggaggagccgcgtgcgcgagctgctgcggagcctggaccgccggctgtccagccgggggcggcaccaccgccacgcagcggagggcgcggcggcgtcccccaagggcggcggcggcggggagcccgggtccgaggacagcgacgagctcggggacggcgcgccgcccgagtgggcgctgctgctcgtcggctgcctcatcggcctagccaacggcatatgagtcgctgcgttcaaccgcggggtaagtgagagatctgcgtggggaaagttgcggaaaaaaaaaaacgttgattaccttagactaggaatagtctggtattcttgcgagatctatatctttaaggtgattgcttgggatgggatatatgagcaggggatttctactggacagtttaggttgcaatgaataaacgcaatgctgtatatagcacccttcaatatgtaggtacactttgttttggaggaatttcttgtctgatttgtgtgagaatgagaaaatggacatttacccacgttcaaaacagggtttcgctagaatgcaatcttgaaaacgtgtttcgctaaaataccaatataaagcgtgtgctcaccgccactttgccattttggcccttttgtgtattttcgaaatcattttcgcttcttcagtgggtaatgagacgaaaatgcccttccatccaccatccttccccttccgtagccgccgtcgacgagggcgggatggccggcaacgccgctggatgagcccaccgccactgccgacgagggcatttgggtgtgcgggtgcgcggagtgatggaaccaccggcggctgcccctggccgccgccgccggacagcaccaacaaggcggaagcggagg

SEQ ID NO: 31764 - DNA, 14561 bp, Oryza sativa
gagaggaagatgtcggaagactcgccggccacctcgccgtctgggaggaagacggtgagctgcttgtggtggacatggagattggccagcgaggacgagctcctcttcctcaacagcggcgacggaggacatgaagggcaattttgtctcatcgcccggtggaggagcaaaaatgatttcgaaaatgcacaaaagggctaaaatggcaaagtggcagtgagcacgcgtttcatattggcattttagcgaaacgcgttttcgggatggcattctagcgaagccatgttttgaacgtggctaaatgtccattttctcgtgtgagaatatggactgtacatttactttatcctgccgtttagggtgtttcgtggagatgataatgtattttcttcatgtgaaatttgatgccacggggatagttgatacaaacatgaggtctttgctagttaaagtcttcctcttatggcatgggtttaggtgaaaacgaatcttgcgtggtattataatctgctgaggtttactagattatgtctacttgctggcaattttggtgcattgtttgtgttctctgaatacttcatagatctgaattgatcagatagaaactcagaaaagtcctaccgggttaatacagtatgtgcctattttactttgactgaactgcaattaatcgaacccccatttcttaaagttactagaaaaggctctttccttgaaataacttagatctgttaagcgggagctatccaatcaagtttagatgatcatttctaaaccaaaagtttcctgtttgtacttttctcatataccaatctgctggttcaatagtggctaactattcttttcaggtgcatatcatacatgaatgggcatgggcaggcacacccacagagggagctgcttggcttcgcctccagagacttgctgatacatggcataggatattgttaattccagtgactggtggagttgttgttggtatgatgcacggattactggagatatttgagcagataaaacaatcattatcatctcaaagggaaggtgttgatttcatggctgcgatttttcctacaatcaaagcaatacaagctgcaattactctagggacgggatgttcattggggccagaagggccaagcgttgatattggtaaatcttgtgcatatggatgtgctgaaatgatggagaacaatagggaacggagaattgctcttgttgctgccggatcagctgctgggattgcttcaggtaattttaaataatcatcatctgtttgatttttttacattcatctgggaattgcaacagattggaatcgtttcccactgccttttagcattataagatgttagtacaagttaacaagaaaaggaagataaactaattctgcaagcaactggaactacaaatacaatactatagatctttgttgtaccacgtatctttgcaatttcatctctttaacatccagtatcttcaggccaatgcttttttctttattctctcctgacacttgtgttgctttgtctttaggttttaatgctgcggttgctggatgtttttttgctattgaaacagtactgaggccacttcgagcagagaattcaccgccatttaccactgctatgattatattggcatcagttatatcatcaactgtgtccaatgttttgctaggggagaaggcagcttttattgtcccgacgtatgaactaaaatctgctgctggtattttatcttattctgatcaaacctggtattactgaaggtggattttgcttagttaggtattgaacttgagtagatttttttttgttcttactactatagcagaggactcgtgatatcctgcctttataatctattttatatatgcatcacgcatttatacacttgtatatgctcatggttttgaagttttgtggttggttcccttaccatcaacacgttagttttagcagcttcttattgttccgatcttgttttcttgccattcacaattgaatagtttgaagttctggtatatctgtgacgtgaacgccgaactgtgtatctattactgttttcatgttgatatgtctaactggtaaatatgcaaccaactaaatcactaatgttatattctgcagagttaccactctaccttatcctaggcatgctttgtggggtagtgagtgtggcattcagacagttggtggtttggttcacaaagacttttgacttgataaggaagaaattcagcctccctgctgtagtatgccctgcgttagggggtcttggagcaggtttaatagctctaaggtaccctggaatactgtactggggcttcaccaatgttgatgaaattttacatactggaaaaagtgcctcagcccctggaatctggctcttagctcagttggctgctgcaaaagttgtagcaactgcactctgcaagggttctggtcttgttggtggcctttatgctccaagcttgatgattggtgctgctgttggtgctgtatttggaggctcagcagcagaactaataaactctgccatcccgggtaacactgctgttgcacaccctcaagcttatgcactagtaagtttccttttttgagctaggaaggtagcctaaagtttgatagaaacgaagtatactgactgtctgcttaattcaggtgggaatggctgccacactagcatcagtctgctcagttccattgacttcagtactactactattcgaactaacaaaagattacagaattttactgcctctgatggtgatgtctcatcccatatatttgctattttgcttctaagcatgaaagtttgcacactccttgtgacataagctcacccttatttttaatttacagggagctgttggtttagcaatatgggtgccatctgttgtaatgtctggcaacaaagaggcgtttgaggctacatctcctcggcatggttattcttcactattacctcctacagataggaatgagacagaccggagacgaccagacagagatgacgttgaacttgcaattctagacgatgatccctaccgctatggtattaacaatgaggatatgcttcttgatgatttaaaggttccatgcctcttttctacattctctttattattttgtcaagttcatccttagtaaatttgatatatttttgtggtcattcagctttctaacaacgagtgttccaggtatcacaagcaatgtcaaagcaatttattaaggttacacctacagtgactatcaaggaggcaacaaggcttatgcatgataagcagcaaaattgtgttcttgtagtagacagtgaagattttcttgaaggaattgttacgattggtgacattcgccgtaaaggatttgaatctgaattaagtgaagatactccacggaatggggcaaattcatctactttggatgtatgcaaaatctcacacctttaaagcctataatttaatttagcaattgccgttttaagggatgctttggatctggaattttataggatgcagacgtgcagttaaacttataaccaaagtatttaaatttgaacacccctatccaaacaggcccttatagtaatatcgaaattagcgatgcacatacttacatgctttaattgtttcaggcaaattcttctcttgtttcatcatgcctcactagagggtttcagtaccacggcaatgaaagaggactagtgacctgctttccagatacagatctgagcactgctaaggtgctcatggaagtgaaaggtatcaagcaacttccagtggtaaaacggagggctggccgtaggaatgatggaagacgtaaggtccttggccttcttcattatgattcaatagggtggtgcttaaggtaatccttcttgtatttttttctttcatttattgaattgcagtggctgcttctttttggatgtgaaccaataattggaacagctaattgccttggggaaactagataactcaattggccccaactgcccaatggcacttgaatttaccacctcggtacacaagacttagcttatccattatacgatgtggactatatatacacaacttttgttctttccgatacttaatgatttctttaataactgtgttgggatcaagttccttaaggtcaaactcaaataagtgatcgggactagctaatttcagtagagcttagacataaacaatgatctgtatctatgcacatatttcccagatctaaacaatctaaaaacatgcccaagcagattaattgatcttttttgtctcctttggctcccatactcaatgtcagtgcacttgtcccatctgtacattctgttcaggtgtagacagtggtctacaaaaataattacttaaacaaagtagccttgtataagtgatcatatattaattgcttcattagaaacacaataatcagctaaacaattgtatcctacaagattggcaattatcttttgtatcatacatcataagataatatagcactaacgcagtcgactatataacagtgcattagagaacctgatattgtacaacagtataagcaattgtctgcaactggccctcctcccaaagaaaggggtcaatttctcctcccatttctaacttctggtgtttatattatttcgcagggaagagcttgagcggtggaaagccatttatcaaagagagaatttccagcagtcagctgttaatggccactgagcaaaaagaagtgctgaagttttggttgtacgttttagtgaagagaaataccaaatttataaagtgacatttcaacatgattagggttaacttaaaacctcctcactcaaaaaatatcctcgtcaaatgtaaagtttcttggagttgccacatatgcacatttttgtgcagagaaaatatataagcggtgatggtgtgattcgcttttgttagcgttgactgtttcgaagttctgacatgacagtatactgggtacactttggtctgtcccgcaaaaaagcattgcaaatggtgactgtttattgtttctgtccgatcttctgctgcacgtcaattactggataatgcaaatctgcggaccagttactcctgtaaagttataaaatacctttttttttgctgcagttttttgctcccagaattcaagattgaatttgttgattgtaaaaccagtcagcctaagatgtcaacgcagaagttctgatcttattaaggctgaggctgagttcggctgtagctgtagacgccttggaaaacaagggggatcattagcgcataattaaagtatgtattataaattttaaaaatactatataatcttttttacagaaaatatatagtttagcaatccagtaaacatgctaatgaaaaaggaggaagttatttagaactcagccaaagccatttatcttttctagaacctctactacctacaattgcctgaactatctgcttttttttcccccgaaagtaaattgagctacaataacactccattctcctaacaaaagcaccaaaaatgtttcatatacataagcagcaaacaccatttgtctcatgttcctgccatttttacatctgaggatgctgctttggcaacctgcccatcagctgctggctagctgctgcaccagcattcccagactgtggcagcaagttcaccttcatctcacctctcggcagcacaagccctgggtacccctgcatcgccggcacggcgatcgccggagacggcgccggagttgcaatgctacgaggcagcattccaaaggagaaaccagctgctgctgcaccaaactgctctgctggtctgtgaccagctgagccatagccaaactgagcaaggctaccaccaccaccaccttgtgccggttcaggtctccggtgaagaagaccattggtagcctgtggtgcagcggctgagcctgagcttgggtggccactgttcctggcagctggaacttcatggttgtgctttccttcatacgtcgtgatgacggatttcagatcatgcgatgatcgctccacatgcttgcgcaccgagcaacccggatgagtgcacttgtagtagctcctgcaaatacaaaatggagttttttagataatgcgagtaatttccggtctttgtaccaactatggatgcacacatatggacagagaaatgttccttcgatgacagtgtcatattgtgaagctaaacatttacttttgtagtgaaggattagaggaactgcaaagaatttgttccaaaagagaaaaatggcattagaattgaccttggatttgggtttcctttgacaactttctgcccatacttgcgccaacggtaaccatcatcaaggatgtcaacctcacttgtggtctgaacaacaacgcgaggctcccggatagctcttgacgccacagctcctatgtcgatggcgttggtgctagtgctagtagcggcataaacatccatctttctgaaatgaataaaattgaaggaaaacaatcagctactcaaagtgaagattggttcattgagtgattagtgactaaggctagccaaccttctcttgtgttcaacatagtcatcgttcgcatcaaagcccagagaaagcggggcacgatgcgttaccctatcatcctcttcattggagagcgtcgatgagatatccacagcttcttgtttgtccataacagatttttcagcatgttctgttgtcgtaagagaagcagacagttttgtcagaacttcactaccgacatcttggaggtgtccatttgcggcattctcccatgaagttgctgtggcctgaccagacttggaaccaaatttctcagagtgatcatctctcagatcattgaagtgtgagaaaggaacatttggtcggcggttggaaggcggcaaagggtgattgtgagaacctttgtagactatctctgttatttggccatcttgagaacgctccaccttcttgacagcgcaattcgtgaaagtgcatttgtagtagcttctgggatgctcactgttcttaacttgcttctgtccatatttcctccagttatatccatcctcagcaggggtaatgatcaggtctgaagaatactcttcatttttgtttgttgcattctcttcttgatcatttgcaggggaagggtgatcatcattgtctaacatggaatcagatgtcttaggtttaacaatagttgctgaagtgaaatccttggctgcagttgagctagactgaagactgagctcctggtgattatccgtcactgaaggctggttttgatgattaacactgaaaccctgaaaagtataaatatcatcagaccaatgcataaaaaacactgataatttgattttgctcgtcagatttgctggaacagtaaaacaaactgcgccgagcaggcgagcagtgattacagatttgcagtaaatagggaatagaacaacattgtttgagaaaactaccttctctgcaactggacaagttggtggcttagatcccaaaatgggttgaaagaagaatacacgatcatggcgtgtttcatcttcagtttttttagggatcgatggtttaacattactatgcatcaaaaatggcagtttgccagtggtaggagaaggttgtgcctgcataaatcaaaaccatgacattaagattaatcagtcatcaacatatatagtcactttcttctccaaaattccactaattatacgaagctgcagagacataagagaaattaaagatgctgtatcttgcgttagaatattttttataataggtatcttggtttagatttcaccatttactgacaaatatatcctccatataaaccacatgagtagagtaactgaacattacacagagcaaatactgattgaggtgaggaagtcacttacaatggcgttcggaagaaaaaccggcgactcaagaagttcccttggactcacaccgggcgggatcgtcaccggagaccgaatcggtgtagaataaccgacacgagatgtatcaattttcaggacaccaaaacctgtccttgcagccatcctctctgacagacagccatttgagcttgatttctggttggcaccaaaaaggtttgattcaaacttttttgctagctgagcagtttcttcccggcttgaatcgatgaaagctttgctcttcccaagtccatcctgatgtttgttactgccattatcacagaaaatgtctgaaaagggaccggagctgaattcttcgttcaagaaactcgacatgagtgttcttggactgggtgagggaagcatccaatcgtccatcagtgctccatggttgttggtcccgtccatgaaaaggtgacaatcccaagctcaaactgaaaagtcacataattcaagctcatacattcaaaaatggaattgtgaaaaaaattatggacgaaaggaccaaatttttttttataataatgaagagaactgaagcctgaaggaactagaaacaagtatgcaaatatttcgatacaaactaaaataaaaacacaactcgattgtgtaaaatacgaaccaaaccacaaactctatttgatttacaagagcacacaaatccagtgctccaaaaaagaaccaaagaaaacccagaacacctcaaatttgatgataaaggaaccacacctttattaccataaaacccaccgaaataaagaggcaaatcagcaaatggcaattaaatacgaaagaaacgacgaagaattcaaatggacacctgaagcggagggcgatagcaacaattaagcctccccaagaaatgagaaaaagaatcaagaacccccaaggttggatgtatgaatggatggatggatagaggcagagcagagacgacaagctggtcaaatcacgcgcctgtctgtatgataagaaggggcaaaatgattcacagtcccagcaactatcccatcacaaaccgaacgaacaattaccacggggtaaaaacaaaaacctttgcctttgatccctatcccagtatccctctcgttgttctttcaccaaacaagttgccacaagccttgcatcatcatcatcatcagcagcagcagcagcatcagaaatggagagactctgatcccaaaaaaagggaaaagaaaaaacaaaacctgttcttgcaatggatagagaccgaacaaagaatctgttctgaaactgaccagattagcctcactcgctgctgctgctacttcttgcctgcttctttctcccccacggtttcttgaaatctctcctctcttttttttctagcgcaaaccgcaacgagaggttggaagggaagagaagggaagggaaggcggttttggcgaggtggtgaagcgaaggagaaggcagagaagatggaaggattggttacaggtgatgggtttcctgcaggctttgtgcgccgagctgcggaggtgtcgtcttccccgctcacttttgccccgtctttgatggaaacggttgctcacttaaccacttgctaactatggattagtttttaaaccgtttcgtttttttttttaaaaaaactactcgccctatcccacaatatgtactgctacttattatggatatatgtctcatgtcaagatttacattgctaagatatataacatccgagtattaagttgttatattttaagacagagatagtagtaaatttcacgtaaccacgatgttatgatccaatttgcataaaactattggagttttggcatgttgcacacttgcacgtaatgctggtactatgacatttagttttatatacaccattaactaaattttctttgatctaccatacatgcatacaagttccgaaatatatgaattcttttaatccatcatttaaatattgtaggtaagttaactatttttattggtgaaatcttatgaccgtaatatctatggttatatgccatgtaccagagccgttgtgattttgtgcaacttaaatcataacatgtgaggtttcatgaaatttacttaaaaaattataaaatagtttatataaaaaaatttaaaattacattattgataagacacacgcacgctcaccacactcacacccacaaatatacatcccacatgcttaaagagaccaatgccagcaaaaataatcatgatatattaggcattaatttaagaaagttgaatggtgggaaatcagcagtaatatcactacctatgaaatttatatgacattaaaaaaattaccagcagattactgtggttgaaatggctttacgactgtacaatgaaatagtcatttgattaaaaaaatgaggacagaaaaaaattaagacaagctgaaatgcttctatgagctacatcagacatgctggaatttattcagacttgtggattaaaatcgctaatcatgaaggggtttgtaaaagtatgggcattgcaaacttctaacagacagtctttgtcacctcagaccaaacctgcttaaaacaaaagaacacactttttttattatctagctggagatttcattcctttagactttgtaattacttcctccgtcccctaatataatcgattttgatattttacttggaccactcatcttattcaaaaaatttatgcaaatataaaaaacaaaaaattgcgtttaaaatattttggataataaagtaagtcacaaataaaataaataataattctaattttttaaaataagatgaatagttaaagtgcaagtgcaagtaaaatcacaaaaacctcttatattagggtacggagggagtacctttataggatcgaataactaaagtactccactaagatggagaccttgcaagttgcaactgatctgaactgacagtactgttctttgggctctagcagcagcaagtggctgctagcctcctagtagcactgagcgtagaactggtgtatcacgcagggaaaaatgtttccatccataaagagacactagttcatatcacttaaatagtcattatttttttaaaaaaattaaaataaatcaatatgagatatatcgctctatagatttcgacctgtgataaaaacaacaagagaaaatccaaaaaatatcattaacaaacgtccaattcttaaaaaatgacattgacaagtgcgagttgcaaaaaaaaatgtcatcggacaagtggctttgacttaaaaatgacatcttcgttagggttacattattaaccatccttaagtgctataggatacgatgatatttttaagacaaagtcatttgtacaatgatgttttatagaatcacacttatcgatggtattttttttagattttggtgttttgtcaatatcttttttgtatttttctcaaatactcattccgtcccaaaatataagaacctaggactggatgggatatttgctagtactacgaatctggatagtagtactaggaaatgttccatccagttctaggttcttatattttaggacggagagagtaacaaatacctgaaatttgttatttttgttacaacttgtaatagttaaattgtacgtgtatatcttagtttttttattttttttaaaaaaatatttaagtgatatgtaagagaacccttcgaaaggatgaaaatctatgtccacatcatgtatgatccaacagagaagcgaaggcttatcttctcttctcgacctgattgctgcttttgtctccatgtttatatgcactgcaccatgagttcctgatccatgcatggatgcatgtggtctgcctgccaagctccatgtaaacctgcacactgctacaatggagtttgggcaacagcaactgaactgggcactgaatgtctgaatataacttgggactggctagctttctgcctgaacatgtacagaaactgaaacatctgaacatgcatacttgtgcagggcttcaaccacatagcccagatgaaatgcatgcatggcaccagatgcctgagatgccttgctttgtgatccatgaactattaacaaatcttcttcagagctgctcgatcatcttttgtaaaaacagatgcaggaattaggaacagtattagtgtggagtctcctgttgcattaaaagggacctatgcaagccaggttgcattggcagcatctagataaatgtattggatgaccaataaaagaaaatagatataaatcattaatgatttgaaggaacaattggagttgtatggagaaggggaaaaatgttttcgtgatgatgcatccaacggttgtatctatacttcagacaataatggtgataataaataatctatcactttaactaactctattggatatttttataccagctattagttcaattattttaaactagtccttgtacatattggtcctatcttacttcatctctaaaatacaaggtcatcatacaaaaagcatccacatggacacattgttgtgaaaacctcacaatcaggacctatttagtttccaaacaatttttttacactgtcacattaaatgtttagacacatgtatggattattaaatgtagaaaaaaaaccaattacacagttcgccaggaaattgcgagacaaatcttttaagtctaattgcgccatgatttgataatgtggtgctacattaaacatttgctaatgacagattaattagtcttaataaattcatctcgcagtttcctggtggaatctgtaatttgttttgttattagaccacgtttaatactttaaatgtctgtccttatatccgatgtgacatgtaagggcaaattcttttaccaactaaacaagcccttaatgttctaaacatcaagtactctctcggtctcataaaaaaccaacataatactagatatgactcattctattagtacgaatctggatagtactgaaatatgtcacatcattctagattcgttttttattggacggagggagtacacattaatttatatctatccacagcatttagctattactatatatgacttgacgacgttgaggacataaacatcttagaacagcacggtgtgattcatttgtgattgcttgcttaaaccaaatttgtcagtaaattagataaactctcttcaggtcggtccagtcaagggcgtacacgtggtggagattatgggagtaaacttcactacggcagcaaatcatcatctcacaccatacctacgcattaaaagtcgtacaatccatgtttctctcattacgtaccaaagttaaccaagaagataatctcgccgggtcggtcgtttcacggtctaattctgaatgcaatttattcatgtatccaaatacgcagatgcagggataataaactgaaacagcacgcctaatgtctcaactctatttttgtgaaggaactcgatcttcttttctcagacttactagagcgagtacgaatggtataccattgcacgatatcatcataagtaccagatttgataccttcgataccaaacataatactccggatgataatgctttcgtagtaatgtggtgagatcatacatcagaatatttgtggttggattatgtctttttagcatgtgtaatatatgtgcgtgtcttgtaagtataattgggaaattggaaggtaatgattatacacttgaaacaccggaatgtggtaaggaattttggcgcaggatatactttcacacgggatgtttatctcatataggtgtgctagcttgtgacggaacgagtttataacagcatgattagcacaaagaattttttttcttaacctccgtacttgcgtacatgattacaagaggccaaagctgagctttgtggcaaacagctttgtccagcttcttgattgggttgcttgttttacctctgctgtctgtacgtggcataggatcctcagctttttctggccggcagattgggattagaactgatgaactagataatctacttgtattggtgtgagatcaatgatgtgataatttgcaaataggaaagagagttttggaagcaagaaaggatctcctcattttctaggttatatcatgttattgtctacggtacatttcatgaacaacgatgatgtctattgctccaaatcgcaccacattcatattggattaggcaaaatggtttcgtagcatctgaagtttatggttttcatcaatttcattgctttagttgttttttttgggggggggggggggggggatttaattcgatcatgccaaaaaaattggcaatttcaaagagatgatgggtttaatttggtttgttgaaaaaaatatatacggccggtaatgttcttttaaagaaaaactaatgctgtaagctgagaaaattatctgttttttgagaaatgcgcagaatggaaggacatcttattgcattttacaacctatcgaacattaactgatgcaaattcaagctgtttttatttcagttttgtgatcaacaagctggtgatgtgtaggagcaggaccaatcgtactgttgtttagagtagaagtgatgatctgatgataaagaaacgcgatccatgccattatggcattcctgatcgaatctacacatgcagaacacaagaatctgtcagctttgtcaggcacttc

SEQ ID NO: 31765 - DNA, 38802 bp, Oryza sativa
tttacatatgggcttcacatttttttttgattttctatttgtcgactaggatgccacatcaatcaaaacaatcacttgtactgtctcaggaccttatttaacctagttatgaaagattttttttcttagttatgaaagatgtggttatgatttctattattacggttcaaaggacgtgattcaaactcgcgtgggtgatcgaaagtggacttattccggggagaaaaaaggaaggtggtggtgctttggctggccggagagaggatgggaggatgggccggccttgctaaggggaaggatggaggcggcttgtagagatgggctgggctggggtgaggaaagaaagaggaggaaatgtcgggccaggagggaggaaggataattgggccggaaggaaatggtggcccagttgcatttagcaacctttgaaatcagcacaaatcgcggcgcagatcatacggtcgaaaaaacgacaaaatacgtagaaaaaaaatcacgcgacaaatatatagcaaattccacgggtcggtccctcggcagctttgcggattaaggcagccctgactttcctctttttttaccagtcggatgatccgtgacgcagccgccactccaaacaccagggcacaggacgtgacgacggtaaaaccgggaaagggacgacggagtcgctagactcggagacggttcaccggtcggaatcggacacggtttgtttcccatcagatcagataaaaggcagcaacaagctaatcccatgacccccaaacaaaccacgcacccagcgtcccagccggagggtgattcagtcgatcgatcgatcgatccatggacaagggaggcggcgccggcgattgccagccgccggagtcgtcatcacatgagaacgaagagaagaacgcgttggttattccttgttccctcgctccaatcaaaacggggaagaagtatgaccagcagcaggaggaggaggagaacaattgggagtatgatgaggaagaggaggaattcttgtacgacatcgacgaagacgacgacatgatggaagcctccgagctcatcggcgtcaagcacagcgacggatccatctacgaccccgactcccacccgttccacagcctctactgcctcgacgacacccgcgagactagcctgctgccgatgaggctgtcggctcggaccgaccattgccagccatgctggacggcttgcatcgtccaccatggctgccgcatgatgcaaatcttctccatcaagatagcagctctgtccaacgccgccgccgacgccccggtccagatctatggcttcatggctgcccgggatctctttgaccccctgcgcaactacatcttcaaccgcggccgggatgatcctttcgtcttgcctggccactactctgatcccaactcgcttataagattgtcaggtcctaagcgaggcatctcgctggaaaatcctgctgtgatcgagtacgacctcaagatcaagaaaggagaggacgaaaaggacgacttgcagctcatcgacggggtggccgccttcagcgaccttacaccatttcatggggtgtatagtcggcggatccatggcatccatggcgccgtggatatcagcttagcccttcttcgcaatgggaaggaaagcaccatacaaattaagattccgaagctaattcatggcggcatacacttatccatctcttgctttgtcagtcaaatacctgaggaaatcaagctcttcgatggcaccattgttaatccatcaaaactcagaaacttcgtggttgctgtgcagctgcgcactgtgttgattcttgatttcaagattacgcctgtggtagcggccgccggcgaaaatggatccaatcaaatccatcgctattgtgccttcaaggctaccactcatgcaggttctattcaacggatccaacattatttcgccaatatagatgtgcatgttgtttggtcagatttgatgtcacagtagcctattggtgttttttcccctttactttgttaatcaatttggtaaaagaaacatatgttattgagacccatttaggaagcttaagatagtaggaaacaattagttggtagtcagttgttgaaaatatctgcatcttccactccttcctcctccgccatactcctcttccatccccggcatctccccctccgcttcttccctagctccaacgctgtctcttttaaagtacgccacatcagagataagtagcacgcgttcactcatgcttttcaacgttgcaaattaatcgccaatgtcaaaaacgcgaatattagggaagaacctaatatcaaataattagaagaggtgaggcttcgaacccagatcatctagcccaccaccttatggagctagccggaagacccctggacgtttctcattaatcgtcaatgtctacaagctagaaagaggcatgagaagttaatgaactcatacagttttgttcaataacatcatgctaaccaaaaaaacatcaacacatcatgctagcataaaacatatcatgctagcatgaaggagttaatcttgtggaagtgcggacctttctgagcaaagacattttcttccccaatccccattccatgccactaaatcactatatacttaaaaaggaaaatctttaactcaccatatctggaaaatggacatggcacacgaattaaatcaacaatttaaaataaaactacggttgctggttcaatcagtaatatttatacaaggatcaccagtttaataaatactcgtcaaaaatattttcaattcccaagaaaaaggaccggagaggattgtggggggattaaatccacatcaagtccctttcaatatccttatgggccaataggcttagggagagattggagagaattttataaatcaaaggctctgcgccagcctttttactaaaaaagcataaacaatgttcattacaggagacaggtcggagagaattgaggagattagtttcatactaaatcccattcaatatttttatggaaccaaagaagtctcaagtgattttaagctgaatatcatgccaaacaatataaaattacaagtaattttaagatatcacaatggagggacatcacagtagtcaatattctcataggcaaacttctgttcccctatgcatgagaaatttgggattatgccaccctcaaaaataggtttcgcctaaataccactgtgcaaaaaggattcgataaaataacactttcaacaacatgggttctctataggccatctcttctttctcgctccggtgatggatgcccttatcaactaccactaaatgccatggcgccgagctgaagagcccgctcacatcaagctgcaccacaaccatgaggtggcggagctcctctctagccgcgtcacgtgagctacacaccactctttggtgcccccttctcctctcggtggcaatgaggtagccaatagcaatggtgataacgacctcagtgccttcgtgagctgcacgatggcacccaccatcccagcagcttccacgcactcctcgggacactcgaacataagcatcccccatgccctaggtatggatgagctaccgcgtggcgtccaagacttttatggtggaggtgggagggggacgcaaaggagcttgcggatgcagcggccgttatggaaagtccttgggcttgccaacggccatggactggtcaagctacgaggacaaaaagataaagatgatgtgacttttctatgcggtgtgcaacggccatggtgctaggtagacatcggccatgggggttgcgccagagcgacaaaaccgaggcaacaaaggaggtgaaggttgctaccttcccacactcgagcccatcatcagctcatcaccaatgagcaagccggagttaggagataagcttgaaaaggagagtcagcggcaattttattcgaaatattccctccatccacaagagttagatttatttcatatttgagttttttcaaataagttatttttatttgtagtctttatgaatttaagatttaaatgaagaggtaaattaaatgcttgatcataactcgatgagttattttaactagtaatatacccgtgctaaacgctacggtgcaactctatttgtctttaataatttttaaaattttcatgtttagcaaaaaatattattatattaactgtgcatttgagctttaattcaatttatatcatacatcaaatatattgcaagtaaaatattagaataggatataccaatatatttgtgccccatgtcataatgcataataatatgatattaaagatatatgataatgcatatatctgtgccttaagatatatgataaacgtgacagatcaaaggcacttaggttgagtattgcatataagtatttataatgggtattttagttgttaatgggccattacaggatttggaccatacacataagtttgacatctagcagtcctttactcctttatcatgactgaataggcaacataatagcaaattagcgatactggtttcttatgttaattatatttgctttttttttatacgctttcatgttcataaatcaatattcatgtgattggtcagctctttaaattaatggagccctgaagcaaataaaatgtgttcgatctaaagcaaaagaattacatgtgtttgatctaaagcaaaagagttacagaaatcaatagtgctacacaacgtcagaaaattggccgacctaatttatttatgtgagatctaaaccacaattggtgtgtgatgtctccttatataaaaagacatggaaaacaaatataaaggaacattgctatgcatccaaccgtgccaaacaaatacatagtagttcaacaggaggtagagcacatttgtataggtcccagaaatcaactcaatcacaagcaatactgaataggcatcataacaacaaagtttcatcgaatttggttgtgcatttcacaagcagtactgaataggcctgaacgacattgtttactgaattttcttgtgtaattcacaagaaatgttattttattctaaagccaaaacacagtagtgacaatactaaatcatgtttccttctcggttgcttcatcggagacgtcgtcattgcagatcttcattgttatctcgatgggagaagaccagcgaggatcatacccttctcccaccttccttttctcaccgtgtcctttttctaccttcttgcacttctagtcttccatggaactctcaacacgccggcaaccatcacgtatgtattgaaacatcatcatgatggcattcgcgtgccccatgtaataattccccttgtttggtgtttgccctgacgaaggctgcaccttcgcatcatccttggagttcattgactccttaggtgtggcttgatgtggtgaaaaatccacatcatccatggatgccatgccttattacaatacataagaaataggagatcaataggtgcaaactaaagtatataataatttccaacacataagagatagcttggagaacgataccaagatgatgagttgaagttgagcagtcgtatgcagccggctaaggaggatcagtaatttttttttggatcacactccttcacccacatatatataggctaaggaggataatgttaccattgttgctatcatgatatctatggaaagacataacaatattgccttgtatgtcttgtgagttgacatgtatgggcatgtaatacatggaaatattgccaaaatagcatctgacagagatttggatatgatttgctaacctttactctgatctgctgcatgaaagcgtaattgacagagatttggatatgatttgccaataatatctcaagcttgctgctacgaagataaataataataataatttgttttaatcattgatcattacaaatgctcaggaaagctgacatgatttgcagtatagtgcgcctaaaattaattaacaatcaattacaaatgcagtcaattgccaagaatgattcgcaattagcattatctgttgtaggtactgtttacttcagacaagggtggtgatgatccattcaagtaatttcagtccagctcggtacatggtgaacatttctttattcaaattaaagcaaagacacaatgcaaaacatactttttaataatgcacagtgaacatttgtttattttcaacaatgcaaaacataatgtttaatactgttttagagtaactttgataccttgaataactggagtgaagtagtcaacagcagagcaggagtcctcaaatattagatccttcaatcagatttttcctgattcatgcaacactgtaaacgtaggatacaaggaaaatttaataaatgatctgtgaacgtaggatacaagaaaaaataggaactacatgaacaatctatttaaatccatggttgtggaactgcagcaggttaggttcgtaaaaagtggttaactcaaataccaacactcttcagttatttgccctagagaaagaaaaataggttcatctattctgtaggatatagttatttatatgaactgaacgtcataagaatttagagtcaattgcaagaaaaactaaaggtactgcatataccatctaattcttagatcccagatcgattaggatgaccgggctttaacagggaagaatatatgtgaaatcaaaatgctggtctgtcaatgtacttgtccacaatgtgatgtgcatgtcacaccgtgaaatcaaaatcattaatgcatgactacactgtggtgtgcatgtgaaattgagcaaaattttgcagtattacgtttggaacagggttaagcttttccaagaaaaagattggtcaatccctcaaagaaaatatggttggcacagtaatcagggcaattttttttcttgatttgtaaaccggatgcaggcaattttaaacatcagattctacaacagtgcgaagattgacccacgaagtatacatttgcactatttgtaaggggtaatcattatggaagaaattacctataccaaacagaaatttagtagaatcagccaaaaatttcgttgattgtgcagcaaacaatagcagttgacatggtgtcctgtcagcctgaatttttcttcggcaatctgaattttcgtcctatagattaaatcatttgaaatgaaaggttaagtcagtttgctagatataagcaatcacatagaaaaattgacacaatagaattatctgagataggccatttcttccccacaattttacaatgaaagattgacgataaatgttaacaagatgtgaagtatctcatccaatgacaacaatgaaaccccaaaaaaaaatcctaccacacgaatgagattaacacgtgaaatttagttgaaatgcaaaataggctttggattagagttttgcatcacagatatccatgcacagtgaacaatgtttaataatgaacaatggggatttagtcaacaaaggggattcctaaagccattatgcatctctatgaacagtggcggaggacagaaaaaaaatttaggtgtggccaataaactaccacacgcgagagttaacacagaacaagaattaagaaaaaaaattcaatgcacaatattgtacaatgtaacattatatcagcaagtcatagtacaagcacttaatcacaagttcacaattcatcatccatttgcaaataagtgtaaatataaaagtaggtactcaaaaatacctcaagattcactgattcaagctttcagccgtacatcacatatatgaactaatgaggatagatacatatgtagaatctgaaaaacaaatagcaaagattgattagtttgataagataaaaagcaatgagtgaaacaaaatgtacaagcatcctaaaaataaaatatttaattgcaatttcagtaataaatttgtacactttgaaattgcaatgttctgaaattgtcaaataaaaaaaaagtacaacctctttgtgatgccagtgccttcccttttctctttctgtccattttctgctgatgggagattgggcgtgatggcctgatggctgctactgcttctgcttgccttgcttgctgcttggtgctgctgcgccatccgccctgcccctgccctgcttggcgcctgtgctgcacgcctgcgcggctgcgccccgccacgccgcggcgccctccggcgtggatgccgcagctctgtgaggctgcgcccgggagcccggcagacggcagccatgcctctcctcgcctccgcctgccctcccacgcgctgtgcgtcgcctcctcatgtacaggaacgggatcgagaagcactcttaccttgttcacaggcgggatcgacggcttgcagggttgaggagccctggatcagtggcggcgcgagggactcgaagccggttctccttcgaggtcgggacggcgatgaagcgacgcagcaacggcgccgacggggctgcgggctgcggcggcgtggagcgtcgatggagggcaggcccgacctcgcctcctccagccgtcacgcggagtccgccatcgatggagggcaggcccgacctcgcctcctccagccgtcgcgcggaatcacgcccccatggcggaaacaaacggtgatgcggctgcggcggcgtggatcggggctggagtggcggcgtggagcggcgacgttggagtccgggggcttggtggaagggcgagacggtgcggcgcggcacggtgcgacggtcgacgggggctagcggtggcagtgacggcggttagggttgggaatcgcgggggtgaggaaggtctcggcagcgaccaggcgaggaaggcgtcggcggcgacgtgaatcggtggcggtgggacgacggatgcgatgacggcggagcggcggcagtcgagggcggcggctacagcggtggcgcggggatcggtggcggtgacgacggatgcgaagacggcggagcagcgacagtcgagggcggtggcgccgcgtgagtcggggttggggaggggcggcggcgcgtgagagcgatagagagggggcgaagaggagcgcgcaatcgagggaggtgggaggtgggagcgatctcaatcgttgagatttcaccgagacaatctggaccgttgagtgatgaatgaaagaaggatactcattggttccatgagtgtatatactctttgatatttgttacacacaagataaattaaattctctttgatattgatggtaaaagtaatagatgcagggcatgttaggattcatgccttaccagatttttggtagtgccaaattttgagcaagttttggtactactaaaattttggtagggtaaagttgaaaatgtttatttggattgaagccaaaatatgtccataagagacaagttcatgggcaaagctaaatttatagcataggtagtgttttaatagaggtgtttagtttgctattctaccagagcaaattttggtagggtagcaatttaaactggcccgtaacttttatgtaaggtagcctttaattaagagtgatattttattgaatcctcctgtacagttgcattcgggtgaaatccaattttgaggaccacgacgcgaaatcccaattttccccaccagccgccgccacctcggtcaatgcgccgccgcgccggtgctgctctgcacggccaccgcgcgcgtgaaccgttgcctcgcctcgatcggtctcgcccgctccgctttcacgccgccacccgcaccttcgctcgatgagggttagagcctctccacctcccttcccccaatcccaatccgctctcgcgtctcactgcgcatcatggccggattggcggtggctggccgctcgcttgacgaggcgttcgaggtgaccagcgcggtggacaacatcggcgcctgggggtggctcgacgtgcagggatgtcggcggagtttgaagcggctgggcacccgatcgagcatgaggcgagcatggctggaccgcgccgtggactcggagggcaaggctcacgcgcgcgacatcgtccgggagatcatctcccgcggcacggatgattggatagtgcggcggtgaacatggagtggggcgatggccccgacgccatctccgccgccaccgacgagctcgaccaaagcgcgcttgggtggcggagcgcgacctgccccccaacccccacccacctcacctacatcgacggggcggcgtcgcgttcgtggccgctccacgccaggcagcacacggtggtcgccgccggctacgacgtccccacgggcgcgctcgaccatgcgtcctctcgccagccgccactcggcggcatgcgccgctatcacttcaagttcaagctgctatcgttcggggtcagagcggcggatgttccacctgtcgatgaagatggcggcgcctggggatgaacaagcatcgacggcgacggcggcggcggtggtggcggcggcggcggcggccgacgcggtgggggacagagagggtgtgggtgtgtggatcggctgagcgagcccaacatgctcgtttagcccggcccagttatcaagaagaggggcaccagatgcgcccaatcccaagacaaccatttttcccaaggaaaaaaaaaggaaaggaaaaaaaaaacaatcgtcttcaagcttcgggttcccgctcagcgcggcagcggaaccaagccgagggagctcgactcatcgacgatcacggtgtccagtactttggaagaatcagcctatcctgcccgcacccgccatctagtttctggaggatactattccgccggtgagcctcgaaagaacatcgacaattcttgtttcttggatgttttgctctgttcttggggttggtcttctcctttctgctgcatcagttcgggccgttctgcacctttagttctatagttcttggggttgatctcccatttcttcttcttgttttgctctggatcgcctgggggcgttgtgccgcaagttcttggggacattgtgtcgcaagatcgtgttgttgatagagaataatccaactgttagctcaagaaatctctgaactagctgattctgatgaaaaaattaggacttgttttgattttgtttttctttgtatcagttattgattttgttggggtcggactcctctctgcagcattttctcttctgcattgtcctttctattctgtatggtcctcgtcgcgggagatattgttctgccggtgatcttgaggaatcactggaatcagaaaactcggtttgtttctttttttaacagtaaacggcaagagaattgccggctatattagaaggatagagaagagttttacatcacataggatagtagcagcaaatacaaacaactaggaaaaaaaccaacagagtggcgaacaaagctaaagggaagaaaattaaggcggcttaaaggtgaactctctatcgttaatatcctctaggatggcagctaccgtttggtcgatttggtgggtattcgggggatggcctttaaaaattttctcatttcgcattagccaaatgtgtcaccaagtcgtaactagggctcccatacttcttcttgcttgtgccttgtttgaggaggagcagatgttcgaggtccattcttgtatgttatcctgcatagaatggccggggattccttttattttgaaactcggtttgtttcgattatttggttttgtttccagtttttcttgtcggtctcctggaaattgttctgctgctgccggtgcattgctgctgcggctgattgatgcttaattcttttgcgcattccaaaacaaaaaaaaaatctgctgcggctggagagaacaccacaatgggcttgtttcttgtaaaaaaaatcaatttctttttattgtttggggctggtttctgctgcggctggagggagcacagttaattttgattcttaccatagcacgatttgttttgattcttaggatgtagtttagttcttaattattattttgattttactacgccttccctgtggctgcagaggataatttgctgaccttgttgctgttggaggaagtatcttagtgttgataatgggcaggcgcaaaaagaaaacaccagctctcacaccgagggtatgatcgtcgatcactttttttctatctcctgtaatttacggtctgctaacgaattgatctacccattttcaacctgtgaatgcaactgaactgatctttctattttaccttcatcctcctttggcagaacacagtaactctatatcttgatggaacagaacatgaatttgttgagaacttcatacattgccaggggcactacagattctggctcctgtggaattctgctttcagggtaacatatagccgaatgatgctatatacaacaccagtccacgggacattctattatgtccttaggtatgaagcagaatacgttgtactagtgattgatgctagaactggctggcttgttgggttcttcaacaacagaggcatttatgagatgcggtctgatgataatcttgggagttatatgaattcgtcacaatgtcataagcttccgttcaatggaaatcataaggaaatatccccacatgggacagaaaatacatggctgaatctgcaactgttcaaaaaatgttttcgttatctttcctcttatcagcctagcaacagaagagtcccaattgggttcaagatttcattgggcatgatggtcgtaatgtttttggaatcaaaattcaaaatggtgcataaaaaggatatgccatgccatggagcatggtacggggtcacggttaggtgatggttttgaatgggtcaagaggctaatcgtcaattggagttcaatcagccaacaggttatgaggtctcttagcaatcaaagatacaatccccacgattgtggcataagagaattgcttacttttgatgatcttctgaaaagcacattttatcttcatgtcgatgcttatttggagggaattttcaaacatactgcattaccacccccaccacgagacctgagctggtgtcctgtatgtagatcttggcggtgatggggaggaggatattccactgcctcgagagccacagcccacgccacgcagtgcagtgcacaggagaggtcagcaacagttgacaaaaaagaagggtctatctggaggcaaacttggaggtcctccagttgctccagaaattttcttaagatggagtttgagtgatgtaagtatcgattcctttgcatattattaggcagatagtatttggcttatcaattcaactgtcaacttatttcatttacatatgacaggaccaggagaaatactatgatgagctggtttcatacctcgaggaggagcttgggttgaaaatgcataaagcaagacgttttgatcttgattgtaccaatcatcttgtgaagcatcatcctatgctgcctgaccgaaatttatcagcacaagctcagatagacagtgatacaataaatgaatcaccacaagctcttcccacaaacattagttctcagattgtcagctgttcagtagatgaagcaccgcaggctctccccactagcagttctccgataagcaacaacacagaaggtctatcactccaggctctcccaacaagcagtgaatcagcggcaggagtgacgatagatgatctacactctttttgctctcaggagtttatcactgacccagtgaacaggttatcagatagaattgacagcgaatatgtcttgcttgtgaatcctgcaatgccacatctgctaggaaactcctcagatgctactgatcttgattgtaccaatcaacttgtggagaatcatcctaagctgcctgaccaaaatttatcagcacaagctcagatagacggtgatacaattaatgaagcaccacaagctcttcccacaagtgttggttctcagattggcggctgttcagtagatgaaacactgcaggctctccccgctagcagttctctgataagcagcaacacagaaaatctatcaccccaggctctcccaacaagcagtgaatcagcggcaggagtgacgatagatgacctacgctctctttgctctcaggagtttttcactgacccagttgtggtccatgctttcaacaggttatcagatagaattgacagcgaagatgtgttgcttgtgaatcctgcaatgtcacatctactaggaaactcagatgctactgttgtgtcaacccagctacagagtctaggactcccctctcgaaaactagtccttttttccagtgaacagtcaggatccccatctgttgggtgaaggtacacactggagcctcctagtgtttgaccgcaaccttggaggcagaccatgcttagcccaccatgacagcagtcctggtgatgctaatttgagagctgcacgccgtcttgcggcatcactgcttccttacctacctcctgagacgaaatgcactaaagctccgacacctaagcaaaacaatggaaccgaatgtgccctttacatgattaaatgtgctgaggtgatctgtggttggtggcgaaaccacgctgctggaggatcagagtcgcattggcttggagttgtggcccgaggtgttaccatggacagcgtggacaacttgagggcacagctaatccatgatattggacagctcctcaacggctcatcatcatcatagagtcatactcttacttgtgtatgcttgtgctattgttgtgattacactttgccgccttccaaccggaaggttctcatattcaccctttgccgcctttgaaccgccgaccaagtgttcctttctcacaattcaatgatccgaaaggtgatcactcatgaaaaaattggttcaagtctggtcaggccactgcaacttaatgggaaaatgccgcaaaactgcaagttttcaggtaggtgcttgtaactcaatctcagagttgtcatgaggccactgtaaccttttgtaatcaggtcaacgtcgttgttttctatatcgaaagttcttgtttccagtattctggtccaatacttaccacctaagcaagaattcagcattgcaccaattgtcttcgcggcaagcggtattccattaagcttctctgatatcttcataccaattgagagcaaccttccatgctcatcgatgcctgtaacatctgcaaatgcatgctggttgaatagtaataagtagtcatctttttataagccctccaaaatgattcttatgtgctgcccaacaacttttccaatcatatcagcaactgaacccaaccgggtagttatcagcatcttgctcccatggcctgcacatcttagcggagcaatggctttactccaactttcctgatcagcttcattccaaacatcatccagcaccaacagaaatctctttatacatcaatgtccatcagtctcttgtgagctttatcaagggtgttgacgtcataattcacacctgtcactgactttaccatcttttttggcaatgcttatcgtctcaagtctactagaggcatggatccatatcttgaattcttgatgaaacttcccttccagttctttcttattgaatacatgttgtgcaagtgcatccttcaggatccacctgaggatatcctccaactccttcactggcaaaaaaaaaagctcttgcaggctctgcattacaggatcagctttcaccactctcccaaaaaaaaactgaacactttcctcatggcactggaaaccttctctcaattagtcacctcatcagggattacatcggtactcgatctcatcaaacacgctgtcttgtcagcagcttcgacagcataacgaagctgtcaaagccaagattgcaggccagggatgagctcaaccttgccatcctcagcagcagacaaccaggctctcaatctgtgaactggactcatccagtttctcgagcttacttttcatgtctttggaccaggatatctggtccttgccataatcggatgtggcgtcgatgatcaggtgcgaagatggtttcctagaaagcaataatggtgactggcctttgattaatgccaatggctcttctaaacatatagactaaacttgcagagcgaagaacaacctactcatttttcaaatctcagcatatgcctttgattaatgtcatgatgtcacatgctgagattcacagcaacaaacatgagtggttaatacttaatacatcacaatctttttcacaaatcatgatgtcaatcgaggtgctatcatagtactgtatgccaaattgtgtgcaaagaacaagaaatacaggagagatgagttagggtgtgtttagttctttgggcgtaaagttttaaaagtatacggacacacgtttgaagtattaaacgtagactaataacaaaacaaattacagattccgtctgtaaactgcgatacgaatttattaagcctaattaatccgtcattaacaaatatttactgtagcatcacactgtccaatcatgacgtaattaggctcaaaagatttgtttcgcaatttacatttaaactgtgtaattgttttgttcccacatttaattccccatacatgtgtccaaacatttaatgtaacgtttttggccaaaatttttttaggatctaggccttacatagaaaaaacccttaaatgatggctatagtgtagtaaccgcaatctgctagaaaataccaatttgcatcgatgccctaacaactaatttgaccaccagcgatacataaattgcaagttgggcaaagcgcccaaaataactaagcacagcgatcaacttgggccttgatgggccgtagacgaagaaggcccgctagttcatgacacttcgcggtgggttgcgcctccacgcacgcacgcagccgtggaactctctcctccctctcctcctcacctacgcatcccgcgcccatgggcggcggcgccgccgccggcttcacgccggcgtgctgagcccacccccgagagacctagctcacgccgaggacgctaccactccggcgcgggcggcggcctcgggatcggggcggatcagatgctctccctcggcgccatccgcaagctctgcgccgcgttcgacgccatcgcgctcaccgtcatcgcggcggggctctcccggacctcgcaccacccgttctccgcgcacgcgcactactcccagccggacttccccaccatcgcctcctgccgcgccgccgtcgccagctccaagtggcggggccgccacccctccaccaccaaggagtccgccggcgtcgagcctgccgagccccccgttctggtcaggatcaagaacgagagggacccggtgcggctgtacgagctgttcagggccaacgcgcacaaccgcctcttgattgagaaccggttcgcgttcgaggacgcggtggcgcgcctggcaggtgctcgacggaatgacctagtggaggagatactcgagcagcacaaggcgttgcctcaggggaggcgggaagggttcgtggtcaggatcataggtctgtacggcaaggcaaggatgccggaccacgcgctgagcacttttcgcgagatgggattgtatggatgcccgcgcacggccaagtcactcaatgccacgatgaaggtgctactgcgagcgcggctgtttgatgaggtccttcagttgttcgagagttcagagacatatggggttgagttggatgacatttcgtacaatacagtggtgaaaatgatgtgtgacttgggggaacttcgagcggcatttcgggttatgcaggaaatggagaaggcgggggtgagaccggatgtcatcacatacacaacactcatggatgcattctataagtgtggccagcgtgaggtcggggatggtctgtggaatctcatgaggttgagaggttgcatgccaacacttgccagttacaatgtgagaatccagttcttggttaacaggagaaggggctggcaagcgaatgatttggtgaggaaaatgtatgcatcaggcttaaggccagatgagatcacgtataatctagttattaagggtttcttcatgatgggcgagcatgagatggctaagacagtatttggtgcgatgcatgggaggggatgcaagccaaatgctaaggtttaccagacaatggtgcattacctctgtgagagaagggagtttgatttggcattcaggctgtgcaaagacagcatggagaaaaactggtttccaagtgttgatactattaaccaactgctaaaaggcctcatatcaatttcaaaggacaggaatgcaagagagataatgaaattggtaataggaagaaaaccttcctattcaaatgatgaagtgaaaaccttccaggacatattgtctcttgggaacaccagaagataatttgagtatttgactgctggatggaattttttgctgtatgtccaccacatgtaattgtaaggctgttgttggcattcattcattcattttatttttgcagccaaattgcaatgcttagatagcaatgttcagctgtttaacagtagttcatctaactaagataagaacattaatatctaatagaaaaaaaaaatcaagaatcaggtaggctcttaaggagaatttgttttacttcaaaaccttctaacacggaaaagttctagaaattcttgtgattaatattgctagaataaagaaatatcatgtgtagaatttcaagctatacggtcatcttcaaaaaagcttaggcaagaattcatataatactttatttatttcacgggaaacatattctttagttgttactttctgtagaagtgcttctcactccagattgatgattattttgatattgatgagtaggcataaaaaactggagtagtgaaatcctatgagttatttttgacaagcgataggagttacattagttgtatgaactcagattatgcctttttaagggaaagttctgtgcccctgacacctgttgataatttccatggcttttaagttctataactgctgcttttgttttattttgattgctttacaaagcttcccacgagtaatctcaggacatagttctgtattaagttggattatgtaatgtaaatgaattgttgaagctattcaattgagataaaagtactgacttacacaatttgaacataaatgatcttaaaacataagccaagtgtacctttcgaaattccaaatgattcatcatctacaaacaaactttgagatacatggttgctggaaggttagatatggcaatttcgataactatgtccctttcacagattctttgagttcaatgtgatcgatactagtggtccctttcataatggtgctcttgtttgcagttaacacttggttggcactcattttatgcctgactgaatgggagaacagtgaggaaataatgttgggaatacaggacagcggaaactatggggaatgaaattttggacttgtggttattcaagcagcattgttctcagaatcaattgatgacacaaggtaagacagaatcgtattactgataaccaggtcaaattgagatattcagtaatccagttactgaagtcttggcaaatattatcatcttttcatctattgcccatctcttctgttattcttcaaaccaagcaatcgaataattatcaatcaaaataatgttggaaagcttctccagctattgctcattcacgtggatatctttgttgtttattttttagaacttcgtggacaaatcgaataattgaatcaatggttccctttgcttattcttaatcatcaattcaccatcgctcatattgtcattgtgcagcattgcaactttttctctaggattacaaacttaatcacttatcatttccccttgtctacaggcaggcattttgttgacagttccatttgttctgttggcttggagcactgaagggaaaaaaaaaacgtatagatcaatctccgggaagtaaatttttctcggattggtggcagataaacattttgtacctcaacgttttgtagcatgtacaagcatagcctagcatatggatcaatcactacaaagcaaatttgttctcagattttcagatggaccaggggtgtgtttggttggtgcctgaggaagactggtgcctgaagatcccctgaaatctcgatgcatttttcctaaccaggaatgcctgacattgtttgtttggttttgaggcctgagattgaacatgcccgagagagaaaaaaacgtaatattgaaataacattgactgaagaaagctttgtccaagcctaggaatctaccattgactagtagtatagccattagttaacccagtgatacttgtgtattactagtatgttcatttgactacacctttttcaagttcatttcactacacaagtaaatgtacattataactttcagtcttttgttctttgtttacattcattaattatactaataaatgtagctcagtgctccagtttttccttgtattaactttggcctttgttgaatgttggatcatttacattttgttgtactcttggcaatgctactcaacgttcatatttactcccttataggatataaatatacgatattttagacaatatgaatttttaaaatttgaatatctatgaatttttaaatatttagtttaagaacgtgaaagtggtatgcgtaaatttatctcaaaatttactcaatatcataaacttattttaaaatatggtcaaagatgcatctgtagactaaacaaatgtcaaatgtcatattagagggattttttttttttgctatggatgggattttatcttctaagaattgttgtaaaagaatttagctcaagtatatttctaagaaaaaaaaatggcatacatattctcaacatgttttgaatcatttactccctctcataaaatataatcgcttctagagttttttaattggagaatttaaagaaattaaaaagagaggtaattatgattggttaacataaggatgtggacggagaaaccaaatgaggatggtttaatttgttgacacgcacgagtagcattattcttaaaaaaataaaacttgaatgacacaaactactatatttctaaacaaatggagtagataattaactcaactcatgcgacaatttatggagtacatgattaactcaactcatgcgacaatttgtgaataaaatcgtttgtcataaacgacccaaatgaagaagaagaaaagttctcatttgggcgggcccacatgtcatacaccaaccctctcgtgggccccagatgtctggtggtatatcccggggcccgtgttcacatctatacgcttctccagtctcccctggcccggaagcaaacggggagcagcaatggagaagagacgccggctcgtcgtcgccggcgacggcgagggggacggcggcgaggcctccggcagcgccgcgcgcggcctggtggagagcctcccggaggcgctcctcgtggaggtggtcgtcaggctggagctggaggccgcgtgctccgccgagttgtcctgccgcgccctccgcgccgccgccgccgccgtcttttccgccgtcacctccctcgacctatcggtgagggggctcatctctcaatccctccccccatcctctcctctcgcttcccctttcccccccgcgccccaaatcgatttccccccctaaacgcgcttggtgttggtgttggcagatgttcccgccgacgaatgccatcctgaataggattctcgcgggcaatggcgcgctccgctgcctcgccgtcaactgcagcctcctcgatgactccgcggtgggcgccatcgcgaagggaagcctccgcgagctctcgctgctcaagtgctcgtccttctcctcgtacctctttgtggcagttggtgagagatgcaaaaatttgaggtgtggtttcttccttcagcgttggctttgtttctgtgtgcacgattgcccacgaaattgtattctatcaggggaatcgaattgatgaatttgttgcatgatattgtgcacactgctcggtttatccttgtttttgtgtgacaaacattaggggaaattgatttttaaactttgtttttgtgtgacaaacattaggggaaattgatttgtacattccataggttgtatattggcccaaatgatgtcgattgaagcatgttgaattcttctctttatatccagatcatttgtgctggagatggcagcttcagatgatgatgaacatttcgggatctgccgaaagtccatagcacacatcgtcaaaggatgcggttacctggaggtgaggaatctttgttgcagatgaaccccaatactgttcttcgcgtacatatatggtcagttcatagcaatatagtattttgtaaataatattttaggctgagaatgtgtgaatactaaagtatagataacataatattagccatattattttaacaatgacatggaactctttgaaaagttaatctggtcggataatctaatctgacgttcttttctctccatgcagaatctttcactcaagttctttcctctgctaggtccaggctccgttgattttgagtcattggtacccattcctagtaccatcaaggtactattgctacagcctgtgtcgaattggcaggcaaagaggctatttcctataagcacaagtctgaagacatctattagcaacactctagaatcactctctttagttcttgacataataactgatgaacttgttgcgttcatcactgggagtctccataacttagttgagttgtgcctagaagataacccaatgaaagaaccagatttgcacaatgacctgacaaacgttgggctccaagcacttgggttatgccacaacctggcacatttatctctgacacgtggtaagcagaattgttcgtccaccttcagaagggtaactgactttgggataatgatgcttgctgacggatgcaagcaactgaaaaccattagacttgctgggttttctaaagtgagggatgctgggtatgcagcccttcttcagtcttgcaaggacctgaagaaatttgaggtcagtactggatacttgtcagatttgacatgtcttgatcttgatgaggcagctccaaagattacggaagtgaggttgctgtgctgtagtctattaaccagtgaaacagccatctcactctcatcctgcaccaagttggaagttctagacctatcaggttgcaggagcatcgcagactctgggttggcttctatttcgcagctttcgaagctaacactattggatcttgctggagctgacattaccgatgcaggattatctgcactcggtaatgggcggtgcccaatgtcttcattatgtttgagaggttgcaaaaggatcagcaacaatggcatagcttctttgttgtgcgggagtggcaccatcaacaaaactctaatctcactggatatcgggaatgtacctagaatatcaggcagagctgtcacgttgattgccaagaactgcgagcagatcagcagcctctgcctccggaactgcctcctcatcaatgattcttctcttgaaactctaggttctatgcgtcacaatttgggtaaaagttccctaagaatgctggatctctcctattgttctaggctgtcacgtaatttcctgggactatttgagccgccattttttaggggcctgaggtggcttggtgttgggaagaacatgttggaacgccgtggctgcagtccaactgtcgcggagctcctggagcgaaagcctggattaacagtctgtggcaacgcctgcgagatgggctgcaggaatcagtgccatcctgacattcgaaggcaataaaccgaagattgtcgttcgggtttgattctgtaattccttcatccgttctgtaacataactgtggaacatctcttgcgtttgtaggttagaaggggctgttctttaggatttgttggtttgctctgcacttgtagattgtaaacaaggaacagctcttaggattggttggttttctttgcacttgtagattgtaaacaaggagctgttcttaggattggtcggctgcttgtgtcctgtaataaagtaatgaattcttattggaaatttattggttttcatcgtctttgttttctagtagcttggaatttttttcgggctcagcttcatgatctacattagcttgaaacatgaaaggtcatttcgcccccgtaaacggaattgttaagcttctgttgacagaaaacgcatacacaaatcttgcaaattttgtatcattggatgtgcttcgcgattcgtgctctaggtttcttttccaactccggtgatctcctcttcttctccggcgccagcgacaacctaaactccagcagaggaccgactaattaaggtcccggggtggggtggggtgggggtgggagtaggaagaagagggtggttgccgggtttaaagggatgggtatgggaggtggtggaacgagcggccggcgaggcgccggagccgaagccatggtgatggagaatggcggtgggccggcattggcggcgggggcatctcgccgccggtggcttgaggagggaggggaggggaaaaagtctggccaaagggggggggtgctcgccggcgccgttgacgccttctggccaactagcgaggccgagcggcggcaacaaaggcgcggatcacgctagggagcggcagcacggtatagggagaaaggaggatgaggaggtttttagggttgtgtttctttgcacggatcttaaagtaatcgggtggtctgcaatttgcaagatttttatgggggttttctattaaatgatgtatagacagtcccgtttaattttgccatgaccatcagtcaatcacgcatcaaatcagctcgagctacgttgacaccaacagccatacataacgcatcacatcacctcaagctgcgtgaacaccaacagccatacatacagttaacctaaagaaatttacaagcataactcaggaaacctgcatccatatccatttagggagtcaaatagtgtaactaccatgggggtgatggggataaactttacatgtcaatcttggcgaatgaggaataaacaacgatctaggcacagaatcaagaatatcaacatgtttgccgtgtcaatcctgaacgagggagcatgagtttggaagaaacttgatggctgccagatatagttcctaacagattatacgcaaaaacttcctggccatatgggtaactatttccaaaatctcagcagagaaccagctgcagatgcagaagggggaaaatctacatgaaagcacctcggcctcctctcctggcagtcgacctctcgtatgtcgcgttaaacttctcgaccagctcattcattgtgctgcaagttacaagagtattaatacactgacatgggtgcaatgccaaacgagtaaacaaccattatgattcaacttctcttcatctcttggcagataacttcatttgcaagtacggatttactaacattagtgaatctattaaatttgctgataatacattgaagtgtacaaatcacaagctgatttgagttccctataaagtatttttttaatcttatcttgttgatgttgtgacattctttcatatcaaaaggctttgtagtttgcataataagtgggggcataccttgaacagttagtgaacatagcaaggtaagtcatgaggagggtgtcattgtattcctgaaaattcagagaagatcatcactgcatgaaggacaacggttgataaacaaaaataaagagaatattatcaagttagcagaccattaggaagtcatcttggaatttttctgactccattgctggtagccttcttactaggcttgagacttgcctaagcagcgaattgtccagtggcatatcacctgcagtgatggtaaagggatttacagttgatacctatttgaagtaacaggtggcaaacatattttgaactatatttcaagcacatcgaatagcagacatattttgagggctcaacagcaacaaaaaatacctttctgcatggaaacaagatattgatggataacacggaccctgctattgagcatcttgatggcactgtgtattcctgtcagatgagcagccactgctcaaatatatctgtcagtatcatttttccaaaaacaatatattgggtagtacaactcaatatctgtaagacataaactgatgataagaagaaccctcacattgagtcgccgcagagccaccatcagatggtttgagatgggcaacatgatcaacagatatcctctctgcctctacagtctttaaatcaaacgtactaacgttaagtcttaacaaaaattatttatggaaaaagcaacacacacaagaaaaaaactaacctcaattgtataattagctctgacaaagatgagctgcggactcccatcgataacatgcaactcttgaaattacagaaaatcatgtcaaaaaaaaagaaataacagaaaatggtaaagaggaaattagaataataaacagacggagaaatggaacaataaaataacagtagcaccatgaaagaacaccgaactggtttgagtcaattatctgagaaatcaaggggtcacacatgctatatacgtgatgctaaaaggtggcatttgggggaaaaaagacttctaggagtagtgggcaatatgtaaaaggtggagtacatctcaggtacatgcataattgacgtacacctaaaagtaaaacaaaaacccaaaccatataaaaactgtgaaatcaattgcaatatattttataatgatacaagctgaagtcagattcacttaccactctcataaattgttacagggagatccttctgggagaggttgattgcaggattcaaaagaagataaacgggactttcgttaatgtccatcagctggataataaaaaaaagaagtaagtaacacaaagaggaacaaaaacaatgtacagagcagatctcaaaagaatatatatgtttataagcaatgaggttataaaagagttaacagtcatgcctatttcatttgctaacagaaacttgagtaaaaacacaacatagagaatatatgtacgcaatgtcaacataagcactactatctgctactgctggcaaattggcaatgaaagaaggcataaaacattttggaatacatgacacatgactacagcagatattttagaaaattgtagcatcaatttatatggccagaataattgcatcgcacaatttgaatatttgaatacatagtaacattctttggtccataaatagcacggtatgcgcctaccatctgctccaccacccaatatgatgctataacataacaataaacagtatatgttcataacaatataatttggtgtagccacaaaactaggaaaaccatgtcctcttctaccatccctttcagaattcaaccagaaaccccacagatattagatgctagcactgccaaccatgccaactaaacaacattacaccaagcccccatattctatttctgtaaaaagagcaaacaaccaagcacattgtcataatgagacaggttgggcacttgctgaccagatagattacttctttctgctagcttgccctaagaacagaacaagaacttacagccttgtggatttgcatatcagtgtcccgcacatcgcttccagtggagtaccaacccagcacatagaagtcggggaaaaccttcttatctgcacggccacaaccgcaatcacgaatcaaaccctcgtaccactagatttcgccgaaaccctaacaaaaagcgcagaagattcgccggaatttcactcacagagctcctgctttttctcgaggaaggcgcggtcgagggtcccggagacagggtcgaggacgagctcgaagctgttgaagatctccaccgtccgcccgcgctgcaccccgatcacgcacccgaacaccctcggcggctgcccccccgccgccgcagacgaggccccgtcgccggagcacgccgcctgggccttcacgcgggtgtggtggtcggagacgttcacgatgacgagggggtggagcttgaaggtgaggccgctgctggaggacgccgccgcggcggcgcccgcctgcgggtgggtggccacggcggggtcggatggcgccgacatcgtcggagtcgcgagcctagcgccggcggcgagggttgcggcggcggcgacgacgacggcggtggtgaggcgagagagagaggggagggttttgggttgtgcttaggtttccttctcgggctttgttgtacgtatgcgtctcgtgttgggccaattgggcttacttgggcccccatgggcttagaggaaatccttgtgctggtacagtgtattccgctcactccctcggaaatttcgtacccatatcttactatttaactattcgtcttattttaaaaaataattattattatttatttattttatttttgacttactttattattcaatgtattttaagcatattttttcgttttttatatttgtaaaaatgttttgaataagatgagtgatcaaatagaataaacaaaatgtcaaaattcatgaggacaaatttacaatctacaatataaaaagatcacccaatatcgaatctctgatattctacgggaagttcgtggaacttaaccggacaaaatttatttctgtgagacacagtacaaagtctcctattcagtggtaggagactctcagaaaattcggtcacaatttcgtggaacttaacgaaacgaatttaaaactaatcgattgtctccacccttctcgcatcgtatagaaactaaatttaaaaaacaaaagttttcaccgcgagaaaaaaacaaacaaagataaaattaaattaaaattaaaattatttgaaggaaaaagaaaaggtattctcaaccaaccaaaccagccatacgtatatggagtagcacgatctttcacgtgtcctggtcttatcggggtccaactgcttaccgctactactcccctcccacaaagccaccgcgacgctgcacgactcctctctctctcctcgacctcgacctcgaccggaacgcctctcgccggcggcggcggcggagatggcgatgcggcacctcatcaccgggcagggcaactgcgcgccggacggggcgtcgtcgtccaaccccttcgggaacctcgccaacgccatcttcggccagtcgtccaaggcgcaggtaaagcttagccctagccctagtcacttgctctctactactactggccttttgctcgcggttccgaggcttggctgtggctggttgatggttggggatggatcaattccggcgccgtttaggtcgctcccctttcctctcctccgcgatgtgattgtttggtggaaacgacgcaatttcgtttgactggtcttaaaagttaaaacggaagtaattcgatgtatgtttgtgtactgttggtttggtctggatgtatttagttactacttagttcgatcctgtgatgtttaggttggtgatcatgctgcttcatctgataaaattgtgcagtaagtgaattggtgggtgacagatggcctatcataattcacgacagcgagtggtagtatagatttccctgatttttggctagtttatttatctgtgtttcgtcatgtcgcctacctatgattctgtggggttttggcctagattggaactgaagttgcctgagcaattctggtgaagtagctgaaaagtacatgcctgttcctaaagtgttggtacaattcagtgctttccatgatccatgtaagtagatcatgaggtgtctctaaatagtgaaacttagtccatttagttaaactagtgtgggacaaggattgtgcatggttggcccgcgtcaacccctagtttatctttacctcttttacaagtcttaataagagctcttttatggtgcacctatgattcctgtagctgtaagaaccatatggtaatcatggccattcatctctgaaggtcaattttggcataaatactactaaccaactggaaacagttagcccttcatggaacaaaagggatgcacttgcaacgctctaaatgtgattaatcacttcccttaagccaacatttgcattacacattgacaccctagacacaactgatatatgtatttattccattatcagccggattgcaaatatatgcaatggagattgtccatgaatattgtacaatattttcaacgctttttatggtaaaacatcacaagaaattagactgtttctggatgattccaattcaacttccaaggaagtaggaaagatacatttgttttattctttcattcgaactaaaaaattgtcatcattagcagaaaaatgcatcttaaaacatcacaagagatttcatgctaaagtgtgaaagacagatttgttttattctttcatttgaactaaaagattgtcatcatcgacagaaaaatacatcttaaaacaccacaagaaatttcatactgattccttttcttagatgtatgttgaggagaaacttacctactccaaggtagtaataaccataggtgactaatttacctcctaggtagtaataggtcattttcaattctagccactatataattgcaaatggatgttccaaatataagtggtgtaccttaaaaagttaaaagttaaatcctccagacaataatgcttatgggtctataatacaatgaagcggaaatttgggattacgctgttctaatgtaataaagtagaaagttggggtgattaacatccagattgcattaataatcaagctaactttgtatgtgcccttttctttgtgcagtcaataaaggaacttccagggtctgcagttaatgttccaacaacatctgaattagggacagctgctcccttatcgaccatccctggttcagagaatgagttcaagcaagatcaactgccacttgcacgggtaatggtcattcggtttgctgcttttggtgcccttttgagcatttctaactataattgaacacctctagggcgctgatttcatccgtgggggtccttctcatgattgggttgaatcttttcggcctccaggactcccagaatttgctgtgccagatgcacagcttaaagaatttgagcaaatttttaacagcacagggccaacctttggaccaccagtcatggatggtagatttgtagtttttgttctttccaatttattttattgttgtttatatattcatcacttgataacatactgaagcacattatactgactcccaaaattggttcaggtccaccacaaagggtcttatctggtgtcctacgttctttcctagcaagtggtcaagctggtgtgccatttcaacctgttccagtaccagcgcttggtttgtctgaaagtgacaagcaatgtatacgtgatcgtagttgcattatggcacgccacattttggctgaccagcctgaagaatatatccaagcacaggttaacttataatttttgttacctcagtgaatatgctaaagcacttgcatttgtgtttcatttcattagattgttgcagtggcttcgtttttatcttctctgctgtgacctaatttgacacttctcacctgtaccaggtaaacacattgctgcattcacttgatatcgacagtaattatcgaatgaaaggacccatgcacggaccatacccagagatggaggagtattggaatcagtcccaaagcgccatgagatctggtccaatgcacaatgctgcagacaaatggataactgagtttggcaagcaaaataataaccctgaagagtgggctcattcttttgagcagcaatatggttccaatggttgggcctctgagtttgaacaggtcagagccttatgcatgggctatttgatattttcacatgtaccatttggttaacttcatggatattaactaattgtctaattttattttatatttacaatgggtgtaaaacaaagttatataattttgtgataagctatgtccgttatcatgtttagatatcatcctttccctagcatgtgcagcatatttacaatgggtgtaaaacaaagctatataattttgtgataagccttctaggatttgtgatttaagttatctatttttgtcttgttgcagcatcaatctcagatggccatgacaggaggaatgaatatggcaaacctggcagccatggaacaatctcgtatgcttgcacagacattagctagtaataatgacccaaaatttcaggtatgtatgatgatttgatttgtttatttaactctattaggtctgtatactttcattttgaatgggtaaattttaaatattttagctggtgagaaaaaaatctgcttgagcaacaactcatcctaattattttcaacagtgaagggtataacttccctttgatattttctgcttatgatcttatctacagttgtatgtagttgcaacttggttggggtgaccaatgtaaactttactaggataaacctaaatgtgtcttgttgggctcaatatcgatatgaatccattaggattaagtttactgatcttgttacctaaatcaccataaattgacatataatctagagtttccacgctacttattttattactacgaattccaaccaatttatgtgccccacgattgtggaattgcacataacaggtttaatagtgtgaatatattgatataccactttgctaatgaattgggtccattgatatcttattttatgcacatctcacttgaaataactttttctatgtcatccagtgtactttaggaagcttctggcattttactttttacaaacaactcgtcatttgttaaccccgataggttgtgaagactcattagtttaaaaacttgtgtgcatgcaggtctgtagaataccactcaatatagaacactcaatggaagaggtttctgtttgacaaagttttttccttttctcaatgctatttctgtcagcataaaataagagtgaaaggggagactctactagacgtgctgagatgagatggtgtagtgggcattgttgctatattatttgctaatgcgtcctaggacaccacattgatatgttgtgccattctgcagttctgcacatctgtggtttaataccaactttagttgattctgaacctcatctcagctggctatactgctagcaactttgttatgctatagggtcatttggatcagcctgtctcaactctcaagcacctgatgataccttttgtttcttttttggaagaactctaaattcttccagtttgtttcaaagattcgccgtggtgaacttattcttttgttttacttttttctggaagaactctaagttcttccagtttgtttcaaagatgagccgtggtgaacttattatagaagataatcaagtaaaacaaggttcagcatcccaatccagtggctgggctgatgaatttcaaacccagtacaatgctaatgcaaactcttgggcggatcagtttgttcatgaagaggtaatgcagagagctggatgtgtgtaaatacatgcttgatggggatgtggttttctttggtcaacataaacaaaaactgataaaactatagaagtactggtaaattgtggtgtttataacatggaaccttgctttgtaagtttatgttctgataaatgagtaatataaatatacaataaaattgttggaatatgttcattctgttcatacttgcagtccagttactggagtttctgattggataatattgccattaatacaattcttccggtgctacaccatgtttgactgtataaatattacactgatactgctgcttgtgcactgatgatgtggcatcacttacttttattctccagatgtcacaaggagcagataagtgggctagtgagttctctactgagtataatcagggtggcctcaacgagaactggattgatgagttctccaaaatgcgtgttgacgatgaatgggcagaagagttcagtggaggaacatttggtgaaagctctgctgatccatgggtagatgagtaagtacaaatctcttttccttgttttgtcatggctatctcttcaaggttgaaatgtgttgcttctgatatgtttccacaccaatcattagaccagacagaataccataagaatatcaaatcttctttgatccaatatcttgtctttttgggttaattataggcaaccataaagttccctttttatcaatcatgtaccatgttctatttgacagaagccttttttttttcttcatcagttacacttacacatgctctgtttgtgccttttaggttccagaaccaattatcagcttccaaacagaattctggtgcatctcgaggagtttatgttttttcagacatgaacccatacgttggtcaccctaatccaatgcaggaaggccaggaactgttccgcaaaggcctcctaagtgaagctgttcttgctttagaggctgaagttttgaagaatcctgataatgctgaaggttggagactacttggagtaacacatgctgaaaatgatgatgaccaacaggtgattgtgtctctcccactgaggatatatgtagatgtaaattaccatgtgctgattattttcaacttttcattattagtttttcagcacaggtgcactgcatgcttgtgtgcatcacttgttttcatcacatgttttattagaatattttttttatgaatcttttttcggtaggagcatgcagtgtgctggatctcaatagaaattacgtgaattatgctctatcaagtttttgcatacccttgcaagaacttcataaactgatatatatggaatttgaacggacgaacccatactattgtctgtcatgaaattatggtttatttttagctaaattttaagcaccatgtgatatggcattatgatctatgagttccatgcttatgtttaacacaaggagatgctattactttgctttcaggcaatcgcagcaatgatgcgtgcacaagaagctgatccaacaaacctggaagttcttcttgcacttggtgtcagtcacacgaatggtgagtgcatggtaattcagtgtccggcataatctactaagatgctcctgaaagaaatgaagcggcataaattatggttagaagtaacgaggtttcctcattgatacaagcttttaagttttaaacaactagataaagctaatttatctttgagggggcaaaggtctatttccttctagcattaacttaatattctaaaatttagttctaacaggttctatgccttgatgctttttgtatacatttgagggttctatataattgatgcagagttggagcagggagaagcattaagatatcttcataggtggcttcagaatcaccccaaatatgggggtatcgcccctccacagccaactgattcaccttatggtcctgatgtaagtgcatcccatctgttccataatgtaaataaataataatggcatcttcaccttccaaatggtatcctgcacagatgttctagatgtatgctctagagttctgttggtctgcggtccttttatttttcttcaagtttttttttcctgtcaccccatactgtttgtcatgtatgatatgttttctgatatttctaaaaaagtcatttcgttttgtcactaagcagtttacctctgatcaggttattagattgtttaatgaggctgcccaaatgtcacctgaggatgctgatgtccatatagttctaggagtcttgtacaacctatcaagagaatatgataaagctatagctgctttcaagacagcgctgcagctgaaaccacaagactattctctctggaataagctaggtgcgacccaagcaaacagcatccagagtgctgatgcaatattggcctatcaacaggtaattagttattgtaagatattttatttttcagctttggtgaatgtttcgctataagtgctatagcgtatttacatatctctactactgtaaaagcagagccgtcctcctatcccaccattgtacatcccacataaaaaagaaacaccctgccttaaaaaaccccacttacattatccaccagaaaaaccagatagaaaaaactgaaaagtctgtattccttccaatcccattgtaactcatgggaactagtctggttgaagaagtacagtgctttgtctcgatcatgctgtgtagaatagctacttcatccactctttcattgggctctggttattcctttcggacgatgtttatggcagttgcattcacttgtgtgtgaactgcaaatctaacaggatataattcgtggctggcaataatccatatatgatgtgtatctggaccttttggatttttatttggaaaaaaaatatgacctttaccctctggcggtctgtccattcctctatgggtacccaatttcagtataattcatagtaagagtgcattcagttcaagctatgtgccgcatccctgtacttctagcattacagtaaaaccaatcaattctaatcaaactgtttgcttaggtagcattagtgttgtaataccattggtttggtgtccaatcctgctgagtacagacacatcttcacctagcattagtgttgtaataccattagggaggaaccttcacttattttgctggtacaactatccttttacggcttggtctactgcagtcctgcaagtgtagaacttgttgatgaatctccaatttagagaaaattgtgtaatacaagtatcctagcactttatggtatgtaaatctggaactaatataatcaattgctgctggtttcaggctctggacttaaagcccaattatgtgcgtgcatgggctaatatggggattagctatgccaaccaggtaattcttctctaacatgatgctaccacttgataacaccattagttcggtaattgtatttttaacaaaataattgcagtttcaacaatttccttgcatgcaagtacaaaaccatatctcaatgttgtttatcattgtctgtcagcattattcatttactcaactaacttgcaaaccatcatttttatgagtgagcttgtatgcttccacttgtttgcttttcataataagatgttggctatcatggtttccactcgattctgaaaagatcttcaagtttttgtgcattggatatccacctaaatactaccatccattcaaagcctcggtaatattaatgttaactgttgatttacagagcataataaaggatgagtacaaatatatattatatatccaatgatgccacggcctagctcaaatatcttttattcaaagtggcaacagagatgtaataccccagctttccgtgttatgcagggattgtatgaagactctattcgatactatgtacgggcggttgctatgaatccaaaagctgacaatgcctggcagtacttgcggatttctcttaggtatgtcttgttaattatctatgagatatttgaagttccttggaggatactagagatacatttatttcaaaagaacatcaattgtcgctcacttttaagtactcataacttgcaagtactcaagaaacattgcaaccagttgatattccaatttgagtacatctagaactttccaagcacgttaaatcatttctttgtctacctaaattcaacgctgatttaattgactaacatttttctcttttaaaaaccagtaacgcttcacgagctgacatgatcgctgcatgtgattcacgcaaccttgacgttcttcagaaagagtttcccctgtgagtccaaacattctaggcattgcacttgctcctcaggcccgcccccatgataaagggtacaaggaagtagagaactagcgaaatgggggctgcacattttggaatgatgaaagtgcaaaatggcagtggccgttgtgttgtggttttcggttcgtgtatacgaattgttcattttaacaaggcgcgacatgtatataaaattcaagatgggcacccattcttccgtaggtgtgggaaacgcaaagcagaaggcagttgtcacatgtaattctgtacacagagagggaaagaataaaagaatatcgaacgaatatgtcaaaaggaggcaacacgttcttgtaattttctacagaaaataaagtggtagcaggtttcactgtttcagcatgtctgcgggtattactctcagttttttttaaaaaaaaattatacgtattgcggattgttttttcttgatgtggattattacgggaatgaaaacggtgatggaatttcagcgttgtattacaatgtcattaaatagttaatgggtagatatagaagttgcagaccggatcaaagatgatgacccccgccacgtgcatcgccatcgaggagttgccacatcagtcttggcctccgggaacggcctccccgcgccagctcctcccacacgacacgcgcaaggctcggcccgtccgtcgacgtaatccatcacgacgtcgaagcatgggccggcgacgccgccgatgcccctcctcgtctcccggtccgcggcgccgttcccgggcgggaagaggcggcctggttggtggtgttgtgtggtctcttacgtggtgtttttttttttcatgaagatgaagattaaaaaaatgaggtgatattaacgtatgattgattgagttttaattattataaatttaaaaaatatattaatatgatattttagagcaacttttatataaaaagttttcggacgaaacgtaccgtttaataatttgaagggc

SEQ ID NO: 31766 - DNA, 3091 bp, Oryza sativa
tttcccccccccccccccccctatagccacaccgctggccctcccaatctcccacagccgctggatcagtgcttttgtcactgacatatggatctgatgtctccggacctagtgacaaaggcacggtacaatgactagaagaagaaaaggcggaggaggaagtggggctgacaagaaggcacagcaagtccggcccattagttagctaaacagcccacaggcctagtcctacccctaataaataggcccaagtagcgtacaaagcccttataaatcatacctttgtgttagcaaaccctctataatacacatgtaggattttcattttggcaaaaattgttactaaaacatatggattcaaaacatctggacaatgcgttgtacaacattcaaaaattcttccatactaaacaaggaacaatacaccagaaaggcaaaagaagctaaagcaaatgcagaacactgacatcaacgaggtcaggccgcctgagctgctgctctgcttcagggatttcaccgcctgaatgcattgctctcatgggcattacgctgcgaataatacgcacggcgccggatgctctcttcgatcgtggcgcttccgcccttctcggttccaaatatgctcttcttttcttcttccaagaagttcttccctctgaattggtttgcgttcacagatgccgcctccttggcatcgtcgtctgcagctttcttgagcctgctccatctttgttcttcgtggacctctgcgtcagcctgcatttgacgaagtcgagcttccctttcttcctctgacatgtgctggacaccccgtcgacggttgaatgtagggccgttcctgccctgctggctttcctgccttcgttggccttctgaacctagttcagaagtggaattgccgcgtccatattccggtcgcctatgccttgaatctgaactgtcgtgctttggataagcactgttgtggtctgacggagtatagtgtctccctctcctatcatctgacggagtatagtgtctccctctcctatcatcagcatccgaacgaccccgtcgtgaatattcgtcatgctttggcatctcctgccttcttctccttggttcatcatctccggaaacctcagattgtcttctttttggttcatcatcttctgacctctggtgttttctccttggttcttcatcttctgaatcatgtcttctgcggtctttccttgacttctttggcttgtcatcttctgaatcttccctctgtcctttcttctccttctgtgacttccttggctcatcatcttctgacgttgcatgccgtcttttccttcgttcatcgtcttctgaatcttgtccgtgatccttcttatcatgtcttgaccttttctcttctctcttatgctctgaggcctgaacactctttcttctctcatccctgccatcactttcctctgaatctgagttctcacttgagtgatgcctcttactctttgatttgtgatgatggcgcttcttgtgctttctcttctctttcttttcttccttttgctttttctcagcttccacctacacaagacgaagttatgtcagggaatatgttcaggggaagattgattataaaccttccaatatgtttgacattacaagagtttgacagtagttaagatgctcagaaggtataattccatatcaaaagaaggatatagcttactgatttctttatctcagccatcttgattggattattttttattcttgcaatggcatcctgctcccgctgccttattagtagaagaggatcagtgtggagttttctccatgcatcatttgcagattggggcttatcctcaaataatgcacctggagcagctgcctgaaattattccaaacaaaagaaaataagcaattatcttctaatagctagtgatgaatagatattttattacaaccaatgggtgatatagtgcgcatgaaataactgatattttacacttttatactcccttgactaaaagtctaaaacacaaaacaattcaaaagacaacataaaaatgtaaaatgccatggaagcaaggaaagattaattaacttcttatatccataccacaaacaacagtttccaacttattcaatgatccacaactagacagtaggaggcactttgcttttgcatacaagtaagaaggcaaatattttatcgtttttctgcaagttcaaagatgagaaatcatattacaagtttacaacagcagcacataatctagcaacctcagcccatttgctataatggaagaattgtaacaatcagctaaacatttgagcatcgcatcctactaagaatcaaccaagcatcgcatcctactaagaatcaaccaagtatcttcctactaagaaaaacctttgccctgtcacatcaaccaagtatcttcctactatacgaatttctttgataatatcagtggaattagatgcacaaccaaaaaaaatattttagaactgcaaactaacataagtacaatcacatggccgagaagaaacggtcgcgataccttggaagagccggcactcgcttgggcagaagaagaggcggcggcagcagctgctggggcagatggttgcagcgcttggaatccctcggagctccccttgccaacagccaaccctgactcgtagaggaagtccaatctctcttgcctcctgcagaaaaaaaataacaccatgcacattattatctccccaccaatcaggcacagaaaaattccaaaatagttggacgaacagatccaaacactaactcctagctaaagcttcatgaaactctcatcgcaagcagtaatcttacaccaaattacctcaaccaattagcagaatctaactaaaaccgcggatacctgcgtcccaaaacaaaacataagcggcctagaaggctacaactacgaaaccctagaacgccgcccaaaagcccaccgatccggccaccgccaacaccgatttctcctgaactccccccccccccccaccctgcgctcccgccagcgtcaatttctcctgaaaccctaacctactccccccaaacgcgatcgaagcaaaagggggaaac

SEQ ID NO: 31767 - DNA, 9629 bp, Oryza sativa
aaccctaaccctagaaatccccgcggcggctttgcctcttcctcctcctcctccgagacgcgtcggcttcgaaacgagagagaagagaagaaaggagggagatagccgccgcctcgagccctcgaggagacgacgaccaggggttggttgatttgtgggacgagatgtagggtggggcccaccacgtcagtggcagtagatgaagtatatgcgctttcatagaaggaaagcgtattatgttggattttaatacgttttccagggatgaaagcgcatttgaagggaaacagggggatgtttggtttttttttttttgaccgatttcgctggtcgtatttgcgatccgcgcaggtttcatatacaagacaattaaattttccttttttttaacttaaaaaatacccgtacgttgcaacgggtgaaaggttattttaatcgtattattgttagattgttttgtctaaaaagtatgtgtttttttattttgatagtattgatatttaatttgaaatccttattgggatgatggccatatcatgtatcttactttcttataacgtggcaagaattctcaagcaattaggagtccgactcacatatcaagttagcatattaaaatgatttcttatacgactctttatgtatttaaaaaaataaacttaaaaaccgactcaaaatacggacgacgtagtatcgatgaaaacattttcaatttatttttataatagtaaagaagataaagatagaaatagagattgcaaattttagttaaccatgtgctcagttttacattgatttttattttaatatccttataatcactattacgaacttcacttgttctaaatcgatcactgatgtggatgctatgtccatccatgagtttgattacgattgggtttcacaccggtgccttgcatggtttccatcgttggtagagtctcacagttttaaaaagcccttgtccgttttaacaaaatgtctgtgtccgattccatacaaaatatgatccatgaacttaaaaaacgactcaaacacagacgacgcactaaaattttagcaaaaatatcttcaatttttataatagtagagatagagataataggtaaccagctacaaggtttacaatacatccgattgcaattaacaatcgaaaggatgatgagaagacataaagacggtttgaatagaagaactgatatgaaatttacatagtttgacagaagcataattcaagggtgattcaaaagagagagatttgataatttaacacttcttaaattgggcttcgattatttgacatcttggccatctacaaagattctgaagaaaaggtgttcggttgtaaggatgatcaaccaagttggcagacaaggtgcaaaattaggaagcttttatacttgcagctgaaaattcatgagctaatacatatagaattgagttcttgttccagcatagaaacagcaggtgaactgaacatccatccaccaagagaggagaagggaggaggtattacatgattttacagaaggcttctcacagaacaaaaactttcttatacacaaaaaaacaagtaaagaagcccaagcatgaaacacctcctgacaagagaacaaaaggaagaacagatcgatctggagtgtacagggtatgaaacaatctgggtgaagaaacctaaaaatcggctctaataaaatcccagggaccgaagagatttgcacactcctggctgaaattgccggtttcgactgaaatgcgctctcagcctgacttaagcgggggaatcgttcatcgccgcttcctccagctggttgatctcttctcgcctgaaagtattctgggaaggttcaagagggaattgacccgcgtcacaccttcgagtgctgaccattcctcctcctcgtttgtggatatacaatcagcaaggctgcgggcagatccacatctttcaggttcctttgagactggaggctcctctaccggtacaatctcatcaacatcccttaatgtgtaggagtgctgcaatgctggctcggtgatttgctcttcactggagatatgtgcatctccttgtgcaatgtcttggtcaaccttagcaacggtgtctgggattgcaacatcctctgtagtttcttcctcgctctcgttctcttgaatcaagtcaggtgactttgcatggtctaagaataggcacacaacagcgcagtcatcgctcttggatgttgggaacttcaatctccatgatctgacagcacagtcgacaagagccctggcagccgttgcacgagatggagctgcggctactatgtcaacagcctccttgtttgagaggacgtcccaaacctacatgcattgagtttaccaatattacaagttgaagcagctgaaggagtgaaggctgtaacatctttgtatgttaaatcaaactattccccaatccccatggattaagtagggattggagaacatgatgcatttctattcacaaaaggaattagtaactttcaacaccatattaagtagtagtaagaaagtaataagatgataagaaaaataccccatcagtggccagtattatgaactcatccttttcagtaagacgacgataggatatctgtggaacagatattaaaccataatctttaaggcagaagtctccaaaagctcttgccattgccaatccaggagagtcattatttggcaaccatactctggcaacttctggttcatcctgaagagcaaaaactcttcccctacactgctggatcctcgcagcttcccctaaataagaaatatgaagattagcgattaaccaaaaagagtgaccaatccagacaagtaactatacttagtgcgttaataagtttgactgaagccatatctaggaggaaaagaagaaaatcctaaatgcgcagttaaagagaaagttcagttttgaaaacacaagggtacccactgaaatgataagtgagaaatgaacatacttggaaggttaggcttcaaatcaactgtgagttgtacagcagttagattattggcagcatctcgtgtccccattattgctctcgagtccccaaggttcccaaccacaagatccaatccctggaaaataagccatgtccagttcttctgtcattttgatttcaatatctaccactattttttttgttccaaatgctggtcagttatctacgaatactagaacaagtttagaagcatccctcacctgttttactaacgtgactgctgttgatccactgcaaaagcaatcaactgtagggtgcattttgagttccttgtccatcaatttgaaagccttaaaataagactgcttaagtggaagaaacatctcaggaagcttctcgctgtcatcagcatattcaccccattcatcatcaacaacaggtgactcttctgaattaacacttccagaaatgcttccattttggtgggaactagtgtcctcgttggcactggttttccatagtgtgcgtattttgacaggaagagaatctctgaccttcttggcaacaaaatgaccatatggaccatgaccatcaaacacaccacagaagacactatcacttgtattaaagttctgcaagaatggaagggctaggtcagataattgtttgcgctcctagtaccagtgatgtgataagctggtaatgtctataattaatttgtttaaaagcaaatcgacaatgcacattacttttcaggaaaataaactgaagggtatagatgggttctaacaaactgtatttgtgggattctattcagtatgctcatattttcacaatggagtattccctacacaaagaacggtagacacaggtagttgggtgaacaatgtgagaaatgcacataggatagaatcagataatcagacctcaaatagcacaaatgagatggataaagtcagcaactaggcaaggaaaaggtatcaaattagcatccaatcacccatgatggaaccctcacaaggcattgttccatgcgattagcaattgttgcaactgacccttagtaaatgaggatactcctatgctaagaggttctattagcaagacatcgaacagtccctataagggtatttcatattcatgttgaaagttgactagaaatatgatttctgttataactcacatttcaaaacagaaggcgaggcaaaacaagaaaaaatataaaaaatataaatcccaagccaaaaggaagaaaataaaaactcaattccaacagatggaaactatttgtcaaggaagtacctcctcactccaataaagaagtacttacctattttcgttgaatattagcaatcaatagcattatactgagaatctttaggcataaattctctttactgtcctctgaagagcatgatcaccatgcatatcataaagtggctgcttttacttgtttgacttcctaaaacaagctcacaagatattcctatgtagctagataagtttagctagctgcctagttgtaggtccaaaacaaaagtgaaaattatccatgattgtacttcaccactccctttaggtaaactccaccaattgtgtgatggagtcaacataactacttgcttacatatcatgaaaatgaagggagtcgattagttgattaggatataagctaaatataccaagccagctattactagaccagactaatcgcttgacctgtcaagagcatctagttgaagaaacagccaaaatcatactcttctttaaactaacagaagaatacaaagaaaggtagaagcttttgccaagggtcacaggaaaggatctcgcttggactatacagaaagttttgaatcaacgcaagcacgagcagacgactccaagtctccaatattccaactaacacgtcccatttatcagattttcttttaaaattatcaggattcaggaaacattacaataatacagaaaaagtgagctttccccccccacaattttcacatacaaaaagaaccagtaaactcctcgttttcagattaaatctcaaaacaatctaaagctgaatccttcccatttcgaattaagtcatccaacaaagcaagaagacgctcccagtgagaccaaatcaagaaatgctcgaactgtttcgaagaacaaactagaaaaatagaagaggttttgcttattctgttataaagtcaaatcccacatttcgaatcaagcactccactaaaacgctcctccctgtgaatcgaatatacacacactccgaattcaaatccgctattgatccaaagccaataccgtgaagaaaaaaaaagttcaaagaagacttcggaaagatcgagtaaacgcaagcaccaagttctgaaccgagcaacacggcgaggaaaaaggcgggcgagattttcagaaccaacacgcgaaggaaaacgctactagtaccaatgatcaggaggactcagaagccatccaccatggctgcctggctcacctcccacacgaccatggcgtcctggttggtgcccttccgcccctgctgcgtgtgcaggcacgccgccgcgctcgcgccgttgacgcacaccctcccctcgaccttcgcgagctcctcctccgtcatctcccctcctcctccgccgccgtggtgcagcttcttgccgccgacgccgatggagaagacgccgccgccgccgccggaaacagccccgccccgctccaccccccgctgcctcctcctccgccaccgctgcggccacccgggtgacgctcccgcgccggcgccggcgcggggaggcaggtcggaggagaggcaggagcccatggcggcggcggcaacacggcggagcacagagttgggcaaccgcttcgcaaaagtgcggattgtatagggtttttgatgtgttttttgatgtttcctcgtcttgtagacttgtaggctactcctactactccttgaggtctcttctcacttgttgagtggagtatcatatgatttgtatggtcttgttaacttggagatttggggttgaaaatgaagaaaaaaagtatttgttttagtattttataaagtgccaaagtggggtttggttggggtgttagtctaactgattgctatcatggtgtttcttcttttggataatggaatcctatgataggggaaattactcaaggttaaaaaaaataagagtgtatattcttctatgtactactgagctttataattaatgaataaaaagtattataataccgtgtaaaataaataaataaataatacatatgattttgtatgcagctattcattcattttgaatttgattgtcttttatattaagaattttaaggattaatttgtaaataatacaatgggattaggagtaggtgggcggtggggtggcagattcacagctaccaccagtattttctaaaaaagattatgtgatttggttttaacaacggaatgagataaatgatgattaatccaagagtcatatatttccatattctaagggatttggataaatgagtagcattttttgtttctaattagttgttttgtgctttaatttataaagttgaattgagaggcactatggctctaaatacctatattgacagagcatgaacaaagagtgagatgagggcacaagatgcatgtggtacaacagtacaaaattgtctctcttttgtatctgcaagtgccaaagaatcttaaaactggaataaatattgtttagttaatcagatccggttgacaatactaacccaacaggccacatgaatatatatgttttttttttggtaggctgaagtccctttactggatacggagcaacggtgtatatccagcacagtttggggtcatttttgtaaaaaaaaattgaagtgtcatcaagaaattatttctctatattgaccaagtttcatttttctaaaaacaaaaatttcaagttttatattgaacaaccactagaactatcatcccttcagtcttcatccacttttcaaacttctttcagcaagggagagaccttttggtatatcttttcttggattctggattgtgaattttttttcccattatacatatacaatgtcctcctctggcatagcctttttgtcaaaaggtgatttaacttatatgctgctctttgtcctcattagctcaggtacagacaagattactcacactgctcctcttaaggattaattaagctgataaacaccaccctactgtcgtctaatcttgattacatggacaataatgatgacaagatggctacacttctattgatagcaacagtcatatgtgtccatctgtattttctttattcttctttgtttttttctttctttctttcttacttttatgtatctatttatttatttggctcctggaagtctgaaactgaaaccaagtcaatagtaaactgtgctttttttttgaaagggaaaaactgtgctattttagtcagaaaagcaagtgatgaatctgtgggcacgtccaacgttcatacaaactttcagacttgagactgtcaaacttagaacaagtggtggtgatttgagttgactaaaccactcaaagtattagtacgttacatgacagtaacgacgatagtaacaacaaagttgaaatcttgttggccaagaagatcctctcatccttaataaacatttttctgatcccgcaaagcttcacagttcacatgaaaaaaatcacagtttctactggagacatttcaagtaattggacttggaccatcctagcttctagttgagacccaattcacaaagttacactcaattatctccatcaaacattttcggtgccatttggaaattggaacaacggtaatttcaggttaaacttataaaaatacatatacctctgtaaaattaccatgaaattcctgcgttccaaacaaaccatattttgtgaccactgttgtacagtgtgcggacttatgacaaggtttccagcatggaactttccatgtctctctctctctccctgcagatctacctgagctagtagatgagacattgtggccacacacatgtggcagccaagttgcatgaaaataaaagagaaaaaaaaagaaagaaagaaagagcaggagctatgtatgctggaggcaagaacatgatctccaaggagcataatcatggtgaggtagatgaatggattggatgcaatgctgtcccagattgtccttgccggcgtccatttctcaccggcctcttccccatctcatctttgcacatgaatgttggccaaattaaaatctgttcaggagggtcccctacaatcagggattgatggtattgggggtacaattaagagcaagttcggtatggccgatggattatgaattatcccgtgcacgtttcccgagctcttaaatggtacgatttttcgataaacatttttttcatcatctttttgttatataatactttctccatctacttttaatagtcatattttatcttgacacacagactaaggataaataattctatttatcatctatttaaacatgctactagtcatttctcgtaaacaaacgattcattaatatttatatttctcaatactcatgtagccaaccatatgtggaagaatagatagtcatgcattaaatgtgtgaattgaaatatgcctatcaaaaataaatttttcaaatttgaaaatatgactatcaaaatagatggagggagtactttttagtacaccttttcaactttgtaacattcaatttattcataatgccctcgaataattgccataaacccactatcatccatcatgcagatggcctaacaattaggctcaccacaccttgagcagtaatggcatatatatcatcagcattgcatggttgcatccatggcaggtcattgctgcctggggtatacagttttgcagcttttcttcccttgtgttcagggttctggtgcttgccgtctgtaaccggtcggttattaaatactgtactgagtaattaatccaactacttaatgacggtttcttttatcttctgaatctgaattttttgtccatcctgaaactcttctcctaatcccagagattcagcacatgcgtactttacttaaatcaggcacagatcaaccacccaaccttggctacttccctgttccctgcacaatagagaagatgtggacacttgaggatccagccaagaacaagcttatcatgagtcatgaccacatattgctgcatttcaaagccagaattgcagtgaaaacggagacttcacacctccgtcatttcatcttcagcttatcaaccgcaaccaaaacttaaatttcaaaacttaattttagagttaattttattattttctcatcatagttctttattcctacaataactacattcttttttcctacagtaagccgctaaaatgggataaataaaagtcttacttataaattattttgtaatcactaataaacatgactgtttttacgttttgaattcgctaagaacatatataaaatttaaaattgagtaaatttcagaaaactacaactttagtgacaaatgtatcagtttgctgcaactttagcgacatgtttcagtttgctgcaacaatagcacgggaaattatcacaaaactgcaacttttacgttat

SEQ ID NO: 31768 - DNA, 19309 bp, Oryza sativa
  unsure (1)..(19309): unsure at all n locations
gctggttaggcgtctccaaggggtgttcatcacaggccaccagacgtaccgaactcacctgtctgtagttaataagacgacgaacttgccggccagtcgtcaccaccgccaagatcgctggcttgctgaattttagctgatggcgacaagaattaactcaaccactccccattcacatcgagcagagccttgagcagcaaaccagatttaatttgctttactgatcagatgtgtttgtatatgttcaggttcagagacgtttacagctcaatcatggagtgtttggccgtttattatacggctctgaattttcactgtctcaaccacaagcttcaaactgtttcaaagaataacatgtcgaaataaaggatactgatctctctggtcacaaaaaaattgtgcccttttaatgttgcgaagatgttttcgtcactgatccatatcacaccgcattactattaagtttcaaccaaaatacaaattatcgagtagattgctaaaacggattatttgctccatgttttgggaaaaaataaaaaaaaagtcttctgttatattatttagaccacttgtatttaaattaattattgtttatttaccaaaatatttaatttatctccataactaaataaataatctttagtaatagtcagctcaatatttgttttgaattgagcttggtttggagtcaaatcaatatgtatgacctttgtgcatcaaatgtaaatattttaaaaaataatactcgaagtttttttaaaacgttttttttgggaggcaacgatcccattcattctccatgattgcaaccaactacaaaccagtcatgcacgctagcccattcagcccactacatatttgcatagccatttggctgaactccctacttctcaaggcatagctacttccgcattagctcggcttctcaatcctatatgtgtaccgatgtttgcactttgcagctcaatcttggagtgttcggttgtttatacagttttaaatttcaatgtttagatatcagccaaataacaacttgtggaaataaagtgaaactctctctggttataaaaaggcccaatcaatttaatttagacgttggtatggtatttaaaacatattttttcccactattttgtgtcagtattagcaagctttagtaaaatcataacattagtgtaaaagtaggtttcgtatcaaatcaatatcaatatgtgactttcgtatctactaaccattgggcattagcccattcaggcattcagctcagtacatatataatgctttcttgcatatttgactatctaaatcatgtgaatcctggtctaatggtggctaattttatagtggaattttagtaaagaaccaccttgcgataatgtttgcttttacctttttatccaacccaatcgatgcccaatatgcatttgcaccatttgctatccaccaccattctcttgctagtctcctaaaggcctatgccaatgtcaagcaccatgctaaaaaaggtgtctccaactgacttggcaactgtgtggcattgatcatgccttgagagctggacaagcaacaaaagaagcgagataaatgagtgaatagggaaacacatgtggtcattaataggatagaaaggcaagtatgtaaaaccactctccaacaatgaagaattgggtcagggcaaggtcaatagaagagtcagggccataactagaaatcagaggcccccggtgcgaatatacatattgggtcctaaaatttgaaagccatggtggccgatggcgggtagtcataatcatgcacggtgcacactgtcatggctggcggcatatagtcgtaggcacatagaagtcagaaacaaaaaggggcaattgcaaatttaccactgttttgaatcgttattgcaaaactgtcactagataattgaaaaaatgccactggaactgccattcgagtggcatccttgcaaaattgaaaaaaccagtggcaaatttgcaaatgccccaaacaaaaaccagcaagtgtggcggcggttgggagcatgttcatttgtgacgtctgttcgtgcccattgcctagccttatgtagcgttaattgtttgaaaaaaggggtaaatttgtagtggtgatgggaatcagaggagccaagaaggcgagtaagtgcagtgtgcggtgcatgttggtttgatcaaacgaggtaatgagagaatttagcttgttgtttggactttatcatggatgctagaatagcttgttgggctttttcatacttgcaatagtgtttattagattggataactaattagtactagtacttatagatttgggagccctaaattttgaagaccttgaacagatttacgctttacacgaaaaacgtccagggtcttccggctagctccacaaggtgatgaactagacaacctaggttcgaagcctcaccccttctaattatttgatattaggtccttctctaatattcacgtcttttagatttacgctttatacatatggatgtacggccttgagaagagtaagcaactatctttaaagcatacctgttagctgcattgttaccttgcattcttttttctattgagcacatgtataactagtgactaatcatttctacttattttcttaatctccgttctctaacttatcactaaaggagaggtgattgtactactgtcggttaatgtacatgctcttatttgaattactagtgcatatatctttccatgtttagtttttcatcgagaaataacaatcagttctaagatttgctcttgaaataacttctatttgctataaaattgtctccacttctttcttaaataactttgatttgctacgaagttatcttggattgcttcaattagctcttagagtaaattgattttgctctccaagatccaatatattacatgttactgaacaaaggttacccttgatgtagaaaaacaatcgaaaacacatgggatcacgtggaatggccaagagaaacaaagatatgcatttcttacaaaaatgagtttcacgccacagctgcacatggtaaaaccgaattttacatgcaaagtttgtaatcatgtgctaactatattggtaccactagttcaaactctcaaaatttaaagttcgaccgatttgtttctttatggtggaacccatctatctgagccaaagtcctagatttaatataggccatcgtatttttcaaaacgaatattatgaggtaaaaaaaaagaactatcattgaccgggccagggctcacaatatcaattgtttttttgcgaaaaccgctcgtttttttatgaaatcgccggcgaacggtttgtgaaaacagatcaattattttagcttggcgttgaccgaaagtcattggtttaatcaatttttggacagttttttgggtaaactgggtaagaacccttttttcctaaaaacttaaataaatctaccataaacatgcaatggtgaaactggctagtgccactagtttgtgaaaaaatggtttagatccaatagcaaaatatctcagcacaaatcttagcacgggatccacgggccaaaaagaaatttaacagtcctgagaactgcccacaactagctagaaaaaaaaaagcggccgtaaccttgacttgtgagagcactgagcaaaaaaagagagagagagagagagagatggtgaggagaggactgaggccgtaactttgacttgtgagagcactgagcaaaaaaaaaaaagagatggtgaggagaggactgaaacaaaagaggcgcttttttttttttcaggtcgtgtcgcccgcgtgttctccgctgctggagatggcaagcaagggaagacctctcgcactcgcagtcgctgccaaaatggaagcaagcacacccctctcgctgccactgccactgccactgccaagcaaacagcgcggcgccacagtagcagtagccaccacgcacgcacgcgtcggtgcgtgttccccccccccccccctcccccccgcgacaaattcctcctcgcctttcccctcctcctccctctcctcgccgccgatccgccgccgccgccgcagccggtgagtgatcccctttccttcctctgttgccttaccgaattccgcgccgtgggacgattcgatcgacggatcgatcggtggttgggtgggtactgggtactagggttggggtcagcgccgaggggttgcggattggttggggtacatgtatgttggtggtggtggtacccgtggtttacctcgtgcttggctccggcgcgtggagcggcggcgctgactttcggtgaatcgcgatgccccccgattcggtggggtggtgtggtttgtatggggattttgagtttttttgtttttgttttgggggtttggtttggcgtgaaattggggcgaataggtgtgtgattctcgcggagtagccgctcctgggtaagaaatgggcgagtttttgtggtgatccgtgatcgtgagaatttgttgataaatttgcggtgtgttttactgttgaaaaacccttgctttgagaatgcctagcatttttagcttgtctcagactgtcagacatgatgtctatatggtggtgctattcgcaagcggaagcatttctgatttatgtgtaatcagtttggttactggactagacaatgctgccctcccagttataagttgtaacatactagtgcttaccaacaaccagtatatctctgtgctgctaaatggaaattgagatgacacccaatgttttaaacaaataaaggccagtatagcattctatttccaggaattatttaggcttggctctgcaatgtatttccttccagcctacttggtgcatgaggtcatgaaatatggtcttcaaattgaattatagatgaattgtgatgctgatattccttgtttttcttttcctttttcttcacagggatcttccgtcggatagtatggtattgtgctggacacactgttgactttcgtctctatgattatctctgataccgatcggagcattgcacctcttccttcgatcaatgggcattgtgaaggtagcaagttgtgcgcctacagaagagcgggcttacagctgtggagacgaggacattacacaagaggagaaaatgctgcttcagagatttcctattcatgaatccgatgactatgaacatgaagaggtcaattgtgagcttgcaaagtctggagatcagatctgtagtgtcccttatgggctttatgatttgcctgaattgaatgatattctttctttggagacatggaacttatgtctaacagaagatgatagattccgtctagcagcctatctcccagacatggaccaacatgatttctttgtaacaatgaaggagctgtttagtggcagtgacctgttctttgggagtccagtgaagagcttcttccacagattgaatggtgggttttattctccagaagtttcccaggctagagaattactgatgatctttgaaagacgaagatattatcattttctgaagtcccatcatgatggcatgattttcaagtttgcatccatggacaaggtaggaggacgatgtggggcgagtactggtcttcagggtaaggttaacagttggaatgacagaagacatgaagatcccctcacaggtgttgacataagcggttctcctttcaatagaagtctatcaattgccaatgaggttaaagatgcaacccttccacctttgaagcgaaccaaacgtatggatgggacagtaaccactcattgttcagccaagcgcaagggaatagtctacagagacaaatcaatggaaatgagctcattgaagagtcctgtctttcatgttcctggtgagcttactacatgtattagattgcccaaaggtgtgctgaaaataaagaccgattgtgcttccctcattgatcacaatgaaggaattcatcgtacaccagaaccgatgctagcagaccaactgggaatacaggtctccagcttaccttgcgcttctgcactggatgttcatggttttgcgatgaattcagcttattactaccacataaacacaagcaagagtactttgagaaatctacatgtgcgtccctaccaaagagaaggcacacttgatacttaccctcactcagttgaaagtccgtttggagtgcaaattatggttccagaggagcttaaaaggggttactattctcgaatgccgaattccttccatcagtcaacaaccaaacatagtccggaatattgcaatgaagcaccccacgagaagaaccttttgaagaactttggtcaacaaaatgccgtaattcctgaaagttctcctgatccatttacaaggaatactgattgtcatcaaacaaatggatacatgacgcatggtctgaaaactgctgaaagtatttctgaggtgttgacccttggtacagacaccgctggcccttacaaacacctattggagcagtctgaaacaatgcgttacccagaaggattgaagctgaagactcctgccagccagtcagttacagaagttgaagaaggtcataggtaccctttcacatacaaaaggaggaagctgcagaagaggcttgaccttgttgatcctgtcaagaaatcaactatggtggattcagagcctctgagcgcactggctagcgtggcaaatgtaaaaatcaaaggcaatcaagctttgaagattggcagctgagaacaaggatagctgaacatagaaattggagcatggcttatgaacatctagctaacatagtaaataaaatgttctcttttgttttgggttctggttcgaagtcaggtggagtgcattcattgttaaatttgatagtagacaaaatgacatgaatctctagtgcaaagcattcagattctctgctttctatcatgcacatccctccctgaatacctcgtcttccagatgagccgcagtttacttagatatatacattgtgttaatgtttttcttttaaaatagtgctgttgacttgcaatgtacttcctccgtttcatcatactaaaaagccattttagctttgtaccaagtcaaatattttcaagattgatcatgtttatagaaaaatatagcatcatttaaaaaaaccctatatatatacccatttgaattaggtatatactcaatttcaacaatggtgcccgggcaccatggagcaccaaacaaatttactatatatatatatatataatgatgatttaatgaaactaatttgatattgtagatgttaccatattttcatataaacatgatcaaatttatatatatatatatatatatatatatatatatatatatatatatatatatatatatattgatgatttaatgaaactaatttgatattgtagatgttaccatattttcatataaacatgatcaaatttaaataggtttgacttaggataagcctaactctgtactaatgaaagttctgcacataaaatgtgtacaattttccactcatacagtagtatagaaaaaccagtagctagtgataaatgtttctttttctccagctttatctgatctcagccatccgatgcgcatccaacggctcacgttaatcacaagctttcaaatattcaaataaagccttctcccctccacgcggcgagaaaaaaaaaaagaagataaaaatggcgccgccgcctcacctcctcccgctcctcctcggccgcctcgtcgtctccggcgacctccgccggagccccgcccacctccgccgcatcgtcccgctcctcccttcccacccccacctcgccgccgccctgtgcgccgtccatttcccgctcttcccctcctcctccgccaccttcctccacaacatcctcatccgcgcctccgcctcctccgcgtccccgcgcctctccttcgccgccttctcctccctcctccggtgcgggctcgtccctgacaggttcaccttgccgcccctcctcggttcggcgggtaagctcccggccttcccgcgcacgggcgcgcaggtgcacgcgcaggccgtccggcgcgggttcttggcggatgtcttcgtcgtcaacgcgctcctcgcgatgtacggcgcgctccgggacgcggcgtcgatgcgggaggtgttcgggtcgtgcgccggggtcgcggacgtggtgtcgtggaacacggtgatcggtggctacgtgaagtgcggggagatggagagtgccaagagggtgttcgacgaaatgccacggaggaatggggtgtcctggagcaccatggtggggggctatgccgcggccggggagctggatgtggcaagggagatgttcgatcggatgccagctattgggaggaatgtcgtgacatggaactccatggtgacaggattcgcgcgccacgggctgctgccgttagcgaggaagatgttcgatgagatgccagtcaggaatctggtgtcatggaatgcaatgctccggggttattcagtgaacagcgacatggatggcgcgagggagttgttcgatgtcatgccagagaaggatgtggtttcctggacatgcatgatttcagggtatgctcaggctggacgctatcaggatacccttgagctgtttcgcgcaatgcagactgagagcaatgtacagccgaatgaggtgaccatggtgagtgtgctttcagcatgcgcaaatttaacagcactggaagaaggaagatgggtccatgccttcatcgacaagcacaaaatggtgctcaacaacgagtacaatcttggtgctgctcttattgacatgtatgccaagtgcgggagaactgacattgctgtcaaaattttcaactccctggaccgaaagaacgtctcggcctggaacgcgctcatcaccaggttggcaatgaacggcaatgctcgggattccgtagacgcattcgaacagatgaagagaacgggtgaaaagccgaacgacataacgtttgtcggtgtgctcacagcttgttcccacggtgggctggtggatgaaggtcgacggtgcttccagagcatggcgtctacctgcggagtgcagccggaggtgaagcactatggttgcatggttgacatgttaggccgagcagggcttcttgaagaggcagaggagttgatccggagcatgccgatggcacccgatgtcatggttttcggcgctctactgggtgcctgtcgaatgcacaagagatttgatgtggctgaaagagttcagagtgagatccatagcctcaatctcaacgcccagcagtctggctgccatgttttgatttctgacatttatgctgctgctggtaaatggttcgatgttctggaggcgaggcaagttgtgcagaggtctggcatcaggaaatggacacgataggtttaagattcttgcagaagcctgatattgactttacgcttttgagcaatggaagtggtggcactggtgggtatattgcttaatgcttacaagttatcggaaatgtggttagaacatcacaactcataagccccagatagcaaaatactatgctcgttatgcttcagagctgattgaaattgccataacgccaaagatggattatgtcacagcatctgtctttacaggccaaaacttaaaattcatcagaatttattcagttggtcttgtttccttgaccatcaatttccttgagcatcaaaacataggcaaaacttatttaaatcatcagaattttttcagcggtcgtgtttccttgacccttatagaagatccaatgacaatatgctatacgtgcataagcgtagacataatcccacttcatggtcttcgagactcgtctgttagcagtgtttgttactctctgtttcatattgtaatttgttttgattttttttctagtcaagctttttaaatttaaccaattttatggaaaaatagtttcattaaatctaacattgaataattgtaatgatatgtttattttgtgttatagatgctactatgttttttctactatgtgatttataatatgatgaagaggaagtataaaatttagctgatgtgaatatgaacgaggaccgagtgttatgttgttttttggtttttgtcaggtacctactagtcctaattgtgtttttgtcaggtaatccggagtgagctgctctgaagaaacagtcgattgtttgctctgaagaaaaagttgattgttattgctaacagaaaacagatatatttaattgttatcgtgagctgaagaaattttcatcaggtgctccaaggataccaaagaaatcagctgcaaggattggacgccaacgggcaatcgccaacaaacaccagagcgagcaaaccaccaacaaagcacagtataaattgccaagggcattcgctgcaaggaactcctcccgttgctgttgatcaatttgatcagcgtgacaagatctcccattcacactacgcaatcatatgtttctgtaactgtaaattgcaaagctggtgctcgaaggtggaattgaggcagaagaatattcgcaaaattaattgatacatctaacttgcagaggaaaaaatagacaactcatgaggacactaatataatactcatatttagcaatataattaacgtacgcagttcgagaacccatagcacaatctagccccatgcattgcaggctaggtaaaggtaaagcaaatcgcacaaaataaaccgaaccgacccaacaacgcgatgttcaaaaggtaaaacagataagctagctccaatgctccatggtgtactttcgctgcgaaggatttgacgaggggaaaaaaaaggaaacccgcttagtcgacctcctccatcttgctctcgccggcgtcgtcctcgagcggcggcatgtcggtgtcggcctccgccgtctcgtcctcgtcgatgctcaggccgagcttgagcatgcggtggatcctgctgccgaaggtgttggggtcgtcgaggctgaagccggaggtgaggagggccgtctcgaagaggagcaagacgaggtccttgacggacttgtcgttcttgtcggcgtcggcgcgcttgcggagctcctccatgatggcgttctccgggttgatctccatcgtcttcttgctcgacatgtacccggccatgctcgagtccctcagcgcctgggccttcatgatcctctccatgttggccgtccagccatactcgccggtgacgaggcagcacggggagtccaccacacggtccgagaccaccaccttctcgaccttgtctccgagcacctccttgatgaccttgcagagaccctcgaatttctccttgagctcctccttccgcttcttctcgtcctcgctctcatcaagcttgagtccctccttggtggcagagacgagcttcttgccctcaaactccttgagctggccaacagcatactcgtcgatggcatcaaccatgtagaggacctcgtaacccttcttcttcagcttctccaagaagggggagttctccacggccttcttgctctcgccggtgatgtagtatatgtcgttctggccttccttcatcctcgtcacgtaatccttgaggctggtcagctcatcgccgctcttggtggagtggtacctcaggagctcggcaatcttgtttctgttggtggagtcctcgtggataccgagcttgaggttcttggagaaggcttcatagaacttgttgtagtcttccttgttctcagcaatctcgaagaagagctcaacgcacttcttgacaaggttcttcctgatgaccttgagaatcttgttctgctgcagcatctcacgggagatgttgaggggaagatcctcggagtcaacaatgcccttgacaaagctcagccactcagggatcagctcctcacagttgtccatgatgaagactcggcggacgtagagcttgatgttgttgagcttcttcctcgtatcaaagaggtcgaatggtgccctcttgggaacaaagagaacagctttgaattccagctgaccctccacagagaagtgcttgacagcaagatgctcctcccagtcgtttgtcagggacttgtagaaagcagcatactcctccttagtgatctcctcaggcttcctcatccagataggcttctgtttgttgaccagggaccactcatgagaaacctccttgatcttcttctttttcttctccttttcttccttctcttcatcaacatcctcaaccttgccctcctcagcatccttcttctcttcctcatcttcatcatcagaaatttccttctcagtggtcttctcagtccatagagagatagggtagctgataaactcagagtgcttcttgatcaggtccttgaggcggcgctcttcaaggtattccaactgcaggaagcatgagcaagttgtcaataacaaatgaacacattagagccaggacaccttatagcacatttcacagttcaacttaggagttcaggtgattctaaaaattcacaacagtagaacagtaatacttgttactaattaattcatagtactccctccgtttcacaatgtaagtcattttaacatttcctatattcatattaatgttaatgaatctagatagagagatatgtctaaactcattaatatcactatgaatatgggaaatgctagaatgacttacattgtgaaacggaggaagtattagacaaccacacgcaatcaaactgacacaaaaccagacccaaagaaaaaaaatgcatacacaatcagtttatgagctcaacaataagcttatagatcctaagtacatgtgtaacatgattactcataacatccaaggcagaaacatactaacataattttcacagcaggagttcgaaatgttaaggcatctatctagattatcacaatgtcaacagtgtgtgaaatatgttcattctgttcaatcaattcaccaaatgcccctacatagagacattttttatgtcttaaacagaccgattaagcacctggctcaagcatgcctatggtgaaaacttgaggcacatcaacatgttctttctaaaagtggctataaaatcaagtaccaacaatattcgtaataatcctacgaggacagaattactagttgatgcatttatcaatagcaagccacattcatgaactataagggcattcagcaatacaagcagcacaaattgaacaagaattcaatgaaattctgttagtacctgatcatccttgaggtagagggtgatcttagtacccctcccaagctgctccccagatgtgtcacgtgtgacagtgaaggacccaccagcctgagactcccacacatactgctcgtcatcgttgtgcttggtggtcacaactactctctcggcaacaaggtaggcagagtagaatccaacaccgaactgaccaatcatggacacatcagcaccagcagccagtgcctccataaactccttagtccctgacctggcaatggtacccaggttgttcacaagatctgacttggtcataccaataccactgtcaatgatcgacagtgtgttggaggccttgtcaggaacaatatggatgaacagctctggctgagcatccagcttgctcttgtccgtcaagctctcgaacctgatcttgtccaacgcctgcagaacacaaaagcataagataagtggccggttttgtatgaaagcagctagcaattccaattcactatccgacaataatttaataatgtttccacaccaaaagttcagctatccccatctattctcacagctcaatcttgacaccaaatgggacatctctaccctgcccaaatttagcaactccaaagatttcaggatttaccacatttttggcaggatagagaaccagaccaatcctcagttcataggggcaattttaacaatgaatcagcagagtaaagcactggttgggtgtttttgttccatagggtcaattttaacaatgaatcagcaaagtaaagcactggttgggtgtttttgtttcatagaggcaattttaacaatgaatcagcaaaataaagcactagtcgggtgtttttgtcttatatatggtcaaaccctcctatcaatttagaatgtgacataactagcaaaataaatgacaaataaatgataactagcaaaataacaaccctctatgtttataggggatatgttttacaacatttaaacatcaacactcaaagcatgtgagacttttcagatgcgactttatcagagcaatcgtaaataatgctacgagattaattagcagaacaacgacagataatgctgcctatgcctgcagttatgtttataacattctaatcagcagcaaaattcaggactcttaacaaaattaaggaccgcatgatccacagattattacactaacaaaattaagtactgcgagcatgatccacagattgatacactgagaaacgtaattaacgtcggaatcgaaacataatcttaaaaaatggggagtgaaacaccacatcgcagatttatgttgggatgatgtctcagtaaccagtaaccagtgctgcagtgcaaactccctcacacacccacacacataacaacacacacgagtcagctcgaaccagattgggtgaacaaaccgatctaccaatcggaccaaaaaaaagcccttctaacgcgcgcgcgtgcagatctgaaccagtaaaccgagggcacttacatcggaggagttggagatgagctcgcggaggaagatctccttgttggagtagaacgtgttgatgatgagcgacagcagctggttgatctccgcctggaaggcgaacgtctccgtctccgaggccatggcgctgcggcggcggcggaggccggaagcttccggaggacgacgacttggaggctagggttagggctttaggagagggagctcgcgtggcgtgtgcgattcgattggagaaagatggggaagaagggggcgatatataagggggagatgggggttctcgaacgttctaccaggggctcgaaccagcgggggagttgggagatggacgacttgacgagtcgtcgggcccacatgtcagtcggttggttatggtttttatattttggaaggttctggaggagtggagaggcttggagtcggtttaaattaagaaaaccatcatctctatggtctagtactgtatgggaatagtgaatactataattcttgtaaggggcaattataaatttaccactgctttaaatcgttattgtaaaactgccactgaaaaattacaaaaatatcactaaaactgtcattcgaatagcatctttgcaaaatagaaaaaatcgcaaattagatgcaagaaggttcaacttaattacaggatgaattttggaaggttcaactgcacatcgcagattagatgcaagaaggttctggaagcgaatgaagacttgtggtctttatctttagggttatgttatttggttaaggttggaagcctttcctcgtaacacgcaaaacaaaacaacctattgacacgattaattaagtatcaattaaaaaacttatatatatatatatatatacatattaatatgatttttaaacaatatttttataaaacttcatagaaacaaattacgtttgatagtttgagaaatgtgcgtgtgacaaatgagttattgaagttggaatagtattgcaaagaacacggcctaggttcgttggtcagcaaaactaatttggaaccaaacatttagtacaatctagaaactatcaaattggaaattggcaatgccaatgatttggttgcaaaccaaaaccacatgtgcactattcaactactaaaagtattttggtaggacatgttttggcatatcaacaaaataatttagccaattgcaacacacggggacacagacaaccaaacgagatcagaatgcagacgtggtaatatatcaattcaaattcatgaacaaaaacttatatttcaatgtatggacttgcagaattgcacaaacgcaaaaggaaacaaaaaaaggggcaaggaattgtgctttgcttcactgcttggcaattggcaaggcgacggaatcaatcccggggaccataggctgaagggccagaaaagagggcacaagatgtcaagcttgttccgacttccgagaggaacttcgtacaacaaaatggaagtatatacgcctatcatgtacacatggatctatgaggtatatacagcacatactctgcctgttctaaaataagctaatttttatacataaaattaaacatagcatgtgtagattcgtgtgaaaaggttaatttatgagggtgtttagatccagaggtgtaaaactttagcgtgtcatatcggatgttatatagggtgtcgcatgtggtatttggacactaataaaaaactaattacagaatccgttagcaaaccacgagatgaatttattaagcataattaatatgtcattaacaaatgtttactgtagcaccacattatcaaataatggagcaattaggcttaaaagattcgtctcgtaaattagttacaatctatgcaattagttatttttctaagactatgtttaatactttatgtaggtgttcaaatgtttgatgtgatatggtgtaaaatttttgtgtaggatttaaacagggccttattctaaaatggagggagtaaaatggtgaaattttctgttgtactttgttagtgtcatcggtcagctcgggcgttgacctagtaatatgggaactgtggtgtgtaattccttcgaaatgaagctggtcacttcatctctccagtccatggctctgcaagtctcgcaagtcgttagatttgtttggtccttcatctgctttgcattcagattcagtcagcccaaacttactagaatcctgatgatcatcagtgtcaccactttgggatgtgaaaaatggtagtttctgtccaatgtgtggtgaaggagggagtgctgcaagattaatcaagaaaacaagggattacaaagcatggaattaagtatggtttaatgatgtggataggaccgtttggtgtccaaattttgagggtatcaactaaacatatccagaacaaagatgatacttggggtacaaattaaagtcctcggtaataatatatcttctctggatgtctcccagtttcaacttgaatctgtttgcagtagaagtgccttcctcgctatgctgttctatactactccctccgtcccataatataagattttgagtttttacttgcactgtttgaccactcgtcttatttaaaaaaatttggaattattatttattttttttgacttactttattatccaaagtactttaagcgcaacttttcattttttatatttgcacaaattttttgaataagacgagtggtcaaacagtgtaagcaaaaacttaaaatctcttatattataggacgaagggagtatatgttacccatattactccatcaaaattcacctggtattgcaagttaataatcacagcagtcacaacctacaattgtggaaatcgttatttggtgagcatatgtgacattttgctacaaaggtaatttttcatgcgataaatttaacactgaacatcaaatcatatatttatattcgtaggccacaactaggctgcattatccaataaaagaaacaatacactctcaaccatcaaatactagtatatgagcaaagatgctgtacacatatgaaacttttggaatactacacagaaaccaaatgtgcggcttcattttaagcttatatattttgagtttttacttacaatgcttgaccattcgtcttatttaaatttattttacaaatataaaaaacaaaaagttatgcttaaagtactgtagataataaagtaagtcacaaataaaataaataataattttaaatttttttaataaaacgagtggttaaacattgaaagcaaaaactcaaaatcccttatattatgagatggagggagtacttattagtcaaaatttaaattttcaattttaaatttgaaattgattttaaagtttttttttatcaaagtttatttttagcatttacttttaattcgttaaaaacacgcatataaaagttttattcacaaatgactttttctttgcagatatgccgatgggcacccttatcatcgactcatcgtagtattagaatttattagagaaaacaaattgcggtaaaagaagggtaagatggacggcgtcagctatatttcccaagtctaaaacgtccagccgtcagctattacgcaatcaccaggagacggacggcgtttataaaccttcctccgtgcatagaatcgtcgtcccttccctccgagtgccgtacggccgctgccgccttctggaacattcgcttgcctccgccaaaaaaaaaaaaaaaaaatccctcctcccctctcccctcgagtggggcgcagccgcctcgctcgtcttccttcctcctccaccgccgcgcgtgcgcgagtgcgcagccgccatcgccgtgcgcttctctgcctcccgatctgcggtgcgaccggtgtgatcgcggagcggcggccgacgagaaggatttttttgagggaggggggcgagtggtgcgacnccgctgacctccttcaattccacctgccccaatctcggttgggaatcgaatcgaaaggtattcccatcccctcctgcttggctgagccatacggggctctgattgattcatatttgactcatattaagcatccagttttattctggatttttttttggcgcgtggtgtagtactactggagtagcaacttgtgtcccaaaataaaattgagggtttagccgccccctgctcattagatgcagtggccttatactttcatattgatatagcaagatagggtagtaattttttttcttccctgtcttgttgataacttcttggtaggtgccactatgatcttctgttataacatcatcatactatgaaattagtttgatggcataacgtgtttttttttcttatcaggaataagatggaagagaagagaatagctcggatttcggtcacttggagaggcagacagctcgatgtcgatgcagacccgagctgtacggtgaaggaattcgggcaacttttgcaggatttgactagtgttaacccagagacattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 31769 - DNA, 850 bp, Oryza sativa
ggcaaccggagaggatggggccgcagctgtttgcaagtgaccaagtcatcgttccgcccatttcaacactactgtcaaatttaaagttagcatatctttggactatagaatagagtaaacacaaattttgtttctggtcctgctgattcaacaatatcattccatatttccatttaaactttgcagccaaaataaaacctcaactactactatttaccctctcaacctccacactaaagttgttctaccagcagcgcgcacactttattctctcctctttatgtcagcattgacgaagcactgtctgtcatagtggcatatcttaagctgtggtacttgctatctttcttccctgatgtttgttcagttgagcagcatgtgcatgcttcacttcagcatcagtttgacatctctgaaaaggcctcacacctgccggattcctatgacaaaaaaaaaaaaaaggatcaacaatggctgaaggataatctgctccaggcttcatctttcacgcaaaaaataactatttttcaatcaagtttttatttttttaaaaaaatgttttcccattcatcaacatcagttcgtttcattgccgtttattaacttcagtgctggagtgattttatagtctttaagggtaccatatttccaccgtacatttgatatctcacggtactaagagatatatatatcatatttgcactaaatgttttggtatctcttggtaccttttaataactgtaaaatttctctcagcactgtacgtaggtttgcatgtatgttttgatttggcctgtttcagattgtagtttgtacgaatttgatgagaaacagtttcgaattactacaa

SEQ ID NO: 31770 - DNA, 6664 bp, Oryza sativa
  unsure (1)..(6664): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatttgtacttacatccaaacaaaacaaaattgtaaatgtatcgaacccttttctcctatttcctcaaaaaattgaccattgagtagggaaacactgcatttaaagcagtttttttagggaggggggggggtgggctggctaaaagggtggttaaaagaattcgttgttggttggacaccggataaatttagtctttttgacaacaaaccgagtgaaatggaggaggaagcaataagcaaactgatctttgtgaggagtgattttagaaaataaagacccaactacaattctaagacataatagcaggtgtggaaacaatatgcatattactcatttactcccctggatcaaattaaagagctaccttagtctgtgctgaggagtgaagtttgtactatagtcgttaatccccttaactcgaactgtacgtttgtacttagttttagataacgacgtgcgttcgtacctgaatctgaatgagaggggtgaagtgtcgtccgggcgtaggaattcattggccgggtggatcggcaccaaatttgaagactttcttcagatctgcacagctagcttatatctatatttattaaggagacagcttatgcatacagatagatttatttatgaatgcaaagaatatacataatagcatatagcatgaatgattgattgattaattaattcgtaagcaatcatatgacagaacaagaagaatttttggcagccaggatatatatatatatatatatatatatatatatatatatgtgtgtgtgtgtctagattcattagcatctatatgaacatggacaatgttaaaaaatcttacattgtgaaacggggggagtatatatctagcattctagctagctagatgatgtgaagaattgaggcttttgtcttctcgctcacatggaactttagctagctatcgaaattgaagaatcatatggatgcagatgcagaaacaaagtagccagaggaagagagatctgcagttagctagcgcacgaatgatcgatggatagatcggtgacatgtagtagtacgcacgatacgagtgaatgaacaatctgtgagtgagttagggcatgtttggctcagctaggagctggagcttagccaaacagtttcagtttcaactgaaatatataagggcagagctgggtggagcactctcacaaaatgaactagagatgtgaagctgggtttaggctgcttcacaactccactccaaacccaactactgaagctaaatttaggagttggaactctatcaaacaggctcttagagtatatagatgagtaatctttgataaagaaagtggtacttgctatacatgcatactcccttcatcccaaaataattttatttctatcctcttacctccactcgattagtaagtcgataagctttattgtttcaataccttttaactatattttaaagataatgggataaaatccggcctttgctaaaaaagctacggccaattattacacatattcgtctctaagagatttaacaaaccataaactcaaacaaataagcaccaacacaagataaagaaaccccacaattattgtatcctactcgcacattaatattactttcccattaacatgttataatttagtttttttctctctaatttgttttgcacacacaagttctaaagataaagttattttaggtctgttgtttttgttcatgttgattgtctgtcctgtgatatgcgttttgattcacagaggggctcagtcataatattggacccaatgcaaatggacattgccgctgatcttttatgttgaacggttgaatggtttaatagctgatgtcatggttatggagggggtacaaatgattaaattactattataaaatagaaaaaatgatttaaaaaattctctgagaaattcatatatagaaaaaaaattaaaagttataaagacgtgaaagcgtgaacatttgtccattcatccgttaaggagcaatataccgaattacatagaattatttcaactcctagctactccgattatctgacatatataggcatgtccttttgtcttaattaatggaatggaatataagaatacatacacttgttaggctcctaaacggtataaattttgcaaaatctctctacaaacaattttttgaaacacaatttaaaatctacttaaatttatgatagttataattaattttattagtccgtattctcgaaacatttgtctatttagctaagtagtattcagcagtccgttctattccatttaggccaaaataacacccaggcaggagggcatgcacacctaattaattaatcagataatatagtagctagccagggagtagtttgattaattaatctcctgtcacatcttgctacgctgatggttaaccaaattgctaaatcccctataaatatatataattttatactacgaatctgcccatttacactcaataaattatatgggcgacgatcatatccattaataatcaagtagaaaagcagatcgcaaataaaggcgacctaaatgctaaacgtgacaaattgtcgcaagtatctttcacgtacagttttttttaaatgtctcattattttctaatatgcccttgttaattaattccttggtattatatatttttttgatgaggaaattccttggtattattgcactcaagaaatcagatactcaaaattaacaagagaagcaaagcttataacttataagttacatatttataacggcggtaaaaaaaatattaatcgtgccgacagataattactcgcggttaaaaagaaatcagaaattaaagcggaggtactttgccacgtccgcaagtaaagcaaaaggcaagcaagcagctgatcagaacttcatggatgctcatgagaatcagatcgataaatagaataaaaaagagagagaaaagagacaaaagaaaattaaaaagaaaagcgtaggctatcagtgatcagtcagaaggtgccatgaccaaattttgtcacttcctcctttccagctcccacgctcttcctccatacgaattcattaccgccactgaattaatcaatcaattaagtagtagtatttacataatggagtatttgtgtaatatacttccttcgtcccctaatataaagtattttgacattttacttgtactatttgaccattcgtcttattaaaaaaaaattagaattattattttttacttgctttactatccaaagctttaagcacaacttttcgttttttatatttgcacaactttttgaataaaaagagtgatcaaacagtacaagcaaaatattaaaatcccttatattaagagacggagggagtaatctagaggagaacttatgtaatattaccatcattttttagaaaaactttggcaatacacattcggttagacatagatgttatgtttttttaaaaaaagatatttttaatttagactattcgttatttctaaatttttttataaaaatagacaaacataatgtgcttttaaaagtactctttttctataacatatttagggtgcgttcggcactgcctttttttatcttcttctatttctcgttttatacgtgcatatttttcaaatggttaaaaagtgtattttgttaaaataattatagaaaaattgcttgaaaaattatattaatctattttttaagttttgttagtcaatacttaattaattatacaccacaccaatgagttacctcgtatttcataggtggagaagttcccaactcttctcgtggagacgtggacacagccttggggatactcttttcagtttaagtagttgaataaataaacgttggtaaaaattcgaggaaataaaaatcaaatgtgacatatattaagaaacagtggtaataaaatattttatctaatgatttgagtggatctgccgttacatggtgcggcgcccaacgtgtagatcacaatgcaagtagatttagtgggttttatttggtcaaatttggtttatctgcctcactctagcatgcatgcatacgagtgatgattcctctaaaatacgtactttacatgattaccgcgaattgagagctacgtgttaaccacaaggaccaagagatcgatcgaccaattagcttagcttggctagcagatactctcgtgcgccataacattagtccattaattagaaagttaatgatcctattagggtaaatttggaaaataccactgcaaagatacgtgagttgcaaaataccatcgtacgtgagaatgacatgtggggcctggacccacatgtcaatgacacatacgatggtatttttcaactccgtgatttttgtaatggtactagccaaattggcccattgtattatggatcacactttgttaattaacacacattccccatatgcatgtgtatgtatgcatgtatgcatcgatcgatgtggggcccgaggacagggacagcacggctaccgggcccacccgcagcttcgattctccctctgtcctcaaaggcatgatgcgatgtgccatcggttcatatctctcttttttggtcactaataaccctcctcctaatcaccttgtcaccgacatcgatcaccttgatcgatgagaaataagcacccctgcaactaatcaatttatatttttgatgactcaactaatcaaattgaaacttacacgccacaaaaatataatcaattggagcttgaaagtagaatgcacgatttgggaaatattctgcaacttcaattcattgatcatgaattgtgagaacttgttgcgacctgcaaattttgttgtatgggggaaataagatgatctggttgaactttggcattaatttgatgttcgcatgcgtacctgtatgggataaatttgacagatgtaattatagtacaatcgtagtgtaattacactgtaacttatatgtaattgcactgtaacttgcatgtaactacagtgtaacttgtatataagtttcacgtaatttgaagaaaaaaaatcacagcacacacatatgtgtaaggatttgttcccacaaccttaataacatattacagagagatttttaaaagttacatacaagttacactatagttacagtgtaattacatgcaagtttcagtgtaattacactacgattatactgtaattacatctgtcaaatttttgggagaaaatttatcgacaaatatatagcaaaatcgtacctgcattgctttttgtttagactctattggattttcgcatgggcgtatatacctgttctgtaatttatcataaaattctttactagttaccaacttactattgacaagcgattgatttctactataggaattatcatcaataaacatgagttataccgaatagtattgctgtattgcacgttgaacagacaatctttccttcgcctcaagtgcacttagcttcacactgtacacgtcataaaagccctgagcttaggcagttcttcagacatttaagaagtaaaacagacataattttatatggtttagcgaaatgcaattgatgaaggctaacagctatagctaaaaaaaacacatgttggcgggtacagtactcctcggtttttaatatttaacgtagttaattttttaagcacgtgtttaatcatttatcttatttaaaatgtatatgtaaatatggaaaatataagtcatatacttataacgataaaacaaacaaaaaatgataattatgtattgttttaacaagataaatgattaaacgcgtgttaaaaatgaactgcatcggacatttaaaaattagatagggtatttcgtaaaacttatgtttatcgaaaaaacattgtattatactaaatctgcactatatatcgtgcgatggaggaaatataataaattgtcgtgttgcaagtcaatgcattgaatcacatatcaatacagtatactagtactccactctgtattaccttgatgatgatgatgaagaacgttactctaattagtaaaactaccgtccacgtcaccacccaaccccaacgtacccagcgcccaaagtcagactcagacagcccagaccagacatggcgccgcgcgcatgcagaaccgtgactctctgcccacctggccccacctgtcatctcccccacaccgacgctccccccctctcccgcttccgctccgttaaactctcctggccccacctgtcaggcggacttatattagtactactagtaccagtcctctcctcctgacagctaagcaccaaaccatcacttcactcccctgagctcaccttgatcaccctcctcgcca

SEQ ID NO: 31771 - DNA, 40745 bp, Oryza sativa
gtgtttgtttctctacctgcattgttgcttcatcgctcatccaagtttttattacaacttgtattctcacgtatcaaccgacaaccataacaatatacatgaatacgtccacaggtacaattttttttttcaaaaacgcatgaacatagaaaagcatgagaattataagaattaagtagcgtaccaaggcttggtttagttcccaactttttcttcagcttccaacttttccatcacattcaaactttcctacacacgtaagtttctaacttttttctttaaacttctaattttggcgtgaaactaaacacagcccaacttgaatcgtaggcaattccaaaacgcacaaatctttcgagttgttatgaagcctcaaagaaaaatattaactgcaagatttgggagtgacaaagttaatttcaagcagttgaacgtcgtgttagaaatcgtccaaaattctgatggtgtttaggtaattcaatgggattcctattagttcatttctttgttcgaaatgaccacatgagaaaatttcccatatactaattcgtatcctatgaaattctttaaaaatcctaaattccaaataaacctctgaattcttctcactaccctcagttactgtgattttcctgtcatttactcatttacattaacattggttgtctctctcaatttacagaaccaattttgctttgccccattttctcatctctcccttgccacatcatcaatatcaccaactcttgttgtctgatgaaagctacttcttctgcataacacccatgaactaaatcctgcatacctctgctcattaaaaccgctgccattgttgctacacacatgaatgtacaaacaacaacatccccaaattcaattttggcatcgcaaatctgtcttggtcccatctgatctgacacacccagcccaagaaccatccacacaaacccaagagactactcctaccaaagatcaccagggaagaatcccagaaggccatatgagaattagaattaagacacaagggcatatgttggcagtacggccatgaaatgtcattgtcctgtatatatatgagagagagagagaaatggggggccctcagtaattaaggtagcaaaggctacacattttgtgccgcacaagatgccgcaggaggtcactggctgctacagtggatcaggtagatccgtggattatacaacggtgacgccgcatctgctgcctgattatcagtgagtggccgggacgcctgtgtctccggccaaaagcgtccccccccccccccccccggattctctctgtccctatgcttacctcgcacgcatccaagcgcagtccatgaccgcgaaaaaaaagaaaagaatcatccaaatagtcgtgaaaaattctgaaaatgatctcgattgcgtgtttgttctccgtggagtaaggaatttcactcgtaagacgagtgttgttttcggtaatattcaaatagttatgaaaaaaaaaatcagagaggataacatattaccatataagcttagtttttgtgtagtaagaaattttgctcctaagtaagtcgagttgcgcaattcggattcgggtactaaactggggaggagggggggggggtggagctcaggtgttgagctgtacatcgacggatgttagcgtgtcactgttgctccaacttgctgtcctccagggtggtgtgccagaattttgacaaatcacaagtggagatcccacttgggttgtgtcatggtagctaccatgtaatactacaagaggacaccagattttgccaaatgacacaagctttggtggaggagtgggggtagcatatatattcaggcatttagggacattggatcctagatgagaggaacatgcatgattggtactactactggctagcaaaggaccagtgtctaattaaggctagtacctacctagagtggcttagaagctgtgtgatcagggacacttagtgacaggacaaggttgttggtttcagcaaaatgttctgaaggagatcaggaaattccagtgaaaaaggttttactttgaggcaattttagctgcaataatgcaggtttcttatcaggcttccataggcaaaggttcaaaagtatgtatcaatttcttttttcttctgacactataatttgatccaaactgttgatggcttgcttagggaagtggtatggcataccagctaaatgttgaaaatacatgaaaaccagggtgtagaagtgaaggagacttctgttcaacacagtaccaaacaaatatctgaatttgcattccaagcatgcataattcattatctgaaaaaatagagtaaattccttgtgtgtgcccctgaaaagttattcaatcccttacatgcccctgaaacttactcgattccttctatacccttgaatttttgattggatcccctacatacccctaccgttagattgagcagcattccctggttagtttggttgaaaatgtctataatacccttgaggttggaggagctgaaaactaagaacatgtttggcagctgggtttgaaacattcatgattgcacagtatgtattccatgaggctaaaaaattagtgcataaaattaatttcattttcttttgttatagcattcagtattttataaaaaaatataacatgatattggatctttcatgaccactaaccgacacagcctgggggtaaaagacagtacccctagccgtttactcaaacaccattgcaattcatcagcatatcaagaggatcggtagcaccatttaataggaagaaaatgaaaatacatctaaaagcattcatacaccatcagcagtacacaaatatattactttttacatcatgagcataatggcacaagcccataacagttcaaggcatccgcctgcataaagtcaaacaaatcaatcaagaaacactagcagcagcagctattcgcattttgctaatcaacgcaagggcgtatcattaccgacggcgaggagcagcggagcaaggaggtaataggccggcgtcggagcccccgagaagagggtgaggtgacaagagggagggcgcggaggaggcagggaggagatggcgtcgccatgaccgcaagcagagtcgaggccgcggcgggatgcggactcgtcgccgcggcgggatgcaaagccgccgccgcccaccagatgcggaccccgccgcgccactgatgggatgcggacctagccgccgccgctgaccgcaagcagagccgagaccgcggcgggatgcagagccgttgccgccgccgggatgtgggagaagggcggcgatgcgcgtgcaacgatggctgaaagctggcgatgtgcggcaccgtgcgtgtgggaactatactattttggaggatttggggatcggatgtggccctgtgttacctagggttgacaggggcattttcgcattttatgaaaatactgacaagctaacacacacatgaacacaaacatctgacggaacccaaacggtaggggtatgtaggggatccaatcgaaaattcgggggtatagaaggaattgagtaagttccaggggcatgtaagggattgggtaacttttcaggggcacacaaggaatttactcgaaaaagaaaaaatagggcatattgcataatttcattttcttttttgtacattgtgtcttgattgtatgaaatgagaaatatatcttgctcatcttgtatccatggcaatatggcatttcaaacagattaaaccatgtgaaaattgggctatgcaattgcttcaagtaattgaactggactttctacgataaaatcattttcaggtttagcttgaactgaagggaaatccaggacaggagttgccagtttctagcttcttacaatcaggctaatgtcagtggtgtcgaagctgctgctgctgccgtaacttatttgcatttcctgccgcgacgggaaggtgatgatttggttttgcttggtggcgaccgtgataagactgtcactatatataatctgaatgatctctgaagaacctgaaccttgatggtatttttcgaagcatgtaagaaagagaagaaagcgaacaagtttgtaactgtatatgcatgactcctagctccccaaattcttttgattgtgtggtatatatacatacatagcaggaatggaattgttttcttttgtgtgttcatagctctccaaaaccctgttccttttttcttttagaaacaaccctgttctttattttaagtggccgtgtggtacatgttttactactagttgttttgatccaactagaatggtttcgacgaggagtatagagagagagagtaatttcatatgttacttagttaagatataacattggagatagctttaccattgtatgattagatgaaatctgcattaacaagtcatttaaccactctccataagttgtagcaaggcaacagatacacgaggggaggccatttcaatatacaggtttaatgggcttggaccttactgttttatttcctgaaggaaataatttcactttaggtccctcatcttgacgtcgagtttaaaattcacctctgaactgcaataccaggcataccccaacttacaaaaccggtatcccctgaaaaacaagacgcgggacttaaaatgaacttattcctttcctgaaatgatgatcaagtccattgaacttatggccttttggcccattaccaagagaggtaatcccaaaacccaaacggtttagcccacggtggtgagtgagaagagattttctttgataatggaatagaatattccggcctttgctcaacgaactacaaccaattattatagagtagcacacaaaataaaaagcttctcacacaaaaaagaagacacctaccaacgcaagataaggagtacacaattattaaattctgtttgtgaatctccatcaaaaattggtaaacagttgcataaccgttgcctcaagattacgacatgcaacttttaaacgctcgccctcttcatcacacttttgtagcagtgcccaagacctgagccaatgtattgccctgaaaattactttgccctatggtgacgaaattaaacaaaattgtactatgcatacaaaacagtgaggaagaaaattgctggatgaagtgtcctattttttttccaagcgaagtgttataaccttgtcctatttttttccaagcgaagtgttataaccttgtatgaaaaagtgaacccaaatctttcagttagcaaatgggcttgtttggcagtgctgctttgcagctagctgcaacagtagctgggttgtacctacagtaaaactggagaaaattttccatgtttgctgcagctgcaaagcagccacaacaatctctgctgaaaaccccaatgatacgactcagagaagcaggtcgataagtagaatttacttgacgaagaattcctctgagctgggtatcttttatctcttgaatttgtaattgggtggctcatgaaatggtagtattagggaacaaatatgcaattgatggcgattttgtaatgcatggtgagcctgcttgtcttcatgaattggtagccaacgatttatcaaataaaaagggaaaaagataagtctgaattaccttctgaaatatcgaggttatctgaggaatccataaattacagcaccagatatttcactgtccatagcttttcataccagaatatcttaaatgtattatactacattcgtcccaaaataagtttatttttcaccaatcacacattctaatacaaaagcaaaaggacaaactaaaatactcatactttatgaaaccctaatgaaactattcattagagcaggtacaatagcaggctattagctagccataaacatattttaatgatataaacgatgagagagaagagcagcgggctacagatctgtagccagctgcagcacggactccaagacacactgtgtatatgacaggtgggaccatatactaatagtatagtaagcaactattgtatgaattggctattagattggctatagatgaattggagctggtagtgggctgtactattagacttgctcttactttatctacttctaatacaattatgatgtaatgattactttaaaaataaacttattttcggacaaatgaagatagctaaaaataaacttaatgtgaaacggatgaagtatataagtattatagttgtagggtatctcaaactacctaaatagttgaggagtaatttagatttttcttttaaaaaaagagtgaagccaaatcctaagtgtgaatgctataacagaacaaaagtctgaataagttatcaagtactcaagattccgaaattccataaacagtcgatgtgcacggtttatatattattatatctctcattttgcaaatttaagttgtaagtccgtatttcgagctacagtcccagaattagggccccttttttttttgaaacacagtacaaacgcaggcgctcacaacgtgcgcacactcacccctatgaacgcacacacgcacactctacccctatgagcacctccggaagacttgggccgcatatcttgagattgacgaagtcaccacaagcgcctcgctgtcgacggttacgtcgcctaccactgaaagaataattagcccgaaatgcgagcaccgtgttaaatctaggatttaaacccgggtgggctgggttccaccacaaggaacctaacccagttgagttatgctcacttcacagaattaggcccctttgattcaaaggaaattcataagaattttaaaggatttaattcctataggaattttttctatatagccctttgaatcaaaggaatgaatcctatggaatcctataaaattcctatggaatgcctcttcccatgcaaattttgaaggaaatttaacatgaggttctacctcatgtaacctcatgttaagaatcctttgagtctttctctcttcttaaattcctatgtttttcctgcggctcaatcaaacggtcattcctatgttttttctgtgttttgcaatcctctgttttacacttgtatttctatcagagtcctatgtttttcctatttctccgtttttttattcttatgattcaaagggggcctatagaacattgcggcctgtccttcaaaattcacccgccatcgttgttcgttgagcatttgagtttgaaatcaccaggcaccatgacaccacacagtagccgtgcaacgaatgttcaccgcatagcaagcaaagtcgtactagtacgttggtgcgtgcgcccctccgccgtccaccgaaaaccgcgtggacggccgctacttaagagcaattttttatagtatagctaactattgactattagctcctgttggagacaataacacagtacttcctccgttttatattataaggctttctagcattggccatatttatatatatatgttaatgaatctagacatatatgtgtgcctagattcattaacatctatatgaatgtagacaatgctagaaagttttataacctgaaacggaggtattaagtatataataggttaactgtaagatttactctgtttatttttctcctctctatttctttcactataaatttcatgtaaatattttgaagattatgtaaaacaatctattgtatgagaaccaaaacttctcatctttttctctttcttttacataagcttatattttctccgtggctttgtcttatattttaagagattttaggtggacgtaacatttcctacactccggtggtgtttggatctagagactaaattttagtccctgtcacatcagatgtttggacacaaattagaaatattaatcatagactaatgacaaaacatattccataaccctggactaattcgcgagatgtatctgttgagcctaattaatccatgattagcctatgtgatgttacggtaagcatgtactaattatggattaattaggcttaaaatgtctcgcgaattagctcttatttatgcaattatagttttattataagtttacgtttaatacttctaattagtctcaaacattgatgttacaggcctaaaatttaggtggtgtttggattcagggattaaactgtagtccctgtcacgtcggatgtttggacactaatttgaagtattaaacatagattacttataaaactaattacataaatgagagataattcatgagataaattttttaaacctaattaatccataattagagaatgtttacggtagcatcagataagctaatcatgtattaattaggctcaatagatttgtcttgtgaattagttcgggttatgaaatactagtaggttttatcattagtatatatatatattttgagcgaatcattagtacatattcaatacttctaattagtgtcagggaatttttttttttagcacctcccgtctcctcattcctcaatcgtcatcctcctcccaacccacacggtccagtcctcctcctcgcgtagacgcggcggccgaggaacaagtccgtcacgcgaaccttccagaacctcacacgtcacgcaacctcctcctctttattacgactactaccaccccctctctcctctccgttccaccgccggattcagattcggagagagctactcctcgtcgttagccatggcgtccaagcggatcctcaaggagctcaaggacctgcagaaggatccccccacctcctgcagcgccggtgagatgcatatccctctcatcacctttttttgctgcgtaattaagcttcgatttactagccgtgctgtgcttctgcttcctgctcgatcgatcgattccatgcgcgacccgtcgctagatctgaggatcaggtaggttggtttgctgttggtgtggacgagtggatgatgatcttgttgatttctgtgcaagtggagggggtgcctgtgcgagccaacccggattttctttttcagcctttgatctcgtcaaaactcagaaatttcgatgataacgtagtaataccgctttttagtttcacttttaagtaaacctaaatgtacggcacatcgtataagatctgcaatccttagctttgaaaacaagcgagaactgtattctgtagcccaatgcaatatcagatcagttaaatttgcagggagaatgagctgcgtagtggctatttatgcatcacaattcagagagctaccgaaactttatttaagcacatggagatggtccagatggagtggcttactctgtaatttttaaatggttgattgttcacggataaagagtttttatccccctactttgggatggctggtcataagatcactagctatgtttaactttgaataagtctaccaactaagagcattggtatatgcattagggcattagtgcttccaagaacagaacaattacgcataccatgcttgctcaattttaaggacaatgttctattgtatcagttcacttacttcctatatactccgtatgttggaagttggaataagctaggtgtttcatgctctgctggaagatgtaacaacctgtcgtactagtattcctttgatcttcattctatacaaatgcttccttagttgtttacgtatacgactgacatgtatgtattcttaacctaccaggccctgtggcagaagatatgttccactggcaggcaacactgatgggtccatcagatagcccttatgctggaggcgtgtttttggttaccattcattttcctcctgattatccattcaaaccgcctaaggtaaggaaacattacatcgtattcaacctacatattttaagatagcttccttgttgcaactatgaatgctggattgttcaagtgaatgggaaaactggatactgtgaaaatcttacacaagatcttttcctggaagtttggaccttttaggcgatagtaggtgtatcaattttctgaagtgggatatgataggaagtataaactgtgatttatgaaaaccattggtaggttttagtgcatcaatatcaaatgctgcgtccataccgttgaacatgttattctaagcacatgattgccttttgaagatgagagttaattgtgttcattttagtggtgtaggtggcaattctaattaatttcacctttacttccctgttcctgttctggtattatgaaatgttgtttggttgtccttaatggaagcagtcatttgtttttgttgcttctgtattgtgcgtccatatggttgaatgtattattctaagcgtgtgattgcctgtagatagttcttgtgcaagttttttaactttaatggtgtaggcagcagttgttccatttaacttcacttttccttgttcttgttcttgcttagcccttacagaaccggtcatttgttcttcttgcctaagcagaatcagtcctttgttaattttgctttagtagaacaagttatacaattatcggtttgtttgttcgtgagttttatcttctcatgccacaagtgagatgtctttagtgcatggtcgtggcagagtgcagcttgtgatctggtgtcttttctggataaatgtagcataagggtgtgaaaacatccttgacaatttctgaacctaaaggcaattgtttcccctgaaaaaacacccttgtttaaaagtggcgccaactgcaatccttgtacagagttatgctttggttattcattggcaatttggtaccaaagtttgtcatatagaaaaggtctcggttgtacaggacctagatgtttctcttaactcaaaaacgtaacggttcatgattgggaatttgtagttgggactcagagttccactaccttttcttgctcttttctgtcttaagtttaattatttttgttctacagaacaattacaatcagtagtaaaattttcaggtggcattgaagacaaaggtgttccacccaaacattaatagcaacggaagcatatgccttgatatcttgaaggagcagtggagtcctgcattgactatttcaaaggtaagtttgttcctaatatgatgaacaattgaagtaagaaaggagctgctccctccggtcataaatatttggcatttaacataagattttggacagatttttaaaattttgatcatcaatagtttcacaggtcctttgcttaaaacaaggacaaaatggtatatggatttgtctaaaaagtatcatcataatattgtaaatatgttatattacaaatttgttctgatacaaaattgatggtcaaagttttaaaagttttgaccgaaacttgtcctaaacattgacaatttatgaccgaagagagcataaagcttggtagtcaatcctctgttcttgttcagccgtgttcgcaatcccacgtgcaccattctgggtttggggcatatgatggacactgaagtagttcagttcctctgatcttgttcagccgtgttcactatcccacgtgcaccgttctgagcttttggggcatatgctggacactgaagtaaacttcagttctaatatcttccatttcatttaggtgctactctcaatttgctcgctgttgacggatccaaatcctgatgatccattggttccagagattgctcacatgtacaagactgatcgggccaagtacgagtccaccgcaaggagctggacccagaaatatgctatgggctagaatggttaacaataagaaatgtgagatatgccattgtattgccttgtattctcctgtaactctttcaacatttaagaaacagcaagaatcaaattgaactctcgagttgttgtatggaatcctactatagatgttcagctattgtaaattatgtagtgggtggttctattgattgttcgatgagcacttggaatggtacttttatgttccagagtaactgtgacaaaatagtctgtattgatctcctgaaaggctgaaacccatcttggactgtttagtgttttattaatttcattctagaattagaaattaataattagcactatttactgttttattagtttcattctaaaattcgaaattaataattagcaagtttgtaactaacgtggactcctttttttaattgtaagtagctataattcaaatgtacagcttcattttttgcttattggtttatcagtcgcaaattaaaatttaaaaatttaaaacctaattttaaagttaattccgctatttgcttgccaaaaaaaaatctctcaattctaatgtccctattgatcaagaaaacattatttccattagttgagcgcaacaaacataggcaattgttagatttgaaatatgaattttgaatggcgaaagcagtaactccttctcatggcatcctggacccatgttacaaacagagtcctgctctatctttagtggcaggtgatcctaaggccatgtatagatgggattaaaacttttaagtccctatcacattggatgtttggaaattaattataaatattaaacgtagactattaataaaacccatccataatcttggactaattcgcgagacgaatctattgagcctaattaatccatgattagcctatgtgatgctacagtaaacattctctaattatggattaattaggcttaaaaaaattgtctcgtgaattagctttcatttatgtaattaattttataagtagtctatatttaatactataaattagtgtctaaatatagggactaaagttaagttcctggatccaaacaccacctaaaagctctatctttagtggcaggtgatactaaaatttcaccttattactcagtggtagtacaactgaaccaaaaaaaaaatcaataattctgtgcttaatcaggggacaggcagagaaggatttcagggtggaggccgtgacgatcggctgtgttcagcacaagaatctggtcagcctactgggtattgcagcgagggagctttgtaggtatgcatggtgtaattttaatacgatttttgaaataacaagttgtgctctctgtacaactttactctgctagtgatgtgtaaattgagttcttgcaatttttgataggaagctggtgaaattgagttgaccaatttggactgaagaagtgatctcagataggggggttgctgcctggaagagtaggaaaacaatgcagagagagatggttcaaccctttgaggccaaacatcaaggttagtctcctcttccttgtaggtttcacacacattgtatatccaactaaaaatacttcttttgccggcatttcaaaattcttgtcttgtatacagttaagatcacttgatttgtctgatagatctgttgatggcatgtaggcatagatagctgcttagtcaacccaataaaatgaggctataacaagttctatcattgctatgctgcatttttgccaagtctgcaatctatcaatcttcatccgccgagtctctgaacataaattactacatctatagagggctcaatttatctttagctagacaatctattagaagatgatgagggatttgggactcttgtcatctgttaatgtgttatgcaatctccttccaccagctaaatgaagcatgcgagcttctttagattgattgtttcagactttcattatcttagattggactcgtgcaatgtctaatgcaatgtttttttttgtcactgatttttgaagggaacgactccttgcagcctctgtgctgcatcggccaccatcaccggcgagcctgtggcccttctctttgtgccatcggtgccacgagaacatgaagaggccattcgcagtcaccgcaagaagaattagtgtcacaacaacaagaagcatgagcgccttcatcaatgggggacagtgagatccattgcaatggccatggccatgagaggatcctgatgtcatctgccacgatatgtcagcactgaatggctgggggcctgtcggggttgatgaggtcggccggactgcacagcctgagagcaggcagaacatattcagatgagtgttgtttgcaccttgcaatccaccctgcagtttcgctaattcttggggaaaatgatgttttgatttctgtagcaacagctttaatttgttgaacgaatggatcccatgtattttttttctgggctttgaacaacaaaagcacaaaaagggacagaagcccatgttcgacccaacaaaccttttggcaggggtgcttgatgcacgcacagcacgcggggaggaggtgggagatgatgacacgtgtcatatcctatggtcaaaagtccagctgatatctcaaaaaatttcagcaggatggtactagacagtccctaagtggtacttaattcgtttcacttcagtaaagccgcgtataatatgcagagtccagagtataatctgcatcagtagacctactgatatatgatggctcagtagcatcctgtagagtttataatgtggcaaatgtctgacgacataatataactcctcaaaataacgttaaattaatttgggacctgcttttgcatttgcttcctcaaatcaaattgtttcctcgagttcaacatagagattctgcagaccagttattacagtccaatgcattttttttccaggtggtttccaagacaaattggtgttccatcggacgagtaatgcagccaccatctgtcgttatatcttgacagagccgagaaggaaaatcctccagagattggccaccatttgcatggtcagttgattctccattaccctacccttcttgttcctatagaagctcagaagcgggcaagcggcttgttttgcgacgcaccactgacactgtctctgttcatcactgcagcaaccggatggcgagcaaggcgacagagatgggaatttttttcgtttttagattttttttaatatttacagaaataatctatcggcgagaaaaattgcaaaaatagaccctgccgccccaatggtgggcggcaagctgacgtggcaaacgggggaggaacggacggtgacggagggtggttttttttgcatgaaaacccttgccgccctttggtggggcggcaaggggtccgaatgcaaaagagccgcaggggccggccattttgcaggcggccccttgccgccctctggccgggcggcaggccttgctgcctataaaaggtctgccgcccagcccccagccctcattcctcacccctctcaaatccagtgaaaaaaaaagaagagaggggaggagaagagaagaaggggcgaagccctgccggatttagacgccgatttcaggtaatattcatagatcctatatgtgactattgagttaaatagtgtgtatttttaaaaaatttgtttgaataaatgcattatatttttagggtttcagttgtactaatctagaagtgcgtattgtagatatcggtaactacgtagatctgctagtttggaatcaatactttaccgttgcattggcttacacaagaagatattacgttgtagatgtttattgcatgaaagagtaatatgatctagttaattcgttgacagatatgtcgaacaaacaaatattccaagtttaccatggaccaggaaacgtccattacgggccaactggggtagatctgtcagattttattgtatcagaaaggggaattgatagaccggctgagaggagtgtaccttctataaaaggatggttaatgaggggcttgagagttgatccacagacaagtgacataacaatcaatgttatagtaagtcgggcaactgagggtttttattaggaactaatgccagttcaaaactctcaagtgtggagatggtatgtggaaaatgcaatgcaacgcgggtggcctctagctttggttccgtttgtgcacccgaaggatccaggtatgcagatgaacatggatgatggcaagggaccaagtgctgaagtaaatgagacttctgtggaggaggtcaacgcaggagaggacaggggcgtagtagctccagtgggcattcaaccaggtggagtggccgacaagggggagactgtcgcagccattgtggatgaaatggagagggaggattctgacaacgagcgtgtagaggaaggtgattcgtcagatgaggagacggatattaatccagcagaatgggctagttaggatttttctgggctgatcgtctctgaagaggatagtgtgagatgggagtacaaagaaaatgaggttattcagggagcgatttatagtagagcagaagatatgaaggaggcggcaaaacattttgcagtgtcacttcatagagagttttgggttgccaagtccaaccggtcgcaatatgaagttcggtgtgttaaggaaaaagatggttgtccatggagagtgcacgcgtataaggggaaatggaaggattattggacagtgtcagtcgttaccaagcatacatgttttctacctggtgttcagaaataccacaggaacattacatgtgcatttgttgcatctgagatgtatgcgcatgtcatcgataatctcacatatgaaccaaggtcaataatccgacacatcgaggagacatacaagtatactattagctatgccaaggcctggagggccaaacagaaaataatagagataagatttagaacttacgaagcctcgtatgacaatttgccacgcctgcttggtgttatcgaggaaagaaaccctgggagctcttacgaagtgaagaaattcccatcaattgaacatcctggcaagagtgtgctgcaaagggcgttcttagctctacatgcatgcaagatggcattcgtgaactgtcgtcctgttctctgcattgatgggacattcttgacaggaaagtatcggggccagatactgacagcaataggggtagatgggaacaatcaggtattgcccttggcatttgcttttgttgagagtgagaataccgacagctggtactggttcctaaaattggttaaaacaaaagttgttggtatgaggccaaatgtgtgcctgatacatgataggcacgctggcattctgcgagcgatagaagagttgcagtttgggagcatggaacaaggataccctggtgtttgggacgatgtacagagtaggtggtgcatgcgtcatatgggagctaatttcttcaagcaattcaagaacaaggagctcatgaacatgttcaagaggctgtgcaatcagaaccaggagaaaaaattcaatgagctttggaagagattagatgagttgacagccaaatgcagtgatcagcgtgcagcggctccatcgaccgccgttgctgaccctcctcaagctcttggacctctcccaacggtagtccaactttggttagaagaactggattggagattaggaaattttctcagtggattctgcatgaaccaaaagagaaatgggccaaggcgtatgacacaggtggtgctagatatggaataatgacaacaaatttggcagaagtttacaactgggtgatgcgcggtgtccgtggactgccactagttggcatagtggagttcattttacatgggacatgcaggtattttagggatcggttccaggcagttcttccctctatgccgaacaacagcatttttttggaactttcatacagaaaaagctagaggagttgcgtaaaaaggccatgaaacatcgagctgtagtgcaaggtacccacaacacaggtttgagatactctgtcaagataaggcaggcaggggtatctaccacaagagagtgaagcaggagtgtgttctgaaagccgacgacacatgtcattgctcttgttcaaagccgaagctgctccacaggccatgcacccatgtcattgctgccgcagcggagtgtagcataccagatgtagtatatgtgtcacagtacttcagtaagcaagcaatatattatacatagaacggcgagatttatgggttcggcatagctagggagttcacagagactaacgatgaagtactcaatattcctgacccatcgaagctccgaggcaaggctggaaggaggaggactcgtcgcatccgcaacgatatggacgagtcggaggctggcagggtgaagcgttgcagcaaatgcgatgaacgtgggcacacctacaagcattgtcctaaagacaaggagaaaccaagtgcggcggaggcaggactatcaggatcagcagcagatggagctcgccctacgggtgaaggcactacctccactcgaccacgtcctaggcgtcgtcgtgccacgtctggctacgtggtgtagttcttatgttctatgttggcatgtgggtttgcttgtaatatgtttcgaacttatcgatgtgtttatgtttcgtcgtgtaatgtcagacttcggcatatcatgtctttaggtctcgtgatgtaacgtcagactaaggcccctagtgtctttagatatgctgatgtatgtcggacttcgacacgtaatgttatgttatgttatattatcgaactctacataaatgttaaattgcacgtcatcgttatgtaccattagtaacgtttgctttatttaaatagcctgtaatcttgttgtacataattattctcatgattttattactatttcataattttgtgagtcatattttgttttacattactacgttttgaattgttataacacgaaacactatatttttcagagatggcacgtcaggatacacctcagctgttggacccggtgatagatcaccgacaccggtctcaccttactgcggtgcagggggctcagcttgggacgttccgggcacggacgtgcggtgagctactcacggttgacgactcctttgtcgagaggtacgaacagtgtattactataaattagttgcgctgtaatattttttataatgacatattaatttcttattgtaggctgcgtgaggccagcctcctaccgatgtgtcggctggtggaggctgccgccggccacgcggacccggccagacgatggactgtggacaggtccctcctagcagctttggtcgaccgatggagaccagagacgcacacttttcacttgccgtgcggtgaggtagcccctaccctacaggacgtatcgtacttgttggggctaccgctcgcgggagacgctgttgggccagtgaccacggctgtggattggcaggacgatctgacggcacgtttcgcactagtacagcgcgcaccgcacctcccgctcgagccgttggcacaccaccgcaacaccggacctacgaagaggtggctgcttcagttcaccgtgagtgtttttgtaccgaaatgacaagcgtactacatatttattccacatgttaaggttcctaacattttaacgaacgcttgcaggtcgatcagctacaggcggaggctgacgagtactcctacagccgctgtttgaaggcgtacttgctctggcttttcggctgggtgatgttctgtggcggtcacgggcacgcggtcgacaagggactcgtgcactacgccaggagcatcgccgacgccgcggtaggcgaggtgcctcagtggagctggggttccgcgttgttggcggctctgtaccgtggactttgtgaggcttgcacgacgacggatcccagcgcgacctttggtgggtgccctctctttctttctatctgggcagctgagaggattgcgatcggccgcccggaggtggaccagcacgcgtacgaggagtcactgtacaaggagcgaccagaggtcgactaccctacgatgggtactctgtggtgccgtcgtcaggtacgttgcatcgatcttctcgtattgttaagttaattgctcagttcattatatatcaaatcgatcgtcccgtattgcagcgccgatgggctcacgtccaggttaggcggtcgtatcctgagtttgttatggagttcgaccgccttctgccgactgacgtcgtgtgggagccctacagtgccgcggctacccaggctcgtgcgccgttgggtctgtccacactctgcaccagggaccaggcgtactggatgactacggttccgatggtcttcgacatctgcgttgagcctcacgcccctttcggcgtgatgcggcagttcggcttccgtcagccctttccagtaccttttccgacgaccgtcccagctgctgttcagcggtaagatctttcactacgctttccgttattgcattaaaatctacctgttcacaataatttgtaacatctctcgattcacactaatattacacattaattcgcaggtactcgcgcaagggtcagcagtcagctggcgactggcccgccaagttggcgacttttgttgaggactggttgctcgcaaccgaggaggtcgtggaccacgagggagagccgcacactgaggaggcgtacaggcctactacgctggtaccagccacgcacccgtactagggtcaccttcgctcccttggaggagcagccccacgttgcgagcactagagacctctacgccaggcaccgcgaccaggacttcgctcgttgtgtgagtaccctgcatcgcaccattcctttatgttttcgtgtctttctcattgtcaaattttacgaatatgtatgaataaattaaccatgcaggctcacgacatcaaccgggtcgtcgttgacggttcaacgacgatccaacgtttaggcgcggggattccggtacccgtagaggagcacttgacgacgtacacgcggatggtggagtcgatgcgctcaattctccgagtgctcacctgtcgtgcagacgacgttgctcgggcagacgcagctgtacagcggccacccgtaccgactggtccccgtccagctgcgcacgttcctaggccaactccccctccgcacggaggtaagtatttttaaggatttttctgtacatgcctcgcacatatatgtgagccgtttcacttgccgattgattcagggtttcgtgcaccgttcagcaccccgccttcctcggctaggccttctggtgtgccccccacaggtacttaaaaaacaacattacttcgacaataaatttacatgcatttaatgtcttagcttacaaggtcccattgtcgatgtgtaggtttcgcccagttcgctatgatgcaggacttctcccaggctacagggtcagcgtctcaggcagctgtgtcgacctcgcactcagcgcagttctgccagtacaccggtacttcgtcacaggcagccggcacgtcgagtcagggtccaccactggaccatgctgggacctcgtcggatcgcttgctgccttccaccgtgctcttcgacatcactgacttcgactccgcttcaggctcggcagaggacgtcatcggcccctcacagctgggaggcgcaccgccggtgtagacgcaggaccaggcgcaggccactcctccgccagacactcgtgctacctgtgctgtgccaccggatcgtttcacctactcccaggaccacgtgcgagcacaggcccggaggaccaagcgtggtcgcggcgcggggcagggccagtagagcagtcttctctttgtttatttgcttcactttccagtactgtatgcttgtgtaatgactacgttgttgttatatgtgcacgatatctttcggcgcatgcacgatacctttcggcgcatgcacgactactttctgccgcaccgatgcagcctcctttattcgcgtgcgatacgagtatttgcccgccatttgccgcatacgaccaatgtaactttcggcgccgatcaggcatgcaacttcggcgtacccaccatgccccaccacgttcacatgtcaaggatatcactcgattttttgcgcctatataagtcgccttaacgagtgaggcctcacgaactcagtcacattcagtactctcttccctacttgcttcattacaaatcctaccggctttcgtcaatggctagacgccggagtgttgaggatccaaactggcgcagcgatccttatgtatacctactaccaccttggtgccagcgtcctctctgcctatgcggtgatcgatgccaactaatggcttcgaggaatcctgatattcgaggaaggcgcttttttaggtgccctaactatgaccgtgaggtattttattatctgcatatgcttattcattccgtatgggtaatcgctttattcttcgtaacactactctattcggcagacccgcactatggcttgcacatacatcgagtgggtcgatacagaaaatcccgttctcgacctaaccacttgtttacaagaaggtcgctggtatttcgcatccgaaagtaccgagcaatacttacagagaaaagcggtttatgaacgacaatatcgtgaacaacagagcgactggcgggtgctaactacggcactccctccatgggaagcccgtccaagatgcaggtgtggtgatcgttgtcaggttcttcgttctataaatcctacaacattgggtcgaaggttctttgtttgtccaaatattcttgacgacgatttcatggtaagaatattttgattacatgaatccttattttctcacaacatttactaactttgctcgctttacatctattctttcctcccaggaaccaccaaggagatgtcaatacagagaatggatagacaccagaagggttctaactccacctagccgtgttgtgcagcttgaactaccagagcaatacagggttactaaagcgcggtttgagagaggagagggatcctcacgtaggggttagctattatcggacaacttggcatattgaaatttctactgtcatgcttccttgtcccattactacatcgtcgttgtgttcaactattgcactacctccctcctagttcgaatctaatatcatctatgtaaccgcaatggaaatagttgtatcatgttcaaattgtactactatttcttcatcttacataattctccttgtttaagttcatataatgtttctacgaccgagactgcgataggcctatattaattatccgagtactaatacgtcgaataaggtacaaaataatacctcacttaacatatgaaattgcgcaacaaccaacttcaatacatttttataacaatattaacaagttttaccaacaaatacttctttatttattattaacattacatagaaaaatcttttgaccgtactttttacatctgggtcccttgccgccctctattggccgcaaaaagtacggccgcaagctctgagggggcgtccaaaattgcaattagccccttgccgccctctgtatgggcggcaagggtctaatcgcaattttggccgacggcggcagacggcgcggtcgacccaccgtctgccatgttagcttgccgccccaatggtgggcggcagggtctatttttgcaattttgttcgccgatagattatttctgtaaatattaaaaaaaaatctaaaaacgaaaaaaattcacagagatggcgccgggggccctctccaatgggctgtggcttgcctgggccggatgcgcgcaaacaaatcagcccatgtgtgtgtttggggtggtggcccggctcttgggcttctcctctctactccacgcgttgcaagcgtcgacgccgatgccatccgccgtcacggtctgcacaagcatgcatctgctcaggcgcctcgcgctccctctggcgggatgatacgcttttggatcattggatggcagcgggtttgttcgagggataggtttttgcttctctcgaggctcgacggataagttttagtagctgattggtggtgttggcgtgggtcgttcagtgatgggttcacgtctaggcttagcgctctctgatcttgcttagcggcggttggtgcggtgttaattttgttttatcacctgccattaaggactcctgatgctgtaccaataattgcagagcaattgccatcgtaggagcaggattgcaagagacgactgacttgcagcctttcttgactgctttactttgtttgcattttattagtttatttaaaaggcctgatcacggattagtggttagtatgtaaaaattcatctgtatctagtgagcagccatcaccgatggggtcatctttgtcggatctaaatactccatccatctacttttgatagtcatattttatcttggcacacatatcaaggataagtaattctacttatcatccatttaaatatgttactagtcattcctcgtaaacaagcgattaattaatatttacatttctcaattcccatgtagctaatcatgtgtggaagaatgaagagtcattcattaaatccaagaaagtcgttaagataataagttgttggattgaaatatgcctatcaaaaataaaattttcagatttggaaatatgactatcaaaagtagatggagggagtaaaaacctattactgataaggtttgactcagcgcgtgaggcatcctataacccatgatgggctccaactcttactcgtcaaaggtgactttgtcatccgactaagtcttgctctccatacttgatccaacatgtgttctccttcatgaattctggacatattagatgagggtgtatatctactcttccgacaaacatcttctcattttttttcaatctacacatgaacaagtcatataatcgttgttccttctttctctcctcctccgcaacgtttataaaatttgcaacaccatttctatactcttttctatgtcgatcaattatgtacatccaatttccgtccatctctacaaatgcgaacaaatattatatatgtgtgtgtgagagagagatttatattataaaatttgtagagatggtttatttattattacatatagagaaattttccaaattttcttttttttcttagaaaagacaaaatttgtccctctagtcctcccaccacaaatgtgaaataatacatttgattgggataatcattacatgaaggtgttggagtatttatagtgtggaatatcggtaacgaggcgataaatgaaacccatcaataaccaccttattggtgacgggctttatagctatctttgttgggcctgtagatctggttgcgatccgtcaccgatgatcttcggcgggccgcaacctaacctcgtcaccgatgagggtcatcgctgacaggtccagccatgaggtctcaggtgagtgtttctatgggtgcttctatgtcggagattattttgggccgttaaaagtgagtgcctatgcgattggtcgtaggtctccgttatagatggtccatttgcgatgtctagttctatattagtcgtcgtttgatgaaacatctgtaggatcgaatactaagaaataagccaaccagagggggggtgaatggttgatgtacccaaaaactaaaacttttagcggaattaaaagttaccctcgaatcgacggatcacggtgtgaccgaagtagattggccggtctgaccgcctggatatcgtcggtctgaccggagttgatcgttcggtctaaccgccccgaagaagctgtagtcacctgaagctgccgccagtctgaccgccgcaatgctgccgatctaaccgacggtatctcgccggttagaccaccgaacccgagcaaacacaaatcgaagaatttttgatgtagacgacaactttattacttctctctgtgtttacaaagtgcaacaacagcactcctcatgaaaatctcgactaaactcgaaaccttaactattctctcaactcaatgctctctaaagtgataccgggaggccacaccctccctctctatttatacataaggtaaggcagcctaaagccacgaaccaaactcatacaagaaatccaaatccacctagaaaaccttcccgtacaagaaaccaactttacaaactccaattgtaccaaatttggactccttccaatttcgactccgcatcccatacgcacacaatatctccatcgtatgccatatggaatcttcaccaaccacgtacattgatctttagcctaagtatcccgcatgatatctgactgtccggacgtcaccttatctccaagttgactcccaatccatcaccggcaatactctcccgagacatcaagacacctacacatgaatcaaacaaagaaaccatattccgagaccaagttatctccaacttgactcaatgttagcaaacaacagtattacgtacgcatagtatccatctagaaaccataaacatgaaacattcacggatatccaatgaaacaacccgaaaccgaaaccgacatagtgtcggccggtctgaccgcttgatatatgctggtctaaccggcaaccactgcccggtttaaccggacccgacaatacaacggttcttgttcatcacctgaaaatccaatcatctcaaaaaccacttcgccaataatctccaaatatcaaaactaataatctcagatgctaattgttcacagaataagaattaaatacactttgattttacaaccttgaccaaataccgtggacagctttttccttagcaaaattttactcacccatttcacacagtttagtttgctatgcaactctagggcttaatccttacctatgatattttgggatagcctattacatatggtggtgccaatggcggcgtgtaggtgtacgttttggcatcggcgtgcaaacttattcctaccatagccattttttttccctactagcaagattttattcatccatttatacagttttgccatgaaattgttgggattgattaatcgcaaattggatattttgggatatatctatagcagagcacaggataaaagagtatcaaagctgttctacacgataagatataaatgaactccctcttccacaataatcactggaacagtaccgcttaccaaatgggatgactaaaagtcgtcgttgatcacttcagcgcagaatatttcaggtcatttgtagtctcatagcatatagttttatcaataagttttacaaaattatagccggagaacacgcatgccattttcattcataattaaaccatctttctgctactaacttgtgttaagaattctaattttagccatgaacctcgttgatgcaaatgtttgaacctgtttagtcaaaacagaacaattctttcatgtcgctaacaggtactgttgaaatttgtgtgtgctgtttggactgaagttgaaatttccacccttgtgttcagaattgaaccatcttgtgttcaaattctgaattttaccaatgaaccgcattgatcaaatgtttgaatcggtttggtcaaaacataaattctttgatgggactaattattggtagtgatgaaatttgtgtaaacggaccaaaggtgaaacttctggccctatatctcgactaaggaggatcttagtatcaatgttttcaagaaaggagatggtgagcacctgggtgtattcgaacccaggccgttgattgactagctcccggcagctccctgccaactaagctacacaacgttctcatgtttttcatccagacgttaaatcatgattcacaagtgctttcattgatttctttgcatttatacagaagtggtgcaagggaatgtagttgaagaaggtgactagaatacttatctgcaacctttttgtgttgtttctctgaaactttttcttcatgaagctatactaacggtagcaagtgagtttccattaagatgtgattttttttatcgtgtgtgtcctattataatcgagaaattttacaatccttgagacgttctaaaaggtatcaaaatttttagtacaaatttggtaccttctagtaccaaaggtatcgaaagatgctaaattttacactataatggtaccttctggtaccttttgaaggactaatcgttataatcaagatatggagctgaaataggatactatagtcaatttacttttataacttattctagtactccctccgtattttaatgtatgacgccgttgactttttaaccgacattttgaccactcgtcttattaaaatacggagggagtaagtattaatatagttattgctgattattcttgcttatttatttagaaaacacttccaccttattgttacctataagtgcctatataacatggacaattttcctacccaaattttcactcgtccatttcacacagttttgctatgaaattgttgggcttaatgagctcacattggaaatttgggatagcacggttactattatgcacctgcaccagtagatgcagatgatctgtcactacagggacagtgacgttgcccccatttgtgacgactggcaaatcgtcgatcgtttcagcgcagagtagtcttaggaaatcacatccatcaatagcgttgtcaatccttcgatgaaacgatcgttgtcatttaaccggaatcatttatatcgcagtagaagcaggcccgggcgccgggctaccagaacaagtataattccttgtgtactcatccagctttcaatactacataaaacattattgaaagtctgaaacacaagtataataagaccttgtttagatccaaaaaattttggtcaaaaacatcatatcaaatctttaaacacatgtataggacattaaatatgaaaaaaaacccattgcacagtttgcgtgtaaattgcgaggcgaatcttttgagtctaattacgccatgatttggcaatgtggtgctacagtaaatatttgctaatgacggattaattaggcttaataaatttgtctcgcagtttacaggaggaatctataatttgttttgttattagtctacgttttatacttcaaatgtgcgtctatatatttcaaaaactttacacccaaagaactaaacacaccctaagtttggcccgaggtggatacgggacgcttgtatagtgatggtgtttctctttgcaattcaattttgcgtggctcatacacattgtttagatggtaatcagatcgagagatgctagtccaactcaattatttgtggagtgaataagatggcaaaaaacattgacttgttcaggagcaacccttgcgtacacacctgactgcttgtctgaatgcaaattcaaagtaattgtgtaggggcctacctgttgcagattcaagtgtcgttgcgcttataaaagcttacaacattcactccctctcactaaactgtggcatgttctctagccgcttgtgatactcgcaatcctaaaccacgagagaaaacattgcccctatagcagaagggtagatcgatggaggcagccatcggcgcagcgagctggctcgtcgacaaggtggtgacacagctgtccgacgagctggtggcggcttacatagccagcaccgagctcggcctcaacatggagcagatcaagagggacctcatgtttatgcaagggctgctccatcatgcccgggagaggagggacaagagcaaccctggcctgcaagggcttctagaggaactcagaaagaaggctgatgaggctgaggacgtgctggacgagctccagtacttcatcatccaggaccagatcgacggcacccatgaggccacccccgtggtagacgatggcatccgtggccaagtcctccatggccgccatgctcttcgtcacaccatcggtaactgcctttcatgcttttcttcttcttcttcttcttctgtaccagaggatgccaattatccacatcacacagccaagtcccgtagtgatgaatctgactatgttggcaagttgacattcaatcgagtagacatgtccaaaaaaatcaagtcggtaatcgagggcatatatgacttatgtagccatgtatccaatttgctcaaaattacccaacctgaagaaagaagggttctatcactgaagcgacctcccaccagctcaacaattacacagaataaattatatgggcgggaagacatctttaaccagactcttgatgacatgtgcaccatacgtagtgaaacactatcagttcttcccatagttggccctggtggaatcggaaagacaacctttgcccaacacctgtacaatcacaaaagaacagaggcacacttctctggcaacaagacctgggtttgtgtatctactaattttgatgtggttaggctcacccaagaaatcttgatgtgcatatgtcaaaatagaaatgaggaaagtagcggagcacatgaaacatccaacttggatcagctccaaaaatccattgcagaaaaattggattctaaaagatttttacttgtcttggatgatatgtggagatgcagcagtgagggtgaatgggaaagcctactagctccattgaaaacaggagaagccaaaggaagtatggttattgtcaccactcgttttccatctatagcacaaatggtaaaaacaaccaagccaatagaactgcaaggtctagaggatgatgaattcttcacattctttgaagaatgtatatttggtcaggaaaaacctgcgtgttatgaagatgaattgattgatattgcaagaaaaatttccaagaaatttaagggtttcccactagcagccaaaaccgttggtcgattattgaagaataacctttcccaggaaagttggatggaagttcatgaaagaaatgagtggaaaaatcagcaagatggtgatggcataatgccagcactacaaataagctatgactacctacctttccatctgaaaaagtgtttttcttattgttccctttaccctgaggactaccggtttggtaatttagagattacttatttttgggaagcattaggcatcatagcttatggagatcaaaataataaagctgaccatgtaggattaaagtatttgaacgaactagtaggtaatggttttctcatgaaggaaggtgatgatagtaggccatattatgtaatgcacgacttattacatgatctagcacgaaatatttcgtcacaagagtgcattgacataagttcatataactttaggtctgatagcatcccacaatctattcgacatgtatctatcaccttacaatatgatgagtatgaccaaagttttgagagagaattagaaaaattcaagacaaaaatagacatagtaaatttgcggactttgatgctttttggaaaaggcaatgcaaacatgacctttttcaaagatttgttaaaagaaacaagaagtcttcgtgttctatttatgcatgcaaactcgcccgaatctttcccacatgactttttcaaactaatccaccttcggtatctaaagttgaaaataccttatggcgtagaactatctctaccaaatgcaataagtagatttcatcacttaaattttttggatctagggaatagtatatgtattttgccaaaagacatgaatcgtctattcaatttacacctctttcttgctagaaaagaactttgttccaatattcctgggattggtaaaatgaagtatttacagaggttggaagagtaccatgttaagaaagaagacattgggtttgatctgagtgagctaggggatttgacagagcttggaggtgaactgacaatatttaatcttgagaatgtggcaacaacggaagaaggtaatcaagccaaattgcagttgaaaagaaatttgagaagattgacgctaatttggggtgcggtgcaacagacgacaggatctgatgttcttgatggcctgcaaccacattataatcttagagcacttggcataataaaccatggtggtcccactggtcctggttggttgtgttccgatatctatctatctattatatactaaaagtccattaaactttctataaacgctctcaagccgccacgtggctttctacaaacgctcctaggtcaccacgtggcattctataatctcaccgtcgattttcttttaaatcggtggacccactaattttaactattagatcttcattgaaaaaataaatctggtgtccccactattttttaaaaaaattgccgtgtttgccatcgggcaaggaacgtaagttcttttttttttcccggcggcatacgatacgtactccacgttccacgttagtattatttttttccttttttttattttgcaaacagttctggtgtccccactatttttaaaaaaaattgccgtgtttgccatcgggcaaggaacgtaagttcttttttttcccggcggcatacgatacgtactccacgttccacgttagtattatttttttccttttttttattttgcaaacagtactttttctttacaccttctgaaaacagtactactactacgcacatcgtacatacactaggggagtttaggagaaagtgttaatagatatgtaaaatcacatcttatcgatttaagtaaaaatccatagttaaatattttttctttttcttataatttttaataattcttttaatttagagatatgacatgtggtaacctaccagcttttatatgagtgtcacgtggtagcttaatagcgtttctaaaaagtttaatggacttatatatagtaaaagttaatttaacttcctataaatactctcaagccgccacatggccttctacaaacgttcctaaatcaccacgtggcattttttaatcacaccgtcaattttacgaaggtaaaaaaaaaaaaacgcagtacgtactccttccaccctccgaatctcccatcctctcctattttctagctaacttatcatattttctcattaacactcaatatatcaaaaaataattcggacatctaattgatcgcgactctcaaattataattttatactcaggtttttttcaattgttatgttatttataattaaatataaaattcaaaatccatatcactcatattttgttatctaaaaattagatcatgctgccgttctaactacaaatgtcagggcctaatggtacgcccataaacacttctaagtcgatctcgccttgtaacactataataaattaaaataaatctataagtatgacaaatgaaaataaaacatctaaccattgctctccacttaaatcgatggatccactatcttatatggttagatctatctttaaaaaaaaatcccaaaactccctcacattcctccattcctctgattcctctctccctaccattccttctctgttctttttatctccatagtaactaaaaccaacattatctttaggataaaaaaactccaaaaatggactccacctaacaagtctagctagctttccctctataatgtgcttttcttatctttctcctcaagctagcacttacagaaacaatataaactagactttaaaacactcataaaattttaaatcgtatattcatttatgatatttctacactattttaatttttaattaaataaataatttaatatctgtattgacttacattgtggaccacatctatccacctttaagcctccaataaataaaatagaacactaaaatttctcattaaaaattaaaatatctcaccttatgtttttaataaatggtcaacccattatttataccatgctagacatctaatctccttcttccaactccttatgtttcagattataagtcattttaaattttgtcaatgtcaaattacttgaattagtttataaaaaacatagtaatattttctacacaaaacaatcatattataaaacatattcaattttgaattcaataaaaataatttggtgttgtaaatattgatatatttttcctcaacagtggaaatagttaatttctcttaacatgcatatatgggctatttacttatatttgaacttaattagatgcacttttatgaataaatgatctttttagggataaataaacgttcctaagatgatcataatatctaaattatacatatgatatctgatgtcactaatagattagagaaaaagcttataattatatcattttttcgtgtcataacgtgtaccccgtctaggatctatttgtcatacacagcacattgaaaatatttaagggatacctttatcccatgccaagttgtatggccattccaaattgcagagatcaaaacatttaagagacgctcgatggaatggaaatctataaaaaaataacatgataaaaataattgaagactgaactttttttttctaaatttaacatttttttaaaaaaattgaaacccattctaaatagcaatgttttaatattttaggagtactgaaataatgaaaataactaaatatttaaataaaatataatagaaaatttgacccttttcagcattatgttggaaacaaaatctaatataactaaactacaacttgggagcgataaaagtctcattttctaatatattttctggttgagaaaaacatttactgctaaactgtagtttcatactgcaatactatatacatacaattaaatcaatatttcaacaaattcagctaatttaattagatgtagtcgtattaggcatatttttaatagaaaatatcttcaattaatatatcctaaaattcataaagacatatatattataaaaagaaaaattgttactcagagtttagaaagtacaaaattatgttatgctaaatattttaaaaaaagaaacgcattatgtacaaatgatatatagtttcatgtatattttttttataaaacctaaactgcattgttttaagtaattttagtttacaatttatacggtggcgatggttactagcattaagagaaacaccacacaaattattgaaaaattaaagatgtttacgatagactaatcataaatatttctaatcaaatttttaacacacttaaatatgatgcccgcgcatttgcgcgggctaccttcctagttcgtataaatggcctgaaatgtctacatttagagggcatatcttggagaacactcccacctttggggcaactaatgcatttggaggaacttactttgatcaatattgctgggatgcgtcaatttggacctgattttggtggtgttacgaagaagagtttcttacacttgaagaaaattgaacttgttggtttaccggaacttgtggagtgggttgggggagatcattgccatatgttttcaaagcttttaagcatcagatgtgaagattgtcctaatctcaccgtgctcctgctgccatcgtttgagtgctctatctctgacacaaaagacataaacaccatatggtttcccaacttgtgttctcttaagattcgaaattgccccaggttgtcactgcctcccctgcctcacacttccatgctaacctgtgttactgtgaaagaagatgatacagatttgatgtattttgatggaaaaagtctgaggttaaatcgctacggtagtgctttggccttccataacctgaacaaagtagaagatatggaaattgtagacatgccgctcgtttcatggactggtctccaaaagctgaactcccccagaagcatgcaatcgatgggtctgctctcaaacctctcatctctcactcatctagaactagtaaattgtgataacttaagagtcgatggttttgatcctctcaccacatgcaacctcaaggaaatggcagtttacaatagtaaaaaccatcacccctccatagcagcggatttgttctcagtggtggcaatgatggaagtaatacctgcaggttccttccagcagctggaacaactctcggtggacagcatctcagcagtgcttgttgcccccatttgcaacctcctggctagcaccctctgtaagatggaattcccgtatgacatgtggatggaaagcttcaccgaaacgcaggaggaggcgcttcagctcctcacctccctccaatgcctaggattctatgtgtgtccccgtctgcagtccctcccagaagggttacatcgcctttcttcacttcgtgaactaattatccataaatgtcctgaaatcagagcgcttcccaaggaagggttccccgcatcactgagatatgtatttgcatacgagggcatcagtgttgatctaaaggatcaactcaagaaactaaaagcatcaacgccaggtttacgtggtaaagcatgtcctctcctaattcctgtatttgtcccttattaaatctgtaaattttcatatttaactaatttttgcctgttttgctattaatgatttacctcatgtggagtagtggtttcatcgctaaccaacttagtaaattaatgcgagctacacaagattacatgaaggccagcaatctagaggtcagttcatggaaaaccaaggcagtccttcattttgtggtttctttctaagttcaggcagctgcttttagtttagtccatatggttgagctgttttctttatctgctatctgaatcaatgctatattagttagcttacattctatatatccttacatatttttttcatctcaaacagcatcacaacagtttgcacgcatgcagctgcgtaataaatctgaaacccgcccgccctgctatggtctgatgtcatcagatccaacagcatcaattaagccatggtggtcagtagcatcacttctgctcatatcgtttgtttttttttcttttctgtagtttctcctgaaactagtactccatccattctaaaatggcaaaatatatcaatatcaacgtagtactacgaatgtagacagccttcatcgtattaggtggtgtctaatctattattaggacactatattttgaaacggaggggatagcttttgtaatttctctcgatgtcctgaaatcagatcgctgctcaaggagcattcctctcttcattgagatatccaagggcaagaccgcaagaggatgcagcatcgtctacaggatcaactcaagaaaatagctaggagaattagacccacatttggtaaaagtgccagggtgatccaaagtgaaatttaggtaataaaaagtgacctaaagtgcaattcactcaataactttacaacgcactgcagaagctgatatgttctctgttatctttggtagcggtggaggcagcctaggaaaatctggctatactgagatgtttgtcatttaaaaagagaagtctatcttcaattaaaataacaccaaaatgcctttatgcattcatcaacgagccagggaagcatttcaaggtactagattcaacaattcctgtaggacaaatggtcattccactgttcatgggtattgagagtatagatagccatgtgggccgcccggcacagcccggcccaggcccggccgtgcctaggccgaggcttgtcaggccggcacggcccgaccgactcaccgggccagcccacgtgccgcactcacggcctaggcacggcccaacacgcctcgggctgtgccgggctggcccgaaggcacgatgggccatcgtacgtttcctcagaataagtctaactttcctccctcctattgggctgtgacatatatatagctaaaaaagtctattttacctccctcttatttgggctgtggtatataaatagctaaaacaaactcaacgcacccattggtgcgcggactaatgtatggcccgtcaccatcgtgagcttctctatatctcaatattttttttcatatttatttgaaattgcctgcgttagttcgtttgggttgggaacccatcttctccacatagaaaacataacggtccattagcacgtgattaattaagtattagcaaaaaaaaactttcaaaaatggatcaatatgattttttaagtaactttcgtatagaaactttttgcaaaaaacgcaccgtttagtagattgaaaagcgtgcacgcggaacacgagggagagaggttgggaacacagagtaaagaagtgcgttttttgcaaaaactttctatacaaaagttgctttaaaaatcaaattaatccattttaaaaaaattttctgctaatacttaattaatcacgcgctaatggaccgctccgtttcctgtgtggaggagatggttcccaactcgaaggagcgaacagagggttgggaaccactcccctttgcacgcaaaacggagtgatggattaacgcatgattaattaagtattagctataaaaaacttgaaaaatggattaatatgatttttgaaagcaacttttctatagaaacttttttccaaaaacacgcgccgtttagtagtttgaaaagcgtgcgcgcgaaaaacgagggtgatgcgttgggacataggggaaagaactaagacagggggtgtttagataattagatctaagggtgtaaagttttggcgtgtcacatcgggtattatacagggtgtcgcatggggtgtttgggcactaataaaaactaattacaaaatccgccagtaaaccgcgagacgaatttattaagcctaattaatccgtcattatcaaatgtttactgtagcaccacattgttaaatcatggagaaattaggcttaaaagattcgtctcacaaatttatcgcaatatgtgcaattagttatctttttagcctatatttaatacttcatgcagatatttaaatgttcgagttcgacttgacagggtgtaaaattttggggtgggatctaaacagggccttagttttatgccagtaaaatttgtaacaaaaaattcacacatttgaaatgatcccttcaatacttccctcatcacttacaattttaataatttttttaaagttatgctgaatacctaaaatagatattattgtatattggcttacaaatttatatctaaaggaaaaaatgtagcaagtgaagaaattcaaccacctttttcagtcctttgtcagttcaaaattaccttcagaacccaaccaggacgtacctatgtatttgactccaacctgtctgataactaaaaaaaaaatgtcctagactccatgatgtaaaatttgctaggttaaattagaccagattttattttaagaattgcatgtaacattttctttttttaaattattcttaccttaatttttcctatctaatatttaatctgcattaattttgcttgtaaaattttcttgatggctaacattagttttttgttcttttgcctgtcattctcctcttacatgcagcgcaggacttgcccgtccagtagggcacccaagacccagcacgcgcgcccaacgtcattcgtccggtcgtcgcacgtcctttgcagccgctaattttcctccctcctattgggctgtgacatatatatatatctaaaagtctattttacctccctcttcttgggctgtggtatataaatagctaaaataagtctatttaaggtccctattctttggacaattacatttatatgtctattttagtccctatactttatgtgccgggcctagcctgccggcccatcgtgccgggccggccggtcgggccagcgtgccggtggggaggcccagacacggcccggcagtcgggccatgccgtgccgtgcttgggccgggccaaaaagccgtgccatgggccgggccttcgggcctcgggccttatggccatctataattgagagcgattttttttttctgtggaaatctaccaatccagaagcttatccacaaatcatcaatttaacatgcatcatatatggttcggcaccattcagattcgccagtggaaactgattctatgtacgcctactaacttcaaaatcttcttattttcataggcaacctgtccagctgttttcgataacagaggtacatggcgatgtggttatgtttgtagctttcttgggagttctgaacaaaccatttgtaacacattagcaggtgattacatggcttgttttcccacagaaattacagttttgttgttaaggggcaatacccgaattcttggaggatcattgtttccatttcatttcgttcaaaagaaatttgtttccatttcatcatctggtagactggtatgttcatagtgttagttagcatgaaaggttcggatcatgtgatcacgacctgacagcttgcatgcatgtagttgttgaggttagtttggattaggttagtctatccatgcggatcaggttagcctttcctccacatgcgataacagatgtttgttagagtttgttttctgttttctgttactgcatgcagtcgtttcatcaatctcggcttcggttgttctcagctgcgccgaactctgtatcgccacgatgggggctgttcccatcacatatatattaacacgaaggcgacgcacaggattagtgcgatcgtttccacccaaactaattcacatggtatcagagcgttgatcaattccctaatagatcaatactcatggcctcgtcgtccagtacggctgccacaaatccgttccaaggccacccaatctcagagaagcttgggaaggcaaatcatgcgctctggagaaaattgacatttagccattgtcaaaacggggtttcgctggaatgccactcccaaaaatggtttcgttaaaatgccaccctcaaacaggggcaacttgttgcaatgccattccatccatttcttctcagtttaatgttttttgtaatgtttttcttgttgagatgaccaaaatacccttatcctatctcatctctcctctctgtcttcctcctctccgttcggctcggcggcgcagctagagacggagacggcggcagcgtggccggagacggggaaggcggcagcgcgcttggggatggggaaggcggcggtgcggacggggacggtggcgacgcggatggggacgggaaggcggcgacatggctggggatggggacggc

SEQ ID NO: 31772 - DNA, 18328 bp, Oryza sativa
cgccagccgcaccggcaccgcccacctcatcgccgaccccatctccatcctcctcgacgacctcctcctcgagtgcctcgccggcgtcccctatgcctccctcccgcaactccccaccacttcaccacgcttgtcgcctccgtcgcgcgcacggcgagctccgctcctctctcctcgccctctccgtcacgcccacggcgagccgacggatgttggcgtggtggtggtgatgaggacgaggagccggcggccaccgactcgcagctacgccccgtcgccgccgctacgctccaccgccggcgactggatggggatcccctttcttctttcccctgcaaagtcaacaaaatgactaggggcaaatatgccagagaatgatggaaaacatttggaaatcagttaaaatggttgaaatggcattatagtaagttggcttcatttgacaatggtattataacgaagccatattcggaagtggcattccagcgaaaccccatcctgaagatggctaaatgtcaattttctctgcgctctggaaggtgcaagtaagcgccgcagtcagaggagcgcggcttcaggggcatctcaccggcgcaaccaagcggccgccggcagagatcgctgtcacaaaagatggcgccaccaagaaggagccgaacccagcccatgaagactgggaagccaccgaccagcaagttctggggtaccttctctcgtcgctgacaagagaggtgctgatgcaggtcgctacaggcgacaccgcggctgaagtgtggagcgccatcgagcagatgtactccgcccacacacgagcaagagcgattaacactcggtttgctctcaccaatacaaagaaaggtaacatgtcaactcctgagtattttgcaaaaatgaaatccttaggagatgagatggctactgccggaggtcgcccgatcgatgaagaggagctgattcagtatatcatcaccggccttggcgagggctacagcgaggtggtgtcggctgtctgcgctcgggttgaaccaatctctgtgagtgatctgtactctcaagtgttgaactttgaagctcgccaagccatctaccgcggcgcacaggaggtcaccgtcaatgttgccaaccgtggaggcttcagccacggggggcgtggcaacagcaatggtggccaaggaggttcgcgcggcggcggcgacggcggcggccatggtcgcggcaacggaggaggtggccgtggtcgaggccgcacaccaggaggcgttgataaaagaccaatctgccaagtgtgtttcaaacgggggcacacggcagcagattgttggtataggtacgacgaggattacgttcctgacgccaagcatgttgcagctgcagcggttaactcctatggagttgacacaaattggtacatcgacactggtgctacagatcatgtcacgggagagctggacaagctcactatgaaggaaaaatacaacggtggtgaacaaatccacacagcaagtggtgcaggtatggatattagtcatattggtcatgctattgttcataatcccaatagtcgtaatatccaccttagaaatgttttatatgtgcctcaagctaagaaaaatcttgtttcagtacatcgcttagttaatgataactctgcctttcttgaattacatcgtgattatttctttcttaaggatcaaatcaccaggaaaactctccttaagggaagatcatggcgcaggctatatcctctaccacactcctccttgaagcaagcctacagtgccatcaaactatctttggaccggtggcatcatcgtcttggtcatccttccattaccacggttaaacaagtagtcaataagtttagcctcccctgttcagatttgtctagtgagtcagtttgtaatgcttgtcaacaagcaaagagtcatcaattaccttttcctatttcttccagtgtttccaaacaccccttagaacttgtcttttctgatgtttggggacctgctccagagtctgttgggagaaaaaaatattatgttagttttattgatgattttagtaaatttacttggatttatctcatacagcataagtctcaagtgtttgacaagtttcaggagtttcaagtcatggtagaacgtcaatttgatagaaaaattctagccatgcaaactgactggggaggcgaatatcaatcccttaactcttttttttctaagattggcattgttcatcatgtttcctgtcctcatactcaccaacagaatgggtcggctgagagaaaacatcgtcatatagttgagatcggtttatctctcctatctcatgcatccatgccattaaagttttgggatgaagcctttcaggcggcaacttatcttattaaccgtgtgcctagcagagttatccataatattagtccccttgaaaaactgttcaaacaaaaacccgattactcctccttgagaatttttggttgtgcctgttggcctaatcttcgcccctacaataaccacaaattacaatttcgctctaagcgttgtgtttttcttgggtttagcactatgcataaagggttcaagtgtcttgaggtctctacaggacgcatctatatttctcgcgatgttgtctttgatgagaatatttgtcccttcactgaacttcatgccaatgctggtgcccgtcttcgttctgagattgatattctcactcctgaactgctaggacccatacggtctgttgggaatgaacatgcatgcatccagtgactaatccattatctgctgatgtttctgctgctttatctaatcgtgctaatgagccacatagagatggtgcagtacatcccgctgatgcagaagatccgccggcgacgcctcctctggatgccagttctggtccagaaccagaccgtgtcgtccaccactcccctgcggccacgtcatcaggccgtcatccgggtcccacacctggttctgtgccacggggggcagcatcatcgctagcagaggagacagcagaagactcagtgtcgcaggcggtgcaggagcaggagtcgcaggtggtgcaggagcaggagcagtcctcaccagcgcaggaacatgcacaggctgtcacagatgagactaatacattacagcatgcagatgtgactgacacaggttcagaggcaccggcaggaccgcgcaccaggttgcaaagtggagttcacaaagaaaaggtatatactgatggtactattaaatataagcattcttggtttactgcttcaggtgaacctacaaatgatttagaagccttaaaggataaaaattggaaactagcaatggattcagcgtatgatgctttagttaagaataaaacttggcatcttgttcctcctcagagagggagaaatattattggctgtaagtgggtgtataaaattaaaaggaaagctgatggtaccctagataggtataaggcaaggttagtagcaaaaggatttaaacagaggtatggtattgattatgaagatacctttagccctgttgttaaagctgccactatcagaataatattgtctttagcagtgtctaaaggttggagtcttagacagctagatgttcaaaatgcctttctgcatgggtacctagaagaagtttatatgctacagccaccaggttttgaggatcctactaagccacatcatgtgtgtaaacttgataaagctctgtatgagttaaaacaggcacctagagcctggttctctagactaagtaaaaagttgatggaccttggttttaaaggatcaaaagctgatacgtctctgttctttctgaataaaggtgatataactatgtttgttctggtatatgttgatgatatcattgtagccggctcttcagagagggccactgcagctttacttcaggatctaaaaggggaatttgcactcaaagatcttggtgagctgcattattttctcggaataaggtaagcaaggttcataatggcattgtactgaatcaagacaagtatgccaatgatttattgaagaaagtgggcatgatagattgtaaacctgctaatacacctctttcagtaagtgagaaactctctcttcatgaaggctcattgttagggcctgaagatgcaagtcactatcgcagtgttgttggtgctttgcaatatttgactcttactagacctgacatagctttctctgttaataaagtttgccaattcttgcatgctcccacaactgtacattggattgctgtgaaaaggattcttaggtacttaaagcaatgcactcggttaggacttgaaattcataagtcaggatctactttagttagtggcttctctgatgcagactgggcaggctgtttagatgacagaagatcaacaggaggatttgcaatatttctgggttcaaatctggtctcctggaatgctagaaaacaagccactgtgtctagatctagcacagagtcagaatacaaagctattgccaatgccactgcagaaataatgtgggtgcagactttacttgcagagttagagattaaaagtccaaaagctgctaaaatatggtgtgataatcttggagctaagtatttgtcagctaatccagtgtttcatgccagaacgaaacacatagaagttgactatcactttgtcagagaacgggtaagtcagaaacttctagaaattgattttgtttccactaatgatcaagttgcagatggattcactaaacctctgtcagtaagactcctggagaatttcaaaagcaatctgaacctggttaggtccggattgagagagggtgttagttagcatgaaaggttcggatcatgtgatcacgacctgacagcttgcatgcatgtagttgttgaggttagtttggattaggttagtctatccatgcggatcaggttagcctttcctccacatgcgataacagatgtttgttagagtttgttttctgttttctgttactgcatgcagtcgtttcatcaatctcggcttcggttgttctcagctgcgccgaactctgtatcgccacgatgggggctgttcccatcacatatatattaacacgaaggcgacgcacaggattagtgcgatcgtttccacccaaactaattcacacatagatctaagctaagcagttttaggtgagagcactatctattgtttatggtattggtaacatatgtacatgatcattaataagagaactagtaagagaactaggaaggtagcccgcgcatatgcgcgggcacttatttaatgttgcttaattttttattgttataaatgtttatatgtagattatattttcaaaatagatcttcactctatttaaaacatgttttagttattatctagttatgacatattacataaaaccatacagccttgaatttatgataatgacatgaatttataagaacaacatgtgtcacgataataaaacaataatagaataatggagttgtttcatatctatttgtactatatgtgatttttttacctaaataaagtgtttttttaattaccaccacggtaaaatctccaaaggaccatattgttggttatattttgataaatatctataattttgcgtctcgtgtttttcaacgcctattcttcataatcattcataatcacagaagacaccttgaccaattaatttggagaatgaatctattttcccaaacttatttataataactaattgattaaagtatacttctttgtcacatcaatagagtgcatgacatacattcatcgaattatgcctgatatgctggaattcctcaactataagaaaatatagagtgaacttcactgtgggctagtaatttttacccaagtttcattttggactaggggtggacaaatcttttcactttggaccaggtgattttacaaaaatttcaaactggactggccttcttctccatctctcttatggtttttttcttcatcgagatactgccatggattaaccggagcaagcacataactaggatttcttctctcggatccgttcctgagctcgaactcacgaaattaagtcactgggcagcttgttgctgcaactgtttcctgtgagatcacaatcatgtgattttttttcagctcacatgattttggtgggagaaaaagagcaaaaaaagaaaatcaaggtgctggttttttctttattgagatgctgccatggatcaacccaagcaatcacatgactagcattccttctctccgatccgttcctgagctcgaactcacaaaatcaagccatagggctgcttgctgctgcagctgtagcctgtaaactcacaatcaagtgattttttttttcagcccacatgattttggcgggagaaaaagagccaaaaagaaaatcaaggtgctaagtgatcaggatacattactggcgtgtttagttgtttgtgagctaaagaaatcaaggagtgagtggcagcacagtaggtcagaggcaaggaacaacaagaatggtccaatgtgcaatataaggtagcaaatcccggtccaaagtgaaaacatcaaacatagcctagtccaaagtgaaactttggcaataataagtggcctaaagtgcaattcactcgaaaatatatcgtgagtagtttattgcgtatgttacttgattgttcatttgttatcaaaactatttgacaaagagaaagacatacatatgggacaataaatctcatgatggactaaatggttgttttatagcaagatcactggcttgaaatatttttcataattattttttagatttatgtaatatttatgttgcccaattatcatatagttctgaaaattcaaaaaaaatgaaaatattaatctcaagaagtattctattaaatcatatctacttaaaaatacacaactaaattgtgttgttttcaattattttacatatgtagctttaaattagcattatatagtcatcaagtgttatttgacacctggaatatgatgtaaaattatttaaaataggaaaagcctagagccaagtcattatatagtttctcttgtagagaaactcatcacagctttagagccatccactccctggcagcttagagccaatcctaagcaaacactgaccttggcaggcagctccatcttggctggccggctgagatcaatcatcgatggaggtggccgttggtgcggcgagctggctcgtcggcaaggtggtgacgcagctgtccgatagcttggtggaggcctacgtggccagcaccgagcttggcctcaacatggagcagatcaagagcgatctcatgttcacgcaagggctgctccacgaggctcagatgaggagggacgtgagcaaccctggcctgcctgggcttttggagattctcagcaagaaggctgacgaggctgaggacacgctggatgagctccagtacttcatcatccaggaccaaattcatggcacccatgaggccaccccggtggtagacagcagcatacgtggccaggcactccatggccaccatgttcttcaccgtaccgttggtaactgcctttcatgcttttcttcttcttctacacgagatggtgccggtgaccatgttggcaagttgacattcaatcgagtagatatgtcaaagaaaatcaaatcaataatagaaggcatagatgccgcatgtaaccatgtatccaatttgctcaaaattatccatcctacagtaggaagggttctatcactgaagcgacctcccagcagctcaacaattacacagaatgaattatatgggcgggaagacatctttaaccagactcttgatgacatgtgcaccattcgtagtgaaacactatcagttcttcccatagttggccctggtggaatcggaaagactacctttgcccaacacctatacaaccacaaaaaaacagtggcgcacttctctaaaaacaaggcctgggtttgtgtgtctactaattttgatgtggttaggctcacccaggaaatcttgaggtggcatatgtcaaaatggaaatgagggaagtagtgaagcacataaaacatccaacttggatcagctccaaaaatccattgaagaaagactggatcctaaaagatttttacttgtcttggatgatatgtggaaatgcaacagtgaggctgaatggggaagtctactagctccattcaaaacaggagaagccaaaggaagtgtggttatcgtcacaactcgctttccatctatagcacaaatgataaaaacaaccaagccaatagaactgcaaggtctagaggatgatgaattcttgacattctttgaagaatgtatatttggtcaatacggcggtcggccttagagattggacaaaaggcatctgctcagaggctaaattgcaattccatatggcactcaatgtcatccaaagactcgacgtggcacaagagcacagagaactctcccccccccggaaacgcgactgagggcggctctcaagcggaaagtcctaggactcgcttctatagaaagggcaaggaaaaagcaagcctccagggtaactcacatccgtgaaggagatgcgaacacgaagttcttccacctcaaggttaatgcgcgaaggagaaggaatacaatccaaagattgaaaaaggacagtggttgggcggtgacgcacggtgaaaaggaatcgacgattcatgatcacttcgcaagcttcatggggaggccagggccgaggccaaacgagctaaactgggagacgttggacatcacaccgattgatctagccacgctgggggaacccttcactgaggaggaagtgcatagggcaattaaggaaatgccagccgacaaagcaccgggaccagacggcttcactggggccttcttcaaagtttgctgggaaatcatcaaggatgacattctgctagtcttcagctccatctataacctgagatgtgcgcacctgaatttgctcaactcagcaaacatcgtcctaatcccaaaaaaggatggggctgaaagcgtttcggactataggccaattagtctaattcatagcatcgccaagatcttcgctaagatgctagcgctgtggttaaggccccacatgcatgagttgatctcggtcaatcaaagcgctttcataaaggggagaagtattcatgacaactacctcttcgtaagaaacatgaccagaagataccaccgcctaagacgggcaatgttgctcttcaagttggatataacaaaagccttcgactctgtgcgatgggattacctcctagccttgctgcagcgcaagggcttctcgacaagatggatagactggctaggggctttactgtcgtcttcgacatcccaagtcctccttaatggctcgccagggcaacggatcaaacatggaagaggactacggcaaggggaccccctctcgccgcttctcttcatcttggcgattgatcctctacagcgtatcctttccaaggcaacagagctgggtgcaatttcaaaattacgaggaagaacaactcggctgcagatctcaatgtatgcggatgatgctgtgatcttcattaatcccacccggaacgatgttgcgactttcgcgaacatcctacatcgttttggcacagccacaggactcgtcaccaaccttcagaaatcccaggttgcggctataagatgcggcaatatagacctggaagaggtcctccaaggcgttccggcgaagcgggcaaatttcccactaaaatacttgggcctcccgcttgttctgggaaggctgcgaaaaacggacttgcaaccggtctttgacaaaatatcagggagagttgcaagttggagggggaaaaacatggcagtagccgggagaaccacgcttgtaaagtctgtgctttcagcgcagccaatttatctcctcactgccttgaaggtgacgaaggaatccctggagcagcttgacaagcagagacatcgcttcctttgggctggtacgggggatatcaccggggggaaatgcaaggtcaactgggcaaagacatgcttgccgaccagccaggggggccttggtgtcctaagcttggacaagttcacaagagctctgagattgcgatggttgtggaacgaatggagagatccaagcaagccttgggtgggtttggaaacgccttgtgatggtgtggatagggacctcttcgccgcctcaacaaagataactgtgggcgatgggaatacaacgcgcttctgggactccgcatggattaacggccaaagaccaaaagacctaatgccgttggtctatgagatctccaaaaataggaagaaatccctacggcaagggaaagaagacgactcctaggtgcatgacctgaccctcgatgcgggttcatctatcacaatcaaccttctcgatcagctagtccgcctgtgggaggcggtacggaatgtgcacttagacagcgaggagccggatcagattgtttggaaattcacaagcagcggccactatacagcttcctcggctaatcatgcccaatgtttgggggcgccaaacacaaacttcaactccctaatctggaaagtttgggcgccagggaaatgtaaatttcatgcctggctcatcattcaaaatagagtctggacgtcggaccgactcgcgacaaggggttggcggaataacggacattgccccctatgtcgttgtgacaccgagacagccttgcacctcgtcgccatgtgtagatacacgaagagaatctggcgcctcgttgctacatgggtgggatatcagcagttggaaccggcccaatgggaggaagcctggtcagtccatcagtggtgggagagcctagctaacacacccggcattccaaagaagggccttcggtcccttatcctgctagtagtttgggaaatttggaaggagcgaaatcggcgaatctttgatcacaaagagatggcaacaggtgttctcctagcaaaaatcaaagaggaggccagcttgtgggctttagctggggctaaaagattgcgcgagctcatcccgcactctgtatagtgtatagtctaaagatctttttgttttatccctaggggttgtattttctccttctatattcaatgaaaaagcactgctgtgctgttttttccgttcaaaaaaaatatatatatttggtcaagacaagcctgcatgttatgaagatgacttcattgatattgcaagaaaaatttccaagaaattgaagggttttccactagcagccaaaagcgttggtcgattattgaagaataacctttctcaggaaagttggatggaagttcttgaaagaaatgagtggaaaaatcggcaaggtgacgatgacataatgccagcactacatagtagctatgattatcttccattttatctaaaaaaaatgtttttcttgttgttccctttaccctaaggaccactggtttaataaattagagattactcattttttggaagcattaggcatcctatgttatggatgtcaaaataacaaagatgctgatataggattaaagtatttggatgaactggtaggtaatggttttctcatgaaggaaggtgatgatagtaggccatattatgtaatgcatgacttattacatgatctagcacaaaatatttcgtcacaagagtgcatcaacataagttcatatagttttaggtctaatagcatcccgcaatctattagacatgtatccatcaccttacaagataagtatgaggaaagttttgagagagaaatagaaaaattcaagaaaaaaatagacataggaaatttacagacattgatgctttttggagaaagcaatgcaagcatggcctttttcaaagacttattaaaacaaacaaaatgtcttcgtgttctgtttatgcatgcagactcactcgaatcattcccacacaacttctcgaaactgatccaccttcgatatctaaagttgaaaataccttataacgtaaaattgtctctaccaaacgcagtaagtagattttatcacttgaaacttttggacctagggaatagaaattgtattttgccaaaagacattaatcatctagtcaatttatgcctctttcttgcttcgaaagaactttgttccaacattcctgggattggcaagatgaagtatttgcggaggttggaagagtaccatgttaagaaagagggtattgggtttgagctgagtgagctaggggatttgacagagcttggaggtgaactgaaaatatttaatcttgagaacgtgacaacaagggaagaagctaatgaagccaagttgatgatcaaaacaaatctgaaaacattgaagctagtttggagtgtggtgcaacggacaacacgatctgatgttcttgacggtctccaaccacctcctaatcttaaaacacttgtcataataaaccatggtggttcggttggtcctagttggttgtgcagttatatttgtgtaaaatacttgaaatcattccatctagagggtgtctgttggggcaatctcccactttttggtcaactggtgcagctagaggaacttactttgaagagtatttcaggcatacatcagttcggacctgattttggtggtgtaacacaaaaaagtatctcgcacttgaagaaagttgaacttattaatatgccagaccttgtggagtgggttgggggagctcattgccatttgttttcgaagattacaagcatcaagtgtgaaaatctatctatcttctatctatctatctatctattatctattatatactaaaagtccattaaacttactataaacgctcccaagccgccacttggcgctctaataaattagagaaatctaagaaattctaagaaaaaagcaaaacatctgatcctcgattttcacttaatacagcgggcccattattttacaccattagatccatattaaacaaaataaaccccatctcccaaaaatcctctcccgctcccctcatgggcctccactcctcacataaacagtacgtacatgtactaacgttcctccctcgcatcctctcttttctccattccattcatcttctatttttttagataataaatttattatataaaaataattagataactaaataattatatttatttgcaacatattatatttatctatattagccatgtgttttgatatatgagaaatacatcatttgacaaaaactcctacaaatagcaaaaattaataacatatactatcatgtgatcgcaaataatttcatgtcctctttgcttgctcaccttggcctccttaatttctagctagcaaataataaatatccattaaattaaacatcgtgtatcataatatatctatctattatatactaaaagtccactaaacttcctacaaacgctctcaagccgtcatgtggcactcctacatacactcctaagccgccacatgtcatatctctaaagattctacaaattttgaatacaaagaaaatatccgaccgtcaattttcacttaaatcagtgacccattattgccaaaaaaaaggctgaacgctattcatcgggaaaaaagccaaaaagaacgaacatatatgtacgctcacctcaagtaatgaaaaaacacagaaaaatagcataccatccctcgcctgatcttataaaaacattagactattacaattaaatttaagagatgtaaaacaactaaaactgatatttaaaaatcatcgacggttacgaaattatgatatgttactataaatttaccattagatttataacaaaactacaagaaaaactaattccatttatttatttcatcataaaaattataacaaaactaataatatcgattatatcatcatatataacttcataaacatggataacaaaaattatatctatgattattcgaagtaaatatttcattcattatgaaactgtgataagttacaataacattagagtcatgataaaattatcagattgtcatataaactactttcatgtattcatatttttaagtttattgtgaatatactaatttcatgtattcatatttttaatttttattgtgaatatattgcaagaaagaccagatacaaagctcttactatggtacaacctacacagtttatacgtggataacttaaaggtatcaagcatatgtcccgttaatcttgaatgtgtccgacccacttacaaattcttatccaccaaacatcgagctacaattgctaacaaggtatttgtgcatcatatcatatcaaatatctaatatatgatgaacatgtgtaccattagacgcatatagagataaaggacattttataagggacatttgctcatttaacccttttctaaagcttaactaccaatttgatccttttttaaaacaaggtttgctcatttgaccatgtttttcaacatcgaagttgtcgtctgaccctactttcactacatcctgagtttttcatttagaagaaaagaaaaacatgtatttacaagcccaaatgactaaaatgacactgaatacatcaaccttatcctcaagcactcatttgctcattccttatccccccgtctctctctctctctctctctctctcttcaaagcgcgaagggcaggaggagcggtggcggcagcacgacagcagctgcggagtgcccccggctgcttcgcggagggtaggatcggtggcagagaggcaacattgactcgccgacgaggagggccgctggcagtggtcgaagagacggtgacaactcggcagaggggaggcagcagctccatgaagggtaggaggggtggcgtcggctcagtgacgaggaggactgccgacgatggcgaatgggaggcggtggctgtggaggggtggcagcaaccacagatatggtaggaggagcggaggcagagggatggtgtcggctcagtgatgaggaggataggcggtgacggtgaaggggcggcggcacggtgacgaggaggaccattggcgcccacgcacatctccgccattagcttgctaataaggtcaaataagtaagggtagaagtggtatttggggcttttgttaactccgattaatgctcttaagagaagaaggtcagagtgtagcttcggttttgaaaagaagggtcaaatgagcaaagtgaccaaaacatggtcaaatcggtagttagatatgcaaatagggtcaaatgtgcaattgctccattttatattatagattatatcattttgtatcattttataaacatacaaagccaaagacacgggtgatttacttaatctatctaaaaaaacatgtctacggtaataagaatcatagatactgaaaagacagaaaaactcaagagcatataccctaataatacctaatagtaaataaaaattatcaatggctaatccctaggacatataaaattataaagtattattttactagtttattaaatgccctaaagaaccctcctacaacgtctattaaagcctttaacaaataagaggaaactttaaatttcttctgtaatagataaagcatctaaaccttattcctcattaatttaatgctcccattaattttggccattgggccatttcaatgggtatatgtatacacacattatttaataaaaaaacattcatccaagcatgttttctaacaaaaaattatttgagatgtcaggtgaggttgtaatgacctgttgcatggtttagagggttgttgtcaggatgactagcattgagttttactaggttgccagccatccaatgcatcacaaaaagagcccatataggagatatttgtgttttgttgatcgagccaccatcaagagaagccaacatgggaaccccagtacaaatattttttatgactaaatcttctcttaactcaagtatctatgtaatattatttaagtcgtgttggcttgaagcatgcataatttgataacatggtatatctagaaggctacatgttagaacattcaattaacccatcttggaaataataatacttagcaagaaatcaaacaggtaacaaatttctatctttaattttgatatttaattttaatcattggaaagggggagatagagtgaatggttcaaacagttatgttaatattgtccaatttgcaagctaaatgtttttttaaaaaaaagagatatagcgggttgattctgaagtattatcgtactattcaagagtagaggaagtagtaatcgtatccaaaatacatacaaagaaccatcatacataattttagcattcagagaaatagagatgcacgcgcaacgcgcgggctatcttcctagttgtcctaatttctcttcgttgctgcggccatcctcggagtgctctgtctctcatatacaagacataaacaccacatggtttcccaacttgtgtgatcttgacattcggagttgccccaagttgtccctgccccccatgcctcatacttccacgctgacacgtgttagtgtgagaaaaggtgatgaaacactcttgtattttcgggaagaagagctgacagcataccattatgatggtgctttggcactccacaacctgggtaaagtaaaagctatggaaattgtagatatgctgcattttccattggctgacctccaaaatctaaactgcctaacacgacattctttcgaggattgcgataacattgacaatactgttgttctccattcagttcagtcgctctatctcgatgattgtcatcttactggaaaatcattgacaatggtattaagcatttttccggctcttacctacttcaatttgagaatgtttggtgaaaatcatgacatagaggaaatagtgctgcaggccccaataacctgctcattgtgccatatgtcgatatcctccagcaagaacctagttctgccagttgaggacggaggaggtctgcaggaactctcctcactccagtcactcaggatttcagattgtggcagaatgttctctcgatggtgcatggtcgatgcaggagctcgtaccagcaagcccctcccttcttccctcagggagctcagtatttgtagagagtcaagcatgcagtcgatggctctgctctcaaacctcacatctctcacacatcttacactattggaatgtgaagacttaacagtagatggatttgatcctctcattacactcaacctcaaggaattggtggttttaaataattgttatgagaacaattattcttgttccatagcagcagatttgctctcagaaatgacaaggaccaaagtattatctgcaggttccttacaactggaagcacttaaggtggacaatatctcaggagtgcttgttccctccatttgcagcctccttgccgccaacctccacaagttaattttcaaatctgacttgcagatggaaagcttcgatgaagaacaagagcatgcgcttcagctcctcacctccctcaagcaactatattttgccgactgcccaagtctgctttccctccccgatgggttgcatcacatttcttctctccagaaattgcacatatataattgtcctaaaattggattcctacccaaggagggcttcccctcttcattgagagatctagtgttatcagagtgtagcgtcgatctacaagatcaattgaagaaattggagacatcaaacccagatttatttgtacaccacatgaggtaaaaaggaaagaaaaagaagtgttctctcaactactacttatttcagcatccatctgtaaccttcaatactaaactaaaactgctctgctttgtttcctactttgctgtgaaggatgggccgaatcagtctggagatatagcggactatctgcatccgcatgcgagtaacacaatagcacatgcgggccaaaggatcgatcggttcttccctctgcaacaatctggaaggttcttgaaaaaccaactttttttaattttatgtggtcgggaatttatgatctcctttttttagtgcatgcaagcgaccactctgttattcgcccatgtagttcattgcttccttcacctaaccaatgttatattaactgtcagacagttttggtaaccttggctagagactcagcatggtgataatgcatgcagcaggctgatagctatgcggtaaatttgagacgcgccttgccctggtctgacctctacaacatcagttacacctaggtggtcagtaacctctcctcaactcatctcgtctctctctctctctcttgatctctccaaaatagggaagttacaggatatgtcctttaaaactactccctcagtcccgaaat

SEQ ID NO: 31773 - DNA, 3734 bp, Oryza sativa
catcattgctttaaataaagacagatgatgatcaaaagatcaccacagttgacatgagttctgtggagcatcgattccatttcatcatctggtatgttcatctatgtaagcagttttagatgacagcatcaggcccaaatacgaattatacccttacatactcttttgtccttgctctaagtagaaatttaacaaatagtatattatgattgaaacaaatgagtttatatgttttacagcccatctaaacttttcattgagactggtcccaccaactccaaacaacatagaccacacagctctactagactactaataaactggcaatggattctggtgttggtaacagaggcatatatggtctttcttctttttttttaattgaaaggtgcatatggtcatcgataggagaatcattttgagcttattagtttgttaagtcccatttaatcattcattatggaatgctaaaccgattgcacataatactgatataactggaatgacataatatttcttgactactagataataccccgcgcgttgctgcggacataataaataactttcaaacatgcaatatgtgcataacatttgagaagaaaaaagaaaaaactacttattaccatataattgatggagtatatacagtggtaattataactaaatattacatgatggagtatctccccaggtagcagtggttggccaatgcaactaacagaattacaactcaaatatatggctgttgaccggatagagcaagtattaataaacaaaattgaaggccactaaacattactggaaaatgaaaaatatacaccaataaaattacccaaaattatgtactatgtgtttatgaacatagcatgtatgaaaaataacagtagaaaagcaagtaaggtgtcatactgttgtcctcgttaacttgatagcctttattcagcatgacatttttcctagtaccgcttccctcgctgacccattgatctcagttttggaaattctgtagttaatcttgcaaatgaatgccaattgattcatgaataaggtgctagaatatcataaataattgtggtaagaaatgtttatttaactggaagtagcaattattatgcatatcttatcgtataaatatgcgatgaacattaggagcgcatttgtagttgcatagctgatcaggaatgtagtcaaggcatgtagcaaacctaggtgatgagtgatgactactttacaattacaaaactgataataaccataactgaaacatcaatattttatatgtttaaacatctacaaatatagtccaattatcactgatagcaaggaaatcataactaaggtgtcaaactattatataataatggtagaaaattttcatgcttgagtaagatatgggaagttgggaaaaggattattacctcgtatatataattaagtactcatccttgattaactctttggagtgattttagctttcagaaaactccaaaaatatttatatcaccaagctaattcaagagtgacaaaagatacttaaaaacatatctagagtatacatgatcagaaaataaaatgaactttgagacggaagacaacctaatctatttaagagcaaacctgtgtgtctgtgtgtggagaatctgacatcattcttgatgaggaccttatcaaaagtgaaaagcacatcaacgacatagatgtaccgagatatatatagcttcaccagttaaagaccataattaaaataccaaaagaagaaagctccatccgcttagcagcccatatgattgttacttagctcgatgagttcttagatctgatcgggtgacgacaaatcaaccaatagatgcatatttgccacgtcttcaaccacttaagaatgagaagtggtctataattcaggataaataaagaatatgaatcaactaaatcagtagccaagaacctgaaacctggaaaaagaggatacagcaacaataaaattctctgttgggtatcagatttattgaacataaggaaaggggaaatcggtaggtaacctgtgttagatcattgaagtaattggagaggatcgaccaggtgagggctgcatatgaatccagcaagcagagttgcaagaacggtagtaaaacgccagcagcctggtagagtgtggtagatcgacgaataagcgagatgataaattggatatagatgcagaactgataaagggataagaggagaagaaaacgcattaagccattaatggatttacttgataacagccgtgaagtgttttcctcggtggtgtcgacggttttcattaatcatggcaacctaaaggggcgaacaacctttagacatgggagaggaagggggaagcagcgcacgagccgccatgggggcgcgggaggggaagcgccacaccctcatcctgcctccgtgtggcacgggaggcggatgacatgccagcgccggtacgggcgagcacgatgcgggagatggagaggatcacggcgagattgatacgaagggggcggcggagcgagatgcaggagagggaatcgatgcgagcgtgcaaggggagaggagaggagcgatgcgggagagaggggttgatgcgcgtggggccggtgaagcagcgagatgtgggagaggagaggagcgatgcgaccgcttgattgagatcgaacggtggggagaaaatggggtgacgtgaagcaccaggaagcagagaattctagtagtgggaatgatttgtataggtatataggattcctgctaggggaaggtaataaacctgtgattccaaccacacaataatcttaattatctagactacagacactggtggagaaaccctttgtagtcccggttcgtaacccccctttagtcccggtttccaaaccgggagtaccaatccgggactaaagatcgctatctttagtcccgggtgaaataaccgggagtaaagatcgatctttagtcccggttggtaacaccaaccgggactaaagatcgagctgacctttttttttttgcatgcccctgttgctgcatggtttatatatatatatatatatataaaccatgcatatatatgtttcaatacatatatatgcatacatatatatatgtatatatatatatatatatatatatataatattatattatatgtatatacatgcataatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaatta

SEQ ID NO: 31774 - DNA, 2326 bp, Oryza sativa
tgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctaaaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgtgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagtgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgatcttggcggcgtcaactttcgccttctttgttgcccttgtgtgggcaagcggtggagctgggggggcccttgactttgaaggtgccggaagaggagcttgcgggggagtaggtgtaggagcacgaggaggagtcggtgcaggatcctgaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttggagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttcaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcaggggagtgtcagctcgtccctatctctgtctggtcggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccaat

SEQ ID NO: 31775 - DNA, 1934 bp, Oryza sativa
ccagtgatcccttagctttgggaatgtgtcgaagttcggtgtctgccccttcagtatatacttctggtacagatctcccttgaagctctgaaattgttctccatttttttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctagttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcatgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaatactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattcctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagataaaaaaaatgtattaggataaatgcgaagtaacatatatatatatatatatatacatgtatatatatatatatatatattgcatttcacgttaacgttcgtccttgttagttcgctcgttcacgttccctagctcgttcacgttcgttcgatcgttctcgctctcgttcgttcgatcgttctcgttctcgttcgttaacggcggtgtggcggcatcggggcggcggttggcgcggcggcgtggcgacggcggcggcggcgtggcgttgtggggccgtggcggcggcggcgtggcgtggcggcggtggcgtggcgtggcgtggcggcggcggcgtggcgtggcggcggcggcattgcgcgcgcggcggcgaaggcggcggcggcgtggcgacggcggcggcggcgtggcgttggcatgcggcggcggcgttgcgcggcgtcgaaggcggcggcgtcgaaggcgacggagagagatcgagatcggagagatcgagatgcatgaagggagatgcggcggctctcacccca

SEQ ID NO: 31776 - DNA, 8666 bp, Oryza sativa
attggtaaaaactctaattaagatattaatgtacatactgcatgatttaaaattaataaaaattgtaatcatcatatgtacttagcgtaggaattatattaaattaaatactaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactaacatatacatgatttaaacttgttgacgctcttcagcgtgccatcgcaacattctagcattccccttgttcctgaacaaacgccttagccgtggtattatagggaaataccacatcaccttagcaggaattctcttctttgttagctgtcacatcctgattttcgtttcaggatttataaattatttaataaattaataatagaatttatattaaatgttcattaatttacatgtgaagttaaatgtgggaaataaaatttcctaaatataaagcatggatggatttaattttttattaaattctccatgattaagtcaactctctggaatattctcggatttttcggagctcaattcctaatttttaatcttacaaagagcatttcagtaattacccacatattaaattaatcattaaatggtctaattataattttgttaagtactttgagtgtccaagtattttcaagatttttcttggaattatttgagcataggaagtatttttcacaattcaaagatcatttcagtgattaatttaattggaaaagtatttaaaatccccttctccttttcgggccgaaataggaaaagttcagcttctatcctcggcccattctcccttcctttcggctggccttatccctcctccaaagtctgctttgtgtccctttttcaatcgggccaagaagtagaagcccagcaaaaagtctagtttgcctccctgctacagtgtcatcttcaatctccagccggctggagacagagcccgagccagccgcacagtacctgtatagccgcggttttcccctccaaatctgacctttccccttgtgtttttctaaaattagttgaggggaaatattcctcttatcctcctctatctttacctccaaaaatcggagcaaatcgttgagtatcttatccgaatcaaactcgttttcgagtttatctccaaaaccgagtttttgatttcccggatcgatttcttgcgggaggagtccgatctcttcaatccaaggctataaataggaccccctagtcctcctctttcgtttgccccctctcccgtggtctcccgtgcctcgtagcgccgccgccacgtgctccaccccgccgtcgtcgccggccgagctccatccgcgtcgcgccgtcgcctccgtcgtcgccgccggtcgccgtcaccgccgtaaggtgcgccgaggtgtggagaagcccggccgctctctccccgctgtcgccggtcaccggagccccgtcgccgccgtcgaccgaagccgtgccgccgctagacctcgtcgccggccgtcgtcgttcgtcgtttggttcgagggtgagtaccgttgggttcgtctcgtcgtcctctacgtgttcatgtcctccaaagtcgcagccgaccatccaatctccggcgaggtcgccatcttggtccggccattgatgaggtcatcatgacgtcatcatcgtttttctttttcctgtttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgagtgcgccggaagtattcgagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacctattcctttgttatggccagtttgcattgattaccctattccttgataccttgggttattataacttgactagttgggctttatatattggttcagctagatattagttatgattgcttagccatgcttagaaacattagcacactattgggataacttatgactcactattatttaaggatggcttaatgatagttcacgatggtcaatcgtgattggttaattaattacttgccaactaaaacttgataatggtgggttgtgagcacatggttttgagagtcgtgctcatgacaattaaggaccggttcgcgagttactgttgtgaaacatttatcgtgccaaccacaagccagcgtgggcaacggctttatcttttgtatagcgtgattcattatagtgcgccagactgagaagtggcgagaagtccacgggggtcgctggggagtccatgccttgtttataaaggggtgattatgatccaggaaaggtgcgctgtaatggattatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacaataattatggatgttatacttggtaataatttgcttagctcctggtttggagttagatctgtacagccgggtatggttgttcaggatggttgggcctgtgcagcatgggtgtgctgttcagtgttgattaaaatttttaattaattactctactgttttactactcttaactctttgctaaatgctgctttcgcaaatgagcctatattatgccatcctttggtatccttgtgcacttgcatatttgctgtgtggcttgttgagtatgtcatatgctcattcttgcaataatcaatcaaacctcagttgaagataaaggatccagaaggagaagacgtttggcttataccccagttgagctgcctgtgggagtggagctgaagccatcgctagaccgttaattccgctgctgttttcttttcttttgtaagtatgtaacgttattattatgatggatttgtatattaaattgtcagtttgtgtacctcggctgattcctggacgaggattttatgcacaaataagttcggaaattactagtgaatttccgggcgtgacattagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatagacaacaaataaaacccctttgcctgttagcttcggccactctcaaaaaatagtgcacgccgtcaataaactctttggaccgccggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaatttttattttagtttgttttctattatttaatattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatcattagtcccggttggtattaccaaccggggctaaagttaagatctttagtctcggttggtgctaaagatcccgggggggcctgacaggtcctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtgagagtacaaactgcatatgcagataatactgatgtacgatggattgatggctcagtactagcctacgaaggaacttatgatctagcagatgtttttcgtcctaactcaatgcaaatgttatatctggagtttaccatgcattagcctcgtacttttttttttctttccaggtgacttccaggacaaaattggtgttccatccaacgacagcgtgtaacgcaacctgcactatctgtctccatatcttgaaagaggcaaagagctgcttcttcgttccgggcattccccctgctgttcctactgaagatcacaaaagagatagccggcggtggcgatggtggtggcggaaattgagagccgcggcctgaatgcggggccggcggtggcagacaagcggaggcggcggaaaatgctcgtcaacctggtccgctgggagacgagcagtttccgcgcgtggggttcggctggcgggcgacggcgctctgctctgggtggtggcacactggagagatgaaacatctagagggaaaatggaaagagggggagaaatttgttttgttgccaaaagaaaacaaatttcttcgagtacatattatatatacagtatatcaaatggctctgatttcttcttgtcttggaaattacagcctaacttattagcttagaaggacgcgactataccgagaccggtatcacgatagggctatcgcgcgacgcgcgcatctggcgattccgcaccgcgcgcgcgccccatgccaaaaacggtaaccacctttttcccgggcccccgcgcgtgccatcgctaaaaaaggaaagcacgcgcttgcgcgcgcaagcgccgtgcgatgcacgcctcgctagctggcgtgggccccacctaaaacagcgcgatgcgcctctctccctcactccaacccatccggagacatcaatccacacacagccgccacggtggtaaaaatcagaaaaaaatcgccatcttggaagaggagaaggaggagaagcaaatccaagaaaaaatatccaagtaaagtacacatgaagttcaaattctgtcttctgtgagatccatccacaaaaaaaaactaacctagaaacttttagatcttctctgtattcttcgacaaacaaattgatatgaatctgtgctgtaattttgtgagtaattttgtgagtaatgagctgtagtcttgttttctgtcttccttcttgatttctgtcttcctttataccccaaattcacattctagtgctactcttgatttctgtcttcctttataccccaaattcactttctagtgctgctgagaaaaaaagttgtagagaaggcatgagtactggtgtttcaaaaaactcagagcaatttctaggaacatgcaacttacttccagataaacttgaattcacaatccctagtttacagtttagacagcatgaaaacatcccatctagttacctctcagtgcaatatgaacagaaaagttactttacttcccaaaataaatttgaatttgcattccctagttacataggcatgagtgctggtgttggaaatctcatagcaattttaacagaagtctcagtgcatttttaacagaaaagttacttctaacacttcaatgagttacttccaagaaacattaagttacttctcaccgtgcattaagttacttctcactgtgcattaggttctcatagcaattttaacagtctcagtgcagttttaacagaaagttacttgtaacaattcaattagttacttcctagaaacatggaagttacttccctataaacttgaatttacatttcctagttacacattttgtaccttgtgtctatatacagcatgatgcatcacctagttgcgtctcaatttcatcttgtactgcatcaaaacaaattgtgaaaaaaaaattcattaatatagccactggtcttaatttgagaaaattgcttcctagaaagcatctaaaaaagacatgctgcaaaaactaaaagttacttcttcccccctcccccccaaattactgaattacctcaatgaatgctctgtataaactaactttgttactaatagcctgaaacacatgcagcaaaaatggactttgacctcaacagtatcccggaattagtttctggtgaaaatgaacctccagtacaccatttactagttgatgatgaagacagaaatgaaacatacttccctataaatctgactgacactagcatggagattcctgctataaatttggacgacacttttgactttgaaactatgtatactactggtgatgctggaagtttacaagcacacaatgtagccaatgatgagatgcaagtatttgaagccaatgatgagatgcaaatatttgaaggcgatgatgagatgcaagtatttgaagaaatgtcagatcgtgcagacacaatgcatactagtgttgcaactggcgcaacaactgctactgccaacacaatttcaagtgaagacactggaacagatgattcagaagcacagtcagcgccatcacaggatattccgtgcagcacacaagtgccgtacctcaccttgactttcaactcagaggaggaagcaagggctcactacaacaggtacgcaaagcgcgttggattttcaatcaaaatcaacacttcaaggaagtcagccaaagatggagaacgtgacaaagtaatgtttgtttgcaacaaatgtggtccagaagaaaaaacgggtgaagcgtgccccccaaagaaaatgaaaagaagtagaacaagacaggctgcctgcaaagcaaggatgacagtgaagaggaaaggagctaggtgggaagtaattcagtttgttgaagaacacacacatcctctggttagaaagttttcactcaagaaattcctaaggtcacatagagcaataccgaaagaggaaaaagatttcatcacaatgctgcacggagttaatctctcagctggtacaattattgtcacgaccggaaataacccaacgggcgttccttacgtgcgtgtattattccttgtccaaggaggcaaggtacaccaaaagttgatacaattcagagtttaacaagcggaagcgtaaatagttaattattacatgggcagcgatggcccaacacactcaaagacaatgaaaaacagcggaagactaaggcgacgaccacaggcgcttgacggcaggcacgagctagacaccaaagccttcatcatccaggggctcctcttctgggtttgggaaaaattgagcaagactgagtacaaccaccgtactcaacaagacacacccacaagtgcagcataaatgcaaaggagtacaatggagttatagtataggggttaggttttgcaataaacagc

SEQ ID NO: 31777 - DNA, 2720 bp, Oryza sativa
gtctttattgatgatattcttatctactctcgaaccaaagaagagcatgaggaacatcttcgccttgcattggagaagctacgagaacatcaactgtatgccaagtttagcaagtgtgaattttggttgtctgaagtgaaattccttggtcacgtcatctcagcaggaggagttgccgtcgatcctagtaatgtggaatccgtaaccaattggaagcaaccaaagacagtttcagagattcgcagtttcttaggcctcgcaggatattatcggaggtttatagagaatttttccaagattgctaagcccatgacacgattgcttcagaaacatgtgaagtacaagtggtcagaagaatgtgagcagagttttcaagagttgaagaatcgcttaatatcagctcctattttgattttgcctgatccaaagaagggtttccaagtgtattgtgatgcatccaaacttgggttaggttgtgttttgatgcaagaagggaaggtggttgcctatgcatctcgtcagttacgtccgcatgagaagaactaccctactcatgatcttgagttagctgcagtagttcatgcattgaagatttggcgtcattatcttttcggtactcgtacagaagtgtacaccgatcacaagagtttaaagtatatctttactcagccagatctgaacatgagacaacggagatggttggaattaattaaggattatgacatgggaattcattatcacccgggaaaggctaatgttgtagcagatgctcttagcaggaaaagttattgcaatgctacagaaggacgacagttgccattggaattatgcaaggaatttgaaagattaaatttgggaattgtcagtagaggtttcgttgcagccttagaagcgaagcccactctaattgatcaagtaagagaagcccaaattaatgatcctgatattcaagagatcaagaagaatatgagaagaggaaaagctatcggtttcttggaggatgagcaaggaactgtatggttaggtgaaagaatctgtgtccccgacaacaaagatttaaaggatgcaattctgaaagaagctcatgatactttatactccattcaccctggtagtactaagatgtaccaggatctcaaggaaagattttggtgggcaagtatgaagcgtgaaatcgcagaatacgtagcagtatgtgatgtttgtcagcgagtcaaggcagaacatcagaaacctgccggtttgttgcagcctttgaagattcctgaatggaaatgggaagaaatcggtatggattttatcactggtttacccagaacgtcatcaggccatgactctatttgggtgatagtcgacagacttaccaaagtggctcatttcattccggtaaagacaacctattctggaagtcgattggcgaattgtatatggccaggattgtgtgtttgcatggcgtccctaagaagatagtgtctgatcgaggcagtcagtttacttcaaatttttggaagaaacttcacgaagagatgggttctaagctgaactttagcactgcttatcatccgcagacagacggacaaaccgaaagggtgaatcagattttggaagacatgttgagagcttgtgctttagacttcggtggaagttgggataagaatctaccctatgcagaattttcgtacaacaacagttatcaagctagtctacagatggctccttacgaagcgctgtatggtcggaagtgccgcactccgcttttgtgggatcaaacgggagaacgtcaggtttttgggacggatatcctaagggaagcagaagaaaaggtaaagatcattcaagaaagattgcgagtggctcagtctcgacataagagttatgccgacaatcgccgtagagatttgagttttgaagaaggagactatgtgtatcttcgtgtcacgcctcttcgaggagttcatcgttttcacaccaaaggaaaattggcaccgcgttttgtgggaccttataagattgtcagtagaagaggagaggtcgcttatcagttggagttacctcaatctttggcaggagtccataatgtgttccatgtttcgcaattgaaaaagtgtttaagggtacctaccgaagaagctaatcttgatcagatagaagtccaagaggatctgacctatgttgagaaaccaatccgtatcttggaaacaaatgagagaagaaccaggaatcgagttatccgtttttgcaaagtccaatggagtaatcactcggaagaagagtccacttgggaacgagaagatgaattgaagtcagctcatccgcatctgttcgccagttcttccgaatctcgaggacgagattctgtttaaggggggtaggtttgtcacaccctgaaaattttaaaatttataaattgttgtttaaatggaatttctagaaataatttaaagtcttgaagagaagatcttgttttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaagtctcttttggctttgggccgaaagtcggcccaaatcttttttttttctcctcggcccagccggccagtccgccgggcgcgcgcgcc

SEQ ID NO: 31778 - DNA, 9426 bp, Oryza sativa
gcggcaggcggcgacggcgacggctcggggcgcgaggcgcgcatggcagggaaggggaaggggctaggggacacggtcgagcacgtggcggccgatgaacagtgcactttcctatttttctcattttagtctattacttttataaatttgattccacaattcctaatttttgcataaatgaagtttactccatatttgtgttatcctaactaaaaaaattcaccctaatttaatatcactcatattttgtttatataatttatttaaatttttaattagggttaattctcatttcatcatactaaaatttaattattgctaatatggttgcgataatattttatttattttccaatcccacctaatctttattttaatttatattttaattatttatttagccaacttgatttttagggtttattcctagttagttattcattattcgcgattaataaattccgagatcaaaatccaatgaaacaggcgaataaaatcatgatgcaatttattacttaaaatgttttgaaactccgtatttttggtgttttgattttgttggtcgaattttcagggtgttacagaacgcatacccgattcccgttccatagggttccgtgttcatcctctgtgaaaccagcggctttaccctgtttcatgttcttgaggagcccatgcatatccggatcattcttctgagcctcgcggatttgatcgagcaaggtaggcttggcttccaacgtagccaagaatccacgaccaactatgcttaggttcaggcttccaactgttgattaagttccggtggaatgccacggacgccaagagtgttgcaatggctttttcgacttagagcgtcggcgactacgttggccttgccaagatgatagtggatccccacatcataatccttgatgagttctaaccatctcctctgcccaagattcagatccgactgagtgaagatgtatttcaaactcttatgatcagtatatatttcacagcgattcccaatgagatagtgccgccagatctttaaagcatgaaccacagcggtcaattccaaatcatgggtagggtagttgccttcatgaggccgtagctggcgtgaggcataggctaccacatgaccttcctgcattaatacgcaccccaatccttggcgcgaagcgtcacagtacaccaggaagtccttgcgagtatccggtaagattaacactggcgaggaaaccagcttttctttgagagtttggaatgctttctcacactgcggactccacacaaatttttcttctttcttcaacaactgtgtcatgggtcgagcgattttggagaagttctcgatgaacctccgatagtacccggccaaacccaaaaagctgcggacttgagtgatcgtcttgggttgcttccaatcggtgacggcggtcaccgtttcggggtccacagcaactcctttagcagatatcacgtgccctaagaacttgacttcggacaaccagaactcacacttgctaagcttggcatacagttgatgttcccgcagctttcccaacaccagacggagatgctgctaatggtcttcctctgattgtgagtacaccaggatgtcgtcgatgaagaccacaacaaacttatccaagtattccatgaacactttgttcattaagttcatgaagaaggcaggagcattggtcagaccgaacgacatcaccgtgaattcatacagcccatatcgcgtggtgaatgcggtcttcgggatatcttcttcacgaatacgcaattggtgatatccggagcgaagatcgattttagaaaagatggtggcacctttgagctggtcgaacagatcatcgatccgaggaagagggtacttgttttcgatagtgacttcattgagagctctgtagtcaacacacatcctcttcgtcttatccttcttctccacaaaaatcacgggagcaccctagggggaagtgctcggccgtatataccccttttccttcagctcttccaattgcttcttgacttcggcaagttcatttgctgccatacggtagggccgtttgtacagaggagttgttcttggagcaagatctatccggaactcgatctcccgcttgggcggcataccgggtagttcttccggaaacacgtcaccgaactcactgacgatggggatttctgacaatcctatctgatgaagttctgaactgccaacagaggttgggggtgcaaagaacacaactggttgttccggccctcggtacagagtgacagtgcgccttgcgcaatccactaccccttggaattgagccaaccaattcatcccaaggatcacatccaagttcttggtgtccagaagaatcaaatccgaggggaaagggattccctggatttctataggaacggccgggctgtaatactttgctgtcatatcccctccaggggtggtgatgagcagagggttcctaagccgttctacccccagttgatttcttcccacgaaaggcacagatataaacgagtgggaagctccagagtcgaacaaaatggtagcaggaatggaatgaatgaggaacgtaccaacgatgacgtccggagttgtcagcacatcctcggcagtcacgtggttcacacgaccccgagcgacgtccttaccaccgttgttggggcggggaggcgcttggccttgctggcaccgcggcttcgggcatttgtccgcaaagtgtccgggctcgaagcagttgcagcacagacgctgctgtccttgagcgtctctgcggccttgaccaggctgcacagctggcgcaggaggacggggtgcacgggtcccttgctgaccctgctgttgctgcggctgtgggacgcgcaccacgaattggggtcggggcgcggagcgaggttgctgctgctgctgctgcgaggaggattgtcacgccctgaaaattttaaaatttataaattgttgtttaaatggaatttctagaaataatttaaagtcttgaagagaagatcttgttttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaagtctcttttggctttgggccgaaagtcggcccaaatctcttctctctctcctcggcccagccggcccagtccgccgcgcgcgcgcgccctcgctgtcgctgacaggtgggtcccgcctgtcaggtccttcatccttctccggccgccgccgccgaaaccctagtttcgcgccgccgccgtttcctttccaaatccggccgttcctttccttctccggccgaattgaaagaggggaaatgatccttgggatctcctctaccttttctcctttggaatctttggctaaatcgttttggaaagagttggattcgagttcgtctcggatttgttcttcccgagctttccttcgccgttgccgtcgccgtgggccttcgccgccgcctccgagcccctttaaaaggacccccggtgtctcctctacccgtcgccaccttcgctttcgcctctcgtcgtcggaagagctctagcgccgtgtgccctagcttcgccgtcgccgccgccgctccagccgtgcgccgccgtcgtttcagccgtcgccgtcgctcgggaagaccaccgtcgtgctcgccaagtcgtcgccgtcctcgttcgccccttcgccgtcgccggagatcaccggagcagcttcgccgtcgtcgacccgaaggttcccgccgcttcctccttgtcgccgtcgccgtccgttggtcttccgccgccgtttaggtcaccggtgagttcgccgtgttgtcctctacatcttggtgccctccgtttgcgtcctagcgccgccgtttgccggtgagtgtgcgccgcccgagccgtccgctccgccgagccgctgccgctgtcggtgacgtcaccgctgacgtcatcggggtcgtccgccgtgagccggtcgtggaccgatcgatctcggccgtccgttttggattggatcgatctcggccgtccgttcgcgtgaaccgtcgcccgtgcgcccggtccaccaaaccctagcccgctgacgcaataattctcttttccttttcaaaaataattcattattgcgtcataattcaatttaaaccgatataagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggccctttcgtacttgattaccttattccttgataccttgggttattacaatttgactagttgagctttatttatattggttcaactagatattagatataattgcttagccctgcttagaaacattagtacacattcgggataactaatgactcactattatttaatgatggtttcatgatagttcacgatggtcaatcgtgattagttaattaattaatgtgccaactaaaacctggtaatggtgggttgtgagcacatggttttgttggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataagggggtgattatgatctaggaaggtgcgctgcggtggattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattgtaaaagatgcttaaactggtaataatttgattagctcctggtttggaatggtacattcctggtttggagatagaactgtgcagccgggatggttgttcagaatggttgggcctatacaacagggtatgttgtatagcgttggattaatattgtttaattacttaactgttttattaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagatctttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagctcccttgaccctaggttatgccaaatggttatccatagaagccctctaaaaatattggaaaagtagaactgttctcctccctttctcttttaattaaaccaaactaatggcacatgcatttcataatctcttttaatggttctcattcaaaatttattccagtgttattagtactgtacatctattactgtactaatggctcatttaccagcaaaagttttacaatactgttttatttaatcttgctgcaataaaataaatttagcatgttgattttataattttctttcatttcttttgaaaccagttattcaaaattacaaaatttgtgacctcgtttccaactgttttaacttatctcgcaagcttggtttactttatttacttacctttttactttgattttcaaactttattcaaattaatccaaaaacttgtgctattaattggatagatgtcttaactccctcctttcacctgtctttagatgccgcgttacaagcctgagtacctgtttggtgttgagggttttgtccaggagttgcgtacgatgtcctttgtcattggatttggaactgcccctttttatgcccagattgctcatgatcgtcatgaagagaagtgccgagtcaaagtcaccttgaacagtaatagtgaagatatcccctcagtgatgtttgaagctggaggaagaaactacatccatgcatgtcaggaggtggcaaggatcgccataggagagctccgtgatcgctacagtgatcaattggccgacactgagtatcgctaccatcctcgccaaccacagggaagtgaccgtggcagttaccttgagactgaaggaattgagaatgatgttaccacaaagcatttggttgagatgttgtgggctatggatgaaagtcgtgcggagactgtgttagcagcccaagatcgtgaagattggaatcgtggtaagatttgcaagttagaagacaaggtggatcgtttggagaaggaattagccgcattaaagggagaagcaccgccgcagaaggccaggattcgtcttaccgcaaggaagagagctctatttgttcctcgctatcaattggcgccaaaggttcgtgtggtggagaaagaagttgccccagctcaagcggatcctccggtcatcatcataagtagtgatgaagaagaagaatccaagcgcaacaattccaagattgagtgggtagcaacccaagttgataaagacgagccttcaatcgacctccgatgcttggaagaactagagtgacttgttaagccgttgtcttagatcgatgtgttagtttgcttgttttaagtttgcttgtgtgtgtgggtcttgcatgtgatttacatcagtggtgggatgtaagtgcatgcgtttgtttgcttttgagagttaggaagttggtgagtttagtggtgtgagagtctttagtttgtaataataaaactcagttaagatcaataaaagttaaagtaattctctatcttaagtagtttcccccggtttctcttcttgtgccctgcccatgccaaatggtgaacactcacagcaatgggaatggtcccaacaaccccaataacaacaacaatggagagaatcccactcttgctcaagttcttgctcaacagacacagcttatgaacatgatgatgcagcaatttcagaatcagcaaaaccaaggaaataatcatgcacctccccagaacaagttagcagaatttcttcgtgtgaggccgcctgttttctctagtaccactaatcctgttgaagctagtgattggctgcatgccatagagaagaagttggatttgcttcagtgtactgatcaggagaaggtctcatttgcatcacatcagttgcatggccctgcctctgaatggtgggatcatttccgccttaacaggactactgctgaacctatcacttggcttgaattcaccgctgctttccggaagacgcatataccatcaggagtagtgtctctcaagaagaaggagttcaggtcgcttacccagggatctcgctctgttacggagtatctgcacgagttcaatcgtcttgctcgttatgctccggaagatgtgcgcaatgatgaagagcgccaggagaagtttttgggaggacttaatgatgagctttcttacccactcatggttggagattatcctgatttccagaaattagtggataaggctatacgtcaggaggacaagtacaatcacatggagcagaagaaacgtcggattgctcacttcaaggcacaacagggaaataatcagaagccgcgtcttactttaggaccccagtccatgccacagggaggttcttcgtctgttgttcgtccgcagcgtcagttcttcaacaacaatgctggcaacaacatccgtaatcaagctccacgtcctgttgcagctccagcacagcaacaacctgccaagagagagcaaggcagcaagcccgtggtgtgtttcaactgtggagacccaggacattatgctgacaagtgtccgaagccccgacgcgtgaaggttgtccctgcccagaataactctgctgtaccagcatccaaggctcgtgtaaatcatgtcgctgctgcagaagctcaagatgctccagatgtgattttccttgttaactcagttcctgcaacagtacttttcgattctggtgctacacattcattcttatctatgagttttgcgggaaatcatgggatggaagtagaagatcttagacgtcctttgatggttaataccccaagtgatcaagcactttctttgcaacgtagcccctcggtcagaatagaaattaagggagtaccatttctggccaatcttatcttgttagaatccaaagaccttgatgtcatcctagggatggactggttagccagacataaaggtgtgatagactgtgccaacagaaaagtaactctcaccagcaatgatggtcgagttgtgactgttcatgcattgtcatctgagtctttaaggtcaagactgaaccagataactttggaagagattcctatagttcgggagtattccgatgtgttcccagatgatttacctggtatgccgcctaaaagggatatagagtttagaatagatttggtacctggaacgactccgatccataagagaccttatcgaatggcagccaatgagttggcagaagttaagaggcaagtagatgatttgcttcagaagggatacatcagacctagttcatctccatggggagctccggttatttttgtggaaaagaaagaccatacccagagaatgtgtgtggactatcgtgcattaaacgatgtgactatcaagaataagtatccgctacccagaattgatgatttgtttgatcagcttaaaggtgccactgttttctccaagatagatcttcgatcaggatatcaccagttgagaattaaagaggaagaaaaaccttaggccgcctttacccctaaggaatgggtgg

SEQ ID NO: 31779 - DNA, 9648 bp, Oryza sativa
gtggagccgtctgcgccgtttatttattttccgctgcttagatctttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaaggatccccctggatagggattggtgtagcggaccctttggttagccccctgttgattgaggaaattcgccaagtgacgcttgtgcgactccagttccttgtgcttggcttccaagcggatgctcttgtccaccagacgctggaaatccggataatccccggagaccagacgcacagatagctcagggtccattcctgccaagaacttctcctgcttttcctcatcttcccgaacatcctccggggcgtaccgggccaggttgttgaactcatgcaaatactccatcacagagcggttgccttgcttcaactcccggaattcccttttcttaagggccatgactctggcaggcacatgggtcctccggaaagcggcggtgaagcgggcccaggtaataggctgcccctcgggctgcgtagcctggaagtggtcccaccatagagatgcgggcccctgcagctggtgggtggcaaagatgactttctcctcatcgttgcactgcacggtgtctaacttcttccccacggcatgcaaccaatccaaggcatccacggggttattggagctagagaaggtaggcgggcggatgcgaaggaactcggcgagcttagaatgctgcgggggtggtggtggaggtggagcattatgctgtggtggattttggatgtggtggaggaaagcagccatcatgttggcctgctgggcgaggatttgagtgaggatggggttggtgtctggtggtggtggtggtggcgggggaggaggtagaggtgggccaccttggatgttggggttgctaccttcgggttggttgccatcaccagtagcagcagttctcctggttgtcaccatctgaaataccccaaaacaaaccagccaacagagagaacagactattaaaactaaccacccacgactaccaaaattattgaacttattactgatataaaatgggttcattaaggttcaggatgcttaagccaataaaataaagacaggctccgacacaatcataccacacaccggtacaaccatgccccacacgacttcaacaggaagacaaacgagaaagaacacactcgcaagcctactaactgctcgtctacttctgcgacgggccagggcggaaggtgagcagcagcgcatcctccgtgctaccaatgccggaggtttccccctcctgaggaaccacgggcgcgggctcggcacgaggggtctccacgaagcaggtccacgccagggactaacgaacaagctcaggcctggaggtgctcttgcgggcagtgatcttctggctgcggcagacgcggcggcgcttgggacggcagacctctccctgggcgaccttgagctgacacagctgcgcctccagcgcgtctaggtccttcttcagctgcagattctcctgacgcagctccaggatcttcatgttgttctcgaccatcccacggcgcaccatatgatggaagtcgatacgggccgcgtcgtacgcctccaccatgcgcgccaggtgcatgatggtagcgtcatcctccgagctagcatcccggaaggtggcgtagtcgcgggctcctccgcgacgagggtggtagcggtagggcgagtgctgcaactcgtccgggtagcgctggtgaagagtgccgatggcgaggagtgcggcgttctggcaagcagcggagaaggaatctcctcccgtggtgactgccaacgaagtcctctcgggagagccagtgaggatcactgcagtgacctcccaagcagcatgcgactctgcatcgtcacctcctgctccgggagctgcttgccttggtagtccactccatgcggataccccaggacaacgcacatgccccgcagctccagaacaaagccggtcaggtccaggccacgacggttgatgctgccggccatctacaagcaaggacaaaaaagagagaaaatattttagagatcagcttttgatgacaaatgaagcagcaagacagagagagactaaaggattttcacaaataagagaggatttttatttcgaaaatattgctaaggcttgggatctaaggctcgtcctagggtcaaggaggctctgataccaacttgtcacgcccggaaataacccaacgggggtccctaagggggggaataatccctggtcccagaagccaaggtcccccaaaagttaatccaattcagagtttaccaaccgaaagggtaaatagttaattatcacatgggcagggagggcccaccccactcaaagccaacgaaaaacagcggaagactaaggcgacgaccacaggcgcttgacggcaggcacgagctagacaccaaagccttcatcatccaggggctcctcttctgggtttgggaaaaattgagcaagactgagtacaaccaccgtactcaacaagacacacccacaagtgcagcataaatgcaaaggagtacaatggagttatagtataggggttaggttttgcaataaacagcatttaaaagactcttagttgctcaaagctaaatttaaaacacgatcctagaactatttaatattattaaacaaggccgtgaacccaaacgaacctgccttaacccaaggcctacgatgattcagaccgaactggcaacccgaccctgggtcccagctcgtcccaagccaacccaggccaaccattccacattttagttattaagcaggttttaagaatttgaaacactaacttgggtacattgctaggcttgcccataaccgagggcgcggctattcgaataggttttactctgatcagaggtgtacatctttacccacaagacacgtcttcctcacgtgcaaccacgtgccacataccaccacggcatatggacggaagacatgacatagtttccaacccatcctagccatagacaagagtaccgacccaacccacctacggccagaacccccggacaggcaggcagaattgagcccctagcagcaggacaccagccctgtgctatgacatctcgactaccgggccgcagcccgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatgtggccgaggggctactatcaaaaccatgcaccccaagcctagcctaaaaccattttgagagttttgaatagagggggaggtgtgcatccaattccacaataatccaaccattccaatatgtccaggtgatatgaatattcccaaagtctagagttataaaaccacctaatgttgcctaattaatcagcgaagcatctacctaaattcttgctagtggaaccatgaatagagtgcccactagttggggttttgtttattctagggtgaacaaggtaataataacaataacaacaataataaggtcataacaaaggtaaataggcatggctaaataaaacagtgataacgcgggaatttaaataaagcgataatgcaataatttaaatcaaagtaatttcacaaagtgggatccaatatgttcaaagaatgatgtgacttcccttgctcgctttcccaaacgtcggcttcaacctccacgaagagcggatcttccaaagctgcagcgtctacacgaccaacagaaaagaaaagggcttttactctaataaactccatataacaagcaggaacaaagcacaaaaatgggttcttgacttcttaaggaaaaattagagacttgaacggtccaattccgagttcaaatggccaagttatggccatttgaagtttatatgcactttaaatgaatatttacgaatttcttcatttaaattttaatttaaaaatagatttattgcgtcagccgggagagagggcgcgcggaccgggtccacgggagtgggacccacgcggcagtctcacggtccacggtggaccgggtgcacccggctcacaccggccggccccgtgggccccacgcgtcagccgcacccgagggcgcgggcggctgatggccgggccccatgcggcagccgctaggcgcgcccggaggcggccacatcggcacggccggcgggaggcggcgcgcccgcgcccctatggtcgctggcggcggccataggcacggcggagcggcggccgagagaggggagggaaagggggaaacgaagcggcggtccacggctcaccccgggtcgacggcgacgacggaacgggcgaccggagcggaggaaggcggcggcgcggctcgggtggacggggtcgacggcgctccggcggtcggtgagtcaaacagatgggtggactaggtcggcgaagctgcagcaaaacctaaggaagctgcgcctaggtggaaggtactcccgggcgactacggctgcggaccggacttcggcggaaacgcggagagagatagcgacggcgcgagctcgattccggcggggagagaggacggtgagtggcggaaacggtggtggggagctcggggagggtttatatagggttgggagtgagagagggcggccggaggagggggaaatgggcgcgggagacccggccgccattaatggcgccggcgaggttaggggagaggtttccaaacaaatccgagggagagagggagggaaaaatggggggaaagggggaggggatcccggggaataattccccccactttattgcacgcggggccggcgggaggcggcgggattcgcggcggcggcggcgctaggcgcgggcgaggcggcgggggcggcgggaggaaggggatgacgggtgggccccacccgtcagcgagggaggcgggcgggcccgcccgtcagcagcgcgcgcacggggaggaggccgagtgggccgcggggaggaggagaaagggggagggagatgggccgagccggcccattagaggggagaggtgatttttagggtttttctttttataaaatcattttaactttgtttatttcttaataattattatttgtgctctgaaaattccactaaaatttatttacacattttaggcttttaggaaatatacaaaaatcctccaagccctatttgactttcaactttgcacattttaatttttgaaggcttttaattattctaggcataatttagaggatgtattttagggtcgatttgggacgcgacaaacctacccccttaaacggaatctcgaccccgagattcggaagaactggcgaagagatctggatgggctgccttcagctcgtcttcacgctcccaagtagcttcttcctcggcatggttgctccatcggaccttgcaaaaacggattacccgattcctggtcctgcgctccatggtgtccaggattttcactggtctttccacgtaggtcaagtcttcgcgaacttcaatctgctctgagtcggcctgctcggatggcactcgaagacatttcttgagttgcgacacatgaaacacatcatgcacgttgcccaaggaggcgggcagctccaactggtaagcaacttctccgcgtcgagcaatgatgcggaaaggactcacgaaccgaggggcgagcttccctttcgcttgaaacctgtgtacaccccgcaacggcgttacccggagatacacaaagttatccactgcgaattccaggtcacggcgtcggttgtctgcataactcttctgccgagactgtgccacctttaggttttcccgaatggtcctgaccttcgctttagcttctctcaagatatcggtcccgaacacttggctttccccaacttggtcccacaatagtggtgtcctgcatttgcggccatacaacgcttcgtatggtgccatctgtatgctggcttggtagctgttattgtaggagaactcggcgtaggggagactcttatcccatgtcttcccaaaatctaggacacatgcgcaaagcataacttcgaggatctggttcagacgctcggtctgcccatctgtctgcgggtggtacgcggtgctgaaatttaatcgggttcccaactcttcctggagtttcttccagaaatgagaggtgaactggcttccccgatcagagacaattttcttaggaatgccatggagacttacgatcctagcgaagtagagttcaactagtttgttccctccataggtggtctttacgagaatgaaccgtgctaccttggttagtcgatccacgactacccatatagaatcatatccgccttgggtttttggaagtccggtgataaaatccatcccaatttcatcccatttccattctggcacttgtagaggttggaggagtccggccggtcattggtgctcgactttgacacgctggcacacatcacaaagggccacgaactctgcaatttcccgcttcatactaacccaccaatatttctctttcaagtccaagtacatcttcgtgctgccaggatggatggaatagggactttcgtgagcttcctgaagtatcaactgtttaagttccctgacgtctggaacgtgtggacccccgtttttataacaggaatcaatcgtgtaaacagtaccatttccctggatcaagtagtttggtacccacgaattcatagctggaataccaagtgcacatacacgagtgtctaatacgaattattacatcataggcccgcaggcatagtcttaaatcatcggaccgagcggtccggaatacatccaaaaacagaaatagataaggtagcggaattcaggcagcggcatgccattgccacaggcaacgaccgtactaagacctactgggcaccatcgtcttcgtctccctcctggtagtaggcatagggatcctccgtagcttcatcgcccgcttctgattaattttatatttgcaagggtgagtaccaaccgtactcaacaagccaccacagcaacaatgcatatgaaagggggagagttcaaaggatggctatagttcttttgcgcaaagcaagttttgtaattcttttcacaagcctaagacctagcattgactgatcaaattttagtaccagagtttgtatttaaacaacgacggttctgtccaccatccagtgtgatcccaaggatagtttctcgccattgattcgtcatggttttcggaggacgtccaccttcctgcctctcaggaagtggctccaacggcatagaaatcatcatgcaatatcccatcccacacaggttaagaatttagagtctagccaagtgtaatacatgtcccggtgctcaataaccgcgagcacggctattcgaatagatttggtttacttacactgcagtggatgtacactttacccgcactccacgactgcccaacatatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggacagagaagtctcacacatattaaattatggttcaagttaagttctctctctcacacactcatggcagtcctaccaatggcgacaccgatgtagggcacgcctctcggccctacctcaacggctgtcccatcgtagcgcacctgcctcactcaggggtgaaccatctatgcagggatactgcctccgctcggctatctaatccgctaggtctatactcattcgagaagtacggttgtacgggggtcgtttcatgcttaacttcatggctcggtccttaattgaccggggacggtactagcctttcccagataccacccaaatcctccgtccgccccagtcgaaaacaattgtttaattttattttttctttcacaaatcatgtcatcaacatcatggcaatgtggcgctcatgtctccacatgccgcatctcaattaccttcccaaaggtaattgcccaagcatatagcatttgataattatgagtatgcatgattctagaatagcatttctaagcatttgtcatagttgactagggactcatacgtaaacatggttacaaagatttaagggtaaacaataatcaaggcatggcataatcacaagtaggatgttcatcattgcatgcaattttatttgtaaacaaaacaatttcgcaattgggatcaacatgttcaaggaatagtgatgacttgccttgctcgaggtcccgcgggtcttgtccttcacctggatccgcggctccctcggtctctatagttacgtgcgaaaattgatttgaattcggttagaattcaaataaaaatccaagtaaatccaaatggaagtcgaatgcgaaagtcgattcttttatattaactttactattcgcgaactagggcaaaccccatttcaatttaaactattttgcgagtataaatattttgttgtcatgagtttttaatttaacctacccgagcaacatatcaattaataggttagaaatttctatcgcgagctaaacatcggacgaaatcctagaatattatacgacttaatttagtctatgattaaatataatacacggctaacatcctagtaattaaatccgaatcgctaccgttaatcgattacttatagagattacccagaaataatccataataatttacgagaattcatacatttgtttaattattaattacatctaaattaataccgcgaattgattccttatggagagtaataaaataatctataatctataggaattcatccaattatattttcattaatcctatatttaaaagccagtgttttaggtatttaattagtaagatttcatctaactatattttcattaatcctataattaaattctaatatttgcaaatattttaaatttcccccaaaatttttcctttttcttttccctctctctctctctttatttttttcttctcttttctttcctttcctttttcctctcctctcttttcttttcctcttttcttttcttttcattctctcctctcttttcttttcctcttttcttttcttttctttcttttctttcttttctccccctctctctcttttcttttcttcttcctcctcctggctcctttctctcttcccttctcttctctcggaactctctctctccctacccgtggcggcggtgacgacagcacgcacggaggaggggggggggggggcggcggcttaccgacggcggcgggggcgacggcggcgcaaggcggcgacgcacggcgcggtggctccggggcggcggcgcggcggcacgatggcggcggcgcggcggcacgatggcggcggtgcgtggagaaggaggagagggagggggaaatggaggggatgggtgtgggatggagaagggaagggccgggtttta

SEQ ID NO: 31780 - DNA, 4411 bp, Oryza sativa
  unsure (1)..(4411): unsure at all n locations
ccattaatggtccggctaggttagggaaaggttccaaacaaatccgagggagagagggagggaaaaatgggggaaagggggaggggatcccggggaataattccccccactttactgcacgcggggacggcgggaggcggcgggattcgcggcggcgtcggcgctaggcgcgggcgaggcggcggaggcggcgggaggaaggggatgacgggtgggccccacccgtcagcgagggaggcgggcgggcccgcccgtcagcggcgcgcgcgcggggaggaggccaagtgggccgcggggaggaggagagagggggagggagatgggccgagccggcccattagaggggagaggtgatttttagggtttttctctttataaaatcattttaactttgtttatttcttaataattattatttgtgctctgaaaattccactaaaatttatttacacattttaggcttttagaaaatatacaaaaatcctccaagcccaatttgacttttaactttgcacattttaatttttgaaggctttcacaagcattttaattattctaggcataatttagaggatgtattttagggtcgatttgggacgcgacaattatgcaattgatgtctgaattgtatggaggggctaggaatgtaccctacactagaaaagacataagcaatttcaagtcaaagttggggagcgagtataggagtataggtgtagagatattcctgaaacaattgctcacttcgaggaaatcaaaaaggatgacccaaatttcttctacaagattcaacttgatagggaagacagggtgcagaacatattttgggttgatggagcagcaagaaatgcctacaatgacttcaaagattgcatctcgtttgactgcacatatatgacaaacatgtataacatgccttgtgcaccattcattgggataaacagacatgggcaatcaatacaggtactccttttttttgcaaaaaagtaattctaaaaaatctgtaataactttggaaattatagtacatcataagttacttgttgcattcattgagttacatcaagtcctgataaaagttacttccagtagaatgtgaagttacatttttttaaaaaaaaaaggtaaaaaagtaactaagtttacaagttacatttttagtgtttgttctatagttcaaaattgtactgatttacttccagcaaacacaaactgtacaaactacgcaaaattgtagtaacttacttgcttcaaaactgtactgacttccttatgtgtattatttttgatattcagctgggttgtggatttctatggaatgaaaagacagaaacctttgtatggttgtttcaagcatttctagaggctatggaaggtgtagagcccacaaacataataactgatcaagacctagctatgaaggcagctatagcgctagttttcccacatgctaagcatcgcaactgctgctggcatataatgcagaatgctcagaagaagattggccatatattagatcatgacaaagcattgtgtgatgcattcaatgactgccttgacaacagctggacagagcaagagtttgatgctaaatgggatgcaatgttgacaacatatcatttacaagatagtgagcacttccgacacctttgggaaatgagacggtgttgggtcccagcatactttatgcactgtttcttccctttcctccagactacagcacggagtgagggatttaacgcagtgctgaagcgctatgtaaatcctcaaaacagcatatacaacttatttttgcagtacaagaagattcaagaaaaaatcactgttgcaacagatcagaatgagtttgaagcagaagaaacaatcccttctatgtgggctaactatcccatggaaacaaaagcattggaggtctacacaaggcctatattcaacagatttcaaaaagagcttattgcttcaacatcatataaattgacctgaacttctgaaaacatgtatctagtagaaccgaatggaggtcctgttaggaattatggatcaagggcattcattgtagctgcaaatgtgttggacaggatatacaactgtgaatgctgtaagttcgaaagggatggcattctttgctgtcatgttctgaaggtaacagtctgttattgcagtaagctacttctcactgtgcattaagctacttctcactgcacattaagttacttcttaatgtgcattaaattacttcttatgcattacgcacttttggcaggtaataaaacatatgtttttttccatgcaggtgatgacatttgattttgtgggccaagtgagtgacattccagaacactacatattgcctagatggacgatggttaaagagcctgaattgcctccagttacaagcattggtgaacaaatgcaattgccccctaaatctctgaagctaatcaggtataccaatctgtgcacaaaatttacacagattgcaaaagatgcatcaagcaacgagaaagcctaccgtatggctctacagtgtatgagctcaatgactgatgacttagcagctatgaagcagagtagaaagaaacagaaaaaagcacagccagccccatctgatcctgcaagaggaatttcagatatcccctcagcatcaactaacccaacactacagataaatgaccccccccccatcatacaaaagcaagggagaccagtttcaacgagacgcaagcctggggtccatgcaaaggcgtcaaagacatcagttaggaaaggcctagctagtactgagaagtgaattagagctacgagatgtaacttataatgttgtgacaagattgttgaaacttacttgcacagttgcattaagttacttttagcttccatagtagttacttcacagtgatatgtaagttctcaggaagaccatgctgagttctttgcagaaccaagatgctattttaatttgttacccaacctaatttatgtggctataacttatgtgctggttctggaaaaaaaatgcagtgtttcattactttaccttaagtgtaggatcaggctctttgccccataatacttgcatccattgcacacgatttccttgaaacgagagtatcttgtgtgtaagtagtttcttaatgttggggatgtcacttggttcaaatgctggcaactgtttgccatcccacaactccacaaatttcagcatataaaaaccacaatcccggctgtttttgtttgcaaaaacaaaatagggataagtttgactaaagacaataaatgaaaatcactaactaaaaaaaagcatgttacgtacgtgttatcttgctttgggccatcaatgaaaatcagtgggtaattctagatggttttcttcgaaaacctcatgtaaaacctatcccacatggtcttgatggatgcaacaacaagatgagatgctgaaatcagtgcttcgtcatcttctcccctcagcgaatcataaacctcgaatctttcagctttcagattaaggcacaccacgaaatagtgactagccttatcattcccattacccaattcttggagaatgggaaaaaatgcctgcattcaagtgaaaagagggaggggagtggaaagaaggtttttcagtaaatataatcatgatttagtaagtataaaaggataataaaaagtgattcaaaataacatttcctgtcaatataacagaaaaagttacttccacaaacatgctgagttaatttgcaaagacatttaagttacttctacaagcagacaggaaaaagtaactttacatatcattgacagctggaatatatattttcttactaattctttatggtcaagatggttcgctctcgtttgatcgaagtgtttcttgagctcattcctgtccaactgcgaatccaacaaatatccctgcaccatgtggaaaaaaaaacataaggtgttgcaatgatagtaatagtacattaaaaagagattttaatttgtaaattttatatactcactcctattctggcaggaaaaattctcttcgaattgtccttgatatcagtagacagaacaattaatgccnattcacatgtgttattgtccagtgagcccataggtttgacagagttcgcaagatggttaaaataaaaataatattttctggaaccaaggttctttgggttccatttaccaaaagcaaaaagaaaaaaaataaataagcaaattagtataccatgtacaactactgtagcatgttaaattatttcaatgacatggtaagttactttcaatgacatgttaagttacattcagtgacatgttaagttactttcagtgacatgttaagttactttccatgacatgtaaagttactgcacaggggtgtgtagaaagtttgtctggaaaaaattgttcggtcgtg

SEQ ID NO: 31781 - DNA, 5971 bp, Oryza sativa
tcatcagtatattcatcttcctcagtgtcttccacttcttcttcatcagcaacaaaatcttcatcatcacttgaagttacatctaccaaaaaagaacaaaaagtaacttagtgtattgtaggaagttgtttggacaaatgtaaaaaaactaaaaattcagttgaaatcattgtaaaaaaaacagtgtggtagaacaatgatactaatgagattcaaattgtgcagagtggtagagcatggctaaattaattattctgtacaataattaatagaaacatagtgaaaaaaccaaacctagatcttcatcttgctgaactctttttgtccattgtgcaagtttcttccggttcattcgcattttccttggttggctacccctaggatccacaaaatcaaggccggaaatctgtctcacaaatttcgtgaccaaacctgaaaacccttcacacaaattttgcacagcgatcacaattctgtccttttcctgtataaaaagaaaaaacagagaagttacatatgcagatttcacaaagttacttttgcagtttgttgatgttacattaccaagggtacaaaaagtaaaacagagaagtggggaaaaaatataaacctgctgctgcatagtattgggcacatttgaatttatgaaggttgaaaaatctacattgctcccaaacaaattggtcccttcatgctgaaaactgctcctaagctatattttcaattataaaatccgtaagttacgaacaaacaaaaaactaaaaatgatgcaagtatgccaactataaaaaaactcactggtaaagctccaaaggagccgtctgctgatgtgtcagctaatattgcttgatttatcatttcattcgtccaaacagtagctcgataaccctccactggaacattgagatttttaaacgaaagcgagtccaaataaagaatctacaaaagaaattagagcatttagattaattaaaaaaagtacataacttgtttgatttaaaacctacaaaatatgttaacttccagatgtaatttaaatttaaaaacaaattggaaaaaaagatgtggcagggcatatatgaagaagtaacttaatgcacagtgagaagtggcttaatgcacaataagaagtagcttaatgcacagtgagaagtaacttaatgcacagagagaatttacttgacacaaaattatttataacaatttaacagaaagaagttacttcctaggaacatgttagttacttcctggacagcttaacttacttctaaaaaacataaaagttacattgggacagtgatcaaataaaaaaaggcgagcattgttaccatcatatacaggagacatgctgagttggtattcttcccagctttagcagctttttgcaaaatagatatgataaacttgcaccaattaagattcttgacatttccagcatcaacaacagaaggatagcatcttgggctgactgttgttgccgtcgttggtgctaaaacagaagaaatggcgtagatgatccacatgcgcaggtacttgtcatctgctaacttcaacttctccaattgaatcccaagagaagtcagtgatggtgagataccatcattgattccaagcaaattcagcacaaattctgtagcttcagattccatctcatatgagacatccttgtcgcccattgggataccaagtacagacttcactgactcctcgttcacatctatggctccacgtccagggaatacaagctgattggttgctggattgaaatgctccatcaaccagctgcacaaatcaggtctgagcttcgagcacttgagatctacgaggccatggaagccagccccctctattagtcgcttttgttcgccactcatatggggatacaactttataagtttcataggtgaagccctgctactttcttgctgcaaatgtataaaacaacaaaaagaaaaataaaaaaacatcagcatttgtttattttttaaaaaacatatataaaacagttgaaaaaagggtaactgaaccaagaagtaacttgccattaagttagttctagaaaataacttgccctcaagcagcagcatcaaaaatattttaggcacggtgagaagtaacttaatgcacatagagaagtaacttaatgcaaagagagaagtaacttcaggcacatcgagaagtaacttcttacttgttaacagaaaatctcaaagtaattttgacaggaagttacttctaacaaaacagtaagttacttcctaggaacatgcaacttacttccagataaacttgaatttacattccctagttacacagcatgatacattccatctagttgcctctcagagcaatttgaacagaaagttactcgttataaaactcaaaaagttacttcctagaaacatgcaagttacttccaaaaataaacttgaatttgcattccctagttacatagccatgagtactggtgttggaaatctcataggaattttaaaataagtaacttaatgcatagtgagaagtaacttaattcacagtgagaagtaacttaatgcatcataagaaaatatagtgcattggaaaaagcgaaacactgcttgagggcaaaaaatgcataaaaaaaggtggatgcttaatacctttgatctgctcctttttggaggaggttcctctatgtcatctgcatgatcatctccaatacttcttttcttagcacgttgcgaacccccccttgttttttcacttggctctggtttgcctaacatgcctttctgtacaatggtttttctttttcccattcctggaaatacattttggatgttagtaatcaacttgcaactaaccatcgatcaactaataatcaacttgcaactaacaatgttagtaatcattttggaaattcattttggatgttagtaatcaacttgcaactaaccatcgatcaactaataatcaacttgcaactaacaatgttagtaataattttggaaattcattttggatgttagtaatcaacttgcaactaaccatcgatcaactaataatcaacttgcaactaataatgttagtaataattttagaaattcattttggatgatagtaatcactagtaatcaacttgcaaccggaaaaatcaacataagccagagagagagaaatttaaataccttcaaatggaacccgagatccacaagccgacgcttgagggggcgaattccaccgcaaccttgcgctcgccgagaggatgaactagcacctgatgaatgagggagagagagaggggaaatgagggaataggggagaacaaaccgggaggtttgagaagcaatttgcgcagtgaaaaactgcccaaacctctccacctccccggcacaaaaaacgcagggaaaaacagccccatcactccacctctttggctcaaaaaaaccgcaatgaaaccgccacaacttaccgaaaaaaatggccgccggatttggaggagagaaaactacctccgccgcagcctacgcttcccaccgcaactgccggcgcgatgagaggaaaccgtcggctccgccgactctgccgacgccggcgcgatgggaggaaacaacagcaactccccgcaccccccccttcgccacggatttcgccggagattcacgccgcctccgccacagatttcgccggagattcacgccgcctccgccacggatttcgtcggagattcacgccgcctccgccacggatttcgccagagattcacgccacctccgcctctctcactctccgcctctctctctctctctctcgtcgagcgccacccaaaaaatttgaacagtacccttcgctcgttcggtcggaaaaggcgacgcgtgagctcgctcggtcggccggtcgggacgcgcggcgcgcgccgtgatggacgccacgtcaccacggctgccacgcgcgtcgcacgatagcgctaaatggagaggcctctccgtttagattttacgagcttagaatgaggtcaataacatagccaactatcggctgcaatagatgggcacatcatctggagttggattcagcttatctgacttcaaccctcacgatggcaaagagcagtagaggtcatccagctgtccatgttcgatcgaaccgtctgcccaggaagcgcatcaaatacaggtcagccgcatcgtgagtctgggccaaggccggcccaacaagcctcgtcccccagccgtgctcgtactcctcgtctggccaccgccatcgccgtcattcttgtcctcctcgccgccctcgctctcaccgtcgtgctcgtcctcctcaccgccctcgctctcgccgtcaggctgcggtactcggctgagaagatggggaccggaaggcgcgcaagatgcagcgcccggtcacggccacggcgcatcggtgccacgagctcgatgtgcgcgcgcggagctcgagcaggccatgcgccgcgacaggcagcgcgcggcgaatggaggaggggagtgcgcgcgccgcgtggctccatttcgccgatcagaggaagaccgaagctgtggtgcctgagctgctcgttgatctgaattacctgcgtcgggcctcggcaggcagggagaggaggaactcctcatcgccatctctcagcagtgagcgagtggaggaacacagcggcctcctcttcagctccttgatgctgcgtctaggagtgttgctttgttgcttgtctgaccaaaccgaatggcattctgaagatactgaatgttcagttataagaatgatagattgttctttacacgggcagcagaagcagaccacttgttctgaaaaatggggttgcatgtgttctgtaatttgtatagaaagcagaaaaactctataaattgtttgcaatgagaatgacttgtccaacagaatgatgaaatggccatttgtaacttatcactgcaatgaaattatgttccaattctgggcatatggcttgttcaagagaaccaacggttttttttttccaaaatgcacaaacatatatgcatgacccaacctttccatctgatttccttttgtttgagtacctttctctaacctcgaaacctttctgaccaccatagctaacccaaaacatccaagcctcatcaacagtattgaattccatgccaacttcaggtaacaaactaggtagcacacccactctacaggaacaaaaaaaatgatttggtggtcatcgaacaagtaaaatctacccgatcatggtgaaaaaagtaacaaccatagcttacagacctgttttcttccatctcaaatatgtagattttgctggaggcttctttgatgaattccaacagtctaatggaggaggtggaagacaatcaaataatttgctaaaaaaaaggaagagaagaggccagaacttcacctgtgcttgatcaatggttgaatccgtggttcgctgtcccagcatgttgtcagatgatcgcctggggccatggcctcgtttggcgccaaaaaggcgagcgcgaccgccaaaacgcgtttgttcgcggtaaaaaagataggagcgatggcgctgggacgaggcttgttgggccagccttggcccagactcacgacgcggctgacctgtatttctgggcggacggttcaatcgaacgtggacagttggatgacctcgactgctctccgccgtcatgaggggtgaagtcagatgagctgaatccctggagaaagcattatagctaagtgatacaatagatatatcatatacttactgtaacacaaatattctttttgtttttataggcccaccatccctctactctctttcttgccggaggaggagatgcgtgggaatgtgggatccttcacgtgctcaagtccaaggacgaacatcagtacatcatggccgccgcgttcatccggtccggcccgcgtgcacgtctggcgctgctgtactaagagacgacgactgtggtggacggggatggcggccgctgca

SEQ ID NO: 31782 - DNA, 4198 bp, Oryza sativa
gcggtggatgtgggcgagaatgacaggatggacaccggtgacaacggcagccgctgaggatgaggacagcggcggccgcgcgggcgacgatggcagccacggcgtggctgatgcaggcggccgggctggacgagaaccacaacggcgacggccaccgccgccgtggacgaggtccgcagccgaggcggtcgcggtgggcaagggccactgccaaggcgagcagaggcgatggagacgacggccatggcggacgagggtggcgacaacggtagacgagggcgatggagacgccggccatggtgcacgaggtggcggcccggtggagcgcgacgacggcagatgagggcgacggagacgctggccatggtcgatgaggcggcggcccggtggagcgcgacgacggcagatgagcgtgacggcaacaacggggaacacaagcggagcgaacgcgctggtggtgataccggcggacgcgggccgagtggatggcgatgcagacgcgctggtgggccccgctgcctcgggcgagcgtgcagtcaagcgactaattaggccatccccaaccaataaactattagtttccatacttgtcatgtcatatagacactatatgtagacactatgtattcaatggatggtgtatctatctatcttctatctatctatcttctatctatctattatctattatatactaaaagtccattaaacttcctacaaacgctctaaagccgccacgtggcactcctacaaatattcctaagtcgccgcatggcactatctaatcttaccgttgattttcacttaaatttgtggacccgttattttacaccattagattagatctattattaaaaaaataataacttccacatgtttataacatacaaacgctagctgctactgtccgtatgtatgagattgtacgatacaaacgctactgatgttctttccgtaacatacaaacgtacatgattgaaaataaaatgatcaagctttcttaaccttcgctggaagaaaaaaaaaaccatacacttgtacataaaaaagacagaaacaacatacatccataaaaatcaaccgtttttaaaatatgattttctacaatataaagataaaatatattacttcacatgtataaatatatttagttaaattaagatctataataaatatccaatcaatgttctttaaaccatcttctaaatctatctattatatactaaaattacattaaactttgtacaaactcttttactctgctatgtggctctcaaataaattagagaaatcctagaaatctattatatacttaaaagtctattaaacgtactgcaaatgcttctacattgtcacgtggcgctttaataaaattacagaaatcctagaaattcagaataaaaaaagaaaagcatccaaccttcagttttcacttaaattagtggacccattattttaaacaatggattagagctcttaaaaataccatgatgctaatctctatcctggaaaaaacataatgcgcttacgtcatacgatcgtctccctcccggaaaaaaaacaaaacttaaatacctacatcatatactataaaaaaaataaagccaaaaaagaacaagaaaatatgcataggtacatagtagaatcggaaacatatactaatcaggaaaaatcatcagtgtcggcactgatttgttgtcaacagcctttaatctacgattttattaaaaataatactacacatatatgcacaattaaacttaatataaacttattatagtgataaatatatcatgacaaatgacgctaacatgtaatagttaatgcgataataatgtttcaaataatttcatatcatattttacagtgtcaaatatcacttgacaaaaatatacaacgttaattttaatctacatgtgtaaaaattaaaaaaacaaaacctatcattgttttttaagtacatctgtttaggtttatttaattttaggagagattgagattctcaaattatttcgaagttttcaaaaattttcttatttgaggtgtgagaagcacaaataatagatagatgagaaaaattaaattaaattttagccagtgataataaaaatatataatttagctttggtttttaagtagacctttttaggtttattttgggtgagattgagattctaaaagtatctgaaagtttttcaaaccttttttattgctatttgaggagtgagaagcatacaagatggatagatgtgaaaaaataaataaataagattttagacagttattttactacaatacaacccgtaattcatcacgagaattatgtatgttctttgccaaatagtattggaaaaaatgaataatccaataaaatatgcataaaactacttatgttatatttttttaattgatagaaattctaatatagcgggtataattgatggacgaatgacatataccactgaaactcagcagtaagtgcactctagcgaattagatagtgtaaataagtttgtgaaaataagtacattattacaattagtaaatgagtctcatttagttataaacaatatatggttaaaaaaatctagcgctaaagtatgaatctttatcaaaatataaataatgatatggtgttttgtagattttcatggtggtacgtctctttagctatagctctttttttctaaatagtgccgaatgattaaccccactcatttgaaaaacataatactgtttgtattgcattaaactttgagaagcacttattactaacttcatatacacattgtctattctctaccaaaaatcgactcgaaacttttaaaaaaattgtttcaatcacctcctttctgtccctctttgtcctttaatgtaaggtgcagtacttgctatgctatcgtaaatattgcatgggcatgcacattgttgagttaaggtactgtccatgaaaggtcaccatagacaatgtaactaaagtgatagacttatcaatataatcatttgtgagtgtaacaatagtaaactaagtgttaaaatagtactctacgatggttttttaggggcatggctacatcgacgtggaacctatatgtttcaaggcattacatatgaaagccttggttggcagatacatttgacttcatccgttagagaggtattcatgtttatttttaaagatgttatcgtattattctgtagatatgttatatttatactatttatacatagatgtgaaaataagtgatgaatttttataatgtaacaataatgtatcatttattttagtggtactaatatagtttcatttattaaaggtgcacctaactcttaaaacaatgatagtaagtaatgatgataaacaaccagtttatatatgactaggacaaaggaatttttatttaaattcgagggacattcttatcacattagtagtatattaaaatctatcgtctattttatggtaaatatatttatttttttactgtaggataatctaaattcccttacactatatatagtgatataatccattttagcatttttttaataaaaaataagatgcccatgcatctgtgagaaattccttaccgatttatattctggaaatgttttccaatttatattacgtcgttatagtgtttgaacacaacctatcatacatgcccgcgcgaatgtgcgggctaccttcctagtttaaattaaattctcatccagtcacatctcttctctctccttttatcagcatattctcttatttttattcttagttcttgtgtagagatggtttcttcatctttttacctctcttctcgttaactttcttgccacatactccctccgtttctaaatatttgacgccgttgaattttttacatatgtttgaccgtctgtcttatttaaaaaatttaagtaattattaatttttctcctatcatttgattcattgttaaatatacttatatgtatatatataatttcacatatttcacaaaagtttttgaataagacgaacggttaaacatatgctaaaaagtcaacggtgtcaaatatttagaaatagagggagtatgatttttgcttatgtgatgtatttaatgctatggaaactagatggcatggagggttggggatggccttagttgtccgctgctactctctcctccatatcataaaaaaaatcttacatggaccttat

SEQ ID NO: 31783 - DNA, 9252 bp, Oryza sativa
  unsure (1)..(9252): unsure at all n locations
taattacgaacaaaattagttactactattccttttgcaggatgattatgatttctcgatttgtcatgtaattttttaaaaaaaaaacaaatcagcacaagattgtgtccactctattactagctacctccgcaaaagaaatatatttctacgaatttcagaaagataattataccacctataatcgtatccggttttgtcagaaatacaacataactagcttcagaaaaactaaccgacgatatcccgtatgggggaagtggggacgggatacataatgaacggtcatcgtccttatccgtctgcatccttttccgcccgactcgatccccaatctcctttgtcgctcttctcttgcacctacgcctcgcatccgccgccactcttctccttcctctcctcttcttccttgcctagctagaagcttgaaaatggctagagctcctttctcctgctacacctaccctcctgttccgtccccctcaccatcaacgagccaaggagagggctgccagcaccagatctggagatatctagggcctccccgtcattggatccgcctgagccatgtcagtgatgaggtgatgatcgcaccggcccctgtggcctccacctcgatgtcatgccatcgaggaggatgccgatcgatgtgaatcctcctcccacgcaactgttagtggtgatggagaggagacaaatgaaggtgctagatttggagtttcaattgacaatcgacgtggtgttgcagacatcgtgttgctcgtcgacgttgtgcgcaggtatgtcgtgcatgtggcgtatcaccatggcttagctggtacctacaggtattaggcatggtacgaatggtatcatgttgatacctacaggtttcagggctggtacctatggtatcatggttgatacctacgggtaccagacctagtattagtggtatcatggttgatacctacaagtttcagacatggtacctttggtatcatggttgatacctacaggtttcaaggctgatacctgtggtatcatggttgatactcacaagtttcagacctggtacctttggtagcatggttaatacctacaggttttagacttggtataggtaccaaccaatatcacataggtaccaagtacaaggtataacgtgcgtcactgccgcttgggcaggtggtgagctgtcgaccaccagcgttttgtctcgtcttctcccttctattcctttccaaatctccatgccttttcttctcaatctggtgttggtacaagggtcaccaggctgctacagcctgcagggaccaactttgccacctaagccactactggtactgtggccttctcctagcgcctcgcgcgtgctcctccgccagctagggcgtgagcgcgtagggcggcgctgagtggtggactcgtgagcggataaagtggtggcggagctaacgtcatcaatataaagtatctcgtttagacgggatgccgtaccctagctagcagccctctatagctttatatggaacgaaaataccatatacctagatttatatggaagggtatatatatattcgagtatgaaatttctattggcttaaaaaaataatatgggaattctacgaataacatgtaaatgccattcaatatgtcagaatccaatcgattcgtgtaatataaggtcttatatgctcctatcccacttgtagttttcaagttctaattgaacggtcatacccgtataaatacaaagacttccattgagacatagcatcaaattataaaccatagccataagccagatcgaacaccaactagccatgaggaaacctaaagctagccgccgaggcgccgactacaagtcatcggattagtcctcattgaagactacttaggcttagattagttagcttgcttctaattttataatcggtgtgaaacatcatcgaacgatacatataaattggattagggctatttacctatcaagaggtttgaacaagctagtataaacaatatatatttccgaaaactgaaccagtatatttcttgtctccgtgtcgacgggggatactagcacactggaagaatagggtatagggtatgttggtacgaggatctacacaatacgacatcaagcaaacccggagacaaggattatactgattcagacccctcgtaaggtaatagccataatccaatctatatgagattgatatgaaagaaccacggattacaatagagaaccaacgattccgagattaccagcgagatccttgtcgagatggtttcgacgagatcttctagcgagtaggcttcacgtcctccggattgtaggctatggtggtggtgttggtgctatgattcgatgatctggaccccttaaggggtgtgtcttttataacatgaatcaccttagtctccaagtaaaactcggtgactatggaccccacacgatatagtataacctaaccctttttgagtaggactctgttgttcacttgctcgtgaggataatttccataatctcttgttaatttcctcatcgtatacggaaatatatcgtacaaacgaaggtatgtcgtatccatatattccataaatcgtaggataggagatataccttatccgtaaccatgataggctagtagcattgttttgccacgccagccacggtggcgtggcaagaggctagcatgacaggacagcactgccatgccagctgcgcgtggcatgccaaagttatttggccaagccaggcgggctggagtggccaaaaggttcagattcggacatattttttcgaaaggtctatttataaaattaaaaaaaataaaaagtctaaaaaataaaaaaatttcgcaggtaactggagccttttatttcttaacagaaaaactctcgaacctttattctagtgtgataggtatagcagttctttcactagatgctaccttgagacaatctcaccagaataagttgattgaacaggtttctgggtactgcaacagtgttttaggaaaacaaattcagccacactccatatattcattgaaatatctcaatacaaattccacccccgggaacttgggccagccagcaggttctaggttccatagattacatagaaccagtgttcacctagtcgctaaacgctagtcggacggtcacctactgactagcgactaggctgattaggcggcgactagatggattaggcgaattaggcgttttttatatttctttcacagaaaaatactgattcttgacattcggtactcagtaaatataggcatttagacaaatagcattgggtttagtacaaattcataggaatagcgaacatacattagtatatatatatagcatagcaggctaggggagtagcagtacagcatcaacaccaacaaatcacatacatcagattttaagagcctggagctagaagagaggaagaataatttatctggaactgnaagaacagaanagatgaggtggtggaggggagcctgatcccctgatggcctgatctagggttggcgcaggctgcttgagtggttccgtgcttgactgcttcaattggtgtgtttcccaccttccattgacggtaaggatgaaggatgagagggagagcagtagtagcagaggaggagggggaagaacgtggagcagcagaggaggagatcgggaagaacgcagcggcacggtggaagatcgatgggcacggtggcggagccgtcgctcgtggcggcgtgaaaaaggggagtaggtaggggttgcgctctctctctaggctctcaaataaggtaacctaaatccccttctataccgagctggtcccgcgcggcgtttctaaatttaattgtgcccaaattttgatttctatcacctagtcgccgcctagacacactgtcccattgtccaattgcgcccaggcaccgtcctgtccaagctgtccaggccgcctaggaccgactaggaccgtctaggcggtaaaacgactaattcactgcctagggtataaactggacaaattgtcgccgactagcgattaatcaccgtctagacgggctaggcggctgtttaggcgaacactgcatagaacagaacttatcacacagcagagatcaaaaactcaggttgtcccatcaacatagcaacatgtttgagaattcaagcatggtaattcagagcattgttccagatccaacgcccagcagcaaagcaacacttcgtacatcttcttggtcctttattctcacaaaaaaatgtttcccatttcatcacccatattaccatataaaatgcctataaaatatgtcagacagccaaaaaaaatcgatactcatgtgagaagctccacaacaaccacctctgatgcagaacaaacatcggagcggaggtactcatgtgagaagctcccatccagcaggtaccatcgatactgtccggtatgaaatctgagccatccaatcagctcaatcggatggtggaaaatctgtggtacctccaggtacaaatttgcccatgaggtggtaccggaatatttggagtggtggaagggtaattttgtcttttcgcgtagaagtgtccaggggagggaaatagggtcttctaccaaatcggcggcgagcaaatatccccttcccatccgatccgatccgatccgtgagagtaggcggcgtcggcgacttgcttcgtcagcctggagttgctccgcgggaggcggcgggatccgtgggaggcggcggcgacttgcttcgtgggagatggcggcggcgtcggcgagttgcttccgtcggcgcctacttgctttgtgggaggaggcggcgtcggctgatccgtagccgccggcggcggctgatccgtttgaggcggcggcgaggtgctccgtgggaggcgaggcggcggcgggggaggcgaggcgacggcggcggctgatgtgtaggaggcggccggcggcgaagtgctccgtgggaggcggaggcggcggcggcagcgggttgttcgtggcagcgaggttgtggcgggcgcagtggtgcctggcgcggcgaagccctggtgctgcggtgctgctggtggcgggcgcggcggtggcctggtggcggccgcgttcacgaggtggcggcggcggctggtgcgtgggcagccttggctgcgaggtcgtggcgtgcgcgatggtgccggccgcggtgacgaggtggtcgtcgcaaccggtgttgtggcggcagcgggtttgggctttgcgcggctgcagtggcgaggtggtcgtgtagtcttcttagccggcgacgaggcagtgtatgcatcgattttttttcatccaatctaaatcattagcttctgttggttgcagcggtagatactttcattttctgggctgcatatgctcttcttcttcattgcttataggatttgtattgtacgatttattggatgttttaatgagctcagtcgttgcttgttctatgtgaattttcaaatgttcaataacctcccctatcaatgagtgactgcaaaatgataataggatagaagaaagaaattgttgatagcataacgagtggtacactgatgagttgcttgttttaacaaattgttttcccagcatacttctatggtttattcagggaacagaaactaacctatcaggctatcacaggtggtagccagcctaataaattcttctctgaatctagtttttcaaatccaaaagatataacacaagacatgtagaatctggaggtcgacatatcatttctgacaatgaaaataaaagatgaaaccaccttatccacatcctatacacacactttagatagaaattctgtcatgggtatttcatcgaacaccttttatgcgaaataaatacctaatgcttatcagagacatcctctgttacctctgtaaattgcaacatcacataatcacgcacagaagattcaaattttgtgaaaatcttactgacttttgctagataagaaatgccatcgaattcccttaacttggataaacaggagaatagcatatgcataaaaattctgtgatgttctctaaacaggagaaacattgcaagtagttacaatgatgtctatctgaatcttagcctagagctagttgccttcatttgcctcggtcactaggcgtttaatatcttgctgcacttcaatcacttcgttcatagtagaattaatgaggttggctgcaaccttatgtttgaaagtggtggttgtatcctgaaaagcaagttatgaaaaaaatatcaagtaatgtcattttatttacaaagagtactgattgcaatttaaaattaccatttcattgaactcaggggagagttcttttccattccaatgctgtatgaatttcaatgtgtgcaagccacatgaccagctgttgcaagcatgtcctttgttagtggtaattcgttatagataatttgcgacaaaaattaactgtttgtttgacctgtcactttgctgagggactttcattgggcagaatggccaattggtaatcttggtgttcttccatttgttttcaacttcatcttctagccttgcatactggataaacttttcaattccttttatctgagttatcaaatagagtattacatatctaatgtaacaagttagtaaggaatagtgatgaatctaaaggcacaatgtagcatactgtattattgaggtctttatctttgtcgtagtagctcttgtccatgcgcatcgagtctagtatttgaattttttctttagcaccattgagaacagccacgtaccaatgagttgagtttctattgagtggtaggaaaatctacatagaaaatgaaatgtaagtcatgcagttattattatgaaggatatttgaggacataatataccatatcatgttgcaaatattttgctgtaacttttgctctcttgtcttgatattgcttgttgcgggttccaatttgttcaccatttgttttccaggcctggcaatgtgctgtactttctagaaatgcagtaccattctctcttggactttcacattgcatgtctttaatcaacataatgtatgcatctatgacctgtgaaagaataaagaacaaaatttagatactgataatattatgttgtatggaaatggctgaccggctttcagacatggaattttcattcaagaagaagttgtccaagcagaaaaaagagactgatgacattagaaattggttcgtaggaacagtagttgtagctgtgttccttctcatgaagttatttgataatatgtactatgcttgccgttgttgattttctacatgtcagttagctatgttaaggtaacagactttttagtttgtcatctcatttgtaataaacgaatatcaggcccttgattgccctctaaattgattagctgtgcattgttcattttggttgataagtattggatggatggttgctgcaaaactggaaaactggaatgagatactgtgtaataaacgaatatcaggccctttattgccgtccaaaattttcagatgtgcattgttcattttggttgatgagtaatggaaggatggttgttgcaaaactggaatgagatactgaaagaagtgtactacaaaactgtaaaacttaggtgtactgaatcattttgtacatttttaaggtgtacttagccttgttgtgctactgaaatgacatgtattactggaataagtattactggaaaactggaatgagtgctctcttttgatcactccacagaatggcatgtatttcacaggagttcgagtaaaaacagcacaatggtgctagtagacaaacaataaacaatgtatgctctgttcacagctgacagtaattaagacaaaagctccattcaatgatatacatgctttgttctccagcaaaagcttgtgcttttcacacaaattcattacaagaaccatgacagattgaattgttcattaaaaaaaactagaccacacaatataatcctctgtccaacaatacaacttcccaaacaaggcagattcaacttccaccagtgcaaagaaacacttcaaactccagattcaacttccaccagtgcaaagaaacacttcatacttctcatacatcttcttctactttgctgaaaataaaatcacagatcaaattagtaatatatagagagagtttacataaattgacatattcaaaataatcatattatatttcaccttaggaaaattggacaggttcgaacagtgtgcccatggccacgacaataaccacaacgcctaacacgcttctccatgaatcctcgtagtcttttttgttggagctcctttaggcacaatttccataggatcatggaccttatcatgactctcaatgtctgtacgtgaactttgagctagcacatgaccacataaagtcaaatctgagttgtttgtctcacattcatcagtttctaagtctaatttttctagcatctccatcaccattaaagtagtttccttagacaccgaacacttgaaaaacacttctgtgcccatgctacgcagcctgcgatatctctccatctggtctgaccatgtatatacttcgccatacctatcagaaggaaacatgtgtttcgctttaattgtccacctacgcactatgcatgcttcaggaatggcatcgagcttcaaatgatgcataattgcaaccatatgctcacatgggaggcattcacgatccatttttctgcatgtgcaatttatgctcttcattgttgattccatatatgtacaattcaagatttgtagcatctcagaatcacctttcatggaaataacatacttaaccaagttgtcctcttctacacaatctatcacctcccaatccatcgacttagcaataaccaacttcaacttcttaaaaactgcaggtgcaaatatacgggcagcatctttctcagtaagactagcatcattagaagtgaaagggattgattgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 31784 - DNA, 852 bp, Oryza sativa
ctcgttaagatcgcgaacccgttaaccacggggaggagctcgacggtggagggggagaactcacctccgtagctccgctggcacttgaacggttcactgttggaccatgaggaaacgagcttgagcttgccagcggcgtcgggcgcttgaggtggccgacggcggcgggcgctgggggagaggcggagaccagcggcggcgggagctggatttcccagcggcggaggacgctgggggagaggtggagactggtggcggcgggcgctgggggagagtcggagaccggtggcgtcggccgctgggggagaggcggagcagcatcgtgtctcgggtggccaggtggggaattgaggagtgagtctcgagaggactagggtttgcagttgcacagtatctacttgtggcttaggcctttttattgtattgggcttttgggttgtctgatggagtcctggctcgttaagacttgcgagcagctcgcgagccagctagctggctcgttatatctaacgagctaaaatgccagctcggctcgttaggaaattcaaacgagccgagccgagccagtcacaagcggagcgaactaacgagccacgagcttcctgtccacccacgatgcgatctgcgccaaaccccccgcaaggccgcaaccccgtcccctcgcatcgcgttccatctctcgccaaatcgtcgtcgcctcgccctcacggtcgcgcttgaagtctgcaatggccgccggaccaggtcaccatcacctcgccctcaccgtcgcaccgctgccaccgcatcccccggttcaactccactgagatcgacttctccctcgtctgcgccgccaccaacccgtcgagg

SEQ ID NO: 31785 - DNA, 595 bp, Oryza sativa
caggaagacgcagccggcatggtaccaattcccgccaggccgaagcagctccctcgcagtggcagctgccccagcatcgggccgagcaagctctcgctgtcgtcgtgagccccagccaaggtggtggtcgcggcgccgctggacgagctcacggcgttctgcgggggctttaataggacgagtgttgcagcatgaggatgtccagcattagtgtgaccgacatggatgtggacaaccccgttgagctccgcctttgtcccattgagcaccgcttgcctgcgcgccgacgacgcccaaccgagccggcaccacctcccgtcctactctagcaccacctccgccgcgttgagccagccccgacccttgcgcacgaccgcgtagcgcttccccagccgaggtgccgcaccggactgcgcctcgccgtgctgccgctctcggttgaagaaagaggagagaaagagagagaagataaggaagaataaagaataaagaaaaaaaatgaaaggtaaaaccgtacttacatgggtgtttctctctcaaattccatcagatataataaaataatccgacgggtgtccaagcagctaattactgg

SEQ ID NO: 31786 - DNA, 335 bp, Oryza sativa
ttttgacgggattgagcttcggcatgtgcccagacgggataacatgattgccgacgaactctcacggctcgcgtcctcgcgagcccagaccccaccgggcgcctttgaagaaaggcttgcccagccgtcggcgcgacccgaccccttaggggagacggatgcgcctgaccggcccccgaggcctgtcggagtccaggcctcgggacccgaggggagtgctcccaactcccttagattgattgcttggatcgccgagatccaagcatacctcacagataagactctacccgaggaccgcgaagggagtgaacgcgtccatcgcatctccaaacgct

SEQ ID NO: 31787 - DNA, 1789 bp, Oryza sativa
ttgcggcgtgcctgctcctcctgcgctgcctcgcggagggacaggttgaccgccagctgttgcgccgcggcctcggccccctcgagagctcgctcccgttcggtgagcgcgtcctcgcggaggcggagcgtgaactcttcttcggcgcaggcagcctcgtgcgccgccagcgttgctcgcggcctcgcggtccgccagatccctctccacgacgcaggcgcgctcttccagcgccatggcgcgcgcctcaagggcctctttgcgccgccgggacgccgcttcggtctccgccgcccgctgttctcgggcagcggcagcgtcaagcaccccctgggcggcgtcgagcttcttccctagctccgcctcccagctcccgtattgaaggcggagggtgtcctgcgcctcgttcatcacggtggtggcaatgagggcagccccccgctcctcctccacttccttggcgatctccgccagcaccttcttacgagtttcaagctccgagacgtgctggcggtgagccttacggcccacctccaccatggcctccaccgagcgtcgcccctcttcgacacgcgcccacgcggcgtcgagctccgcccgctctgcctgcaggacctccacctgggcacttaacccatccaacaccgtggtgtttgcggcggccaaggcctgcagaaggggctctgcgttcagtagggcgatagaaggcgtggggaagagccgccttggagaggatgccacgcggctcgggccgccgatggaagtgccggactcggggatgtcccccggacccggttggtcctgagcgtcgcccgagggagtaggcccaagcgacgcgcccgcggcctcgtcgccagctgccccggaagttgtcgcctgagtgtcgcctgagggagtgggcccaagcgacgcgcccgcggcctcgtcgcgagctgcctcggaagtcgccatcgcctcgtcctggcgaaatccggcctcctcccgagcggtttcctcggcctggcgagcccgggcggcctcctgggcggcctcctcggcttcccgtaggcgatccgcggcctctcgccggtcagattcccgcctgagggcctctgcggccgccggatcctcggcctcagactggccggacttggaatggcgggagggacgcgacgggatctcgctgacaccaaagaaaaaaccagaagactaacaagatgggtgagtgaaaactcgcgttgagagaatgaatacagccacgatgggtgagagacgaacctgcgagggggtcggttaaacgaccactttggaggggaaatgaggtttccccgagatggttctgtctcccacatcttacggggccgcttcttcttgcgctccccctcgggctgcgatgttggcgcggccccctccgggcgcctgttactggcacgcgccgccccgccccctcggggaggagatgggggaggtgttcctccctgcttcctcttcccccgggcgtcggcagggcggctgctccccgggcccctgtcgcgggacccagaagcacgaccccctctcggggtagattgttcccccctgcggctcccgcctgcgccgtcgtggccctttggagctcgctcctctgaggccccgaccgccatcataatggtcaggatggaggcgcggtctggatcgctgcagagggggaggattccttggggaatgagggccgcctctacggagttgagattcagcacccgttggaccaatatcttgaagtcctcaggagcccagtcccatctcactccctggtgggtcctcgtgaagt

SEQ ID NO: 31788 - DNA, 1150 bp, Oryza sativa
ttacaggcaagatgttgtgtgaagaagggcgagcatgtagattgctaagctgacacgtggtggacaagaatgaccgtcgtgactggtctgataccggtcatgttgtcagcagccagccccgattccacgtcgcacctgctcccggcgaaagtggaggtagttgtgggccgtctcatcagaaggtgactcggacggcaactatacaaatctccgtccatttatgaaaagggggggggtaagtccccacaaaaaagagagaaatggtgcatgtggtgtccccttaagatataaaaggaggaccttgcccactgagaggggggactggacttttccagattagaaacccagaacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccatcaccatataatctttgtaatccatgatatcgtgtgtctttagtcaatatttgacaaatgcttagcccatgctaatttagattcatgcatattcatatttatcaaaatgctttatgcttgggcaattaccttagggaaggtaattgacatacggcatgtggagacatgagcgccacattgctatgataatgatgagatgatttgtgaaagaaaattaaactaaacaaatgttttcgactgaggcggctggaggacttgggtggtgtccggtaaaggctagtgccgtccctggtcagttaaggaccgagccatgaagttaagcatgaatcgaccccagtacatccgtatttctcgaatgggtatagacctagcggagtagatagccgagcggaggcagtatccctgcatacccgaaacaagcagatgtggacgaacaagcagtctactggcggatacccgaaacggatggccaaatggcggatacccgatacggatggccagagactgacttgtcaagactacaagactacaaggagataaccaaaagaggacagcatggattggg

SEQ ID NO: 31789 - DNA, 271 bp, Oryza sativa
ttattgtactgttaccatacgtgcattgtactaatgtggtttttgatctgcaggtatggctgatcaaaatgatgggcagctgatagacaaggagatcgataggaaccatcgatcgcgacgtcttagtacaagaactttctgcaatgtgctaaagatgcgaggaccggatcaatattggcgtattgatcctcgttgggttccaaggtgtgtgaaaatatattgtttttactaatacaaggtgtttatattttcatgtattaataacttgcgc

SEQ ID NO: 31790 - DNA, 2463 bp, Oryza sativa
  unsure (1)..(2463): unsure at all n locations
ttgtccaaaaattttaaattgtactataccttttatgatttcctatacttttgggatttcggtatttattcgttttcaccatgtattggtttaacataattattatataacttgtaggcttggacatttattaattagaatatactaatatcaccttattaatacaatggcacattggtcgagttaatttggataacaatgtatttacacatggataggtttaatctatttatttcacaaaagtaaattgagacttggtaccatattgatttaaatgtttaattagacattcacattaacatattatatatataaagctcaatttatttgcattaccatttactttatgtgagtgaattctattccatgagagactcaatgaacattataaatattaatgtaaatattctagtggaacgctccttttatatatagaatcatcgtagtggcgattatttcatgtgtagcatttaatatttgacttataaattgatttagtaattaaccttctctttgtattgctttgttgtgttgtgcataaatatttgtagggttcataataaatatcataactttataatttttacgtagttatatagctttagcttaattttcatttgtgatattttatagtttggcaagcaataacaaccataacatccaccatgatgcacaacaaaagaaccaataacatcggcatgatgcaatttatttaaaagtttttgaaagtactttaatttcaggtttcgttttatttgtcgaattttcagggtgttacaaggcggtccaagtcatcatccggaggcagcggtggctgcgcccttccgcggtgggacccacaagtggtgaggctggccatggcgccgtcgccgcgcctctcccctcccctctaccccttcccctcctgtcgcgaggcgctcaaagcggcggagcttggcggccacctgtctgtcacactcggattttcccttcccttaagtttcaaatcactaataaatggcttcaagaatttggtttaattaaccaaaagaaaaccccagttagcaatgcatttaataatcggaattgttaggaagaatttttttcgaattctctttgctctgaaaatcactaacagaacttaaaggataaacatcttcctcatttgcctttggtcgtgaattatgcccaattcactctcttctcagtccgcggtttcgttttgcatgacgaaccgtatctgttcgcgggaccgttttctttccttttctaaaacggcaccgcattgtttttccttgttgggaaagtctcccctctctgccaacattgttgaagaaaagcgaagagaagaagaaaagagaagagaagataggagagaagaaggaagagacttacatgtgggtcccacaattttttatttttttattttgctgagtaggatgccacgtcagcaaaccagatatccatactgccatgggaccgaaattgcatggttttgtaaagtttaagggtgaacatttctggttttggggtttagggatgtcatacaaactcaacgtaaagttaagggaaggatggtgaacttattccaatttgttgagacggctgagcagctacgcttatggcccagcttcaggccgaaactctaccccaggccagcccaacaggaaggattcatgtagccattagctagcccatcaccgactggaggtttttttttttaacacattatagatttggtttcgactatttgatatctggttcattttatcataggcattgtcatgaagtgctaacacaatcaaaatgacaacgaatgtatggctcattttatcataggcattggtgtaaaactggatgtcccatttcgaatttgatttctcagcttcattgtagttagacattattaggcatgtaaaaaaaattgtgactgaaatctagcctttgccaaatgttctgttttgtcttttgatgttcaacatggccatatgtaatagagaagtgaagccataaaatatgtntgtttaggaggcaaggcataaaagattgtattaatcagatgacctatattgccctcgaaaactgcatgccaacccaggaaaactgtagcctatattctgatgattcttgatctgaattgtgcatatacaaatttgtggatctgtagctatgtcatcatggattgatgctttctgactatctgttcaagctagaattctggttatcaatctttctacgtttttcattgaagatgtgtattggttcatgcatatacataaaaaaatctgcacgatatgcatgtctcaggtggttaatattcctgtttactaaaacccatttcataacgtaccgttctcttgcattaatcatgaactggagaaaccttttccgctcgaacaattatcactcaaacaattttttttttatgctgtgaacctccaaaaactagatatgtgagcaagtcatgtttgattcgtttaaaaa

SEQ ID NO: 31791 - DNA, 521 bp, Oryza sativa
attaagagcggcgggctgggcggccgctcgcgtgccacgtcggataggtacagtgcgcgggtagaagttttgcgaaaaaatccttctattttttgtaattatatatatgtccttataaacagtacttgaaggggaaaaatcgcggaaagggactgctctgtaaaataaggaaagaatagggtttttttttcaaaaatgacgcccactaatctaaccccccagaccttatccgccgccgcccgcaccctctccctctgcccgctccctctccctctccgcggccgccgcctcggccacctggatttttcacattttgatccttttaaaaaacttatttcgcaaatagacccctgaaaaaacttatcccagaaatggtcttttttggggcgccagagtggctggcgccgtcatccaacgggacagcgccagcctctctggcgccgtcttcctgccaccgtggcgcacgcgaaccgacgtggcaggaggagcatgctagcgccgccgcctccattcctatttct

SEQ ID NO: 31792 - DNA, 733 bp, Oryza sativa
gccccgtttggcgattttagccgacccgagcccccgagggcaggattgagcacgagtgacctatttcaagtcaagattcttcaaaatgaaaaaacagcacagatacagcctttaggaaattgaaactgcttttatagaaattcagatataagagaaataagaatatgcatatgttgtagcccccggccaaccctgcacgcccgaggggggtgcggggttggcgcgagcccgaaacctgacacccgaccccccccctcaggggtagaagcgacgaaggtgttcgatgttccacgggttaggcagctcagtgccgtcgcccgtggccagccgtatggagcccggccgggggacgccgaccactcgatacggaccctcccacattggtgaaagcttgctcaatccagcacgcgtttggacgcggcgtaggacgaggtcgtcgacgcagagtgatcgggcccggacgtggcgctgattttagcgccgcaggctctgctggtagcacgcggctcggagggccgcgcgccgccttcgctcttccaagtagtcgaggtcatctctgcgaagctgattttgatcagcctcgcaatacatggtagcccgaggagacctcagggtgagctcggatgggagaaccgcttccgcgccgtagacgaggaagaaaggcgtttccccggttgctcggcttggtgtagttcggtttgcccagagcaccgctgggcaactcctcgatcca

SEQ ID NO: 31793 - DNA, 813 bp, Oryza sativa
aggtaaacggtccggagcgtttgagaagcttaaataagggtaacgccttctctcccagcctcgatatgaaccgacttagggcggccatgcaaccggtgacgcattgcacatccctaagtttgctggggggcgcatccgctctatagcccgtatcttctcagggttggcctcaatgcctcgggcagagaccaagaaccctagaagcttgcccgtaggtacaccgaacacacacttatcggggtttagttttatgcgggcggagcggagactctcaaaagtttccgctagatctgagagtaacatttcctggttgcgcgtctttacaaccaagtcatcgacataagcctcaacattacgtcctaattggttacccaaagaaattcgagtagtacgttgaaaagtaggacctgcattctttaacccgaagggcattgtcgtataacaataggttcctatgggggtaatgaacgcagttttttcctcatcctccctagccatgcgaatctgatggtaaccagagtatgcatctagaaaacacaaaaggtcgcaccccgcagtggagtcgacaatctgatctatgcgaggcagggggtaaggatccttaggacatgccttgttaaggtcggtgtagtcgatgcacatccgaagcttgccgttcgccttgggaacaaccaccgggttcgccagccactccggatggatgacctcacggatgaatccggcttccagaagtcgcgccacctcctcgcggatgaaggcttgacgttccggggcctgccgccgcactttctgccggaccggccttgcgcccgg

SEQ ID NO: 31794 - DNA, 1560 bp, Oryza sativa
catcactggttggagccgaagccggcgtagctgactgcgggaaccgtggctcgggacgcctctactgctgctgctgccttggatcaacgccgggtgctgctggaactcgaggacctgctgacgaacggctgcgcgctcgccgccgtcggcatcctctgcttccttaccgcctccccaccgcgacgccgcgtttcgccgactcgccatcccacggtgagccctcgcgtccgtagcgtcctctaccctactattagctagcctcggttcctattttagcgattagcacccatggccgtgccggcccggctgctgttccgccgccggcgaggtccccgtggacatgctatcccggaggctttcccttccatcttgttaggaaaaatggaatcaccatacactgtagaagctttcgcacccatcaatttggttggaacctagccctaccgccctatccccttgcaccccggagctcggccatggcggccatgccgcgccgctcgcccccgcgccgtcgtgcgccgtggctgccggcgggaggtcaccggagattcgcctcatcctccccggccgcctctgtgccggcctcgcgccgtcccggcgtgcgcgctaggcgcatggcgcggctgcctctgcctggcgagaggtagaagacgacggggaaaaaaagaaaggaacgagagagagagaaaccgtgtggggcccacatgtaattagcacacagtaatgctctccctaatggttattagcccactcaatgacatgtggggtccctgttattaaaatctaagaaaacttaattatagattttgtgtccatgacagaggggacccaccggcaattatatgaccggcttgacctcagtcaacagggggccggacccacctgtcagtagcacatcacatttcccttagtagaataaagataaagaaaagaaaataagagtggacctacctgtcagtcactaccacttactgttaacgctgcaataaaaataaatcaattatgaacagtactgtttcacaattattggaattaattcaaatttgaatctttaaactagcataactcactcattttaactcggattcgaatgaaacttgaacctaaatttatctaaaatcaagatctaactattggtaccactttatcaatttaatttgtactgtttgaatttttggtgattttatttgaattctaattgaattcaaatcaaatctttcgcacgtaaatttagattccgaaggagttgctgagttaatcaaagatccgggtcagcaaatctgtgagcaaggcaagtcatcactaatctttgagcatgttggacctattgcgaacttattttgatttaaataaagtttgcatgctatttatatgtgaatatcctactttgttatatgccatacctttgatattgattatccatatgtcggtgacatgggatcaggagtatcatgactagaggtttgaggcagacacaatcgcacacgtggcctggtacccccgagggacgtcgggcccgagggtgatgcgttcgccctcctcttagtccccccgaggggg

SEQ ID NO: 31795 - DNA, 1151 bp, Oryza sativa
tggggagcgtcgcctcctcgtctacggcgacggcagcacgccccagggcgcgctccaagctgcgggcgcgctcctacgtcacccgcccatcgcccatgacccggagtctccagcccaacgttggctggacgatgtggccaaattggtcatgactgcacggcagcgcctagatgctggtgggcggtcctccgccaccaaggcctctggtgctgctaccaccggctccgcatcgtcaagacggagggcgcggcgagcggcagccgctgttcgccattcgaccgccactccttcgtcaacgcctccgacccgggaagatctgcgtggggaaccggatgctcgcatcagtatcgagcgccggcgtaatggccgacgtgctccccacgcaacggagggcgcctcctcgtccggagtgtcacctcaccacggacgcggggatcagccctccgtgcccccggttggtggtgtcttcggaatgtccgtcaccacggacgcggggatcagccctccgtgcccccggttggtggtgtcggctgtagagcctttgtggcgagccttcggaatgtccgttggcccccaaggtgccggcccaccatcgccgaaaaatatgacgggagcgtcaaccccaccgagtttctccaggtctacacgaccgggatcgaggccgccgggggtgacgacagggtcatggcgaatttctttcgcatggccctgaaaggacaagcgcggggttggctaatgaacttgccacccgcgtctgtccactcttgggaggatttgtgccaacagttcaccatgaacttccaaggcacatatccgcgcccaggtgaggaagcggacttgcacgcagtacagcgaagggatgatgagtcacttcgctcgtacattcagcggttctgtcaagtccgcaacaccataccatgcatccctgcgcacgcggtgatttacgcgttcagggggggtgtgcggcacaaccgcatgcttgaaaagatcgcctccaaggagccccagactaccgcggagctttttcagctcgcggaccgagtggctcgtaaggaggaggcatggacctggaaccccttcggttccggtgtggcagcttcggccacccccggatccgccgctcagatagggcggcgtgacaggaggaggaa

SEQ ID NO: 31796 - DNA, 954 bp, Oryza sativa
cttttaaaaatccggcggatccggatgcggatgcggttagtatgaggcggatgcggatatggtatctctaaaatccgacggatgcggattatccgatatttttgtcggattatctgataagccgtttgtcggataatccgaaattatcaacatatataaccactctatctattgcatataatataagttggtacatccaattccctaattcatcaattaacatagattttttagtctaaggcttttatcgtctcatgtcacactcacgtaactatatttttcatactatggacatcatgtattcatattgtttagcgcttaatcatgtaattattacgataggtcatttactgattattgtattatttttccttggattgctaactcgatgttgcattgattgcatatacacgtaacatccgataaatttaatccgcttccgaaccgattccgcaccgactccgcaccatttccgacatccgaaacaatccgctctgtatccgcatccgtacactatccacacccgttctgaatccgcttaaaaaatatggtttaggatatggtataaccactatccgtccgaatccgcttcgttttcatccctagtttcactcgtgttcctgctaatttattactatatgaaattttataggtaaatcaattttaaagaatctgtgcgattgattttattattatttttacatttaaacctttaaatatattagatatattgggctcattttttatcatcgctaaaaatacagaaaagaagatgaattactctcactgtatatgctttatttgctacatgcaaacattctaatttatcatgtaattttctgaagacgttaaatatgcaattgaaaagaagccaagggattattttgtgaaattgtactgtttggacagggtatggacgataagtagcagttttttttttctcacacgcacttt

SEQ ID NO: 31797 - DNA, 601 bp, Oryza sativa
cctctttccatttttccaagaatcggagcaaatcttaaggggtttctatcctcgtcgcctctttccattttcccaagaatcggagcatatccgctttgtatagagcttggaattgagccctatcatcgcctctttccgtttccccaagaatcggagcaaatccgcttcgtattgagcttggaatcgagccctatcatagacaagcgaacctagctagaaacatagggtttcgtccgtttcgcttggaaaaaaaatcgtgtagcggatgttgacaatgacggagaaaaaatcatccggaaaccatacgtattttttaattaggtatagataggcttgtttaaaggaaaaactattcagcctagctcggtccaaaaaaggactgcaccaggcccatcctgaccattttcatttcattgatcgatgaattttctttttttaccaaaacattcatgaaataaaggagcaatgctgcaatatggttcacatgtatgctgatacatgttaccaaacaaacaaaatgtagcttactttatttggctttagagatattctacgtatttctagtaaacactgaaatatcactatgtttatctacttcatt

SEQ ID NO: 31798 - DNA, 1745 bp, Oryza sativa
  unsure (1)..(1745): unsure at all n locations
tttcacaccctacggaaagcaaatatctcgcacgaaatttttgagtcaaaaattgataaaatttcaaacattcttttgcaaaaaagtatgaaaatcatgaaatttttggtatctcagaaattcagataaaaaatgaaaatgggcaaccccatatatgtgtcatgtttacaggaggcagtgcaaaccttgttctattgtttaaaagatatgacaaataaggacggagccttgggttggtctttgttcttgatcgtgtgccttcttcggtcctatagtcttctcagagattatattttctatagtactagtggaaataggtttagcatatcttcggtcctatagtcttataagagattctggtatatctttaatactttattcttattgtaagactatatagttgaattaatagaattatcttctaaagtgttcataatttatatattgctttagtagttatataccttattaataagatatacttcatttatatatttcacttgattagattagtcgatctatgctacggcaacgatcccatgaccttgatgagttgctctaactctaacttgtccatccgaatggtggaagtcctgaggagttagtatcactatttactagcataagcatagtgcttaggttagataaataccgtttgatgtgggtatgtccgacagaaagtgaggtaggcagcaggtggtgatagccttgtccgtcccttgtattcatccacgtccgggtatgatataagagtgcgtaaatgctaggcaaaatttgctacaggacattcaaaaaatatgtaattagctaagagacaccataaaatcgtgaaacggctgaaagacactccaaaaatcatgtaatttgccattggacactttcactattattttattattttcggaacaaatggagggacaaacaattaaaaaggaccaaattgcccttgaggccaaacttaggttcaagggtggtggcgatggccttgaccggtggcgagcgtcagtggaaggcggtggaagaagagcatcttgcagcaagtgccaaagggggtcgagatggcgtccaggtgagctaccatgctccgcgcggcgaagaagaggaagaacaccaccttggggagcgagaacgcccatcacaacgtgtggtaggagcgcgcgtcggggcggaagaacaacgccgagtgtagtagcagcagccacgagatccacggcgcgaagagatagttcatggcgatgtgttgcctgaactcgatcggcgcgcacggcggngaatcggaggaggcacagcgccgnctagagcgcgcacagtggcaccagcttgagcagcgccagcgacaagagcagcacaaacgccgtgaacggcagcgacctcgcactaccaggcctagcgcccgctggtccgtcgacaagtcgctcagcgtctgccacaacagctcctaccccgacagcgccaggggtccacgtaccatgcggagttgcgggacagtgcaaggacatcgggacacgatgctctaccatgcggcgctgccggcgcacgtagtgaccaaggggtccacgtacacgagcactatcatcacactaaacgagcagcaggaataaataaaaagacagtgaaaaaaagaaaagggcaaaattgacatttcacatagcttctctctcctcagctaggtgtatatattattttattgctcatagtgtccatcaacaaattacacattttttatgtgtctttcagccgtttca

SEQ ID NO: 31799 - DNA, 722 bp, Oryza sativa
tttcagttatatgtttgctccctcagttttgctagatagcttataggcaattgcatgtaagattatcagtccgagctatttatttttgttcaagggagccctcatatgttgttttaggatctcataggctcaacctctgaagtatcctattttttccaccaagtcctgctagtgctgcactgaatctatactggttgataggaagcatgggtgtgtgctcatgttaggctcaacctcatcgtttgccactagtttgcctcattttctaagctagggtctaaatggtgattttcatggtccccaaaaggttttagcataacaatacgctgatttaacatatgctggagtagtggaggttagcgttggacctccaaaattgcaataggctgtgatttgaaatgctgttctagatatgcatgcttatgcattaaatgggaccgtaggagagcattgtgtgtggccttgaagcctcaattatttgtagcctatggggccacatgcgtatgcacacatgtgtgttgtaactgaacaccaactgaatttcactgtgaacttaaaactattataggcacatagaagcccaccaccacatacgtacctcacatctgcattacttcgttcaaatcttcctcatcattaagtaagatgtggagatactacaaaaaaaatgtggattgggtgatgactccaatatagggcaatttgtatgttgggatgccatt

SEQ ID NO: 31800 - DNA, 1705 bp, Oryza sativa
tcccactccatcatcaacccagcggtggcatcctcaagaggtgtggctcctccgccgtcggactcggaagcagtcgaactctcttgcctcttcctccccgtcgtcaatccggcagcagtgggggcggccttgagaggagaggatccacaaccaccagactcaggagtggctggcctctcttgcctttccttctttatcgtcgatttggcggcaatagcagtagaagggctagatccaccgtcgcgggactcgggagcggcaacgggggctcaggctgggcgtgatgaggacatcactagctcggatatgaccatggttatcttatgtattcatcaagcaaaggtgcatgctttctaggtgggatttacgtgttatatattggaacaaacattattgtattatgagttccgtgtgttctcatttgtagaggtgcttgcttggtgaaagggaaagataccgagaacaaggaatacatggatgatctaagaagttgattgaggaagaaaccaaaaccttcctcaagtctactccaacattaccatgttatttttggttcataaaaggcaagagatgaagttctgcacgttttggattcaaattcgggcctcctgacaatattaactttaaacaaacctagccactgatccagaaggaccctaggggtccatgagttctttttggaaagattatagagtctgctttcagatggttttagtcccacatcaaaattcctattgagctatagggaatatgcaaaacaagtcatgtacctcatacaatcttagtctgatttgggcgttgggacttgtacttgtcgtgggctaagcccaaggggtggaaaaaccctaggatgtctctaatcatatttattccatagccgtcataatttagagtcgggttttgcttgaattatttctggtactatagtttcgatgttcattggtttgtggaacccaaatttcgagttcttaatcattcatctgcatttctattgcaatattttttgttcttgcttgtgtctttgattcacacaccgtgattagccttctcgatgaagtcaattgggtttcggcatggttgataaccagaggaggcgtggtgctaaaattgcatggttcagatcgtattgattggaagccaaatcgtgtgtgtcaagtttccgccaaattaagagttatcaatacctatcagaagattgagacctaattagttaacgggaatccactgccagcgcccacaggagcgacagatccggcccagtcccattggggacaccgggaaaggtggtggcaattttgactgcgacgatgacggccaacaacacgttattgggcagcaaagactagtccctccactccgacgagggaggcagaggagcttgcttgagtctatggcaatattcatggtgacgacgacggcaagagtacagcggcggcatggttggattgggtaggctttctggattttggtttttttgaaattcttattttagttttgccatttttttccatgcagttggcataaggagccacattttcacatgtggttcagctggccgcctggaaaattactctctttcgcagactcctactggtaggcgtgcactttgtcacaccctgaagttcttctcccaagcctaaatcatatttataaatgacctcgagaatttatctgtgtaacagcaaaagagaaaccctaatttaat

SEQ ID NO: 31801 - DNA, 449 bp, Oryza sativa
agatcggtttgtaagaccccaacttgtaagcttaatctttcacctgcaattttggttgtattctaccttgttcttgtttgtgttcttcgattggtaaatagggattagtcttctcggtgaggtcatccgcgtttcgacacgggtgataaccagaggagacgtggtgctgcgattgcggggctcaagagcatgtttgttcaagaagccggatcaatttgtgtcgcgactccgctcaaatcgttggttatcagaacctttcagaagattgggaaccctagtacacatcagccagtgttgcttttatatatcaatatctcacgagtataatatttgaaatgacctaatctagtctttgtaagcttaacagtatggagctctcacatgtgatcgacgtcttaatagaagtgcaacattacacagatgtaatatgttccataactactaatccg

SEQ ID NO: 31802 - DNA, 874 bp, Oryza sativa
aaggtttttctaaaaccacaaataaatttaattttctaattcatactagtaattaaaacttgactaatcttaaactaatgactttctcgttttatgtgccgacctggtaggccttgagccgtctggggcctcgtatttatgggcctcaataactcagtacggcccactagcccattggaccaggagtctcccgtacatgcggcctgatttgacccaatcccgtgcggcggcggccgccggcggcacgggagcggcgccgcgcggcgggaggagagcgagtggctgcggccatggccatggccggcgagcccgcgtcgggtggcgtcaacgcgggtgctgccacgcgagggagcagacggcatcgacaggaagtttgccagcctagggggaatcgctctcggctgaagcatttggagaagtagcggcggacgccacggcagccggctgaggggggaagacggcggccctcacggggttacaagtcgtggcgccaagctcccggtggccggtgccacggtgccacctcgtcgcgagccacttgaagccaaggtatacttctgaagttctgatttggatttatattccaagattaactactaggacttggtcgaagtttttagattgaggatatttttcagacttttaattggtggtattgagtgagcctgaagaaaatgattgaaagtggataaaaagcgatagtaaataattaattttgtcatcaaagactttgttattcccatatttcccctcaaaaaaaattgtcatgccaaaatatattgcacacaatcacgcatgttatgatcctacactccatacagttgtcttgggagtgttttttgatatagcctactccctccgtttcacaatgtaa

SEQ ID NO: 31803 - DNA, 441 bp, Oryza sativa
ccctcggctgacgcaataaataggttttttaattaaaatttaaatgaagaaattcgtaaatatccatttaaagagcatataaacttcaaatggccatatcttggccatttgaactcggaattggaccgttcaagtctctaatttttccttaagatgtaaagaacccatttttgtgctttgtttctgctgttatgtggagttatttagtgtaaaagcctttttcttttccgttggtcgtgtagacgctgcagcttcggaagatccgctcttcgtggaagtcgaagccgtcgtttgggaaaacgagcaaggcaagacacatcatcttgatcatattgaatcccagtttataaaattatgttgatttaaattattgcattatcgctttatttaaattcccgcgttatcactgttttacttagccatgcctatttacctttgtta

SEQ ID NO: 31804 - DNA, 26742 bp, Oryza sativa
  unsure (1)..(26742): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgttgcgtaaatattcaaaaataagaagcttttcatctccatgaatacagcagccaagaagcctaactagatttttgtgctgcaatttgtcaataagaacaacttcatttgtaaaatgctctatcccttgtgtgcaacctgtgttgagccttttgacagcaacttctctcccgccttccaatttcccctgtgtaatacaatcattttaaatttataaaatattgtaggattctccagtgtttgtgattgtcagcctgaattgtttaccttataaaccttaccgaaacctccttttccaagaatgttggaatcgctgaaattgtttgttgccgcgacaacgtattcaaaattaacatgtgaaaattctaaattctgctcaattagttcttgagatctaaggtttcctagcagcattctgttctgatttttgttgtttctccgtttgcctaataacaccgatgctgtcagtacaattacaggaagacatcatactatgaattcataagtaacggcccttgccataccttttgattgccatttcctgacaaggtatatgcatgtgagcatcagcaggcatggaataattgtgactaaaaccaccactagatatctgttctttttcttatcttcagaagtgtgtcctatcaagagaagtaaacaaaattatgagaatttctaaaccataagtatgcatggatgttgcttttaatttgatgtgcagactatctaagattttgttgtctctgcaggggaagaaatggtgagcataccaggagagtcggctaaccggaggtataggttgtcaccaaggcttgccctcgccatgtcagcaagatccccagtccagagcaagcaccttgactgatcggacatggtgtcggctttggtcaagttgccataagcataatcgtaggccatgcatgagcagttgtggctgcacttggccatgcactcctcgaagcttctgttctggacttgcaagaacttgtcagggagcttcattccagacatggtcacgaaatggttcctacctccgcatcccaactgttgctttcttcgacatcctctcgaagagttgaaatcacttggctcgaatccatcaaggcactggcatctggggatggccaatgtgaagtcgcagtagccgaatgggccacatgaggcgtagagattgcagtcaccagcggccgctggctgttgagagatgactgtccaggacgatgagctcccgttccaactcaggaacctcatgttgcccatgtagtcaagcttgattcgtgtgtatggggagccatcagaggttgtgtacataatgtacaactcatccctagtgttcacaagtgatttgtacatcaaagtggcaatgttgctcccgtatgcttcaccggacactaacactctattaagtgaaagtgcaatgaaacggtaatatggcttggtcccgtgccagatgaaggcctgaaggtttgatctggggtcgctgtggtaggagaagtccccggtggatgggtcattcggtcccttccaagcgacaagtcgcatggcgacttgtgccttgtatctcaggaaaaacttcttgttggggagaagggtatcagttgggtgatcaaagctttgccatgcggttgtattgtccggcagccgaagaaccaagtttcctgagtctagcagcactgcataagctcggtcacctctggtgttgatgttggccatcgtcgttcaaaaggtgtggccttctaaatctgacaatacaaagttagaactattgctgatggcgagcatcgcagatgaaggggcagtgatcggcttgtcacggttggcaatccaaacgtatgtgcgctctgggatgttgttgtaccatatgccgaggaataagctctggttggaagttgctggggagaagaagccgagtgcgaaaaccccgttctgggagacgagcacgtcgccagggtagagtttctttgcttgtgtcagctgatcatcgcacttgcagaatgagaagatgaaaagagggaagcaagccataccattcatttggtcttgttcttagctttgcctagttgcctgcaaagcgtagagaaatagcacacacacatatgggtgtttaattatctgatgcatacatgattctcctgagtcttgactcttgactcttgaggagcacgcggttggaccaaaggaagcagcgtaataacgaatggccgagactattctgtccgtcgagataaagttttgctacgaattcaaactgaactgtggggagactacggtgaagtggcctgacgagagcataggcgtagctggtattagtactcagtgttgtgatgctaacttgtgcagtttgtggctggctggctggctcggtggcaccgggacaacctcgcaactagaaatatcgacgcttgaacgcttgtgcacaacagaaaacttactacaactatttctgtagacgacaacatgaaggttggaggatcaacgatttatgctcaagaacaattgatggagactactgaaggatcaaggaagttgtttgcgttacgcaaggagacgacagggattaccccaagagactttccttcttttttttttttgtaaaccattgaaaatgaaccatacacccacaaagcaatcatattcctaggttcttgcacaattgatcaagtggtgaattctacagccagctaaatctgaaattaaacatctaacgtccttgtagtgtggtaagacttatactgttcacagacttgttggcatcctctcttgcccctcctgccatgcaattccttggcacaaaatatgcaggttgcttaggagtaggaagtgttgtggcttcattctcgagcatggccacaactgatgacatgagtggtctagcatttgggtcttcctgaacgcataacagtcctacatggatacagagcaaaaactcattaagtgaatatatctgcagaataattgagtccacgagatcctctgcctttccattcttccacaagctccatgcctgaaccaagggaacaaagttcctaattagtgcaaaatcctagctattgaaactttatgcattttgatatttcttagaacttacacacttacacaggctataagatttggaaaacccattataagatgaggagagcttatcttagagccgcttataagttccaaaactaaaacaccaaagctgtaggtgtcagacttgacagagaagatgccttccattgcatatcaggagacatgtaaccactatatgaatcatgtcaccaacgagtgtaagttatttaagtgttttccaagtatataaaagttagtattgtaatcataagtagtgcaatagttactcactatgtcccgactacatgtctagtgtttgcttgatgctggttgccaccaaagatccttgtcatgccaaaatctgatattttggggctcatcccctcatccaataaaatgttgctcgctttgagatctctgtgaattattgtcatcctcgaatcttggtggagataaacaagtcctctagctactcctttgattatgttgaaccgtgtttgccagtcaagcatagacttttttgaatcatctaccgtgaacaatataaaacgatacttatagttgttcacacatggccttttggtaacagtcttccaccaaacgtggaaaaagaaaaggtaaaaaaggaatatatgattaggacataccaaaaaggaagtaatccaagcttttgttgggcaagtattcatatatgagaagcttttcctctccgtgaatgcagcaaccaagaagcctgactagatttttgtgctgcaatttggcaataaggaccacttcatttctgaactcttctactccttgtccagaatgcttgctaagccttttaatggccacttctttgttaccgcctagcatgccctgcacaatttaatcactttaatttttattaagaaagttcatcgggatatacacttgttcacacagtatcatggatgtatggtttcacccctgaggttctatatttgattcttaacacaatcatacattcttctcaattatttaacaccaagtttgttggaacaaaatccaataagcatggcaagggcttcccttcaatgggagggaggccaagcttggtcctgtgaggagatgagaggaagaggatgaaggatgagagccctttcctcgaatggttcctgtgtcatctagttcaattctgccagaacaaatacggcccgctaatgcccacaaggacgccaagcccatgttgacaagaacccgatttcaagtcgagatcaatgggttacgggtgtgtcttcttaactcgtttccggtgcgatggctcaaagtttgggtaccgaggaacaaaatcgatggtaaataatcaattttatcatcacaaaaaatgcaattgtatgccacatatgttacggtcctactcctctccaaatatcaattatacatgtttcaccatgtgctcctaaaggaagcacttagcgtgcagaaaaataacataaacacctaccgtccctctaataagctgatgctattttcacctgtttgtctgccttcaaaggccctatgtgcaaaatacacaggctgtataggagctgaaagcgttgtggtctcgttctccaacatggacacaaccgaagacatgagtggtctattatttggattatcttgcacgcacaatagacctatttggatacatagtaaaacttcagttggtgagcaactcttagaaatggatgagtccatcaaatccatcgccctgtcgttcttccacaagttccatgcctgaaacagtggaatcaagtccatataaaattagtacaattaatctgaattgtagagataaagcattccaccatacttacataagctaacaaattggggaagtccgtcagccgaggcaagctaatcttcaggcaacttacaatctctaagagtataacaccaaagctatatgtgtcggatttgactgaaaaggcgccatccattgcatattcaggagacatgtaaccgctgcttaatgatttagcagtaagtaaagattcgagcaaataaacattgtgaacattaatgcatgaatgactcactatgttccaacaactctgttagtatttgcttcatgctggttgcctccaaagattcttgccataccaaaatctgatatcttaggactcatatcaacatccaataagatattgcttggtttgagatctctatgaattacagttaaccttgaatcttggtggagataaagaagtcctctagctactcctttgattatcttgaaccttgttggccaatcaagaacatatttatttgcatgatctataagaatggtaaactatgttattattaagtatgcagccaagtttctttggatcatatgataagtttatgcaatactgtagtatataaatctgaacagtaccaaaaatgaaagcatccaagcttttgtttggcaagtattcgtaaattagcagcttctcatctccgtatatacaataaccaagaagtctaacgaggtttctatgctgcagtttggcaattagaacaacttcatttctgaactcttctgctccttggccagaacccttgctaagccttttaattgcgacttctttgccgtcatctagcattccctgcataatttaatcactttattttttttattaagaaggctgttcatttgtaaatgagtggttttacagttcctaaagactgaagtctgaaaaggtactacagtcttaatgttaatttgaggtacctccatatttgggatggtaaaaatctctctgctaatttatcagtacactgcaggggcattcctacttcctagttccttttttttttgacatgctacttcctagttcctagttcctacagcatactatacggggtcacgagaccctaggtaaaatttcaatctctagttgttttagcctatattaactatattattagttaaaaattatagtattatatatgttagtttttgtccctattgtaattctcaagatagaacttattttgtaccttgtaaaccttcccgaagcccccttgtccgagcatgttgtcatcagaaaaattgtttgtggcagcagcaatttctccaaaactaacaaacgggagctctaaattttcatctccaagttcatttgatgcactcaagtatcctagaatccctctcttctggacaaccttattctgatgacgtttgcctgacaggactacaaatatatatagtgtgttaatattagctctagtaggagtagaggatataagctgcgagtattacctctgcacttgtataaccatacaaggaatatgctcatcagcagaagcaaacatgctgctgtaagtgggagcataatttttaccacagtcctcttcttattgttaactgaatgggaagaaaattttcaccgagaaaaccataaagtaattaattgctgaacccattagtttcaggcaaatgaatgcacatgcgtgcaattttgtgatagtcatgtgtacctagttcagactttgccaatctcacatgcaagtcctgccctttgtccacataacgaacatcaaccatgtcgccgatccacatgacgcagccgcggccgctgatgtccgcggcggcgtaggcgacgcaggaacagttggccaagcacctcgccctgcactcgtcaagcgtggcgcccgtgtccaccgtggcgttgtccgtgtcggggagcttcacgccgcgcaccggcacgaacccgtccgtggtgctcccgttgccgcactccagcggcgcgttcctccggcacccaccggaggtatccctcatggaccaccgcgagggggacaccgggctgaaccccgccatgcagctgcagaagagcgtcgacgcggtgtcctcgttgcacagcccgaacgcgccgcacttggcgtagtcgtcgcacacgccgcgcggtgccttcatgtacgggatccacaccttgctgctgggatcccacacgaggcgctcggtcacgccggcctcgtccagcacgaggcgggagaagggggagccggcggcggcggcggcggtgaagacgtaggcgatctcgtcgggcgtgaccaccacctggctcgagaagatggattcgtacgacgccatctccgggacgccgctgaaccactgcccgttccatggccccgtccggtacttcttggcgccgccgcaccacgtgacgcagtccgggagccccctcgtgtccagcacgcggcggcagtctcccgtcgccgggtcgtcgtgcgcgcgccacgacgagaggaaccacgcgtcgccggtctgccggttgttgccgagcctcatgccggcgatcagtgtgttcgacgggtgatcgaacgactgccagatgaagacaccggtgttcagctggtcgcgctcgcgcacgacgaggtttccggactccagcagctgcgccgccgtcgctgatgaagacttgccagtcgtgttcgacgaccaggcggccctgccggagccgtcgagtaggacgagcccgcccgcgccattgttaaccagtacgccggcggtgtcgttcagtgggctgtcacggttggccacccagacggcgtccgcggactcggagaaccatatcgcgaggtatctcctgtttggcaagccgagtgagaagaagcccagagtgaaggagccaccggccgacacgagcgtgttgccgtcagtgaggttgcggccattgctcagagtgtccgatgcaacgccggcggcagatgttccgagagtaaggaggaccatgaagaagaaggtgaggctaaggtggaaaatgttggcggttgctgcttccataacgggtgagtttttcttgcacgtccttgcccagaattgttcacggactacagtgcacgggaacaggttggcctcacaagtatcatacatacacggaatctagtgcccgtgtaggaggaattcaaacgcgttctaacttccaacacagtaattaatatcccacgattgactagctagctagatgcatgagtccatacggataagttgcaaagcagcggaaactgtagagaagaaagatgcatgagtccatacggataagttgcaaagcagcggagtttattgcatgtcagttagatagttatgaaaaatttttaaaaaaattgacaagatagatcaatatgtattatatcactccataaacatacaagtttaaattcaacttctacaagctgtaacaaaaataacaaatttaattgtaaatatatatgtaataatttgagttttgtttgttatttttgttacaatttgtagaagttgaattttatcttgcatgtttgtggattgatatattacatattgatctatcttgttcatatttttttaatttttttcataaccatttagatgacatgcaataaacatccattcgagctgttaaaacagttttccctatttaacgccttggaaagtgcgcccatggtaatttgattctgaatataacgtactagccaagttactatgatagtgcacacatttaagggtgttcaaactactcacaaaatcaaccttttcaaaagttggtaataccaaaactttgataagttgacaatattattaaattttcatatgcattaccaatgttccgtaacaaactaaatgaatccatatatttatcgaatttacctgatatgaattaaaatggcatcaatataaataaacccttacacgtatgattggtttcaaagtttatagtatatttatgtattatctctacttaatttgtttttcaacctcaaatggaaaatctgattatttgatggaaactgtggctttcctggtgtcagccgatcatcagttcggcgaccgagaccagccgcaggagatgagaaaagtagaccataatgaaccttaggatttctgattcgtttgattgtcacgactcatgagtcaaattatatcataaattcataatgcagatatgaaactgacttgtgtagttagagtttaattccattgctatcaacacctttggggattggaagaaatgaagctgtttaagtcttgattcagaccaatggaaatagacggtgaagggactagtcgaaagctgaatatctcatggccagttcaactgatcatgataaagttttctttttttaaaaaaaaaaactggtcatgatacttccaagtcttgtgacaacgctgcacgaaaaaagaacgccatgaccacgaatttaggttggactttggagggagcgggcagagcaggcgaaagccaaacctcgcgtctgtcccatggcgtggcgggttctcctaccagcgttgggtagtacttcctccgtattaggttacacaagtcgtttaaatttgttgtcaaaattaaactatttcaaatttaattaagctcatagaaaaaaatagaaacattttcaacccaagacaaaatatattatgaaaagatattcaattatcgatttgacgaatcgaatttggtgtcgtaaatattatactatatttgtctacaaacttatttaatcttgaagcagcttgactttgatcaaagtcaaaacgatttataatctggatggagtagtaagggcatgctcaatgtataaggtctacttggataataaggtaggacccggtattagttatagtgtttgctacaatgtatatgataagagaagacattagcctgggtcccactggtcccactcaattgcatggcatgtgagagagaagatgagagagagaagagaaagtattgctattttattcttatgggtgggcattatgcatatgggtagctcatgttaaagactactatatggactactatcacaatgttgtcatggttatggataccacatacctaataatagttgactaaatctcggcatgacccaccacataccatgtcctatacggaaaccgacttcagatatggggggagttccgaataaggaaagacaactagagttttacatggaaacgacaaggactactcggattgtatccatattggtttccctagttctacttggacaagaggacacctatgggtataaatacaagcccccctaggaggacaggggggacacccaccatgagacgatcaacacgatcaccacgatcgggacgaccacctcatcaacgcccaacacaatccacatacaagcctatatacgccaagacacgctgccggatatcgacttcagggataggcatggctattcccctacggtatctccggataccgtcaggagatacgaaagcgctatctctgatctcgccgggcacggattcgaggaggaagactaccttgttgtcgactatgagtcagactttcagaccaacatgtcgataacagttagataggctgcccacatattgtactggtgtgattatggtgaataagagcaataccggcttcggccaacaggatgtagggttattacctgacaactcaggggcccgaacctgtataaaaatccctgtctccatctcttttacctcagtctcgcatatatcctagcaccaacgatccccatactgtccaaataccgtagtcgagacatcaaacgtcgacagtggcacgccaggtagggggattttggtgctctaggatttcgacgagatgggttcaaacgatggattctccgacaacaagttactcgacaacttcggctctgggagatccaacctgtccaaatacatcttccgacgagatcagaatcatcaccatcgactattcgatcaggcgagatcgaccaagcttcaagacgtcgccgtcgcggaagaccttgacgaattaccgccggaccagggtcaactacacgtcgtctacccgccaatcaatcagctggccgactgcatctacacatgtattaagcatgtatgcggtgggaaccatgtacagtaatgcacggcgtgtaccgaaggcttttttagccataggtatgcttgcatgcgtacataggtgccatctagacgtgctaattgtggagtacaattcaatttggctaaaaggtaattagtggattgacttattaattaatctactaatttcgtagatacattgtaacgctccacttctcgtgagatgttaaaaactaattcggcaaatcctaattgtgaaaaattttgtcctttgagtgcgagtctaagtcgtgccgtggatctcaattcaaatcccgttgttccctctcatcgaaatcaaaatcccccgcctcaaatttcctctaccaattcaagtctccgaaatctaattccgaaagtcaatcccttcctttgaatcctcgccaaatacatttccgaatcccaaaatatccaaactcccattttgtttccttccttgactccttgaacccttgtgtacaaagtatcaaatttagattcaaagcccaaactccaaatctctccaaatcaaaatctttcagcaaaagtctattttgcctcccttgtcgatgggctgattcctctctctcccggcccatcccctcctctcggcccatctctctccctcagccgctccttcctccctcgcgtgcctcgctcgtgcgccgctctgagcgagggtgctcgctctctctctctctgtatctctcactctctccctcgtcgaactccctctccccggcgccgatttcccgccaccgctgttcgaaatccggccgcacccccgcgtcgcgcgcgcgctcgctcgcgaggtggccgaccgactggccgccgccgccatcagcccttgcgccaccgacgccacgtgctgccgccttgcccctactccatgacaaaccgcccgccgccgtcatcgccgacgtcatccatggccctcgccactccatgccgcatgcgtccaaagacgtgaggctgggctcgtgctctcatctttcttcccccccaaaacggaaggagcaaggctccctttcctcctcctcctttcgctttatcccttacgggcaaggccgcctcgctctctcccttgtcctggtgcgggagcggacacagggtgccgctgacgccgcctttgcgccctaccgcgcccacgccaccaccgcgaccatgccagctcgccgcccccaccttgaccgtgctagcccgcgctcgcggttcgattcccaccgcaaggtccaccgccttcgtcgcccaatgcatccacgtcgtcgccgctttcccaccgcccacgaaaccgccgctgtcgccagccaagcgcctcttcacctataaaatcccaaccccatgcccacaatcctttgcccttcaccccgtgctccttgaaacggagtactaccggcttctccctcgaccccggtggctgctcgtcgcgcggccaaccccagagcaccgccacctccttcatcgtctcggccaagaacgccaccgccgcgaccaaggacgtcgttcccacacgcttccgacccctttcccggcgcgcccgccgcggcaccatgccacctcggcatcgtgttcgtcgccgtgcgccgctgctcgtccatgcgccgccatcggccttcctccccttcccatcactgaagtccggcgacgccgttccccgctcaacagtgagctcctcggctcctccctcccgttggcaccccctttccttttccgcatcgtgtagctctcgccaccgccgcttggcgccgctgcgtgagcagccgcggcgagcttcgccgatgccgcacccggctgtgcgccaccgtcggtctccctctcttcaagcccgctcgccattgccttcctcgggaccccctcgacctccccaatcctttcctgtggccgccacctcagcggccgggcccgcttgaccgagtcagcggcgacctggttagccgcctcctcagcccctcccgctcgtgggcttggcccatcaaccaaccttcccttcggcctgatgaaacagaaaaagttcacttataatccctcctcccgagcccagtacccacacctaagagctaaagtccatctttaatcccttccccaaacacagtgaccaaaagtccatatctgctccctctcaatttactctctcttaccttcttgttgaccccacttgtcaatgagtcaaagatattctcgagaatatcttttccaatattccacaaatatttccctcttctagaaattcaaaaatcattttatcttattccatgagttaataaatctttttcccttgttccataaatcatttccattggtcccacacgtcagtgactgtcaataatattcttgagaatattatttatataaatttcataaatcaatttccccttgttccacaaatatcttccttcgcccagaaattccacttaaacttccaaaattcatatctccctatccgtaattccgattgactccgttcaacttccaataattccataaaattgagatctatttaatggcactattatttagtctaaaataggatcttttcttggtctttgtttaggttttaattgtttgcgtacagttgcggttgccggattttcgtcgatcgcgggttttctcgaagattcgtgaagaccttgagcaaggcaagtcaccctttgaccaattgctcctataattggaaaatcattattattttgtttgcaacttgcattagtagaatcacacactcaacttgattggcctcggtttgcgtgccaaaccgacggacctaccaagtagtcgcactaattcctgtaggttgtactaccctgatttcctcgtcgctccacctttgtggtacctcggtatccgtgctctttgagcgcgaataccaaatatcccacatacaccgttgtttgtcgaaaacttgggaaatgggtttgagaagccttgaaagcccgacatgtggcgtcggtgtgtttgaaaataaaatggaatgtgaaaactcgcgatgcgggggttgtgcctgtgtggcactgtcccgtattcgcatataaggaccgattcctgtgggaaattcatccgagaatataacaagtgcgaccacacgggtgcaatgggacgcccctggctgagtaattagctaatcgggggagccatgatgccaagagacatgtggattcaacggggtggtgtcggggagaaccctcgggcttcctggcacagtatggtctgggacccctcttgttggcatatggtgaacctgtgtcggctttcaaaatgccttgtcatgaaagccttaaggtctcccgacgtggctgatctcacgggctgggtgatccgggttagtaatgtcgtgtgggtaaagtgtgccccctctgcagaggttaactaactgttcgaacagccgtgcccacggtcatgggcggatgtgaggtgtttcctgtagcgtagatttgtttgcctgtgctttgtgaaaagttgttgtggtgtgggaatcgttaccagaatcagcctatgtggcagatggatgacctgagtggtcaagaaacgaatctgtgtgattcgggatgtctatgggcatcatagtctaggcttcccgagtggaagcggattgttgtgctgctgggcagctggactctaggagtccgagaaaatgaaaaaggctctgggagccgattaatcaagtggaatggctctgggagccgagaagtaatgatctgacccgggaggtcggtacattaccaaatgagctgttgaaaaacatctcttaaagacgaaacgagacgcaagtctcttttcggcctaaacttagaaagagataaatcacttagtgatttcaaaacgtcttcaaataaaagatttgcaaaacaaccttgcctctcttccaagcttgcattaaacacctaagttcccgtgacttgctgagtacgaaggtactcacccttgctctatataaatatatatagttcctccacccggaagttgaagatgaagtaaagtgaagattagggtttcgtcctggttcccagccgtcgcctgtggtgttgggtgttagtccgttggttccgctgctgccgctgttgttggtgtttcctcgttcgcgtcgtcggttgcaatctcgggctgttctgagctgcaacctaagttaaggtaaataagtcctctatttattttaaggattgcaatgattcatatttgtcaccgtgggtaccagcactatgtcctgggactggtactgagatcgcggtttcgtaggaagcggtccgcaccgtttttcctacgacacactcctatcaggtgccgttgtacggcggtgccagattggggtgtgacatacatccggcatgtatctacaaaggtacgcaatattctatatgcaatttatcgtacctattcagatcatatagcattgtcagatctataatttattatgtttacctagagcatgtttcttatacaatatccgttgcacgagtgcttccgacgttaaaccaactacagtctaacgctgggggctcactccgttttcttctgtataaatcatgcttgtttacggtttacataatgcctgataattacatctgctcgttataacctgataatgctagaagatccatgcagtttttagtacatactcgatattatctgctatatatcttgccttctagaaaatatttttcaggaacaattgagcactcgagtaggttatggtcgagtacactccattatcgagaacattctcgacaaatgcggagttatcgcacccaacctaccaacaaagactgacgacctgtctcatagcatcggccatcgctggactacttgaagaaaggttgttaacggatgattcctcgcgaacgtcgtcggcttgatcacccgacatgattgcgaacggacatccggatatgctataagttgggtacgtgagtcatgctggccacatgaaatacacttgcaataaaccaactctagcacttctatcggtgttcgagagataattctgctcgctcactggttctcgcaccagtacacagcaatctctcgcacctcaacttccatcggtgttcgagagataattctgctcgctcactggttctcgcaccagtacgtagcaatctctcgcaccgcaccttccattggtgttcgagagataattctgctcgctcactggttctcgcaccagtacgcagcaatctctcgcaccgcaccttccattggtgttcgagagataattctgctcgctcactagttctcgcaccagtacgcagcaatctctcgcaccgcacctttcatcggtgttcgagacataattctactcgctcactggttctcacaccagtacgtagcaatctctcacacctcaacttccatcggtgtttgagagataattcggctcgctcactggttctcgcaccagtacgcagcaaactctcacaccgcagcgtccattggtgttcgagagataattccgctcgctcactggttctcgcaccagtacgcagcaatctctcacaccgcagcatccattggtgttcgagagataattcggctcgctcactggttctcgcaccagtacgcagcaatctctcacaccgcaacttccattggtgttcgagagataattctgctcgctcactggttcttgcaccagtacgtagcaatctctcgcacctttacttcagatggtcaaggtacgactacaacagtgtagcggtcctcgtaccacgactccaagtgatcgagggacacctactcaccggtcctcaaccagttgatcgtagtgatctctcgtacatttgcttcaagtggtcgagttacggctactgcctggtcctcgaccagcgatgtagcgttcctccgactacttccactttcagtggtcgagttacggctaagttacggctactgcctggtcctcgaccagcgatgtagtgatccttcgactacttccactttcagtggtcgagttacggctactgcctggtcctcgaccagcgatgtaacgttcctccgactacttccactttcagtggtcgagttacggctactgcctggttctcaaccagcgatgtagcgatttctcccactacctttacttcaacaaagttggtagcaggtacacaatatcgccaagtgttttacccagagatcccttaccacgacgacacctagcgttgaaacctatcctactgacccttaacgccgtcttgacaaggcctccgaggaacctaagggatcttcggctggggacgcccagagctgataaggccttgttggatccttcagagacgaaagaccatgtaagatatggtcgtgtaagagttctcgccgtgcgtattaaccaagctgtgtaatcggaaattgacttttccaacttcacggccgggggctaggatcagtgcttattcaaccaaggcaggtcaagagtccaagagcctactcctctgagaacgattctccgacgacaaggctgggggctagggagagtgaacaactcaaacgactgaccaaagtcgtgaactgagaagacactcttacacaaaacattggtcggtaaatttaattcattttcaatttaccatacatattataacatgtcaccctttgggcattcgctcaggggctatttctatttgatattcttttctgagtattcattttaggaaaattctattcgacattgtggaagactccatgtctctatggttctacaccaggatcgactaaggcgagtacgaccaatgttgacaaagctcctttgcagactctacgccttctcgattgctcgagaacggttgctagatcttgacaaggaatacggactgaagagatggtgtacccgccgagataaaatttcttgacttcaatccaaattctcgactacagcaaaacgggagacttagtcgtacgctctgtactttttcggtcgacatcagagattcacttagacaaaccctttcggtgcccacacggggctgacaaaggaagtccaacattatctctaaactcaccgagaacggtcacatgagcttgataacagttactccaatgtctgcgcgcggttgagaataggaattcgttcatttgcatcgaagtcgggggctgctgtcatggttatggataccacatacctaatagtagttgactaaatctcggcaggacccaccacataccatgtcctatacgaaaaccgacttcagatatggagggagttccgaataaggaaagacaactagagttttacatggaaacgacaaggactactcagattgtatccatattggtttccctagttctacttggacaaggggacacctatgggtataaatacaagcctccctaggaggacaggggggacacccaccatgagacgatcaacacgatcaccacgatcgggacgaccacctcatcaacgcccaacacaatcaacatacaagcctacatacgccaagacacgctgccagatatcgactttagggataggcatggctattcccctacggtatctccggataccgtcaggagatacgaaagcgctatctctgatctcgccgggcacggattcgaggaggaagactaccctgttgttgactacgagtcagactttcagaccaacatgttgataacagttagataggctgcccacatattgtactggtgtgattatggtgaataagagcaataccggctttggccaacaggatgtagggttattacctgacaactcaggggcccgaaccatgtataaaaatccctgtctccatctcttttacctcagtctcgcatatatcctagcaccaacgatccccatactgtccaaataccgtagtcgagacatcaaacgtcgacaaatgtataaggactactttagaggcttaagacccccctcctattgctacattgtggctgccctaaggagttgtttagattgacgtcattataagatataccatttttttaaagtaaagttgccaaacatgagcaaccatttagctttttaccatattttggtaaataaaaaaaatcttaccaattgataatgttaccaaattgggagtacctatacatctttcgaaagatttgttatcaaattttaaaaagatttattttagctataatctgaacaagaacaacctctgatgcccgagccatcttaataggccacgggtactcgagatgggccgatccatgcgcgatgagccgtgaattttttttatttataatttttttatttataattttttttattaaaagttttacaaaaataattttccattttgaaaattgacggaagtagtcgcctaccgccctctgggagggcgatttttaaaaatcgccctctcagagggcggcaaatatgacgtggcagacggccgttcgctctcgggcgacggccggcatggaattttgcaggcggcccccttgccgccctccgcgagggcgattttgcactgtgcggggggccgcctgcaaatgggcggcgagggggcatggaattttgcaggcggcccccttgccgccctgggggagggcgatttttgcctcccccctataaagcccagcccctcccctgtgaaatttcattatattcactaaaaatccaaaaaatcgaaagagagagagaggggagggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacccagcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttgagtcaatttatagttggttgttgagaggatttagaatagaccaagaagtctacacaatgtcagtatctgttgtagtgagtcgtgcaatagaaggttatttttgggaactaatgccgatggacagcactgctgcttggagacggtatgtggaaatggcttttgaacggtcatggcccctcgttatatttgtgtcggtacaagagaaagatacaaatgtttcaatgcaaaccgaagatgtggagggtcctagcaatgcaggggatgttgttggaccatcgatgcaaaatgaggaaaatcaaccaagggaggagcaggccatgggcatggcggatgagggggagagagtcggtataattgttgatgaaatggagagggaagattcggataatgagcaagcggaggacgacgcatcatccgatgaggaaggtgatgtaatggccactgattgggcaaatgaggacttctctggtcttgttatatcagagggtgatcatgtaccctgggagtataaggagaacgaggtaattgagggtgcaaggtatgctcataaggatgagatgaaggaggcggtgaagcattgggcagtttcattgcagagagagtttagggtggtcaagtcaacaaattatgtgtatgaagtgaggtgcatgaaggaagaatgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacttactatgacctacatacatttacatcggttgaagatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggctttcgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggatctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcggccatcagaaatttctctcagtggattgagaatgagcctaaggagaagtgggctctattgttcgacaccgatggatctcggtatggcataatgacaaccaatttggcagaggtgtacaactgggtaatgcgaggagttcgggtacttccattggttgctattgttgaattcatccttcacggcacgcaagcctactttagggatcgatacaagaaaattggtccgtccatggccgataacaacatagtgtttggcaacgtagtgacaaagtacatggaagataaaatcaaaaaggcacggagacatagagttgttgctcaaggcacacaagttcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatattccagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgctgatgctagtccatctggacaggcaagtgatggtaggcgaccacctggtgaaggaacaacaagcaggcgcgcaaggccaaggcgtcgtcgcgcagcaggcgattccatggtgtaacaatgctttcgatttaggaaataaaatgatgtaatgagtgttcggactaaatacttctatcgtgtaatttcaattcaatcttgttgtaatgagtacctccgactattgttgtactagtagtattgcgaactattcggtgttgtatcgtaatgttatcgtgatgagtgttcggactaaacacttttgtttgtttgtactcttgtttaatatgtgttagtaattcgcttatgaacatttattacttatgttgaactaattatttatatgtttctgatcaacctatttgatgcaggtatggcgtacgacacaccggcgctgttgaactgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttgaactcaactttgctttgttttgcacttatgtttgaagtttgctctatacaggttgcgtgcggcaggccttctaccactttgtaggcttgttgaggcggcggcggacgaccgtgacccagcgaagcggtgggatgcagaccggtcactccttgccgctcttgtagaccgctggagacctgagacgcacacgttccaccttccctgtggggagatggctccgacactgcaggacgtgtcgtacctgctcgggctaccgctggcgggagcaccagttggtcccgtcgacggtgtttttgggtggaaggaggatatcactgcgcgcttcgagcaggtgatgcgccttccacacctaggaccgaccaccacccttcctccgtactctacagtcgggcctagcaaggcttggttgctccagttcactgtaagtaaataagttgttattatcatacatgcttatttgcgaccggatgagtgttttgtactaacatttcattcttaactgtaggcggaccttctgcaccctgacgctgatgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgtcttatgttgcttcagctttgggcagccgagaggtttgccatagggcgaccagtggtggacagcgcaccctacggggttggtcgcagcgcacagtgcccagaggacggtcccacgatggggacttactggtgtcgacgtggggttagtgcaacttcgctgcgttataagtttatcagtcctcttctttttttttccttcacataacatgtctaattccgatcatgtttattgcagcgtcgttacgctcacgtccaggtgaaatgtggttacccgaacttagtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgcgacagttcggacttaggcaggtgtttccgggcaacgtgcagccgaccgtcccccctgccgaccactcgtgagttcggattgttcatttctaaatttttatgataattacatcatcgagccatacaatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttccaacaattatgtcatttatcttgcataatataggacaactactgaattttttatttccatcttgcataggctgatgcggcacgggatatcagtgccgatatcaccgcagtccaggtgaggttgagcagaggtttgcacttgactgacgttgagcagaggtcgaccttcgaccggatgcaggagaagatgcgtgcggtcatgcgcgtcttctcctgtcgcagcgccgtggacgtcgtacctccagctggtccggtacacccacggcctcgcggtcctaccgtcggagcaggacctcgtttgtcttcgagcgcccctagcttcggagcagtgcgacctacagcaccggtttcgcacggtacagttcagcccagatattagttcatttttgtttcagcttttgcacgaatgtgtcaccatgttttaactgcacgtttcctcatcgcaggacctcgtatgccttcgagcgcgttcgcaggcacgaccggcgcttccgcgagctccgcaggggcgttcgccacctcttcgggcgcgttcgccagctcttcctctcacggagcgtcgttccctcgcccacacggtactttactttttattaatactgttaaatacctgtacgaaactgatggtccttgtccagcaggatttgcagccgggatcttcggtactggggcctcttcgtctcacgccggtaggactggtcctactagccagttctacgacgacgacttgcacggtgcagaccaccaggacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacgtagttcttttcattcgtatggtgcttgaacaacttatgctcacaacaacacactttcggcgcttcacggtagtgccatatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatgtattgcagtgaaaacgacgctatataattgacaatctgaaggcaacctcttcatatcttctttcccactaccacaccacacacgaaaatggaagcctattaattggtaatacgtaatctagaattgagattatgtacaacattcttcactacaattttacattttggcagcaaaccaaatatgatcaaatgcaattttaccttaccaaatatttggtagtgccaaaacttgcttatattttggcattaacaaaatatttgtacggtaacattccaaatatgccctaaaaaataataaaattgtattttaccagtcttggagattttaatcttgtatagttttcaatataaaaagatttgataactattgatatttatataaaaaaatatagagcacagtacaaaatcgccctcccccagggcggcaagggggccgcctgcaaaattccatgccccctcgccgcccatttgcaggcggccccccgcacagtgcaaaatcgccctagcggagggcggcaagggggccccctgcaaaattccatgcccccctcgccgcccatttgcaggcggccccccgca

SEQ ID NO: 31805 - DNA, 6063 bp, Oryza sativa
cgtaggcgactatttccgttaattttcaaaatggaaaattatttttgtaaaacttttaataaaaaaaattataaataaaaaaaattcgatgagccgtgagtgctggagaccggcagagcggtgagccgagctgagtagggtcgggcagtgagccggtgacccagcgttgggtcgccgcgtccaaccccattgtcccgcactcccgctcggcgaggtagcggaggagatcaggagagggaagcgcttggatgagggctgaggcggtggccggtggaagacccaagtgacgtcggctgccccggcacggaggcgccacgtcaaccggcagcgggcgcgggtgcctcggagccatccgtcgaacaggggcagtgaaccggcggagggcggctcggcccgcacgtccaagtgccccgacgcccggcgtccgccgctcccaatgcagcgcgcgcgagatggaggccggaggggttgcatcatgccattgccgcctagggagaggacagaagaagcgctcggctgagccagtagggagggggacggattagcgcccatggcagccggctgatgaggcggaagacacggcgagcataacctgcactgttccggccgctcacgggtgtcacatgcttgtgcgtcggtgacacaagttcacggtgccacctcgacacgacgcgacgtcgcgagccccatccaagccaggtattgctaatttcgatttcgaattctatttcaagatcagctataatctttgggaaaataaaaaaggaaactcgtttccagtacaatgggatcaaagtttgtgtactaaggaatttgttaagatttgttagaaacttagaataataaattttgtagaatataattatatggcatatatgttatgatcctactctagctccttaagattaattactcctatgcatgttcaccgtgcattcctcctttttggtacgtataacctggtgtagaacttccgacttcttgaaacactaaaacatccaacttactagcagttatttgacgaaactgatcctgaaaggatgttgaaatattcttttgtacaacacacaatcttgggagaaccacatattccacatattctagttagtgtaatgttaatactctctccttccctaaatgtttgacgccgttgacttttctaaacatgtttgaccgttcgtcttattcaaaaacttttgtgaaatgtataaaactatatgtatacataatagtatatttaataataaatcaaatgatatgaaaagaattaataattacttaatttttttgaataagacgaacggtcaaacatttttaaaaaagtcaacggcgtcaaatgttttgggatggagggagtatatgtctcttgtttctattaattttatggaaatccacaatccgattacaggacttgtccaaaggaaacgctttgtgcctttgcgtgcaaaaagtaaatctaccgtccttctaataccgtgaggctcatgttattattagagctgctggtatttcctcctgattgtttggctccagaggccctatgtgcaaaatacacaggttgtattggagctggaagcgctgcagcttcattctctaacatgaaaacaacagaagacatgggtggcctattatttggattatcttgcacgcacaacagccctatgtggatacatagtaaaacttccatttttgagcaactctcagcaatggatgaatccaccaaatccatggccttgtcatccttccataagctccatgcctaaacagtgaaatagatcagtccatataaaagcggtatagttattttgaatttttatggacatagagcattccatggtacttacataagctaataggttgggaaagtccatcagccgaggtaagctaatcttcagaccacttacaatctccaagagtataacaccatagctatatgtgtcggacttgactgaaaaggcgccatccattgcatattcaggagacatgtaaccactgcttaacagttttagtaataagtaacaaaggatttttcaggaaatcaatgtaatagtaaaaaacaaattcctggatcactcactatgttccaacaactcggttagtattggcttcttgctggttgccaccgaagattcttgccataccaaaatcagatatcttagggctcatatccacatccaacaagatgttgcttgatttgagatctctatgaattattgtcaaccttgagtcttggtggagataaagaagtcctctagctactcctttgattatcttaaaccttgttggccaatcaagagcatacttacttgcaggatctatcaagaatggtatacaatgttcttatagtaaggataattttatcatctttgagaaagtactggtaagtatcacattgtttattgtaaattttggtaccttcagatactaaatatctcaaggtaccaaaaattttagtgtaaaatttaggtatcttgagatactttttcaagaacaataaaatttctctatcagtaagcatggagtgaagtttattggatcgcatggtatgtttttgaacagtaccgaaaatgaaagcttccaagcttttgtttggcaagtattcataaattagcagcttctcatctccatgtatgcaacagccaagaagtttaacgaggttcctgtgctgcaatttggcaattagaacaacttcatttctgaactcttctactccttgtccagaacccttgctaagccttttaattgccacttctttgttatcacccagcatgccctacacaatttaatcaattaatttttttattaagaaagttcatctcgagatgcactttttaccgcaatataagggacgtggtttcgaccccaaggttccttattcgattcttaacacgctcacacattcttcttaattatttaacaccatgtttcttgtcggttctcccttttttaaaaataaagttcatcatccataattgggattttcatatggtatcactgttttcacttttcagtagtaaactactccctccgtcctatggtataagggattttgggtagatgtgacacccaaaatctcttatatttttggacggagggagtactaattgtggcacttcttctgtaatactcctaaaaaatatgctctaaaattgaagaatattgtgcgatagttttgtcctactgtagttttcaatacagtttttgtgggctaccttataaacctttccgaagccaccttgtccgagcatgttgtcgtcagaaaaattatttgttgcagcagcaatgtctccaaaactgacaaacgggagttctaaattttcatcaccaagttcatttaatgcactcaagtatcctagcatccttttctggacaaccttattctgacgtttgcctgacaggaatatcaatatcgtgtattttaatattaatagtagtattattcttaattagataagctgtgagaactgagaagtgaggtggctcggtatctacctctgcacttgcgtaaccacacaaggaacatgctcatcagcagaagcaaacatgctgctgtaactgggagcagaacttttatcacagtcctcttcttattgttaactgcgaaaagaaatatttcaccaaaataattagtacttcctccacgctaaaatatagtaacgtagtactcaatcagacatcacaaatattatagactctaatcgagtactaggcgatgtttaaccgagtactaggatattttacagcgaaggaaatatatatgtaattaaccattgccaaacacattgagcaattctacggtccttaagaaggtatcatgaggtatcaaaaatttagtgtaaaatttggtaccttatagtacctagttaccaaaaggtaccaaatttacaatagaaaaagtggtaccttatggtacctcctcaagaacacattagctcgaacacattagtttcagtgttgtacctagttcaggctttgccagcctcaaatagagatcctgccctttgtcgacataccgaacgtcaatgacgtcacccgtccacatcacgcatccgctgccgccgccggcgcctcggatgtccgcggcggcgtaggcgacgcaggaacagttggcgaagcacctcgccctgcactcgtcaagcgtggcgcccgtgtccaccgtggcgttgtccgtgtcggggagcttcacgccgcgcaccggcacgaacccgtccgtggtgctcccgttgccgcactccagcggcgcgttcctccggcaaccaccggaggtctccctcatggaccactgggaggggaacatcgggctgaaccccgccatgcagctgcagaagagcgtcgacgcggtgttcacgttgcacagcccgaacgcgccgcacttggcgtagtcgtcgcatacgtcgcgcggcgcctgcgcgaacgtgttccaccccttgctgctgggatcccacacgaggcgctggatcacgccggcctcactcagcacgaggcgggagaagggggccccggcggtggcggcggtgaagacgtaggcgatctcgtcgggcttgaccaccacctggttcgcgaacatggacgagtacgatgccatctccgggacaccgctgaaccacagcccgttccatggccccgtgcggtacttcttgccggcgccgcaccacgagacgcagtccgctagccctctcgtgtccatcacgcgggggcagccccccgtcgcggggtcgtcgggcgcgcgccacgacgtgagggaccactcggcgccggtccgtgggttcctgccgagcctcatgccggcgatcagggtgttcgacgggttgtcgaacgactgccacagcacgtcgccgctgccctggtcgcgcacgacgaggttcccagactcgagcagctgcaccgccaccgatggagacgagccagtcgtgttcgacgaccaggcggcctggccggcggcgccgtcgagcaggacgagcccgcccgtgccatcgataaccactacgccggcggtgtcgttcagtgggctgtcgcggttggccacccagacggcgtccgccgactcggagaaccatatcgcgaggtatctcctgcttggcaagccgggtgagaagaaccccagagtgaaggagccattggctgacacgagcgtgtcgccatcagtgaggttgcggccattgctgagcgtgtccgatgcaacgccggcggcacggtattggaaacaaaggagcacggagaagaagatgacgggacggtagaaaatgttggtggttgctgcttccataactgttgattctttttttccttgcatctccttggaaaattgttcacggccgctgtgcagggagcacgtacgccggccggcctcagtgtctcacgactcacgagcaccatacataggctgtgcttaatctaaattttggatccaaacttcagtacttttccatcacatcaacctgtcatacacacataacttttcagtcatatcatctctaattttaaccaaaatataaactttacgctgaactaaacatagccatatacggaatctaggaactagtagtgccccgccgcataggaagactgcaagtgcgttcctacttcctgccacctccgtccctccgtaccagtttaaatgcagccgtggattctcgtctctaacgtttgactatcttatttaaaaattttaattttttaaataatacgaacggtgaaacgttgaacataaataacgtgaaactatgatctttctgagacggaggtagtacagtaatatcccatgattgactagctagatgaatccatatgggtgagttgcatggtaatgcaaactgcaaagaagattggctgtccatggaatcatggatgattcgtgactgcatataacatgcatggtgtactctccgtcgtcatagccagggtaaagcatcttcatggcaatggtcaaaagagagatgaatggaaacataagtgagggatactgttgccctcgaccccaagaaaaggaaaccataattcatccaagtgataagtccacaacacatccctatcatagtcgtgctgttgacaactgctggtaaa

SEQ ID NO: 31806 - DNA, 61345 bp, Oryza sativa
  unsure (1)..(61345): unsure at all n locations
acttcccaacttttaaactgtatacatccaacttagaatagtttaatgaattgatggtaaaaatatgttgcgattcttttgcaggacagtgtatcgagaaccacattatctactgttattttgtaatacctgcacattaaaaataccatctcaagggccatgataaaagaaaaaactcatccaaaaaaaatgtaacatctgccctttgtttctaatattttatggaaaagaacaaactaattacagaagtggtaaaatctaaatgctttctatgcagaaaataggtaacataaacatctaccgtccctctaataccgtgagactcatgttattattagagctgctggtattttcccctgtttgtttggtttcagaggccctatgtgcaaaatacacaggttgtattggagcgggaagtgctgcctgttcgttctccaacatgaaaacaacagaagacatgagtggcctactatttggattatcttgcacgcacaacaggcctatgtggatacatagtaaaacctcgttttttgagcaactctcagcaatggatgagtccaccaaatccatggtcttatcatccttccataatctccatgcctgaaccaatagaatagggtccatataaaatcagtacagttagtttgcattatattcctcccaatcttaatgaaatttggtcgccggttccttcggccgacccggcaaaaaaaaaagaaaaaaagtttgcattatatgaagatagatcatttcaccgtacttacataggccaacaagttgggaaaatccatcagctgaggtaagctaatcttcaaaccgcttacaatctccaagagtataacaccaaagctatatatgtcagacttgactgaaaagaccccatccattgcgtattcaggagacatgtaaccgctgcttaacagttttagcaataagtaacaaatattgtttcaggaaaggaaataaatatcattctaaacactaacacataaatcactcactatgttccaacaactcggttagtatttgcttcttgctggtttccgccaaagattcttgccataccaaaatccgatatcttaggactcatatccgcatccaacaagatgttgcttgttttgagatctctatgaattatagttaaccttgaatcttggtggagataaagaagtcctctagctactcctttgattatcttgaaccttgttggccaatcaagaataaatttacttgctggatctatcaacaatggtgaataatgctaattagtaagcattcagccaattatatctggatcatgtggtaagtttctgaacagtaccaaaaaggaagtgatccaagcttttgtttggtaagtattcataaataaggagcttttcatctccatgaatgcagcaaccaagaagcctaacaagatttttgtgctgcaatttggcaataaggaccacttcatttgtaaaatgctctaatccctgtgtggaacctgtactgagtcttttaaccgcaatttctttgccacctcccaacttgccctgtataataacatcattttagcatgataaaatgttgtaggtttctccactgttgcgtttgtctgtgtaaattgttaccttataaaccttgccgaaacctccttctccaagcatatttgaatcactaaaattgtttgttgcagtgacaacatcttcaaaattaatacatgggaattcctgattttgctcatatacttcatgagaagctctaaagtttcctagcatcgctctattctgattttcattatttctcttttcacctaataggaacatcaatatcataagtacaattacaggaggaaaacatgatatgagtcggtgttgagtattggctcctgctgtaccttttgatatccatttccagacaaggtatatgcacgtgagcattagcacgcatgctataatggggactacaaccttgactacatacctgctctttttatgacctattaagagaaatgaagaagctttcagaatttctaaccatagattgcaggtatatgcatggatgttgcttttaattggatgttcaggctatctaagatctttattgtcatttgtcaccacagggataaaaggtgggcatacctggagagtcggccaaccggaggtacaagttgtcaccaagattgttcctcgccatgtcaacaagctcaccaacccaaagcaagcaccttgactggctggctgtggtaccgggagagccggttatggtcaagttggtgtaagcataggccgtgcatgagcagtttcggctacactcagccgcgcactcctcaaagcttctgtcctggacataaaagaacttgtcagggagcttcattccaggcatggtcatgaaatggttcccttctccacatcttaattgttgctttctccggcatccacttgaagagttggagccgttaggctcaaatccatccgggcactggcatcttgggatgaccgacgtgaagtcacagtaaccgaatgggccacacgagccgtagggatcacaatcgccaatggctgctgggcgttgagaatagattgcccatgatgacgagttgacgttccaactcaggagcctgaaggtgcccgtgtagtcaagcatgatgcgcatgtatggtgagccatcagaggtggtgtagataacatagaactcatcctgtgtgtttacatatgtttggtacatgaaggaggtgctgctgccatatgctttgccggacacccacacactgtcaagcacaatggagcggtaatatggcttggtcccgtgccagacgaagacctgaaggtctgagctggggtctccgctgcatgagaagtcccccgttgttggatcatcaaggcccttccaagctacaagccgcatgcctacttgctccttgtacctcagcagaatcttcatgttcgacagaatggtgtcagttgggtgatcgaaactttgccatatggttacattgtttgacagccggagaaccaagtttcctgagtcgagcagcactgcataagctccgtcacctccggtgacatttgccattgtcgtccagacggtgcgacctttggaatctgacaatacaaggtcagaactattgctgatggcgagcatcgctgatgaaggtgtggtgattgggttgtcacggttagcaacccaaacgtatgttcgctctgggatgttgttataccatatgccgaggaataagctctggttggaagtggctggggagaagaaaccgagtgcaaagacgccgctcttggagacgagcttgccgctgggggagatcaatcgatttacctgtgtcagctgatcatcgcatttgcagaaagagatgagcagcaagtagatgagaactgggaggtaggccatattcatctggcccttgttcttcttttttggacaagcaaggcaggagctctgcaaaatcaaaattagattatgcgattaaaaagacacagagtcttacaaaagaagagcccgaggagaggcgaggcaactggaaaagaagatgtacatctgataaaaaggagaactgctctcgtagctcttgaaattaccaggctaagctctgctaagctctatctgatttaactcctgcacaattgggcagctacttttgcttctccctctggctttggtgttggaaattcttctgttccgttcctgccacaccaaccaccaaggttcttgcattcatcttccttttccttccatactttggctctaaatctcattaggtcttgttcttctgtttcctagttgccttcaaaaatgtaaatgtgaagaaatagagcatatgtatccaattatcagatgcatactagatgatttcccatagtcttagagcatggttggaccgaagaaagcaaacatacggccaagacatttctgtccttccagatcaggatgcacgcgcaaagcgaaaacgaagttcggatacgacgagaaaatcaacgagagcgaaaccgttatactgttatttttttttcctttttccttttttacctttcccgggacggcaaaagaacctggccagaacagtacaactgtaactaataaaacaaggctgccaacaagtacaatagatcctgttaaaaacggttacagcaaaaggagaaatctctagttaatttctgaaagtttactactccctccaggctgataatacttgtcgttttggataagggtgtagtcaaactttataatctttgattataaatcatttttaaaatatttgtcttttaaatatggtgactatatgtatagattagtcttaaaaagtactttaatataatcgtatatttgttaacaattttatacatattataatgaaaaataatggtcaaagttgttttttagagaccgtgcccttatccaaaacgaaaagtattatcaaaccggtatgaaacaaagaaatcagcaatcagggcgatttggccgtatcagtaataagtaaatggaatatatgttccgctcaaaaaaaaatagaaatcagcagtcaggcgagacgcaaaattccttcttgatcttctaacctccagactccagaggcgtattggattcagattggaagatttttgcattaacgttgtttccaaataagccagaagaccaaaatgatctgagagttgaacgcggcacgttgatgatctgcgtcatgacatcgacctcactccacgattaaccaaattccatttcatggcatcggtagcgctgtactaaccacccgtcagccaacaagtctatagttgacgagacctcatgggaagtcctagttacatacctcatttttcgttaagaaacattaaaaaaacaaaataacttagtacaggtagcttaacacaaaatagtttagagcaaatagctggcctacaatatatatgtttttttaaaacacagtataacgttcacacactcacctctataaacacatatttggaaaactgagacaacacatatgatttttgcacgggctattaaaatagattattttacatagaacaaatagcttagaataaatgatccaaactatttgaaaaaaaagaagatcgagcgtgggagtaaataacatgtgacaaaaattggtgaagaaaaaaaaaagaacaatctgtcgccgagacctattttcttccgtcaaaagccgaaaagataaactatcgctacaaaactgaactctcgatagagatcgagaaaagtcgacggcagcgaaacctcgcggcatatgcagatatgcttttgtccttgccatggcgaagtaatctcatgctcttgctcagcactcagcaggtggaataagttcactttaggtccctctatttgtcggttggtccgattttcgtctcttggccgcaaaaccggatacgacccattccccaacttacgaaaaccggacaaacgagatcccttggcagtatagaggacggtttttgccgacgtggcgcctacgtggcttatttaactagatcttcatcccacatagtgttaaggtggcgcttacgtggcaattttatcccanaaaaaaataaaaaccgtagaacccatatggctacatgtcagctacatataaaaataattaaaaaaggtggggccatgtggttccacatgtcagcctcctcctctctatcccctctctccctctcccttacgctgaaggagaaggacgagcggcggcgggcggtggacgttgctcctggccgcgggcgctaccgacgacatgggcgtggtggcgtcggggcggtggcagatggcggcggcggtggagacgtgcgacggcgccgtcagggagtgcgacgtggacgacgaggaggaggtggaggaaatggcgttgatgggggcggccgccgccgccgacggcggggagacgctgatgccgcggccgacgaactggtaggtgagctacgcggtgctggacgccaacaaggtgtcgtgcaataagcgcggtcagtcctactaccagaactgcgcctcacagaaggccggcaacccctaccgccgcggctgctccgccatcacccgatgcgctcgcaacaccaactgatctccctcttccttcgccggcgtcactgccgttgccggcggcggcaagtgaatacgctgctctcatatgtgtatgtacatatcgactctatccaaagcgtacgtgagcaactgctactgctgccaaaaaaaatcttcagtttctctctcagctcgatctatacaagccaaagtggtagcatgcattatattattggcctgaacctaagaatcttttaaagagtacagtaagtaacaaggcattcacatctttcctgtaaatggcgccctggaagtagagcagcgtcggccggtcatcgtagccggcggagtcgttggccagcgaagttggggacgacgtgccggtacggcgcgatgacgtccttgtcgaggccaacgacgctgggcgggtacctcccgaagtcgcagagcacgaagacgcatggccagagcttgtagcgcgcgtcgagcatcccgttggggtggtgcgcgagcacgacgtggtccctcccgccggacctccgccactcggggcgcgcggcgaggtaatcgagcagcctccgctgcaacgtgcgacaaccggtctccccggcggcggcgccggccgcccccatcaacgccatctgctccaccttctcctcatcgtccacgtcgcactccccgacggtgtcgtcacacgttgccgccgccaccgcggccattagggctgtcaaaaaagctcgagactcgcgagctgctcgagctcgactcgtcctaggctcgattcgagctcggctcgagctccaaacgagccgagcccgagctgtcccaaagctcgtgagctttgtcgagccgagctcgagcttctaacgagcctagtaatatatgattttttattgctatttaataaattggtagatcaaatatgttatttgtatgccttgtattagcatcgtatgtttattttattctttttcctcttatactaatatgataaacaataaattaaatttttttaaaaattatcctttgaaatatacattgttctaattaaaaatcgagctcgatagtcgagctcgagcttgatcgagctcaaacaggcttagttcgagcttatatcgagctcgagcataggcaggcaagctcgctcgagctcggctcgttgacagccctagcgccgatgtcgttggcggcgcccgcggagaccgggagcaaggccaccgtccgccaccgctcgcccttctccttgcaggcttgcagtgtatgggagagggagagaggggatagagagaagagggaggctgacatgtaggaccacatgggcactacctttttaaattatttttacatgtatctgacatgtgggtcctacggtttttattattttttcgggataaaattaccacgtaagcgccacgtcaacgccacgtgggatgaagacctagtcaaaggagccacgtcggccaaaaccgccctccatactgccgagggacctcgtttacccggtttcgtaagttgggggacgggtcgtacccggtcttgcggtcaagggacgaaaatcggactgaccgacaaatagagggacctaaagtgaacttatttcctcagcaggtagtcaatggtagagttgggctgtaaatactcggcccatctcgatgatgctggaggtggtgctcgtcatttccttataggcttcatggattaaatcacacggatcgttgatggaactaaattataaggcccgcgcggnaggcccaaggcccccccaaaggcccccgggttaaaaggaaaggttttaaagaaggccaccgagccggcactggggcggcccatccgaagtggaggccgttccttccgaattcccgatccgctactgaagtggcgaagatgttgcatgccaaggcgcggcgaggcatgagagcgaacgtcctccggccagnacgtggaggccggatcgagaatcaagccggtggcggttaagcagggagcagcgcgcatcaagggaagaagcgcggcaggtctctgttgaacttgcacacctctcaaaggtgcagtgcctatctaatctctaataccgattatagggttctaaccctagccaaagattgggccacgtggcgtctcaaaaatcaagttttgcgcctttgaaaatatgccacgtgtctcctttctctcctcccccaccgttcgatcgagtatcgacggttaaatttcgctgcgatggacctctttataaaactgaggtttgaaaaaaatgactactataaagaggtagggggtcttggaaatgtaggccgacacaggtcgtagctgcagtgccgaagtacctggcacccccacccccacccccatccccatgcatgcgctgcatgcaaacctcgggtgattatccatctaatccatacaattagctcattaattagttgcaagttgagcctatatctagctgtccacctgagttaattaacatatcaaagcgatgtggttgcaagtctccaaaactaaaaaggatgaatagaaatgatgtcgtgtcattcaagtattgagtaaagttggtgctatttagtgacatagtttaaaattggttctttttatgctatattaagggtatgttctgattgtagccaaaataaaccttaccaaattttggcattggcggcaagttgataatattcccaaaattttggcaggatttcttatgtatttaccaaagtttggcaacaaactaaacgtaggcacttttttaacaactttacccaaaaaatggtatggctaaaaatggcataaatctgaacagcccctaaagtacattcagactcggacatacactctccatcctaaaataagttcaattttatatatgaatctagaagaatgtgttgaaatatataaaaaaaatcatatcaacaatcattttatgtatatattagtgcaaacgacaaataaccacaaaattcaaaatataattatacgaggggcgactacgtatattagagcgaacaaaagtcgactgggcgtgaggccaatctgccactctgcaggatttaagccaccaagattcacatcattgtctaccgaggcgttgatgagttcttacgtctcgtgccaccacccctatctctaaatcctggcttcgtcattgtgtagctggatcggtcgacccaccctgtctaggtacaataaatctggttaaggaaaggaaaacaatagtaggattgcatatacactgtacgactcatgttccctaatgagaaaccagattcgagcgtttgtcaatgataaaccatagaattctcctttaactgcattttctaagaataaacagcatgacatttatggtgatgccatcctattacgatatccttttcttggggtcaagggcaacgtacggtatcctcacttatctgccatgcatctctttttaccatggccatgaagatgctctgccctgtatcacggtaagccgagaaaagggctgatggatgagaagataatgcgcggccacgtatcatcacggtaagccttctttgcaggttgcaccaccttgctcgtctatggactcagctgctagtcagccttttaattgcccagagcaaattatactttggttcatattttatttctaaagttttagtttgcacggcaactttttaatattttccgtttgtactctcgatttatagtcaataaagtcattttcatccgtcgttagtaatccgtaatctgttgagaacgcagcctgttgtgctgggtttttctgtctagtaggtttttgaacgtacaggttttcctaatttcctttgtgtttcatcccgatatgacggacaaaaaagtatctgcatacacgtcgcttcctagttccttcggtctcaagattctggaaacaatgtatacgtacgtcagtaacatatatactgaatgataacaatgtatatttctgtgtgcttcgtgcttcgcaggctcgcagctaagcgaagaaacaaggcagaacaaatatggcctgcctgagccacaacctcccagttttcatccacttgctactactaatctctttctgcagatgcgatgaccagttgagacatgcgaagcgactaatctctcctagcgacatgctcatctccaaaggtggagactttgcgctcggattcttctccccggccacctccaaccagagcttattccttggtatatggtatcacaatatctccgagcgcacctatgtttgggttgccaaccgcgacgacccgatcgctgcatcttcatccgcgacgctctccatcagcaacaattctgctcttgtattgtcagattccaaaggccgcaccctatggacgacgatggcaagtcccaacagtattgtcaccgaagacgacggagtttacgcggtgctgctcgactcaggaaatttggttcttcggctatcgaacaatacaaccatatggcaaagctttgatcaaccaactgataccattctgcccaacatgaagtttttagtgagatcctacggacaagtcgccatgcggttcatcgcttggaagggcccagatgacccatccaccggggatttctccttcagcggcgatcccacgtcaaactttcagatcttcatctggcacgagacaaggccatattaccgtttcattctgtttgatagtgtctcggtgtccggtgcaacatacttgcacaacagcacctcttttgtctataaaacagtcgtgaacactaaggatgagttttacctcaagtacacaatctctgatgattcaccatacacgcgcgtcatgattgactacatgggcaactttaggttcatgagttggaacagcagcttgtcctcatggactgtcgcaaatcaactcccaagggcccctggctgcgatacctatggctcgtgtggcccattcggctactgcgacctcacgtcggccgtcccaagttgccaatgcctcgatgggtttgagcctgttggctccaattcttcttcaggatgccggagaaagcaacaattgagatgtggagatgaccattttgtgatcatgtctagaatgaaggttcctgacaagttcttgcatgtccagaacagaaacttcgacgagtgcacggacgagtgtacccgcaactgctcgtgcacggcctacgcctacaccaacttgaccgcaaccggcaccatgtccaaccagccaaggtgtttgctttggacaggggagcttgccgacgcgtggagggacatcaggaacaccattgctgagaacctgtacctccggttggccgattctactggtatgcccaccctttttcccctgcgacgatagaatagctcttagattagcagtcctgaattttgttcacttgtgttgataggacacacttcaaactcaacagaaagaaaaaagaatctagtgaaggtggtagtctaaatttagcatgcctgtttttgaacacgaccaccaggttactatctcccacaagcttgcaagctactgtatgtttgacgctgtaacttctgttcacccacattcttcacagggtcaaattctacagtaaacagaaagaagaagaggcacatggtggtaaatattgtactcccagctatagtgtgcctactaatactcacagcgtgcatatatcttgtcagtaaatgcaagtcaagaggtactataagcagtaggacctgcttaattgcaaagcgtgcatatatcttgtcagtaactgtaagtattgacattgttgattttactataaggcgtccgacaaaacaaggaaaaaacgaaaagacctgtcattcaacagttgagcactattcatgatttgtgggatcaaaatctggaatttccatgtattagctttgaagacatcactgctgcaacagacagtttccatgacaccaacatgcttggaaaaggaggttttggcaaagtatataaggtgatatataattttaccttgtcattctgtcaatgatatgaggaatagcgatgtcatttactcctattactttaataatgatgaaatcacacagggaacattggaggatggcaaggaaattgctgttaaaaggctcagcaagtgttctgagcaagggatggagcagttcagaaatgaactggttcttattgccaaactgcaacacaaaaacttagttagacttcttggttgctgtattcatggagatgagaagctgcttatttacgaatacttgcccaacaaaagcttagataaattccttttcagtatgttcgaccaatccaaagaaatactcttgcttggttaattatttgtttgattctactatcctaactgtgttctgggcagatcatacaacagaggctacacttgattggctgacaaggttcaacattatcaaaggggtagcaagaggacttctttatctccatcaagattcaagaatgaagataattcatagagatctcaaagcaagcaacatactgctcgatggagagatgaaccccaaaatatcggattttggtatggcgaggatatttggaggcaatgagcaacaagaaagtactagacgagttgttgggacatagtaagtaacttctgctcttgccaaccaaaattattcaaatacccaggttctggaaattattaaacttctttcttattcaaatagtggttacatgtcacctgaatatgcaatggaaggcaccttttcagtcaagtccgacacatatagctttggtattttgcttctagaaattgtaagtggattaaagatcagctcacctcatcatcttgtgatggattttccaaaccttatagcttacgtaagtgttgccggtacccaatgcttcaaaatttaacaatcaaagaacaaacataacattgccagaacaaatattgaagttattctcttgtttcaggcatggaacttatggaaagatggaagacaaagggattttgtggacaaatcaattttggagagctgttccctcagcgaagtttttaaatgcatccatattggactcatgtgtgttcaggacagcccaaatgctaggccactgatgtcattcgttgtgtctatgctggagaacgaggacatgccacacccaattccaacacaacctatatattttgtgcagaggcattatgaatcagaagaaccaagagaatactcagataaatctgttaataatgtgagtctgactatactagaaggccgctgaataaatgttttagcataagctctaaacagatggatggttgtatagtacattagtacggaatactttctccgtttcacaatgtaagtcattctagcatttttcatattcatatagatgttaatgaatctaaatagatatatatgtctagatttattaacatcaatatgaatgtgggaaatgctagaatgacttacattgtgaaacggagggagtagtaaacaatgaactgaaagatattggaaagaatgcattccgtaggtggttgtgcgcttgtgctacttgtttttttctcatctgctttgctctatcaatatattaggaagagctaatttatgttcaaaaattgaatagatactcctctaacagaataatgattagagatccacacaagtgatcatttgccatgcgtcttttcttttgtgaaatatattgagcaggtatttgaaaggtcatctaattaaggatggaagaatctatccaaggcgaagtgctccagcagcgcttggggtctatgtttatgtgtggcgggtggttccaatccccgctctacctcacgggcttgactcatgcatgaatcagccatccccagatgcccaacctagaaccaaaaattggaggcttgggtcgaaaaattagttaaaatcatgcctgcccgtgctgggttcataccgtctgcaccctggacgcgccgccgctcgccacacgctctccctcctctccggcgcgcccgtgcagcggatgatgtcgcgactcgcgaatggccgtgccgcacggagtcggatcaactcaatccgcatcgaaaaatcggaggtttgggggggagggggggggtgtccggaacttggcctgctccgtgagctcgcgcaaccgccaccgcctgcatcctcgatccggcctccccgtcctggccggcggccgctcgctctcccgcctcgccgcgccatcgtcggcaacatctccgccacttcgcccgcgccgtcggcttgcagtggcggatcgcctcctcgggtgggccgccccagtgccggctcggtgggctcttactccacggatgggctgactccggcgggcggaggcctcattgaggcccattagtccatcaacgagctttcaccgacttgggccggcctgctttgcctcacctcctgccaacacaggcccccactgatgggtttgggccataggtgctcgagatggtccgaagccgccgaatgcgcctctaccccagttaggtgttcggccgccgcccgccggagccaccggagtagagggcaccgagaccgcggcggggcggagtcgcggacctcctggggttggttcgtccgccactgcgatggcagtggtacgccgcgaggtggtggaggctttgcagccttgcagcctaggagaggaaccgctagtggatgcggcaatggatcagctagcgcttacttccccatccctgggagcgagaacacatgcctgacagagtggtggttgcaggccagaacatattttcggaagtgctacaggacaaacttcgacagcgcttgtatgctgatttgctggtagatttggaaggaaagaaatgcgcgtgttttcgaccaaagatcgagaagccctaaccagttagcagaggctatcaaagaagagatcttagtgtggaaagaagcaggctatttcgagaattgcagttcttagttttctttctgttgtgttgacgttccagttctttagtttgccgggctgtggttcctgccacagtctaattcgacacctgtcgttgcaagcgaaaactacttgtactttgattttattcctcctaatcttaataaaattggtcgccggttccttcggccgacccggcaaaaagaggaaccgctagtgctgacgcgctgttgggcaagcggcggcggcgcagccgccggcggcggctgagggggaaccgaagcagacgcgcaacctccggtcgtgacgtggtttcgccgaggaggttcaggttcaggcgtgccatttcaacgcccctcgagtgcaggtactagtactactactgattaaaacagtgatgaatcacatagatgcggattcgtattcttcgtttttttatcgcctagtgcaaattgcaaaaatgcacccaggtacccaaccttccagttccaataatttagtgaaatttgacgacgaaaggattttacctttttcttttcgtaaaacatatagggcgtgtttagttggtgaaatgaaaatttttgggtgtcacatcggacgtttgaccggatgtcggaagtggttttcggacacaaatgaaaaaactaatttcataactcgcctggaaactgtgagacgaatcttttgagcctaattaatccatcattagcacatgtgggttactgtagcacttacggctaatcatgacctaattaggctcaaaagatttgtctcgtgatttacatgtaaactatgcaattaatttttctttttatctatatttaatgctccatatatgtgtccaaagattcgatgagatgtttttgagaactaaacaaggccataatatccgaaaactgttgaatatgaatgataattcataagcccaatgacccaaagagcaatcacattttcactgggacaattttgtttcctgtaaatttcattccgtagcggttaattctataaccagctcattctgaaattaaagagggacaatcatatgatcagatcaagtgatgaattctgcaacaagttgattctgaatccaaacttctaacgcccctgtagtgtggtaaggctcatgctgtttacagatttgttggcgtcctgtctcgtcccttcggccatataattccttggcacgaaatatgcaggttgctttggagtaggacgtgctgtggtctcattctctaacatggccacaactgatgacatgaatggtctagcacttgggtcttcctggacacataacagtcctaagtggatacagagcaaaaactcgctaattgcatagctttccagaataattgagtccacaaaatcctctgcatttccatctttccacaagctccaggcctgaacaaagagaagagagtttctaattagtgcaaaactttagctgttgaaactttgtgcactatatgtcatacaacttacacgggctataaggtttggaaaatccattgtcagatgaggtgagctgatcttagagccacttataagctccaagactaaaacaccaaagctgtaggtgtcagacttgacagagaagatgccttccatcgcatattcaggtgacatgtaaccactgtttaaatcatgtcaccaactgagtgtaagtagtttgaatgcgttcaagtatatagaagtttgtattttatacacaggtagttgaagagttactcactatgtcccgactacatgcttagtgtttgcttgatgctggttgctaccaaagattctcgccataccaaaatctgatattttggggctcatctcctcatccaataaaatgttgctggctttgagatctctgtgaattattgtcatccttgagtcttggtggagataaacaagtcctctagctactcctttgattatgttgaaccgtgttcgccaatcaagcatagacttttttgaatcatctacgacggacattatgaaaggaaacttattgttgttcaggctttgggaaccctctcggcctctcccaccaaaagtgaaaaaggtaaaaagagaatatataattattacataccaaaaaggaagtaatccaggcttctgtttggtaagtattcataaataagaagcttctcttctccatgaatgcagcaaccaagaagcctgactagatttttgtgctgcaatttggcaataagaaccacttcatttgtaaaatgctctaccccctgtgtggaacctgtaccgagtcttttgacagcaacttctttgcctccttccaacttcccctgtatagtaaaattattttaacaggataaaaattataaggcttgtccactgctacaactcttagtgtaaattgttaccttataaaccttaccaaaacctcctttgccaagcatgttggaatcactgaaattgtttgttgcagtagcaacctcttcaaaattaatatttggaaattctaccttctgctcaaaaagttcgtgagaagttgtaaagtttcctaacactgttctcttcttattttcgtcatttctctgtttgcctaataagaacatcattatcggtcagtagttacaggaagactgcatagtgttagttagtattgagtattgaccctcactgtaccttttgtttgccacttcctgacaaggtatatggatgtgaatgtcagcaggcatgctataattgggactacaaccttcactacttttttgttctttttgttggcttcagaagtgtaccctatcaagaaaagtgattttttttctcagaattccatgtacaagctatctaagggtatcatcaatgtatatggcaaaagtagtctatatagatgggatccacataaataaactttacctatagcaatcctcacaatgtatatggatacaatgtgacattaggagaagagagagaagtagagatagataatattatttatgtcatatgggtagtccatatgcatatggataccttttgctattttctttatatagactagttgcacaatattactagatgactgaatggaatagtttattccctatggactacttttgtagtacattgtggatgccctaagagttatattgcaactgcaggggaaaaaaggtgggcataccaggagagtaggccaaccggaggtacaggttctgaccatcaccaaaaccagtcctccccgtgtcgactagctccccagtccaaagcaagcaccttgattggtctgccgtggtgccggctatggtcaagtttgcataagcataagccgtgcacgagcagttgcggttgcactcagccgtgcactcatcaaagcttctgtttgggacaggaatgaacttgtcagggaccttcattccggacatggtcacaaaatgattcccatctccgcatctcaactgttgctttcttcggcatcctctcgaagagttggtggtgtcaggctcgaacccatcgaggcattggcaccttgggatggctagcatggcatcacagtagccgaatgggccacatgaggcgtaggtatagcagtcgatggtgctcgctgggcgttgtaagcgaactgtccatgatgacgagctatcatcccaactcaggaacctgaaggttcccatgtaatcaagcatgatgcgtgcatttgctgagccatcagaggttgtgtacctaacatagaattcatcctgtgtgttcaccagagtttgatatatgaaagaggtggtgttgctgccgtatgcttcgccggacactgacacactaccaatcacgacgaagcggtaatatggcttggtcccatgccagatgaaggcctgaatgtctaagctggggtcgccactcaaggagaattccccggtggatggatcatttgggcccttccaagcgacaagtcgcctgctgacttgtgccttgtacctcagcaaaaacttcatgttgggcagaatggtgtcagttgggtgatcaaagctttgccatatgattgtttcgtttggcagctggagaaccaagtttcctgtgtcaagtaacgctgcataagcaccgtcgcctccagttatggtgatgttcgttgtccaaagagttcggccttcggaatctgacaagacaaggttagagctattgctgatggcgagcatcacggatgatgaaggtgtggagatcgggttgtctcggttggcaacccaaacatatgtgcgctgcgggatgttgtggtaccatatgccaagatataagctcttgttggaggttccaggggagaagaacccgagcgcaaacaccccgctcttggagccaagcacgtcgcctgggtggagctgctttgcttgtgtcagctgatcatcgcacttgcagaaggagatgaggagcaagcagatgagaaaggggaggcatgccatattcatttggtttgttcttcacttgcctgtgactgtgaagcctgaagaaataacttgtctggtcatcacattcactgattcacaaatagctttggagtaattcccgtgagtcaacgtatggccgagactttttattcgtctacgggtctatgagtggaggtgcacgcgcaaaggaaagtgttgctacgaaatcatactaagggtttgtttagttcatgctaaaattgaaagtttgattaaaattggaacgatgtgacggaaaagttggaagtttgtgtgtgtaggaaagttttgatgtgatggaaaagttagaaatttgaagaaaaagttgggaactaaaatcaccttggagagaatgagaaaactcgtaaaagttgcgagaagtcagcgctgcatgcgtgcgtaacccgtttagttggtggcattgacgcatgatgagtgcattatgagggtggagctgctttgcttttgttagctggtcatcacagtacacttgtgtgcaaaaacttcctacaacgatttctgtacacatgattgctgaagcttaagaatagtccgaaagacctcaaggacacgagatggattttcctccgttcatcagaaacccgaatttttcagtgttgacggcgttctgacgctgggacatggggataagtacactaatcaacacaggaatagctgagaagaaggttcagggggccacaaacaacagcaaactctctctatccaatgcgatttcttgtgagctgtgacatgccgagccaagcacgagacggtcagttcaggctcggcccaggtctgtcgtgtgaggccggctctgtgtcagatactacttgtgaaactgaaggctcgcatctgctgttgatcatgggattcttgggcatggctatctgtgaactgtatttggttagcattgagacaacctgattcatggtaggcctgtcatcgggagattgctgtacgcagagaagcccaatttggatgcacctgtctagcccaagcaggagatcaggctcaggtttgatcagtcctaaatcaagaatgtcctcgatctcatgctgtttccaagactcccaggtctgccaaaaagaaaaaaactcacttacatgatagtgcccatttgcattttctaatagctatatttttcctttcaaaaaattattaactttgcctggaaattcattattttttttctaaaagagtagtactgaaaattatgaacttttatgtcatttttttgcgggtgcttagttcagtctgttggcactggcttctcaacttctgtttatgtgcttatttgctttaggcaaatcaattgtgcgacttatatgttcacttacctcacgaagaaaagttggtaatgtcctgttccttttaccactgattatctctagcaacacaactccaaagctatacacatcgcacttgagcgtcagatttccttgagctgcatattctggagctatgtagccccttcattaacaaaaaaaaaaaagcttgtcggtcagttgagacctctaaggaaaacatgcagaaaatgccagaaaaacttgaataggaacattagctgaagtaatgaagttaaaaatcatacgctgacagaactaatgttggatcagtctggtcgttgataaacagcttggcagtgccaaagtctgctaccttaggtctccgattgtcatctaggagtatgttggatggtttcagatccctgtgaataactttcacgttgtgaaggtactcgacacctatggcgatcccgcggattatgtctaatctttgcacccaattcagagaggctcgcagtctacgatcttctcctgtcagttccaaataggcccgtgtgataagcatgcagaagatcagagctttacaggaatatacagaagataattatgcatcacatttctacaaagattaacagactacagtgagtaatgaatttgtttttttggttaggaatgggtaccaaatatgtagagatccaagctcatgttctccatgtattcatagactagtatcatctcgcctccttcttggcagtaacagagcagctcaacaaggtaggcgtgccttgtgttcgacatcatctccacctctcttatgaaatcctccttgcgtttgtcagtaacaagagactgtgtgagcctctttacagcaacctttctaccactgggcagcttcccctggtgattgtaaaatcagatgtttcaatgcagactttgcatttcaagatttgtggtagtgaagtcaaatcgtaacttagtttgcgtacataaaggtgtcaaattgttgaaaaaagtgcagacctgatagacaatgccgaaaccacctctgccaatgatattgctttcagagaaattccctgtagcctccttcacactagacagattaattgaaggggcagccaaagcaggattaggacgagcatgaacagcagcagtagcagctggaacgcccgcatcatcatctggtgaatataattgcattgatttacaccttcttgtatatcaaagcactcccttcgtttcatattataaatcgttttgtttttggtaaaagtcaaactatttcaagtttaattaagtttgtagaaaaaaaagtagtaacatttttaactcaaaacaaatacattatgaaaatatgttcaattatatatttgatgaaactaatttggtgttataaatattactatatttaactacaaacttagttaaacttaaaataatttaactttaaccaaagtcagaacgacttataacctgaaacggagggagtagaaaactatggggatgattttctcctctctagacgcctcccgtttgtagcacatcgtcaaatagttattaaaaaaacaaaagaactataaaatatattacatataaagtcaaattctcgtttgtgcacgtcgactaaatagttatgaaaaaatataaaaaatagtacatgtaaagttaaattttaacctctacaaattgtagaaaacaacaaattaaagtattcatacattagaagttttttttttataatttgtagaagtttaatttgtctcatggagcaatatatcatatgttaatctatcttatcaatttttttcatgactattcagttgacgtgggagaaacgatgggtcatcatctcaaggggcaaaaaaaatcccagtaaactgaacaaaatagttatcaggaattcagactttcagagtattacgaattgttacctgatactctaggcctctgacgcctcctaatcacatataggaggaccaacaaaataatgagaagaaccccaacaactgaagcaatggatgcaccaataaccacagcagctggaggccgccgttgccgaataccatctttgcctgtcacagttttttccacaaatatatcagcactcactctcactcatttcatcagcattagccttgtcaaatcttattagatttgctcattttgaaagtttttaccaaaaaacatgcgacagttttttttagcaatttcgtaaaaaaaatacattgctacctgcttcgtacctaactcagatttcgccaacctcacgtagagatcttgtcctccatcgacgtagcgcaggtcgacgaggtcgtcggcccagatgatgcatccgctcccggcgccgcagccgccgccgccttcgatgtcggcgggggcgtaggcgacgcacgagcagttggcgaggcaccgcgcccagcactcctccaccgtgacgcgcttgtccaccgtcgcgttatgcgcgtcggggagcttcacgccgcgcaccgtcaggaagccgtccgtggcgcagcccagcgccgcgtctcgccggcacccggcggaggtgtccctcatcttcttccacggcgacggcgacgccggggtgaagccctccacgcagctgcagaacgacgtcgacgccgcgccggcgtcgcacaggccgaacgccccgcacttgccgtagtcgtcgcacaggtccctcggcccctggaagaagttcttccatgcccggctgctcggctcccacaccagccgctggacctcgccgacgcccgtcaccacgaggcgggagaacggcgcgccggcgttggcggagtagccgaaggtgatctcgccggggctcaccgtcagctggtagctgaacatgtcggagtacgtccccatctccgggatgccgctgaaccacagcccgttccacggccccgtccggtacacctcgccgtcgccgtcccagagcacgttctccggcacgcccttcgtgtccgtcctgtaccggtagttccccggcgacgggtcgccggacgaacgccacgacgagaggtaccactcggcgccggtccacaggttcttgccgatcttcatgccggggagcagcgtgtcacacgggtggtcgaacgactgccacacgacgacagcgcccgcgccgccattgccgcggtcactgacgacgaggtttcccgactcgagcagctgcgccgccatggacgcgccgcccccggtcgtcgtgttcgacgaccacacgacgtggccagagccatcgagcaagaggaggctccccgcgtcggtgatcaccagcacgccggaggtgtccgtgagagggcggtcgcggttggcgacccagcagacgacgtcgtcggagacggagaaccatatcccgaggtatctccggctggtgctcgacgacgaagacgacgccggcgagaagaagcccagcgtgaatgagccgccggcggagacgagcctctcgccgtcggtgatgttccggcccttgccaagagtgtcacctagctctgcacctgtagttgttctgccagaattagaaaggagaagcatgcatgataggatgattaggaacattgagctcatggctgattagtagagaaggtaattaaccacctggatgcttaagctagatttgcatctctgtcgtctacatatagactggagattgaaagctggtatcacttggaggttaacctaatatttatatggattggcatttggaggttaagcagctgacttggtcatcatcgatttttggcaaaagagaatatacaactgatgagtgtgattgtatatatatttgtattgtgtctcggaggataattgtaactgcagtctgcaggtagcgtctgagtcataactagcaattacattttgtagccaacctgctaatttgtttacccatgaacatttttgtcttctctgcaagcatatacttcctccgtttcatattataagtcgtttgattttcttatcaaacttttttaagtttgattaaatttatagaaaaatatggtaatattttcaatacaaaacaaacatattatcaaaatatgtttaatattaaatttaatgaaactaatttaatattatagatgctatttttttaaaaaaaatgatcaaacctaaagaattttaacttagggaaaatgtcaaataatttataatatgaaatggagagtacagattgattcaccgtttggactttggagcatgcgaatggtcagtagtcacttgcactgctgcagaatactagtagtaccataattgtcaatgagtgtaaaaatattttatttgagttgtgtgcgaggaaggcattgtcttccgagtatcttgtatattcttgacaacttgcagatttgaatggcaacattaaaatcgggagtactatataaaatgagacaaggtagttcagttcatgcctgattggcaaaggaaaaaaaaaggaaaagaaatcggcagaaacttctgtttggctcaatgattcgacacgtatagaagctagaacagcacaacccatatactccctccattcctaaatatatctgacgtcgttgaattttttaaacacgtttgaccattcattttattcgaaattttttttaaatatataaaaatatatgtatacataaaagtatatttaataataaataaatcaaatgataggaaaataattaacaattacttaaatcttttaaataagatgaacggtaaaacatgtttagtaaagtaaatggcgtagagacggagggactatatatataaccctgtacagttgtactacgtgagatcgtcgtcaatgtcggtggcgcccagcagctccgactcgcgcaacggtggcctgcttctgccgccgtgaacccctggcctcttgggacgatccacccgtgagctcttgctggtcagcatcgcgacgaccgccgacatggccggcctttcctccggcgcatcctgcacgcacaggagcccgatctgcacgcacctcgccagttcatcttccatctcggtgtgatcaggccctgagactgagagagggagaccgatcatcgcgtcaaggagggacatcaccctgccctgctcccacagctcccatgcctgcacacaaagccgatttggtgaattaatccaaatgtatatgtatatttggtgatttggtgtatatatggtgatgcttacatgtggaaggagactgtacatgggaccattcctctgtccgctaagggtttcgagaagaacgactccaaagctgtagacatcgcactttagtgtcatctcccctcgccatgcgtactccggagatgcgtatccccttcatggaaatgtaactcgaccatgtcagtgacacagtaatactacgaaacatgaccagttggctgattgttcatgagcaagagaatggagggtgtgaagtaactgacggtgaaaccacaacggtgagattggaaggctctggctggtctgctgtgaatagcttggcggtgccaaaatctgcaatcttgggtctgaaactgtcgtccaacagtacgttcggaggcttcagatccctgtggatgacgcactcgcctgatccctcgtgcaggtacgcaataccattggcgatcccatgaatgatgcccaatctttttctccagttgagcatgagtcggaggccagaatcgcctgccagtgcaaggtacatcaagttagcaaatgccatacgagaattgtataaactgtaagaatgcagccttttttttttctggatattcgtttctctaagtaccaaatatgtagaggaccaaactcctgtttgacatgcggncgggggtaagcacacgctcgctgccttcgctgcagtaggcaaggagaccaaaaggtgccggtgtctgagcctagccatcacctccacttctcttgtgaaatccttcttgcctttcttggtgagggttgattggtgtagccgttttacagcaatcattctcccatcaggtaactggccctacagattatacaatttatattgtaagcaactgagaatacataaatttcatccacattcctccaaaaaaaaatcatccacattgactctttgacaacctcactacaaggaattttcattagaaaaatggaagcacacgagtgtcaagagttcatgaatcatgaccgagcgagtatgttctatcatgtagaaattagaaaaaggaaaggaggttaccttgtaaactatgccaaatcctccttggccaatcacatggctctgtgagaaatttccagtggccgccttcactttctgcagatcaactgaaggaactgttgtagcaggattatgaggtataccttctgcaatataaaaagaatcagtctgggtctggaacttcctgggaaatgtctaacgcttaccttaaatttgttctttctgtaagcgtaatctagaaggcaaaatttgctcagacatttgcttcaagacactcttattttatggttgttagtcagaatatgctctgactattattttaacatatcctattccaatggtgagatataactagtgcgttcgttccagtgatattgggtgagaaaacacatcgtttttcacgcgcacgctttccaaactactaaacagtgcgttttttacaaaaaatttctataagaaagttgctttaaaaaatcatattaatccatttttataatttaaaatagttaatactcaattaatcatacgctaatggcccacctcgttttgcgtatattcctaatcttctcaagtttacacttggccaccttgcaagatttaaattcaagcttttttttgaatttaaacatattttgcaaaatataaaacttattccaaattgtggaaaaacattttaaaaaacttgtttaaactcagacaatatatgttcaatttctatttttaaaatataacaattctcatttttgtagttttgaacaagttttgaattttgtaaaatatatttaaattcagctaaaatttgttcagatttaatcttctaaggtggctcaaggataaaatcatcttttgtgaagtttttatctcttcatgggaaaaaagatgtattaaaaaatggtcaaattttaccacagatttagagtatcctaaaaaaaaaccacaaaactagagtttaccgaagcaaatgttgccgatgaaaaaaaaaagtgaagcgtatacaagccattggagaatagcactttacctgagattttgtgtttccttctgcaccaaatagcaagtagcagtacgagcataataatcgtggcagatattggtgcagcaataacagttttccagagcataaacttccggctcctaccctcatctgtcatagctcaaaagttttccagagttaatcatcaatagatagccatggttaatattacatcgaacctgatccttactaaatgtgtcagctaagccaagaaatgtgcttggaaatgacgtgcagaactgaaatcactctgataaaattcagcacatacctaattcagactctgccaacctcaggaacagaccctgcccttggtcgacataccgaagatcaacgatgccgccggtccaaatgacgcagccgctaccaccgccgcctcctcggatatccgccgcggcgtaggccaagcacgagcaattggccacgcacctcgccctgcactcctccaccgtgatgcccgtgtccaccgacgcgttgtgcgtgtcggggagcttcactccctgcaccaacgcgaacccatccgtcgtcgtcgtgttgccgcagcgcagcggcacgtttcgccggcatccgccggaggcgtccttcatcgcccacgccgccggagacgtcgggctgaaccccctgaggcagccgcagaacgacgtcgacggcgcgttggcgtcgcacaggccgaacgccccgcacttggcgtaggcgtcgcacacgtccctcggcccctggaagtacgtctgccatgtccggctcgtcgcctcccacaccagccgcttcaccacgccggtgtcgagcacgacggagcgcgtcaatggcgccccaggcttggagacgtagccgtagcttatctcccccgggctgacggtcacctggaacgtgatcaggttcgtcgtgtacgtcgccgcctccgggttgccgctgaaccaccggccgttccatggccccgacctgtacctctcgacgccgtcttgccacaggacaacgtccggtatgccgctggtgtccagcacgcggcggtaggcccccggcgacgggtcgtccggcgagcgccacgacgtgaggtcccactcggccccggtccacaggttcttgcccatcttcatgcccggcaacaaggtgttcgacgggtgatcgaacgactgccacaacgtggtggtgctgccgcttgcgtcacggacgaccaggttgccggagttagacagccgcgcctccaccgaggcggcgtagggcgagttcgacgaccacgcgacatggccgccgccggagccgtcgagcaggacgaggatcccggcgtcgctgatcgccagcacgccggaggtgacgttgagagggctgtctcggttggccacccagcaaacggcatcaggggagaccgtgaaccatataccgaggtatctcttggctgacaccccgggggagaagaaccccagagtgaacgtgccgtcggccgacacgagcgtctcgccgtcggtgatgttccggccgccgcggagcgtgtcggtaacggccgcggcggcggcgaaggctctgggagcaacgaggaagaacgagaagaggatgacgtcaacgaggcagatgccagtcgttgccttcgccattaattaatcaccacgacgctaattggtttcttgctcagttcatgagctactcatttatacatgatctgcaatgcttatcagttatcaaggctaatctagtgcagtttactacagaggttacaacgcaagtatgtacagcctggtaaggtaaagtcaaattaaagttctgactttgtcatctgttcatcatttttttttgaacgaatatgttcatcgattagagagcacaaacattttgtattagtagcgtttgcatccaaggaattacttcatccgtttaacaatgtaagtcatttttatatttctcacattcatagtgatgttaatgaatctagatagatatatatgtctagattcattaacatcaatatgaatatgggaaatgctagaatgacttacattgtgaaacggagggagtaagttacaacttgtgcaggagtgtgcacctagccgcacctacacgtacaatatattttgggtttgttttttgcgttcatgcatgatcgttgagataaaaataccacagataaatggttaaagtaagtgattaaggtcaataatttgaggtcaacacgcttggcttggctcttcattttgccatgtcgatgaggtcagataacgggtcagtgaagaaaaccagcgattccttcccgcgtagaactgctagctaactttgctacactacaggatgctagcggtacagttcgattaatccacttatagttacagggggaaagatatatcactccacaaacaaacaactttaaatttaatttctacaagttgtaacaaaaataacaaatatagttgcgaatatgcgataactattttcagtttaatttgttatttttgttgtaacatgtagaagttgaatttgatcttgcatgttgtcgatgggtgatacccgtaggccggatatagaggttattggggtacgctggtacaaggatctacgtaatacgacatcaagcagacaaaagacaaagattatactggttcaggccccttgataggtaatagctctaatccagttgatgtgggattatatgatggaaaacacaggttacaaagggaacaatggaaatcgacggatccggcgagatcgtagtcgagttggttcgactagatccctagcggtttggctccttgtaggctccgacttcatatgctgtgagggttgtgttggctctgagattcgatgcctcaggccctccccggggggtcccttttatatcacaggttaggcggtttccaagtagaactcggaaacatcgaactttacacgatacattgatgacccagtcttgtccgagtatgactccttccatttgtaaactccgtgaggggtttccttaatatatgcggagagtatccgtatacgcgtgggtataccataccgatatgagacgtatatcaaagagtaaagggtatacctaacccgtaaccctgacagtagcccccgacttctgcttaaatgagctcgtgtaaccattcgcgacttcctgtgtcgagattgttgtcgttcctggtgcgaggaccgtagagacatgacgtagtcgagaacaccgtttgaaacccaatggtcacgagcgaatttaaactaaagtccaaaaaactgttgcgcgtaacggacccagaaattttcggcgggcatctctctccgttccttggaattcgcaccgtcggtagtgcgtctctttaaaggaattttggggatccattttgaagtccgcccatcgtgcagaaaacatcccgcctgcaaacgctcttagtcttctccgcttccacaagaaaccctagttcgtcgaccttagccccttctccggcgatctccgatcgacgatggatcttggcaaatcatcctccaccagcgcgtcgctgaagaagattcaggaagacggcgcccttcccggtcgtgggaccatggaaagggaagcaggaggtactaatccccagcccgtcttaggtcgcatggttgcgattgaagactacattctctgcggttttctccctccgccttccgaatttcttctcttagtcatgaacttctacggtctttctctgctccacctgaaccccaattccatcgcctttcttagcatcttttctcatctttgtgaggcctacattggggtagagccgtttctcgatctctttcgcttctactatgagctgcgttggatggagcccaacagggtgtctggatgcgtcgggttccgacttcgggatggcctgaagtcgcgttacatccccttccagtgtccctcttctcgcagcaagtggtggacgaggtggttctaccttcagatcaaagattcggaccctgtctttgttgttcctgaggaacaaccggacaagatcccgtcttggaccgcaaagccccctttgaccccttctctccaatccttcatcgacattgtcgacgatctccgagtatgaggcttgtcggggtatgaagtcgctgcagacttcattggtagacggatccagccgctctaggctcgagtccacccagcctttgactattccggaccggaggacgcgacccgggtttctcctcggggtatctttcttgcatttatcctaacatgctcgtgtccacgttcctcctgatttatcaaaatttggttctcgattcacaggactgaacagcgaaaccgtgggacgtcgtgtcagccaggtgatgatcagcggcctggcaacggcgagtaacatccccgttcccctttgtgaaaagggggcggccaaacgtgatgctgccatcaacgtaagtgttctcgataggcatcctgcgttttccttctgagatcactttatgacttgattaagcgtaggctcttcctctgactgacatcatcgggccactcgcggaccatcaggtgacggcatctctgaaagagaaggtcgccaaggaggcgtctgatgctgctgctgctaccacaagtggtggcaatgttccgacaaaggggaggaagttctcctctgtaagcggacatcgtcgcaaggcatcaaccccctcggtaagctatcctgtcatcagatcgtacaaccagaagaatttcgccttacttcgcatcgaccgtttttcaggcctcggacgcgtctctaccgcctccacgacgacaacgtcttgtgacggttggcgagaagtaagtagatgaacttaagtctccgtgattttgttcgagtgttatctgaaccatagctatctcatagggcggcacgggcgaaggcggtgcaagacgagtctggagggacttccggcgtgtctcccactgcagcctcgacggatgtcgtgcttgcgcccgggagacgcgaggcgacaccaagcggcccagtcagcaatcctgcggctggtcgtggtccaccggcggccatcctcacctgggaggagctccaggtcgagatggggcgcctcctcgaggctggtgctcgcggcattggccgtgagattgcggaggcgaggtcggcagcggcgtcggcgaacgagtgtgctgaccggcaggtacgcgagttggcggaggctcgtgaagacctcaagaagatgagggagttggtggccggcaacgagcgacaacggcaggggctcgaggaccgcatgtcgaagctcgggaacaacctgtcggaaatccgtggctcattgcgggtcacacacactggcctgcaccagcttgccggggagtgcggcattaagtctactatcccggcgaatcccgacgagttctcgcttacatcttctcttgcggagctggcggcggcgatgagggagatcccctccaagcatgcggccaggatcggggaggagacgtcgaacgggatctacaccggggcgtgccacgtcctcgcgtgtgtaaagctggcacatcctgaactcgatttgcgcgagatcttggatcagggggcggctagcaacacgcataaggaggtgatggaagaagtcggtgatctgggggaatctgttctccccctttttgaagagtaggacctcttgtactcccaagacatgctgtgtaaaactgaatcttaatcgcctttgtgcgtgcaattattgttctagcttactcttgtatgttgatcttgagaacttttgtcccttgtagagatgttgatgacgaggatgtccagcagcgcgggcagcccgagtcaccagcgattattccggttcttgcgtttgaaccacatgcgtcgcccgacaatgtagaccagacccttgctacggggacggagatggcgacgacatccttaggttagtagcccattcatccctttctgctcttccgactagatcaactatgttctcgaaagaggcgtgtagcttgacttagttgttcccacattgagcagatctcgagagtgctcttgctggccaagatcgtcgtatccaatattggaagacaaaatttgaagtagcggaactcgagagaaccatgcttgcagtgaagaaagagcaggctgtggaaacgctccggggtcatgaggtgtggttcaactcgtacttgaagagttgctgcacatccatggccaaggtctgtagagaacttcgagtgccccatggagatcccgaggagtcggcggccggatacatctcatggctgaacggagcatgtgctcaactcgatggcgtcggcaagcgtatcgacgaggccttgaagcaggagtgtcgtcgatcgagccgatatgccggagggcacgtgttggcttgcctacgagatcatcgcccgcacctggacctcgattttctccgtgagggttttgctcattctcggaggactccggcggagatagaccacctggcgaggtcgatggcgccgttggcggagaagatcttccagtctatggactggcgttggccttcttggtagtcttcgtaccctgtgatagatatctcaggaaaaaggtgtaatatagctttggatttgtgttaaaactgtaagaagtattttgtgaaatagagaagagatctatctttaacaaatctttcttactccggatgtcgtgtgtaagagtatgttctcagttcacgactttagtcagtcgtttgagtcgaacactctccctagcccccagccttgtcgtcggaggaattttctcggaggataaggctcttggacctttgatctgccttggttgaataagctctgatcctagctcccagccgtgaagttggaaagttaatttccgatttcgcggcttggttaatacgcacggtgagaactcttacacgaccagatcttacatggtctttcgtctctacaggatctgacaaggccttatcggctctgggcgtccccagccgaagatcccttaggttcctcggaggccttgtcaagacggcgtaaagggacatgaggataggtttcaacgctaggtgtcatcagggtaagggatcatcgggcggaaatactttgattgtaatatgggcctaagaataggctttattgatactgtaaggtgccttacaggtacggatggtattgactcatacatagaatttacgtagttggtcaatgttctaagaatttgctaactcgcgaccatcgccgtctgcgattttgaatgcgcctggctgcaagacttgtgtgatcgtgtaaggtccttcccatttgggtgagagtttgtttcgccctgcttggctttgaacccgtcggaggacgtagtcgccgatcgaaagtatgcatgcttggatgcgcttctcgtggtaacggcggagggtctattgatagctggctgctcgaacggcaactcgttcgtgatgttcctcgagtagatttacatcgacgtttcgctgctcctcctggtcctcgtcggaatgcttctgtactagtgtactctgatgtcgtagctcgctggggagcatggcctcgaagccgtacacgaggaagaagggtgtttccttgttagacattgtcggtgtggtgcgtacggcccatagtactgatgggagttcttcgacccattttttgtcatgtgacatgagcctgtcgtagacgcgggttttgatcccttgtagtaatatgtcgtttgccctctcgacttgtccgttactttaagggtgggagaccgaggcgaagcatatcttgactcccagcccgatgcagtaatcctggaaatcagcgctgatgaactgggagccgttgtcggttatgatgcggtgcggtagtccgtatctgcaaaatatacccttgatgaatttgatggcgttgtcggccttgatttctcccgtgggtactgcttcgatccatttagtgaatttgtcgatcgccacgaataggaacctgtagccgccctgtcctcgtgggaatggcccgagtatatctagcccccagcacgagaacggccaagtaagagggatagtctggagcgcttgcgcggatagctttgtgtgtttactgtggaattgacaggcttcacatcgctggaccatgtcgcatgcatctttaagggcggttggccagaaaaacccttgtcgaaaagctttcccgaccaatgtccgaccggtggcgtgtgacccacaaatgccttcatgtatatcaaggaggaggtgtctaccgtcgtcggacgagacacatttgagaagtaccccgtttggcgctttcttgtatagattgttgggccactgtatcgtcctcgggcaactcctcgctgttgatgaatttgattagtgggatgcgccagtcgtctgtggtctcgatatcggcaacggcgtgttctgcctttgtggcctccgagctaatgtcgggggtgaccgggctaacttcaccgctaacctcttttactgatggcttcgttaggatgtccagaaaggtgccgggctcgagcggttctcgtctagacgcatgtcgtgctaggtcatctggctcgatgttgtctttgcggtagacgtgtcggacttcgatcccatcgaaccttttctctagcttcctgacttctgcgagatacttggataactcagggttagagcatttataatctttgtgcacctggttcgcgactagttcgaagtccccttttacgattagtcgcttgaccccaagtgcagctgcagctcttgtcccggctagtagtccctcgtattcggctgtgttattggtcgccctgaagttgaggtggattgcgtgcttgaattgatctacggagggagacgtcaagataaaccctgcccctgctccttggctgttgagtgcaccatcgaacgccattgtccacgtttcgttgtcgacttggttgtctgatttgttatcaggcatagtccaatcggctacgaagtcggcgagtacctgggatttgatggctgttcgtggcgcaaagtggacatcaaactggctcagctcgactacccattttgcaatgcggccgacaacgtctttgtttctcacgacttcaccgagagggaaggaggagacaactgtgactctgtgggcttgaaagtagtggcgtagcttccttgatgtcatgatgaccgcgtaaagcagcttttggatctgtggatatcttgtctttgcgtcgtggagagcttcgctgacgtaatagactggtcgttgtactttctctctctcgacaatgatgacggtgctaacggaatatggcgtggcggcaatatagaggaataattcttcattaggttggggggcaacaagtacaggggggtttgataggtagcgcttgagtgcaacgaatgcctcttcggcttcctgtgtccatacaaatttgtcttgcttcttcagcaaagcgaaaaaaggttgccctcgttctcccatcctagcgatgaacctgctcaatgctgccatgcatccggttagcttctgtacttctttgagtcttgtgggcgacttcatgttctcgattgccttgatcttctcgggatttgcttctattcctctgccagagacaaggagtcctactcgcgaacacatattcctccgcgtccttttcgaccacgcgtactcgtttgcctttttcagatgcaatgtgcttctcgagcgattttttgaaaacaaggcaatcttccaaagaatgtctgtccgtcttgtgtatggggcaccatgctttctttgtgtcgctactttgtgggtctgggtgcttgggagggttcgcgtattctgctgcgaggacctccgcttgagctttccttttcccatttttgcgattcttcttcttgcttgactcaggtgcgtccgtggctggtttcttctctcccccggtcttcggcttatcgttcttgcgtcttagcgcatcatctgcgtgggcgcatcgctcaacaatctcgaacaatctccgagtggttgtgatgcgtcttgtcgccaactcctgggtagtatagcgatctctgacaccggatttgaaggcgcgaattacagaagcatcggtgatttcggggattgtatttttgcactcgttgaagcactgaacatattccctcaaggattcacccgagttctgtgtcaacgcgtgtaggtcgtcttcgatcgcgtggcgcttgtaggttccttggaagttggcgacgaactgttgccacaggtctgcccacgaagagattgagtagggcggaagatgcatcagccatgaacgtgcagagccttttaacgcagttggcaaataattcgccaatgcgttgtcgtctgctccggcagcatagagtactgtggagtagacttgaaggaactcttctgggtcggtgctcccatcgtacttttctattgctccgggtcagaatctctcaagccatcggacatcacgtagggaacgactgaaagccctacacccagcgctgggggcggtgggttgtcggcgatcgtgtgtccttcgtggatgtctgtctgatgatgaggaagacgaggatgatgacgatgacgatgggtcgcttggttccggcgtacgaatacgaggatgtcggcctggatctcgagaatcttgtcgtcatctcccgctgttgtctcggcgccggtctccatcattgtcatcgttatggcgacgtcctcgaccagtatcgtctggcacccgccgttcgtgatcgttgtgatcgtggcggttgtggcggttatcatggcctcggtcttcgtttgagcggtctcctcgatcttcgttattatggcgccgtgaagagacatgacgccgggaacgattctcattgtctcgtgcgcgtcgtgcctctcggcagccgttgaggtgatctcggagatcgctagtgccgcgaggtggaggggtggctcgatgaggcgattccctccgttcagggtcttcaccattggcatcgccagttggtggttgctccgggtgcgctgcggcggcggcctcttcggacgcgttgctgaggttggtcactgattcccgtagtcgttctgtccaatgcgtgatatcgtcgttcaaaacaggatcgtagggggtttccctcagtatagcgttgacggctctgatgtgctgggccggggtggccaattgattctccgcttctgcattggtgcgcgctgacgtgccgacatcatcgatagccaatacctcccgcggcgtgctcgttgttgatgatccatagtcttcgagaaggtgcaagactgatggttcgtgaggatcgatatcgattaccccaacaaatcgatctgaagttggcgtcgctcctcgttccttgtctttatccctgatggggatgtgtgactgttggaccttaggagatggcgctttcatggtgctgagaaagaccttgcaacttgagaggtcgtgattctttgtcttgtgaataggacaatagacatcacgagttggagaaatacgctgaattccacgctctttgcaggcgcgaatttcagcgcggatgttgaggaaaactcagcaggcttgcaaagtgtcacgcccgaaaattcactagtaatttccgaacttatttgtgcataaaatcctcgtccaggaatcagccgaggtacacaaactgacaatttaatatacagattcatcaaattaactaaaccgataaatacttacttaagaggcacttagtcctcaccaagaagaaaactgcagcggaaaataaaatctagcgaagctccggctccactcccacaggcagctcaactggggtataagccaaacgtcttctccttctggatcctttttcttcaactgaggttgattgattattgcaaggtgagcatatgacatactcagcaagccacacagcaaatatgcaagtgcacaaggataccaaaggatggcataatatcggctcatttgcaaaagcagcatttagcaaaacatttaagagaagtaaaacagtggagtaattaatcagaaattttaaccaacactgaacagcacacccatgctgcacaggcccaaccattctgaacaaccatacccggctgaacagatctaactccaaaccaggagctaagcaaattattaccagttataacatctataattatggtgagaggtgtgggactaatcacgaaaaacattgctcaactcgcccataaccgcgggcacggctattcgaatagttttactctggccagaggtgtaccactgtacccacaagacacagccccacatcatgtcaccatgtgcctcagtaccaccacggtacctcggaaaggggctgtgacagtaccccttgcataacacaatccaccgcagcgcaccattcctggatcataatcacccccttataaaacaaggcatggactccccagcgacccccgtgggcttatctccgccacttctcagtctggtgccccgcaatgaaccatgctatacaaaagataaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgagctaccattaaatataaccataagtgatagtgaaacattagttatcccaaatgtgtgctaatgtttctaagcatggctaagcaatcatatctaatatctagttgaaccaatatatataaagctcaactagtccaattataatcacccaaggtatcaaggaataaagtaatcaagaacaaaagggccataacaaagaataggttaattccacccaatgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctatcacgcaaaacgaggaaaaagactaataaaaaccaaataaacaatacataaaaagtaaacaaacatgtagatcatatttttagatgaattatgagacttgaacggcctcattctgacttcaaatgaatttattatgaattttacaagattaaatctaattaaagcccatttaaaaagaattaaataaatttaattcaatttatggacaattttaatatgtagatctttattttatacaacttttgcaacttgaaccacattaaactgagttaagatgaattagatatgaatttttaaagattaaatcggattaaaacctttaaactgattttaattgaattatgacgcaataatgaattatttttgaaaaggaaaagaaggattattgcgtcagcgggctagggtttcggtggaccgggcgcacgggcggcggttcacgcgaacggacggccgagatcgaaccaatccaagatggacggccgagatcgatcgggtccacggcggtttacggcggacggcctggatgacgtcagcgatgacgtcaccaccggcggcggcggctcggcggctcgggctcgcatgctcgccggcgaacgacggcgcggcgacgcgaacggagagcaccaggacgtagagcgcgacgcggcgaactcaccggtgaccaaagaagcggcggagaagcaacggacggcgacggcgacgaggaggaagcggcggaaaccttcgggttgacgacggcgatgaagctccggcggtctccggcgacggcgaaggggcggacgaggacggcgacgaccttgcgaacccgacggcggtcttcccgagcgacggcgacggctgaaacgacggcggcgcacggctggagcggcggcggcgacggcgaagctagggcacacggcgctagagctcttccgacgacgagaggcgaaggcgagggtggctacgggtagaggagagctcgggggtccttaaataggtgcaaggaggcggcggcgaaggcccacggcggcggagacggcgaaggaaagctcggcttggagagaggaaaaccgatccaattcgaactcgaatccatcgatttccaaaccgatttaggcgaagcttccaaagaagaaaaggtagaggagatcccgaggatcattttccctcaaacgattcggccggataaggaaagacgcggccgaatttggaaggagacggcggcggcttgcgctagggtttcgggcggcggcggcgacgcgaggaagacggatccgacaagcgggccccacctgtcagcggctgagagagagaggagagcggcggctcggcggactgggccggctgggccgaggagggagagaagagaggttttgggccgactttcggcccaaagccaaaagaagacttttaaaacctttttcaatttaaattatttcttaaatgcaattccatttactaaaaatacttccttagctcaaataaatcccagaaaaatctaggaattatagaattaagcaaagtatttaatgaaattttatctagcccaattttatattgagatttaacaaattaaaattagatcttctcttataagcttttaaaatcatttctaataattccttttaaacaacaatttataatttaaggatttttaaacaagaaaagctctttaacaattataattagatcattaatgatcaaataattactgaactgttctttgtattattaagagttgagctctgaaaaatccgagaaaatttcagagagttgacttaatcatggagaatttaataaaaattaaatccatccatgctttatatttaggaaattttatttcccacatttaacttcacttgtaaattaaagaacatttaatataaattctattaataatttattaaataatttataaatcctgaaacgaaaatcaggatgtgacacaaagtgtgtttcctggttttgtggataggacaccaggaccttgtcacttcggaagtcatcttcgtcagctcgcggttcatgtcggaacgacaaggtttggccgcattagaatccttctcgagctcggatgtcgtcgatgttccgttctccgcctcggcgggaggatctttcgacatggagtcgtcttggtttgtagccattgcgttctcgtttctagtcattggcggaccggttgagatcggcattgtggtgtaaaccgggaagacgatttcgccgacttgagtccacaccagcatcgttgaagcagggaatacttggctgaggttggtgttgacgctattgtcgacgaggctggatgacatagtagtggaaccttgagtaccaagtccccctacctggcgcgccactgtcgacgggtgatacccgtagaccggatatagaggttattggggtacgctggtacaaggatctatgtaatacgacatcaagcagacaaaagacaaagattatactggttcaggctccttgataggtaatagccctaatccagttgatgtgggattatatgatggaaaacacaggttacaaagggaacaatggaaatcgacggatccagcgagatcatagtcgagttggttcgactagatccctagcggtttggctccttgcaggctccgacttcgtaggctgtgagggttgtgttggctctgagattcgatgcctcaggccctccccagggggtcccttttatatcacaggttaggcggtttccaagtagaactcggaaacatcgaaccttacacgatacattgacgacccagtcttgtccgagtagaactccttccatttgtaaactccgtgaggggtttccttaatatatgcggagagtatccgtatacgcgtgggtataccataccgatatgagacgtatatcaaagggtaaagggtatacctaacccgtaaccctgacacatgtttgtggagtgatatatttcatattaatctatgttgttatttttttcaaatatatttataactatttaaatgatttacaaataacaggggatgtcctctcgtgggatgaaaatcatgtgttacatgagacaaaacgtatgcacatgtataaaattggcccattaccatcgtgactttggaatgggccgggccggattacccgtgacgtgctttacggcacgccaacttccgggttgttgattaccgttgagaagttaggtggtgtttggatccagggacttaactttaatctctgtatttagacactaatttagagtattaaatatagactacttacaaaactaattacataaataaaagctaattcacgagacaaattttttaagcctaattaatctataattagagaatgtttactgtagcatcacatagggtattcatggattaattatactcaatagatttgtctcgtgaattagtccaagattatggatgagttttattaatagtttacgtttaatatttataattaatatccaagcatccaatgtgatagcgacttaaaagttttagtcccatctaaacagggtcttaacgtcttttgctgcttgtcaacaagttaaccaaaaaaaaggaaaatggttccagttaactgctcctcatatcatgttaatctgtagttagaatcatgaatacatcagccattcaatggaatatctgcaaaaaaagatgaccacacaatgacacaagtcacaagcagccaagcagaagagacatctacaaagagaaactaagtcaacacagacatgcatacaattacaagcagagaaaagaaaatccttctcttctactacacctgagcacggccaatccaggcagtctgcatgcattaggtgagatcggttgtggttgagccttggacatcactctgacgaagcggacgcatggcggctctgctgtcaagtgtcggtctcttgggctgctccatctgcgacgtcctgctcgtcagcatggcgacgatttcggacatggtcggcctatcgtccgccatgtcctggatgcaaagaagcccgatgtggatgcaccgttctagatcgtacaggagctctgcatcgtcgggtgcaggcctcgccattgccgggtcaaggaggtccatgaggttgccctgttcccacaacctccatgcctgtatgcacgaaagaggtctaactgaaggatccaaatgccattgtcttgcaatgaagatttgatgtgttcagtgcactgcttgattacctgtggaagaagcgtctgcattgagccgttgcgaacgccgctgagcgtctccaggaggacgactccgaagctgtagacgtcgcacttgagcgtcatctcgtctcgtaacgcgtactccggagatgcataacctcttcaattcacgaattcaattcaaggcttcaaatcaaaacttgagcaacattgctactaggaacagccattagtttacttactgtgagaccacgagggtctggcctgactgatcggcgacgaacagcttggcggtgccaaagtctgcaatcttaggcttcaattcgtcgtctagaagaatgttgctcagcttgagatccctgtggattacactcccgtctggtccttcgtgaagatacgcgacacctttcgcgatggcctgaattatgtcgagtcttcttctccagtgcagattagctcgacgcggcaacgggcctgaaatgaagaagaacatggaaggtgacattatttattcatgtcatggtgaatttatgatcaggtcagtgatgtagcttaataagctgaattcagatagaacagggtgggtaccgaaaatgtggttgtccaagctcttgttcttcatgtaggcgtataccagtatacgctcattgccttcgttgcagtaagctaggaggcggagaaggctaccgtgatggagcccggccatcactgccacttctctggcgaaatccttcttgcctttgttcgtcagagctgactgctttagcctcttcacggctaccattctcccgtcagattgtactccctggtcatttccaaatttcaggtgattgcaattgcatttttggcatttgccagtgtacggtattaagtatttgcaacttatgtttaatttcttttttcatgaggattagtgcaactttcatgttacatgtgtctatcttctgaagagagaggctcaccttataaacggtgctaaatccaccttcaccaatcaagcaattttctgagaaattttcagtaatagactttatagtagctagattgactgaagcaacgcccatagaagggttatctggaataacatctgtggtattagcaatttagcatacagtttgttagcttagaacttcataataaatatccttaagattaaaagcctggatttacctaaaattccgtgattctttttgcaccaaatagcccaaaccccaaaagcgatcaaaagaatagcaatggtagcagctacaggtgggacaactagtacaatcagagaccttttggtctcaactgttactcagacaaaaaaaaaaagacatagagagagatcagttcatgctcagaattactcccttcgctgacttttctagttaaaacttctttagattaaatcaaatttatataaaaaattaaaagagattgcgacatcaattaggttcattaaatataatattaaaatattttgataatatgtttatttgtattgaaaatattgttatatttttctataaactaaattaaacttaaaaaagtttgaataggaaaaagaaaaggtgagagtgacttatattcgagagagtatcatatgtcggcatttcttttacggtgacatcaggatcgttactttgttaaaaaaaagaactgttactttgacatttctttcgctaatcttttatctggggtcattttcattcaaaatataggctcggattgaaacccattttcattattgttttagaacataatctttcaagataaaattgaaaataaagcaatgcacataccaaattcagacttagccaatctcaggtacaaatcctgcccgcggtcaacgtagcgaagatcgacgatgtcgtccgtccaaatgacgcagccgccgccgttgatgtcggcggcggcgtaggccacgcacgagcagtttcccaggcacctccgctcgcactccgccgccgtggcgcccatgtccaccgacgcgttgcgcgtgtctggcagcttcaccccccgcaccaccttgaacttgtccgtcgtcctgctcccgccgccgccgccggcgcagtccagcgccacgcctcgccggcacccaccggaggtgttccgcaacgcccacgccgacggcgacgcggcggtgaacccatccacgcagccgcagaacgacgtcgccgcggcgtcggcgtcgcacaggccgaacggcccgcaccgcgcgtagctgtcgcaggggtccctcgggccctggaagaatcgctgccatgcccggctgctcgcgtcccacacgaggcgctcgaccacgccggtgtagttcaccacgacgcgcgtcaatggcgcggcgccggccgtggcgaccgatccgtagccgtaggtcacctccctcgcgctggacgtcacctgcagcgggaacttgtcggagtagttggacgcctccgggacgccgttgaagaacctgccgttccacgggcccgtgcggtacaccttggtggcgccgccgccgccgccgcctcgccacaggacgagctccggtaggccgtccgtggccagcgtgcggcggtagtcgcccggcgacgggtcgtcagcggagcgccacgccgtgatgaaccactcctgcccgctccacaggctcttgcccatcttcatgccgggcagcagcgtgtccgacggctggtcgaacgactgccacaggtaggcgtcgccgccgctgccattgcgcacgacgaggttgccggagtcgagaagctgaaccaccgcggcagaggcggccaagaagctcgcggaccacaccgtccggcgagagccgccgtcgagcaggacgagctggctgccatcgtcgttgagcagcagcacgccggacttgccgtcgagggggcggtcacggttggctacccagtagacggtgtcgccggacacggtgaaccatatgccgaggtatctcttggtcgacttcccgggagagaagaaccccagagtgtacgagccgccgccggacgagacgagcgtctggccgtcggtgaggttctggcccttgtcgagcttgtcggcgacgcccgcggcggcggcggccgacgtttggccggagaggaggaagaagaaggcgaccaggcggagtaggttagacgattgcctggttgacctcatgacaaggtcaaaatgtctctagctcttgttgcatgcagaaaggctagctcatgcagcagatggccatgaaggatggtcatgtatactgatcataggcatttctggatatttggattggaatattggatgataaactagttaattcaggtagtccggatctgtctatttagaatttgaaagaggtacatcaaatcccatacgacaatatctaaattctctcaaagtcgtactccaactaattggctgaatttattaatttgcactcaattgggtgtgaaaaaattgcttaaaaagtgcaggtcaatgtgactgcttcgttccaaagatttcttcgtcttagcacgacctgtggctacacgtaaccatgtagcagagctttacattcttttggcctgaaaaaggaaatggagaagcacaatatgcatcctagttatccaatgggttaacacaaggcaaaagtctcccgtgcacgatgtctcacaaatgactttttacagacactcaaatcctactcaaaatagcaaacagatttgataaccggtcactagggcctgtttggttgctaccctgaaaaaaatttacctgacctgagactagcctgactcgttctaggctctgtttggttgctagcctgacactcttttactcaacacggagacgcgtgattagcctgagtcaaatcggtggcctgagcctcaggcgcagcgaggacagaagattaccatcataatctgtttcggcagccagcagaatgaagctgccctcccgtgaagctctgatgccgccactgcgtgaagcccttgcctggctgcctccgccgccgtagctatcgccgccgagtgaagtccatgccaccgtcgccttcgtctacgcgaaagcccctgctgccgtcgccggcgtgcgacaccagatttatcccgtcgtctttcgcggcggctgtcgattcttcggatcccgtcgttgttgcaacatcttggcgcgaagcttcagccaatgctgtgattcttttcgctcctgtcgttgttgccgattgaagcttgccgactgctgcttggatttggggatatttttaatccttgtactcctttggtttccctttttttatgtatgtgattaattgctattggaaagctacgatttcagttggaactgtcaagcaatctcgccgaaatttgcgtcttcttgtttagcacttaacttactagtgaattatcagacccaaatcactttttcccttctcaggcagcggcggcaaaccaaacaagcaaaagttcaggccgcctggccaggtaacattcaagaacttctcagaagcatggtgctcagggcatcaaccaaacaggcccacaacaggaggataaatttcctggtgttgcataccctgatacccagatgtataaacaaacggcattccaattcccaaatacgcttacagttccacatattacaagcaaacctatatacaaaaataataacaggtttattactaggttaacaacaaacaaacagggaaaatgagagacaccaacttcagtaatccaggttggcaagttgaacaagagattcagaggcactgacaaggagctatctgccttgcaattgagtatacgtcaactgattccccgatccagtattgttatcatccagaggaacccttccgacgaaaaatgcagcttgcttcggagcaggaagtgtaacatccccactgagcatcctgagcaccaggggcatgcttggcctatcacctggtaattcctgcacgcacagaagaccaacctggatgcatctgcatacttcatcgtaagagcatatggtgcccatgagtggatcgatcagctccgagacactgccttccttccacagtgtccacgcctgaaatgggtacagtgaattagaagatgccaatcataaaacgtgtattgattaccatatagtttgccatttaactggaaaatgacaaggggaagaagatagtatcatcttacgtaacccaagagattcattgaccattcttcatcaacaaatgagctgttccttcgtccgctcacaatctctaggatcaacacgccgaaactgaagatgtctgatttctcagagaatttgccctccattgcgtactctggagagatgtagccactgcatctcacagattttagcacatttagtttgccttctaggacatctcgtaatgtcaactagcaggtggattttgttatgatctaaataatgtagtaaaatcatagagttaatgatgcaagaagaaagcagtagtttagtgaggcaggtcagtacagttaagagttggatcgtagaatttttgttcaattttactctagtgaacaaaagtgaaaaagagccttactaggttccaacaattcggtgggtaagggcttgaagttggtgttcaccaaatattctagccataccaaagtcagatatcttggggttgaaatcatcatcaagcagaatattgctcgctttgagatccctgtgaataattttgagcctggaatcctgatgaaggtacaataatcctctcccaattccctgaataatcttgtatcgcaatttccatccaaatattagcctcttactttcatctaataagattcacatgaaagcaccaaattagcagacaagttcagttactggcttacatctaaacaaaatcagaacgtcaggatttgcaggaatcaaactaaacgttaccaaaaataaatgagtcaaggctcttgttgggcatgtattcatacagcaacatcttctcttctccatgaacacaacaaccaaagagcctaaccaaattccggtgttgcagtttggatagaactatcacctcgttcttgaactcttccaatccctgactggatctgtttgacagcctcttgacagcaatctcctggccatcaggtagtaccccctagaagtaatatcaactatgttggttcaggtattgatcttatagcattacgattttgaattccaggtcagaacaaagatagtaaaaacaacaatttcattcatattaacaagataggataaaatgataaaatgtttaaatgaccataccttgtaaacaaaaccaaatccgcctccaccaagcttgttgctaaaattatttgttgctgaataaatcgtgctaaactcaactagtggtgagcttagaactgcggatttcactgaatcacttctgaatatagcttcatctgcaggtggtccagcttcttttgtgatcagccgtggtgcttgtattctccttatgcctgcagattagtaaaaatattagatataaacctaccagacagctgttaacgcaaactgaactatatcagcaatctctaagactaagagataactgtcatgaaattatgtttggccgtagaatattatgaagtcttagccttgtatattcataatctgaacaatggcatgtatcatacaaattattcctctaaatcatacaacagaaagaaacactaatgacatcgtagaaggaatccaaatacatgtgaagaagtcagtaataaaaatattacccatttgctttatgacaaatttcttcaggcatccaaacacacagaaatgcatgagcatgatgccgataaggaagatggcagtatcagcgctcactaagacaattgagcatttatgctttgcctagaggaatgcatgtcaacatcgaaatttcgtggatttgcaagataatatgttgtcaatgctccgttcttatcaaacagaacaactggtcaacaagattggtagaatgacaaataaaaactgataaatttataagacaatggaacgtgatgtattagacactgttatccttcgcttgaccacttcaaccattccatgttcttgacaagttcagtatttgttgacgagatcatgaataaacaatcttaggatgtcactatctgaccatgccacctcctagctttgcttaggagttaggacaggagcgaagaaggcaatgcatttttttcatagagcaatgcttttcgttggcaagtggcaacaaattaacagcagccggagaaatctcgggacagtctagcatggaccaagtgctgaaaaaaaaatgaaaattgagacgcggaaatgtacgtccttgcagattatcagattagtcaacatatgcggcgaataactaaaatttctaactatcttcccgatccctaactcacaatccctgtagattgtctatacgggtataggtgggaacaggatggaactgggattaaatttttgcgggacctaacaacccagaaatttcttcattcatgcaggcaggatgacatttcgtgcattcctataccaaaaatatcgcttaaaatctgaggtgaaataagggaggagtagtacgtagttactgattctgggtcgcctttccgagcaagggaaacgcagatcgccgaggataagatggggagatcttcacggtggagaggatctgggcggccgacccatcgcgcctacggccggcgggtccccccccccccttccatcgccggccagaccgccggcggcttcggcctcgtcgcctccgccgtcgccgcggcacaccacctcgccggcagcgaatcccctcccctggaggccagtccgactaatgggctttgccgttagcggcctataccgtaagcaggccagatctagttgtcacatgcggaaagaataaattcactttaggtccctctatttgtcgtacagtctgatttttgtctctgaagtgtaaaaccggatacaacatatcccccaacttataaaaccagcgcacataaggtcaggtcctaaggtggtttggatagcagttttggctgacgtggcgcctacgtggctggtttgactaggtctccgtcccacgtggcattgacgtggcacttacgtagcaattatatctcaaaaaataataaaaacagcgggcccacatgtcaactacacaaaaaaaattaatttagaaatggtggggcccacggtggcccacatgtcaactacacaacaaaataaatatggtggggcccacgtggaccccgtatgtaggctgtagcaatttctttctcctctctatacccttctcccctaccttcccatatcagccattgccgtcgacgaagaagcttcgcgtgggtggtagagcggggcggagtgaggggcggcggcgcggcggatcctcgcgaccacgtacggcttcgtcttgacggcaccgacgacgcggaaccggtcgccgccgacgtaccccacctcgccggccggcaccccgccccccactccgccgcggcgccgccgcccgccggagtacacgacgccgatcctggagccacgtgtgcaccatggtccggttcctgaactcgaacgcctggagctgcaccgtcgcgccgggaagaccactgacgggaacagcacgatggggatctccgccgcttgctcctgccgcggcgccctcgtccacgcagccgtgcaggttgctgccgcccctgcatgtttcccatcaaacgtgtactagcaactacaaccagcaacaccatggattgttagttgagatgatcacatcttccatatatatcatatcagttatccccagctcctaggttttttctccagctatgatcaatgattcaaacgagtacactttgtccgatccacaggtctgaatattccatccgcagagaattctgagacgacgacgacgaagaagctagatggaacttgcagagtcttgagcgccgtggtctcctcctcctcctccgcggcagcggcggcgggctgcctcgagctcccgtccacgtgcggctgcgactcggcgggcggcggagccaagcggagggcgccagcctcgtcgtcgtcgtcttccggcacgaagccggcggggcggggcggagcggggggcggatggcagcgcgaagccgacgggatggactggggcagcgacgggcggacgcgcgggcggagtcttcttgaggtcgtcgtccccggcgccgccgtgaccgtggccggagaggggagatggggagaggggaggaagaagaggtaggggtgagtgacatgcggggcccacgtgggccccaccattttttattcttttatgtctaaaactgacatgtgggtcccatggggtttaatattttttcatatcaagttgccacgtcaccaccatgtcaatgcccgtgagacaaggagctagtcaaagggagccccgtaggtgccacatcatttaaaaccgggcacaatactgccgagggactttttctgcatggttttgtaagttgagagatgagttgtatctggttttgcgaccaaaggatagaaataggactggacgacagataaagggacccaagtgaacttattcccatgcggaacaacctacaatccggcttcatttagaatgggcctcaattcaagcccatttatctgtatgggctaaaatttaagttcaaatcctcatccttttcacgcttgattgggctgggattaaggcccatttatacacggccaccatgcttctttttaccaacgaacgaactgtcgcattcaaaagaagagaaaacacccccccttcttctttctccttgacgtcatgtcagtgaacttgttttcctttccctccttcaaaaaccatgtaagcaaatccaggagagaaaaaaataaagatctagacatcggacggcactatccaagtttaccacatcctgcgggcagagctcgcgtcactgccgtcacaccgtagggagtttaacgcgcctaagcatccacacccctcgccgggcgtccgcatcaacgctgctgctcccgtcgccgtgccacccactccaccatcagtccatcacatattctctcgtcctatctctgatggcgctgtccacatgcgccaccgtggcacgcgccgcgccgcgccgcgtcaggcgtccgtcagcgggtggaaacccaccggtaatgagaacgaacgccaccgcgaccacacacagaacccgctcggaaacacaaacatcggcgttgaacgcgcgacgaattccaacgcgagaacgcgcccaaaaccgcaaagcagccgagcttctctcgcgcgcgcaccaaccgccgcccgtgcccggtgctccccccactcacggcactacaacaggaatacccctccaccaacgtataggctgcaacggaagtgataatcgttgttaagcatccgctttcaaccactcggccacgcccagcgacccaagtcaacagaaacgcaaccaaccattatcttttcctgaaaaacctcccctcacaatcctcgcccgatcgaaaaggatcgtgatcccagatcgctgccgtgtcaatgctgcgccgccccggcccgagcaccgccgcctcgtccctgccctgaccccgccgcatcctccagttctgccgtcgacgctgcgccgcctcgacccgcatgtcgccgctttatcctctcccgtgctgcgccgacggctgaccggcacgccgccgcctcattgccccgatcgcgatggcccctgaatcccctgaccctgttgcctggaccgccacatcgtgctccatctcgtccgctgctgttctcagctgatctggtatgtgattgcggcttctaatgtacgaattatcattattccctgacgtggactgttgtgtgctctagatacttcgttaattttgcaagaaacacacctaaatcctgtagagctttatatctgcgataggcaagtaatgatgccctctttctctgcaggttgatccctagtgacttagttattagttattgatcatgccccaagtttctcgatggaattgcaatgtaagctaagtgattagtgaatcttgtggctatttttctgctctggtatgtggtaatgacatgaaccatgccttttttattaactttatcattatacagtgcagagtacccataaaaagatataaagttcatagctcagattgtcgactttttttaattagtttaagttatgttttgccaattactacctgctaccagatacataaatttaacatgtggacagttgtttgttgctgttctatcatctaaaagatgagtgtattcatgccacagaaatattctgcttttcttatgtccaagttccatttatttcagtgtgaagaattattagcagagaattcttaacaagggatggttccaaagatgcttggcacaaaaatttagccattggtgaaagcaaataatttgatccaaagagtaactctggctgttaagtgacaaattgagatctcattctgctacatgaacaatggtaagatttactaggaatatgtcattgcagtttaattgtcgtggtgtataagttatccctttgtgttcttatctgagctatataaactaatagaaacattggcatttaattagaaatacctggaatcatttccaattgtgtatagcagttttgggctatcttgttgatagtttgtgcaattttttgacagggaaagccaacccatacttcggattttttccaagctgtaatgggatgttaaatgttcatttccattacatatcttttcctgtaatccagtgacatctattttatggtgaagtgttgccttgaggatgatgggatagaggaagaagaaattgctaaggagaagatattgttgttgctgccaagtgcccaagttacagaaactaatgttgatctggtcacagagaaaattcaagatgatgttttttttttttgcaagattcaacatatgtttgtactacactcactaatatgctgtggtgtatacacaagttgtacttataagagatttgtgaattaatatattgtgatttttttcttatagtacttatgagtttttcttgtccaaatggaacctatataagatcgtagtgtaaattattaattacaaattggcaagtaagtaatatgtatttggtaaatgtgaacagtatcttccagttgcatcctattgctcacttacaacagttatttatgtcgttaccaacgcttatgtatgtatggctatagatcgtagcaacgtatagaccttagcaacgccggcataggcaacacatagtcaatgtgttgctattggaccttacaacgcttatttagacctttagccacacatatattcgctgctagaggggggttcctcttgtagtgttccggcgaaaagaaaatctacagaagcacagattctcgcgtcgcctagcgactagcgagactgctaagctagagtggttggccttaatcaaatactgctactgtccaacttgcggttcggctcatgtgattggtcgtcgcgtgttcattcgcgcacgagttcaatacttgtattactgcactgatcagttctagatgcatacatggttggtatttggcatctctgaaaattggacttaggattggatttacgttagacttgtgagggcattgaattgaacatgtagagacagacgagaggaaggagtagttgcgttggcgcctaatccgtttgtcgacagaaggaaataagcagcaaatatatagaatgttcaaatgcaggttctaacgcttgggaaacttctgtgtttggtcaactcgtctttcttaatgggtgatggaaaatatcttaaccgtgtcagcaacacggcaacttctctagaatctagattcccatgcaaaaatgaactattttttctactctaaacaaatctgaagccctcgaccacataaacaggtctgaataatataaccttaaatctgatgaaatcgatctttgctcactgtaatctgctcactaacctgaatacagtgatgcacgcaaaggcaaaaaagtataaataaaaagccagaaaagtcagaagcatctgtcatcatggcctcatgggtgccaatggatgatgcagatctgggacagatgagacgacaattgggcaataatgcccaactccaactccatgtagagaaggaaatttcgaacggaggtcgctttctatatttctcttgtcctcttcttctccccttcgtcctcgctaccatcgccctattaatattcctcaaaatccaaatttgagacaacccgaattcagtcctcagcgagtcggaaacgcgccgaaagacgaactggaggcgcccccccaaatcttgagatcgcaggtaatgtccataggcgccgagcttcatgagtcctcctgcgagggatcttgtcttgaggtttcttgcatattggcctgtgcattttgagttttgatgtgcttgctgctgatccgaattccatctccggtgttgccgtaagattctgaatcgaattcatgcatttgtacggcagatttttttttcccccgctagatccgtatggtgtggttatttgggcgatgatagtatgggtccaagaaacgcggttttccctgtgaattgaggatctccaatttgcttctttggcttcggtccatggcagttgtgttctccaatcccatggttcatgctagacgcttcctgcagacaggactagacattttcagttttggtaactgtgaagattatggcattgttttaccaagagaaactgctgcattgtgatatgtaaaaaattaccctttttttccttctcttttagtagaattattacggaacatgcttcgcttggcgtctgtatcgatctacgttctttattctaaaaggctgtgcttttttgtgagcattgtcatccttttttttttcctttcaactccttctgttcatttaatgaacaattccgttctttctggtgttgatactgccacgttttactgattttccattattttattaattcctacttgacaagattcttatcgaacaattattgtgaatcttttagtaggaatctcgtaaagcgccagtgtcgcattttcctttgaggatctgatttttcccatcaagcaatggtgggatagccagtagtaaaatttaggctttcaggctcactccacatcagaaaattttctacttacatactatcgtttgtagaacaatcgtggaagtttatgcccttgctcaaaaaaaaaaaaagaacaatcgtggaagtggaaaaagggttccgtgaagcgcatagatcaataatgtctaatctcttttcactcataaaaatgttttgcaggatggatggacatacaaatggcactaatggttcctgctctaagccatgcgagccattaacagactactgcatccctgattacattctgaatcctgactctgaacaagtcctcgttgatcaggcaccatgttgccctgtagtagtattcatcaactctagaagtggcggccaactcggaagcagtttgatcaaaacgtatcgtgagcttctcaataaagcgcaggtacctaatctagtagtttgggaagatggaatgctgaaaagattcccttgagccatagtaggacttcatatcattctctcatattatctcatatttggatccacaatttttacaggtttttgatttatcagaagaggctcctgaaaaggtgcttcacagattgtattgcaactttgagaagctcaagtctaatggcgaccctattgcttttcaaattcagagcaacctaagactaattgtgagtagcctaactagaaaacataaagaatgatctttttgctttaggatatgtcctcttaactaatgatctttgaaataggttgctggtggtgatggcacaacaagttggctgcttggtgtagttagtgaccttaagctctctcacccacctcctattgcaactgtgcctctgggaactggaaacaaccttccattctcatttggatgggtatgtctatgactattgttttgttccaacacatatattctcttcagttgtgataatctcctccctttagataattcacgcttgttgtgaatttgtgatcatatacgagctgtttttgttgttgagctgtttgacaacataagaaggtttagcattaagaaacatgcatttttgaattaatagtgaaatagtgatcatacgcttgatacctaaattttatgtcttattgactgtgagctgtgaggggtgcatgatttttcattctaaagtagaagattactgaatctgagattttcttgttagtttgatctggattccttggccgtctttttacctagtctgcataatctgcagccatgatctctgaatcttccctggcatctagttttatacctctattaaatttaatttgactgcaggggaagaagaacccaaccactgaccaagaggcggtgaaatcatttcttggacaagttaaaaaagcaagagaaatgaatattgataggtaatatctcaagcacacaatgttatatttgtttctgttttttctgtcatgcttgtgaaaagtacaagtcctgcccaataattcactgcgacagctctttcatatatgttgtgtagcagtcatttttagttttaaacatgagtaaaatgtaatcccttatatattctgcatatgaaagaaaacactcatttgaatgtacttttttaagttggcatatcatcatgaggatgcgagctccacaggaaggtccatgtgaacctattgctccgttagagctgcctcactcattgcatgcattccaccgtgtatcaggaagcgattcacttaatatggtaagacaactcactgtggatactgtttttacttgattctttctattacagaagtagtagccaatagccatggactttcacttttgaatagtatggacaattggacaggctgagaactgaatatatagatctttaagcttgcttagcagttttttcttttatatttttgttcaggagggctaccacacataccgtggaggattttggaattactttagtatgggtaagagttcctctggtatccaaggcacagcatgatgtttttttttttttttggtttatgctagttcttgctctaacagatatcaaacagtcaccgttgttatccagtaccttttaatcaggacttgttaacaatattatcgtagaacatattttagtatcttttaagcatatcatgattaataaggcagtaatagaaacatggtcatcatgacttcacatactgcagggatggatgcacaagtgtcttacgaatttcactctgagaggaagagaaatcccgagaagttcaagaaccagctaacaaatcaggttcttctcgtttctgtagggcaagtcttgtggcacatttcattttgtttatgctgaatgttgtgatgcatttctttgatgcagagtacatatgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 31807 - DNA, 642 bp, Oryza sativa
aactattttcagtttaatttgttatttttgttgtaacatgtagaagttgaatttgattttgcatgttgtcgatgggtgataccccgtaggccggatatagaggttattggggtacgctggtacaaggatctatgtaatacgacatcaagcagacaaaagacaaagattatactggttcaggctccttgataggtaatagccctaatccagttgatgtgggattatatgatggaaaacacaggttacaaagggaacaatggaaatcgacggatccggcgagatcatagtcgagttggttcgactagatccctagcggtttggctccttgtaggctccgacttcatatgctgtgagggttgtgttggctctgagattcgatgcctcaggccctccccggggggtcccttttatatcacaggttaggcggtttccaagtagaactcggaaacatcgaactttacacgatacattgatgacccagtcttgtccgagtatgactccttccatttgtaaactccgtgaggggtttccttaatatatgcggagagtatcagaataggagtgggtatcccataccgatatgagacgtatatcaaagggtaaagggtatacctaacccgtaaccctgacacatgtttgtgg

SEQ ID NO: 31808 - DNA, 629 bp, Oryza sativa
tactccaatgtctgcgcgcggttgaaaatacgaattcgttcatttgcatcgaactcgggggctgctgtcatggttatggataccacatacctaatagtagttgactaaatctcggcaggacccaccacataccatgtcctatacgaaaaccgacttcagatatggagggagttccgaataaggaaagacaactagagttttacatggaaacgacaaggactactcagattgtatccatattggtttccctagttctacttggacaaggggacacctatgggtataaatacaagcctccctaggaggacaggggggacacccaccatgagacgatcaacacgatcaccacgatcgggacgaccacctcatcaacgcccaacacaatcaacatacaagcctacatacgccaagacacgctgccagatatcgactttagggataggcatggctattcccctacggtatctccggataccggcaggagatacgaaagcgctatctctgatctcgccggcaccgattcgaggaggaagtctaccctgttggtgaaaacgagtcagactttcagtccaacatgttgataacagttagataggctgcccacatattgtactggtgtgattatggtg

SEQ ID NO: 31809 - DNA, 679 bp, Oryza sativa
tgtttgatagtgaaactttcatttttatctagcaatttcagtgcttgttctacttgttcttgcttgttcttcgattgcttgcaggacgagtgccctcgtggccgggttgacgcgcaccacaagttcgcggcgaccattggagacggtgtatcggttgctaaggcgcagcgtctttggacggttgtagtcgggccctgaacgtcgtcttcatccaatcgagttatcccttacctctcatcgaaagatcgggccacaaaccctagcgggttcgcatcagaaagtatatctctcggcatggaaatcgagaggaaatctcggatggcggttttccacccgttgccaaaatctcggacgccgttttccatccgggattaacgcgattcaatttccataactacatgattacgcgcattgatcggtagcgctaaatccttccataatttggattgccctcgatctcccttagcgctatactaataggagaggccggtgtcgtggttaggtgacgatctctccacgaccttcttctccccgaaaatcccaaaaccctatccgatcaactaagcgctggagggagaacgtgtggtggttccgggacagtgtaggtggcgaccggaaggccgtcgctaccccgcaagtgatcgccggcaacccctttgggatcaagccggcgtaccta

SEQ ID NO: 31810 - DNA, 17166 bp, Oryza sativa
ctggatcgatgacctgaagctaattgaagctaaatgggaacactacttttacagtggaactgatcagccagcttgtgtccctatggagcgcaacccaggacatcatgctaaagctagcatgcctgcagatcaactctagaggaagctctcgaatcatggagaatactcggcctcttcggcatacaaggctcagtgtctaggaacagtcggcaccaacttcaatcccctaatttggaaatcttgggcccctgcaaaatgcaaactttatgcgtagcttgtgattcaaaatagagtctggacttccgatcgactagctacaagaggatggccaaatagcggagtgtgcctcctatgccgtatgacgaacgagacggcatgccaccttttagcttcctgtagatacaccagaaggatctggagactgacggccaactgggtggcttatcagcaattggatccgagcaattgggagccatgccaaagcgtacacgaatagtgggaaatgttagccaataaaaggaaagtgcccaagaaagggctgcgatccttaatcctactcatagcctgggaaatctggaaagaaagaaaccaaaggatcttcgagcacaagaaaacggcggcccccaaccttatggcaaaaataaaggaagaggcaagaacctggataatggcaggcacaaggcgacttggagaattcttaccagcttaatcatagcgcttatgtaatttgtacagctcttttttttttttgcctctaggggttgtatttttttacgcctatatctaatgaaatagcacagtctcgtgctgattcctttcaaaaaaaaaatatttcaaacgtggaagactcgttacggttggacccaaatcgcgtcatgttctgactgaattttacagaaaggtcagtggacagggatatacacatttgtcaccttctcaaattgattttgctattttttctacaacatatttcttccttggttacgttgtgctcgtttttttttccctctctatacttggtcactgacatatgagcccaagggtagtgaggctcaaatgtcagtgacaatgtcccactatccacagaaatgttgaaaagtattgtatattccggtgtttaaaggtataaacgacctcacattagcaaaaatctattctcaaaaagataacgtcctatgcatatagttaaacctccaaacgttaaattaataatagaagaaaaatactacaattaaattgatctgtgaaaatgatatatatcaatacatttgtcattggaagcactttaatatagttatttctttaaaaacttttatgaatatataggatgaaattctgactagtgtattgtagattacgttgtgatctgtagaactttaacaaatgaaagagcaccccaggtacgtagtttttttttttttttgcggggaggtacgtagttttactgatgtatggtactaatagtgtggttggagaatatatattattcgacagtttattgctataaggattgtcaaatatgtagacacacacacaagacgagtgaaattgtgtaaacctcaggtcgatagagagatgcatatggatagagagaaactgagatcgacaagtgttaccggcaagggtgtcgagcagcgtagtcttgccgcagccggaggggcccatgatggccaacacctcgccggggcgcgcgctgccgctgacgccgttgaggatggtggcggccttccccccgctgtccaccgccgtcacccacacgtcctcccacgtcaggaacacgcccccgtcgagccgctcctccctcccatctccagcgacgacggcgataccgtcgaacgcgccggcgcagttgtgctccggcgccggtggagcttgtacaggaggcggcgtgtcgtcgggggcagcacgcccgcggacagcctcgagcacggtggtgaatggggaacgcaggagtttactgacgatggcgccaccgccgccggatgaacgccacagcgggcgcgacgggctcggcgtcgccgcccaacgtggcaacggcgatgtcgccatgctagctggtgagacagtacgtggcgagctcgtacaattagtcagtgcaagtgacacaagtgaaaccactagtgtgctcttccgttttagcctctccaatgaggttattttccacttgcagcatccatatccctatatatataggcatcaagtttaattagagtttgttgtgatgtctgcgtccgtcagtgttatggtggttcgtttgtaggttaggggtggtttggtgtgaaaatgaaaccatatctggcgtaaatgttctatttcttcgaataatggaatttatggaattcaatttaaaaatatactgttcattcaattttttttcacatattcaggacgcaactttttagcaaaactattccgtcgatctcgtacaatctatacacgaaaacgacgtatgggtgacgaaacggatggtgtggaagatgctagaccgaacggtctcgcacaaccaacatgcgagaccgaaagagcagtattagtgattaattatcaattagcaaattaattaatcactaattagattaactaatcactacttaattgctaatcaggatcattagtaatgattggcgtattgctgcggtatcgctggttggccgcgcggtctcgcgactttgccgcgccacaccctgcagcgccccgttacgcgagaacgacgttatattcctcctaaataaattatatcctgaatatttatgaaaaaagttaaatgaacactatatttgaaatttaattctttatttatgatctttgcttaaaaatcaatactggagaactgatctcttgtgggtaattgaaaaatcacatttgtcccgattccaatgggaaccggaacctaacaaaagatagctcttattcagtgagatctttttacttaacactcaaaatgaagcagtttgtcttcccttataaaaagatttgtaaggttaagatacctctgaagactagagtctttctctggttgtttcttaaaaacaaaattcttaccaaagataacctgtacaagagaggttggagaaaaggagataagttgtgccaattttgctctagggaagaatccattcaacactttttcttcgattgccctactgcaagaataatatggaacattgtgatatgtgctttaaacattaaaccaattctgaataaaactcagctatttggtacctggttaaccagttttgataaaaacatgaggaatatgatgatggtgggggctgctgctgtcatctgagctatttggaaaacaagaaataaagcctgctttgataacattctccaaaagatcccattgaggtggtctatttagtcggtaatctaattaaatcttgggctattttgcagaaactggaagcaaactgaagaagattggagctgggggccaggctggtaaagcaggtggcaaatgacatcttcaactaaagatatgaatggaggccctgtgcaagaagattggaatgattctgtctctgaaatcttgtctttgtctaccgatgtaacccccctgagttctcactcacttagcttttgtctagtccctgctgttgggatcctggtaacgtttgctagtttcagtttgcttgctgacctgctgttttcaggtttcagcttagtttctactgaacctctctgcttttcttttttctcttttggtagcttgtttaagactctatgtgccgttccattaatggaaaggggggctttcaggccctagttcagaaaaaaaaaaggaaccggaactaaaaatctttttttccccggttaaaaaacccaacaccactttatgatctttagtcctggttggtgtaactgatttttagtcccggttcaaaaagcgtctggcaccctactatttttagttccgtatcaacgcgtcgtatataatcccttgcacttatcctctcctccttgatcgcaaactccacccttttcctcctcctcatctttaacttcctctcctacctttcatcctctctcctctctctctttcctctctcttatccgctccttttctttgcagcactagcaatgaggaaggagcgaaggcggtggcggccgggcgcagcggcggcggcagccccacgtagccgtgctaccagtggcccgcgcggccgcgttgtcggctctggcgctggtggcggagcgggagagggaaggtacctggcgcgggtgatgtctttgttgattatctgtaaatttattgatttgtgaagtctttgcatctgtaaatttatgatgtcaatttgagtatgtccatccaatctgggaatttgtggatgattttgtgatgtttctgtgaatgtggatgatcttattgttgagtttggttcgaaatcaatatgcaaacagcaaaaaacaatgaaaaaaaagaaaaaaaatgtagtcctggattcgttgtcctggtttgaaacctgagactaaagagcattgcaaaccgggactattgtgggttttctccagcagtgaatgctacagccaatttatacagagtttgtaggttgaatgactacgaaggtcaagaaggtcaaggcatctattctgaacatgcaaaaaactagattttcgccaggagaatcctctcctagacctgaaagtgatttggcgcatcatggcatcaccgacgttggtctgatgaaaccgtaatcgccgtatctggtcacaccgatcaatgctattgctagaatggcaaccgcaccgtgatcaagcggaggggaacagcggatgccgtggagctaacgagggccatcggcttcaccaaccccgtctggccgacaagacgtccttccgtccaacaaagggggatggacacgatgaggtccgccggcaccatgctaccgattgcccctagccttttatccgcatagagctcgtctacattgccaccaccttgcagatctggttccgcctcccacaggcgtctacccccacagacaggagaaagctgttggtgtgaaaatcgtcgtacacacgaaggcctaaaaattttgcttgctctagtgcaggtcctatcaaataaggttcacacaatgccaatacaactaacaaggataaaataaagaagattagatcaatgggccaatcgttcatggggtcgatatagtatggtttgcccatgccgatactgatggaatttcggatcgatcggctataactaatggaattcaaaagtcagaataataaaactctattggctgaaacttagatacaatatatttataaaatcttctaatattattataatcaatcttgatagatcagacttaaccgagacgggataagagtgaaaataataagatagaatcttgagtaaataaatatatctttgaatatgagctgatatgtttgaaataaaacttatcaacactctatatagaagaaagttaactgatatcaatcaaaacaagatagaatataaatcatcaaaaactatgattatttatcacaatctagatagatcggacctaatcgagacattatcacagtaactagctgattataataaatattgcaaatttaatcgatgcaaccaattataatatgttaagcagatacttcatcggctaaaactcttatgaaactatgataagaatctatcaacttgagtaaatgtaataaacacacgaaaacctagaagattagagctaagcagaatagttcggggttaacattgtgcttaacggatttaaacgagtctatgaacatttttcagggtgactgatatagaaaccataaacttagaaagcagaacgaatcagagcaagagccaatatatttgataagcaatgcaagcaaaagaagaactagtatatcgaacataaccaaggaagtactaattcccaatacaagcgaaggattttgacaaaacttactttcttgttggagattgataccgatgtagcctatctcataaacaagaacttgtcaagagcaaaactagggtggcgatgccctaaaagttgaatattgaactgttattgtttacaaagaccccaggtgcacatatttatacctataagcaatactaagtctgactctatcacgatcgaattgatctaaaactctatatctaattaaggaaattattacagactccgactcccacactactcatatcggctaaccattacttaaacatttccgattctaacacgactccataggctcataactctattaacaaaatagagttaatagagcccaaactgatccctcatcatgtcggctatcatatcagccaaaggcttctgttgaggtaccccctgaaattgctgttgcacttggtctaactagttatagtgaggcaaatattggggtagaggtgatccccctagccgatactgcacctaaggtgagtgaggctgatactagaagttaacattgccccccatgtgatgctaaggagactgatgcaccatatggatatgttgatcaggaacaaattgagagccaacaggttgatgtagttacggaataggtgattgcagtgccacggttatctgtggaatcggctcaataaccggctgccttggcctaaacatagaggcgacttgatctggagtaattcgggggatgttttgccctatatgttgcggttgttgtttgaccagaacgtgaggattaaaccctggttgccccggcgccgatgtcgacgcaccatgtttcccaggagctaagactgacactatcggctgttctggggccaaacctgagataggccgatgtttatcagaactgagagtcttgtattgtggaaaaacaccttctggaagaaaaactggtcccttagcctgatgctcaactatcgtgccatcaaccacatatttaatcatattagttaaagtattgacaagcactcctgactagttgatcaatgcgtgacgaacaacataaccaatctgatcttgcaagtttttgaactcttcaggacttccttcctgcttattatccttgggttcgacatctttagttgagcttgtccctagctctccattgtttggcagcactatcttgtacctctgaatcactgtacccagcgtgtctagacaaatgaatgtaaaagttggttctgcatgttcatcatttgttaatactctagggcaggtccaaagaattgctttcgggttctgagcgtgctagttggtatgatcctgcaagcaacaagaaacaaagaggaaacaaagttaaatccataaatgacagccgatcggctggattgccgatgacgtatcgtccaatattaagctgatgcaacacgtgttagattggcaatggaatatataagatgagaaaagctagatccacctgatcggctgtagatattaatatgtttaaaccaagtgattgggatagatcggatagtataccgagatagtataaaccacttatgtgtaaaagtacttcaaggtgaagattatatatattcatagcatagccgataaggcaaatctgacatgtatcggctagtactccgataccaccttatactaagatatcaatatagacgaaatataaagaacaaggaatcgatctaataccaggataacctaatcagaccggtaatatagcttaatatatttcaaatgagcgagatcttaatataaaaggcagatttagtataccaagtaacatataatgaacaagataactaaaccaggtaagatcggcagaaaatccgatgctatctctattagcgatcataagacaagctagatattatgattcagatcattacttaatagatcaaacctaactgatgcagcattaagcatgaagagaaatataaaatctaaacaggacgatgatagccttttcaggatgggagatacaccatataatctacctcaacatcaatatctagcccaatcgtctatcttcgatgatacgggccggccgatgaagttagatagtgatatcgatctagattatatagcatatatgataactcggagattcacataaacaagattagagtgtcatgaagatgtaagcactaatcccaagaacgtaaaccgccataacaaattttaccttttcgccgaagatcgaaaccgatgcagcccaactcgaaagcaagaactcgtcgaaacaatgaaagtagaaaaaggtggcgatgcgctgagaatattattgaactgatgttgtttgtttacaatgtatcgggtcatatttatacccaaaatacatgatatgtccttgccggacacgactctatctctattataactcaaaatatgaacaagtcccttaggcggactcttaccaaaaatatctgtaaggaaactactaaaatatcctaatgaatagatacaattgcccctaatgaatagatacaattgccctttctggattcaatccatgctttgcaatacttgcgtagagtttgaaccatcctcggtaacgatcccatgactgctttgccgggatcggctgtatcggctcctccccgtccgatcgggtaatagccgatgcagacggtagctgatacaactcttagccgatgcgggttctgtttctaaggctacagatcttcttcaaatccgtttcagttcttactttggatccaatctatgatttaccaattttggtcgttaatagcggcggcgcgcggccatcctgcgtggcgccgcggccaggcggcgtcggctcatagtggtggagcggcggtggcgcggtgataatttaaatttaactagtatatagaatgatgattcaaatgtaaaactaattaaggtgatatgactttatgaaagtagaaaagtattgagatagtttggacctagattaatcatctaaaggctaaaaataattgaggtaatataaattaatgggagaagaaaagtagagagataattgggaccatagattaatcatttaagtactaaaaataattgatgtgatatggcttaattagagaagagaaaaatatcattaactaagtgaggatgaactatagaggtacacagtatatcatgtaaaaataacgaagatatatattaaaatattatatggatcatgtgggatgatgatttaacatgcttgcattctaaaagctctaaaatttaataaattataaaattatagatattatagcatgtttacatgatgtttaaatttaatgattgttagtggatgatgatataacatctttttagtggatgataatgtgacatctttgcatgttatgcttttagagtcagtgggttatatctatatagtaagagaggattttagactttatgaaaggttgatggatgtaaaattggctattctctattatttaattaatgccatgattttcttttgcaaactattctgtactatttaattatcctcggttttcttttgcaaacctatgttttacatgattttgcattgaaacgttaaatatcactacctggaaaaccggccgttggcccatttttctaaaacatactatacacaaacgctcatatacacacgtacacactcactcctatgaatatatacgcacgtacatcctacatatcctgagattgataaagtcaccgcagacagctcactgttgatatcaatatcgcctaccactaaatatgggacttcaatccgggtagacaggttggtgttaacatctaagctccgcccatttttagctgtaattgtgttgctatatgtccttgtcttatataattgattaagttactgtgcgaacaatcaagagcttgaaattatcataacagtgggagaaaataaacattatttacaatgttgagatgggatgtactccgatcatattcataatataacagtctagattaaaacatagagccacgttttctttcaaaaagaaaacaaaagatctccgtcaaaatatattttacaaataattcaaattaggattagattattctaggaataggcggcaaaaaaaattacattttactctgtaccaaacaaaacagatatttttcccatttaaatgtaactagctagtttatttggaccacaagtgtgcaggaggccgcttcaatgtttttgcacaagaaatattcgatctccagtcgttagttttttcttcttctatatatatgcatgcctctcggaccacatcaattctttggtgtcctcattattctcctgtccacacttaatataaagattcgacagataagagtccacatctgttcttttgccgatcgacatgcttttcacatggcaatgtataccatatttgattgctgcggcgacagatgtgtgttggttctgaactttctcttgctctgcacttctatccgtcagaacgtgataaaacggcccagccacttgttgcatcccacatctcctgccgctcactgcttcgcccacagaaggatttgtattagaaaaatcaaaacttgaaggaaaaatacaacgaaatagggaaggaaaccacattaatatatatatggaatttcaaaccacacgcccttaagaaaatggtgatcacatatgcacctgcatacattccacataagtcacaattgatcacatacacttcagatatatacatccacgtacttaggccctatttggatcatctaatcactagactaaaattaatccctagactaaaaactttagtacctactgtttggatccagagactaaaagggactaaaagcacgtggaccgaggaagagagaagagagaggctgttactttagtccctataagtacctccacgagggactagtggattttagtcccaatatacatatttagtcatccatgtttggatccttagggactaaaatggagggactaatccattagtaccataaaccaagcagggccttaagcacattgcacaaatatcacaagtgagatggcataaaccaaacctcgggagtcttcaataaagcaagccaacacatgctaatttaattaaaaaacaactaactattagcgacaagtcagaaaataaagataagagaaatttcatgtacttgaaaaagtaactcgaggtacctaaattttatactatttttttatatctcaaggtagtacttagaggtactagatttgaccctagaaagtgtggtaccttccgatactttttgatggactgtaaaattacttaggctgtgttcttaccccaggttttccaacttatctcttttgttttccacgcgcaaaatttttaaactgcttaacggtgcgtttcttgcaaaaaaaaattatatacgaaagttgcttaaaaaattatattgatccatttttaaaaaaaaaatagctaatacttaattaatcacgtactaatggatcgttctgttttccgtgcgcactgtaccggttgggaacactctctagcgaacacagccttagtttgttatctactccctttgtcctaaaataagtgcagttttaccttggtcatgtccaatatttgaccgttcatattatttgaaattattttatgatcagtattttcattgttattagctgataaaacatgaataataccttatgtgtgactaatttttttaaaaaaatattataaaatttttaaataagacggacggtcaaacgttggacacggatatccacgactgcacttattttaggagaggtccggtctcaataactaactatggtatgtactcaaatactcgatgggtgacaattcaatcatcccgcctcctgctcacctcctgggtagtccagccatctgtcaattctgctacaggcagcagtgccgctctgggccagtttcttgtagcgaaagccgggacccgatccggttgagggcactcttgtttgcttgctccctgctccggcctcggtgccaccaaaactgttgttccccgtctctgcaaggagactgcgcaactggtcgtcaaggacacgacggctgaagtactgatcctgatcgagtaggagctgcaagctgggtatcctctacatatcccgccctcgaatactcgatgggtgacaattcaatcgtcccgcctccggctcccctcccgggtagtccagccatctggcaattctgctatagggagcagcgctgctctgggccagtttcttgtagggaaagccgggacccgatccggttgagggcactcttgtttgcttgctccttactccggcctcagtgccaccaaaaccgttgttccctgtctctacaaggagactgcgcaactggtcgtcgaggacacgacagctgaagtactgatcctgatcgagtaggagctgcaagcttggtatcctctacatatcctgccctgccccaagatgccatagttattgacaccggaccggactggcggtcggaccggaaaaaaccggaaccagcgcctctgccggtctggctcatctaaaagaccgcctgtgcaatcaaaccggtatagaccggctggaccgcccgattttgcagaaaaccgcctttcccaggcatacaagcaactatgccaaccaccaagccatgtgcttccttgtgtttggaacaaaggagttatttctttattagatactgaaccgctttggacctcgaccgatcagaccaataaaccagtaaaccgacggctttgccgattcaattgccggtccggtctcaataactatggtatataccaaagagcaagaaggagtcgtgtctgatgcgccactaatatctcacccctgtagcctctctcagtctctcgcgtgattcgtggacgattttgttatacgcttacaaaatttatcaaatgtaaatgcagtataactataatgtaattatattataatttgcatgtaactatgatataactttcacataattttagatcattagatttacttcaatattcatgtaagttgggaagaaaagaaatcatagtaagcacgggtgaggagattcggtcttgtgacctccgcttcatgaaaatagcatgttactggggatttctaaaagttattgcaattacattatgattgtactgtatttacatctttatcgacaaaattatagctagtccctttgtgtatgcgcagtcacagaagcagtactaggcttctggacagctgggcctaaagctaatgcttgttgggccatgattttatgaggtatattggcggtggtggtggtgggatgtgtgtgcgcgcggggggaggggtatcatagtggggttggtggtgcggaatataagtcctggcaatgccctggtccacagcatagggtatccgaggctcatgtttgcctctacggaagtgcacggatactgctgttgctttctctcaatagtatctgtcgatggagcgattcctcggacaatggagagtggagacccctccccaagtgtgaatattcaaccagggggtttgtggtgtacggcgtagaaagagatcaaagcaagagcggatctgtggagcccgagctccccgccaagcaaaagacacaggaattatacaggttcaggccatccggaggtgtaataccctactcctgtgttggtttcattgtctttcctatatcagctgagtacaacgaaggccttttcaggctacaaagcgaagtatactgatctaaagagtccaacccttcatccgtagcttgtccccttctttttatagtccatggaggggctcacattattacaaatctactccttgtcttgtgttatcagttgtcttgttgccggttggttccctaacacaatcttcgagaaacctgcattacctcgggtacctaggcttctgtccgagacagctgggtcacgccatgtagacccccgtttttataacaggaatctctcgtgttaatagtaccatttccctggatcaagtagtatggtactcacgattacattgctggaatattaattgcgattgtctagcgtgaattattacatcataagcccgcacgcagtcttagaacataggaccaaacggtccggaatacataccaaaagcagaaatagataagcagcagaatcaaggtagcggcgacgccattgccacaggcaacgaccgtaactaagacctactaagcgccgccatcttcttcaccctcgtggtcgtaagcatatgggtcatccgagacatcatcaccagcttctgatggaatttgtaaataacaagagtgagtaccaaccgtactcagcaagccaccacaacaatgatgcatatgattgaggatattcaatgaaaggctaatggtttatttgcataaagccaattttgcaattcttttcacaagcctaacacctagcataaactgatcaaattttatctctatagttcattaaacagccatggttctgtccaccatccattgtgttcccaaggatagcttcccgccactggtcgtcatggttttctggggtctaccccttctaacctctcgagaagttgatccaccagtctaaaaatcatcatgcatatcccacccaatcaaattaagaaattagagtctagccaagtgtaatacatgtcccgatgctcattaaccatgagcatggctatttgaatagatttggtttactcacactgtagtggatgtacactttacccatactcctcgactacccaacacatgagcctcgtcccaacacatgagacgcgtcacagcaaagcctttcaattacctcacttttgcagtatatgctccatgaacttatatcctcgtgcactttaggcgtcataagtttctagcagtgagaggagttctggcgttcccgggaagggaaaaacacacacattcctaacgttgcttcttgaagttgaacccagtccatatcgactgtcttctcttgggtatcttcttttagtcttgtcaagtcagtctctagccatccgtaacgggcatccgccagcggactggccatccattccgggcattcgctagcaaactgcttgtcacttcacacacctaaaagaaaccaatatgcagggatactacctccactcggctatttactccgctaggtctatacccactcgagaagtacgattgtactggggacgtttcatgtttaacttcatggctcggtccttaattgaccagggatggcactagcctttaccggacaccacccaagtcctccagccgtcccagtcgaaaatatttgtttagtttaattttctttcacaaatcatctcatcactgtcatggcaatgtggcgctcatgtctccacacgtcgtatgtcaattaccttccctaaggtaattgcccaagcataaagcattttgacaaatatgaatatgcatgggtctaaattagcatgggctaagcatttgtcaaatattgactaaagacacacgacatcatgcattacaaagattatatggataatcaatatcaaaggtatgggatgtaacaaagtaggacattcacatataaatagcatgcaaactttatttaaatcaaaataagttcgcaataggtccaacatgctcaaagattagtgataacttgccttgctcacagatttgctgacccggatctttgattaactcagcaactccttcggaatctaaatttacgtgcgaaagatttgattagaattcaaataaaatcaccaaaaattcaaacagtacaaagtaaattgagaaagtggtaccaacaattagatcttgattttagatgaatttaggttcaagtttcattcgaatcctagttaaaatgagtgagttatgtaagtttaaagattcaaatttgaattaataccaataattgtgaaatggtactgtttataattgatttatttttaatccgaaacattatccaaaacccactgtggttgacatgcgggccatccccctatttcttttctctattttattttcttttggaaaacaagctgtgtcattgacaggtgggaccggccctattgacaagggggtcaaccagtccttgtaacaaaatctataactaagttttcttagattttaataacagggaccccacatgccattatgtgggttaatcaccattaggtggaggattgctgtgcgctaactacatgtgggtcccacacggtttctatctctcgttctttctttttccccatcgtcttctacctctcgctcacgaccgaacagagtaacggcgcgcagcgatccaatggctcgagccgggacggctcggcccgtggtggggaaaggtggcggtgcatcacctgaaacccgccggtggcagcggcgaggcacggcagccatccgacgcgcggcgcgatggtgctcggtggcaccgagatcgcaagaacggcggcggcgcaatggtggttgattcgtgtgcaggcgacctcgatttaaccatctaggtttcacacggagtatagaaaaggaaaattctcgccgatgctacattggaacgaggtctccccatggcgagctcagccatggcgtggtggcggaccaagtcagcatggcaacggcggcgcacaccccaagtcgagggggccgctagcttcagggtgactaggcactgctataggcgcgagggcttaccacgggatggcgagacggcggagttcgacggcgcgcggcgtggtgcggccgaaacaggggcggctagcggttggcgacgctcgtaggtgttcgacgcctggtcttcctcattcagcagctcccggctccttccaacaacagcaacagcaacttctctccacaccccgccacccacatcggccgagaagccctgtggcggcggcgcagcccccgctcaccaggtgttcgacacccggcggcggcgcgatcttgtttctcttcgatggagcaagagttttagggagaggaagagcaaatgggaggttggaatttgtaacgcccagattttcgttcgggactaaaaatcattaaataatgtatttttagaaattaaataaaagttaaatcaaattaatcaagtgaaattatagaggaaattaaaatttcctttaaaaatcgttggccgagaatattttgtaacattctttctgccctaaaatactctccggatttttccgtaaatttttcggagctcaagaagtaattttaacatcacaaagtgcatttaatcaattagaataaaaagaaaacaaatcaaatcaccttccttccttgggccatttttggcccaagccttccttctctctctcgcggcccacatgcttttttctctcagaccggcctaa

SEQ ID NO: 31811 - DNA, 2427 bp, Oryza sativa
tcaaatcttgtaaaattcatatctaattgatatgaactccaaattgggccattcaacttgcataattcatctaaaattaagctctatatgtttgttacctttttatgcaatgtttgcttggtttttattagagtttttcctcgttttgcgtgccagcgcgtagaatccattatttcagaagtctgcggtcgcgaggaaaagagttcagaagattcttttgatgaagcaaggcaagtcacacattccccttgagcattttgatcctactttacaaatgttttaccgtttgcaaataaatatgcatgttttgctaattacaggggatccgagtattgtctatctgcttgcttgtgccttattatttgatatctatcctttgtcaaccttgggtaataaatcaactagctcatgttacttatgtgaccaagctagaactatatgcttagccatgcttaattaccactgataacaatccggcccagttggggttggccgaggcccaataacttaagaggttgcccggaccccaacagttcataggcacacctactcagggaaaggcccaatctccctaaaagactagtccaataggggaagagtggctctcccttttaaggtggcttcctcctcccaagctaagcaaggtgggattatttagaggctcacacggtcatcgccgacttttgcatctttgccagcgggtaatagtggaggatgtcctcatcattcccacccccttaaacaagggcctagctctgataccacctgatgtgctcgagggtgtcccgatctttcgatgagagtgataagtcgattggatggagtgacgttggcgatccgactacaactatccagggatgttgcgcctttgcaatcgttacaccaactccagagtgataagtcgtgaatctcgacggatgcacgatcagcccaaccacaagggtatttgttcctgcaagcaatcgagaaccagtaagaacaagatgaacatcaactaaatttgcgaatcaaagatgttggattgaatcaacagaagtaacaagtggggttcagtaacaagcaatccggcgatctaatcgatcacgggatcaactcagcaaagtagcgatgctatactttgatctaaacaaaacccgattattcttggcggtggagaaagctataagaagaggaagaggacgaccacaggggtgctggggtcgttctctcaacctaggacgcgtccctaatggacccaacttgatacacggcccattgggcctaaagaggtgacgcagcaccgtggacagaaaaggactcagtagtaaaatgaagattgcggccactctagaactgatatggacatgaagtacttgcacacctaaatcggagttcgcatgaagtcgtggcggccatcagaagttggtgctatgctgcagtccgaatccatcccgcgcaaatcctctccccgtttgatcctctccattgttcctgagtaaaacaagagtgcacgtgtctctggggtataaataagaatcatatgaatttaagaatgaatgcacctgatagttgagttgacgtgtacgagcgcgggtaataggaccatgaagttgtacttgtggaggcgtggatgtatcgttggtgttgatgtcctcaacaaccactagctcagttgatgggataattgcagtattagacctttttagtattagaacgggctgcgtgctcaagacacccgaccatgttgcattggtcgtaattatctaattaaaatgcgactgaatggtgggatgtgggtgcatggttttgctggtcgcaaccatggcaattaaggaccggttcgcgggatgcactggaagacatacagcgcttgccacaagcgggaatgggtaactgcttgacttgaagtatagctttccgctggttgacggatccaggcaagggtgagcgtgatggagttcggatgggccctgcgatggcctatgcggctttccgatttgcctaggcatgaaaggggactgcccgctgcctgttgggggcgcgggtgaaacctgaggtgtggtgtgtttggtcagagggggttatatgaaaggtcttgtcacaatcactcgacatggtgacgtgtccggccgggcatggttacatgccggtggattgtgtcttgtgggtacaattgtgcacctctggccagagtaaaactattcgaatagccgtgcccacggttatgggcgatcaaccagaatcaccgtgattagtctcagtcccaataaattgactcaatgcactgtagttcaggtggaatggttgggcctgttcaacgtggtgtagcgttgattagtggagattgaatgttaccttaattactcaatagttttactgttttgctcaataaaatgttttacaactgcctttatacaaatagccgtaaaccgtccttgtatccccttg

SEQ ID NO: 31812 - DNA, 10266 bp, Oryza sativa
ctaatgtcgaggagaactttaagggctcctcgaaaacttatgctagtgctctcatcatgagaatgctcacatctcgttagaacgggaaggggagtgtgagagaaaacatcatgacaatgaccaacatggcggcacaactaaagagtatggacatgtccatctctgatggtttcctggttcacttcattatgaactcattgccatctgactacggtccatttaagattaactataacactcagaaggacaagtggtcaatcgccgagctcatctctcactctgtggaggaggaggagtgtcagaaggcggaaaggcaaagaagcaagcctaccttgttgataatgagaaaggcaaaaggaaggctgatgagatttgtgctgctgaaaccagtaagaaacccaggaactctccacacaagcccaagccaaaggggaagcctaagacaccagcttctcctgctcctggtccatcagcaagtgccataatatgcaggttttgcaaaaagccagggctcattcagaagaactgtaatggctttaagaagtggctcgctaagaatggaattgagttccgtgaggactatcgcaaagggggagcgaagtcttaaagtggcggacggaaacgaacttcatgtagaagctattagagacctttcattagttttggaaggaggccatcatttatcactagatgatgttctttatgttccatctgtcaaaaggaaccttatttctgtttcatgtttaaccgaacgcggtttttgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgcagcggaaaaagagataaaagcgagctaagcctgaaggcttgactcctgcagcgggcgactccattccacaggcatccttgacggcagcgacgaaaccaacctcttcgagacatcttcaactgagaaggacttcaactctggtgtgggggaaaagagagcaagactgagtactacccactgtactcagcaagtcataccggaagaggaggtatgatgcaagatatatccaagggaggctaaaggttcttttgcataaagccggcatttcaaagcagtagttgaaagcagtaaaacagttgtagtaattaatccatattaaccaatcactgtccaacgttacatcacgttgcaacaggcccaaccaaccacctgaactacaccagttcattaagctaaactaggggtgagactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctgggtacgtcggctagagaaaagctacactacaagcccagccgttgcccacgctggcttgtggtaagtacgataaattcttccagggcatcccgcgaaccggtccttaattgccatgggcacgactagcaaaaccatgcacccacagcccaccatgtaatgtattttaattaactaacaccattgcggtggcactaatccaaagctattgccaataatcaaagtctatgctttaatgtgaccccccttttgtgcactagttgaactaagcatggctaagcatctcctaaaccaacatctagtcattttaatacccaagttatcaaaggcgtaagggaaacaacatatagctgagtaataggacccatcccacatgatattgtaaaacaatgcaatatttaatagaaatgcaggatacttgtaaattgggtacaatatgatcaattgcaatgtatgacttgccttgctctcgcactgatgagaccacagcaacgtcttcgagcaaccacgaatcgacgaaacggccgaaatctacgcgacaaacaaagcacacaagcaaaacatgctataagactactgaaacaggaaacaaaaccatttttaatggattctatacatttttatgaatttactgagacttgaatggacttaaacggagctcggatgaattagttatgatttttagaagattctctgtgtttttactattaaagaaaagccgtaatcaatttattgcgcaataattcatcccagggctgacgtcagcataaggaggggtggcgccgacacgcgggacctgcgggtcagtgactcaaggagagagaggggcggctggcaagcgggccccaccgagcggcggctcaagagagagagggaggggcgccggcacgtgggccccactggcagtggcacaaggcgggaggggcgcggctggtggctcggctcggcttcaaagccggcaggccaagcatggcgaatgacggcggcacgcgcggtcgccggcgacggcaaccggcggcgcggacggcgacggcagacggcgcgaaaagcggcggcggcggccgaagacgacgatgcgcgcgcggaggacggcgacgcacacggaagagagggaaagagggaggagggggaatttttcaccgaggttggccggcgcgagtggagacgacggcgaacgacgacgacgagcgacgggaggacgacggcgacgggcgaacgatctccgggacctcctagggaacaaaatgggaaggattagagggagaggggtggtctacggcgggcggaaaccatggccgaaggcggcggcaatggtggtactcaccggcgcgcggggagaagcgggccccgacggcgggattggatggggatgcggcggccggggtagctttggcggcggcgaagctaatggcggcgcagattgactcggcggcggcgagcggcgaccggaggagtggaaaaggcggcggcggcgggtgtagcggtgcgggagtgatggagggcacgggagagagcggcggaaagaggaaaaaggtggaggggagtgcggggaagctttattggggctcgagagagacggacgaggccgggaggcggccggatttctcgccgacgtggggaatggagagagagagagagagagtttcgaatttgaatccctccgttgcggggtgcacgcgcgagtgggaggagtggggatggtgggcggcgacgtgggcgcagggcgcggagtggggcgcggaaggcggggaaggcgggcggcgatgggtggtggtttcggcggcggttggcgcaggcgtgggcggccggaggttagggaaagggctgacaggtgggccccacctgtcagcgcccgagagggagagggaggccgggagaacttcgggagtgggagggaggagcgggccggcgcgggaagaaatgggccgagccgacggcccaagaagagaggaaaaaggaggaaagaaaaagaaaaagaagaaaggattttttttccagggatttaatattgcactttgcttattttaattggttaaaattatttccaatgctctgaaaattccactaaaaatcctgttagcgtattttgacatgtagaacccaagaaaaattccacatgccgattccgattattatttgcatttattaatttagggtttctttcttgcctttaaacaaataatttcttccaaccatttattaattgaatttttgctagggaaaagaacttctgggcgcgacagttttagagttcattttggacacaaagaatgttttattcaatttaatgatgagattgtgggtcttgctctccagcaaggcaatctttatttgctctctcttgataattctgcaatgaatgctcatgatgttgtatgtaatgttaagattaatgagacctcatcgaaattatggcactgtcgcttaggcgatatttcgaaggggagaatggaacgtctcattaaggaagagatacttcattcattagattttactgaggacaatccctgcttagattgcataaaaggcaaatttactaagacaatgaagaaaggagcccctaggagtacgggagtacttcaattaatccatacgaacatatgtggcccattcccaataacgtcagtggatggttatgattcattcattacgtttactaatgattactctcgctatggttatatctttcccattaatgaccggtctgaggcactaaaaaaatttaagatttttaaggctcaagtggagaatcagcaaaatgttaagattaaagtagtgcgctcagatcggggaggagagtactatggcaagagtgctccatatgggcaaattccggggccatttgccaaattcctacaagaaaatggcattgtagcccaatactctatgcccggagaaccacagcagaatggagtggctgtgcgccgcaaccgcaccctaatggacatggtgtgaagcatgcttactcattccagtttgtctgtgaaattgtggatggaggcattaaagtctattgcccatatattaaattgggttcctaccaagtccgtacctaagacaccttatgaattatggactggtaagaaaccgactctaaattatttaaggatatggggctgtcctgctgaagctaggccttttaatccacatttaagaaaattagattctaagactgtaagctgtcacttcatcggatatccagaaagatctaaggggtaccggttttactgtccagaccatgtccataagtttgttgagatgagacacgcagtctttttagagaatgatcaaatccgtgggagcttacagaacagggagatagaccttgaggagattcggttctcgcaatcggccatccaacaggaaaatctaactgtacctcagattgtgccgtaggcgtcttcttctgtggcccaggctctagttgaggatattaatgaacctgtagcacaagataatgtgcaaactccacaacccactgagatcactaatgaaccattaagaagaacacagcgagagaggaggtctgctattcgcagtgactatgaggtctatattggagaagacattgggaaatcagacgatcctacttcatttaatgaagccattaatagtgaaagttcatccaagtggcttgaagctatggaagatgaattaaagtctatgggcactaatggtgtttgggatttagtagatattcctgaaagggtcaagacagtaggctgtaagtgggtctacaaaactaagtatgactccaaagggaatgtcgaacgattcaaggcaaggctcgtagctaaggggtttttacagagagaaggggtagattataatgaaacattctcccctgtctcaaagaaagactcatttagagttgtcatggtgctagtagctcattatgatctagagttacatcaaatggacattaagattgcattccttaatagtgacttggaagagcaagttttcatgacacaaccggaaggttttgttgtggaaggcaaggaacatatgggatgcagacttaagaaatcaatttatggtcttaagcaagcgtcaagacagtggtaccttaaattcgataatatgataagaagctttggatttatggaaaatgaagtggataattgcatttatatgaagagtaagggtggaagtttataatcttaatactctatgtggatgacatcttattggctagcagcgataagcacctgctgcatgagactaaggtgtttttgtcatctaaattcgacatgaaagatcttggtgatgcctcttatgtattgggcattgagatacactgagacaggtctaggggagtattggggttatctcagagatcatacattgacaaagtgctaaacagatataatatgagtaagtgctctatcacgcctgctccaatagtcaagggcgataagtttgggttattccaaagcccgcggaatcaattagaaaaggaacaaatgaaggcgattccgtgtgctttagctgtcgggagcttaatgtatgcccaagtctgtacgcgagcggacttggcttttgttactggaatgcttggcaggtaccagtcaaatctaggactagaccactggaaggctgttaagaaagtccttcgctatttgcaaggcactaagcactacatgctaacttatagaaagttagataaccttgaagttactagttactcagactctgattttggagggtgcatagacattaagaaatccacatcaggttatgtcttcactctcgcaggaggggctatttcattgaaaagctccaaacaaactattactgcatcgtcggcaatgcaggctgagtttattgcatgttttgaggcaaccggacaggcggtatggctaaagaatttcattccaaggttaagagtggtcgacagcgctaatggaccactcaccatatactgagacaataaagccgcagttttctattcaagtaacaacaagtcaagtgcagctgccaagcacattgacattaagtatcatgttgtgaaagatagaatccaagatcaaacaattaaggttgagcatataagcactaagttaatgcttgcggatccgctcactaaaggtctaccacccaacttatttaacgagcatattgccggcatgggattagtaggtgacctataagcaagattctagaatagaggcataagaatcaatcaacacccaataagattaagttgattcctatcaaggtattatagtggctataggtactgttgtcatagtgacattttattgattactatgacacattgctttggttcgctattctacttagactggactcgttagcattaagatcaagtgggagaagatcaagtgggagaatgttggttgatctcctggtaacgagaccagagagacacgtcgtggtctaggcccacccacacccacgcccacacgcggctaacggcgaggagcgagcgatacgctcgcatctcatccactacgtgcgccgatcggatgcgcatcgttctccataacggattctcccccgatctcctctagcgctatattaaaagggagaggccgtctgtgcttaggtgacgatctaagtacactaaaccctcccgataaaccctaacgccgatcctaagaagtgctggaaggagaccgaaaggcgttctccaacgccgttcccggccagtgcaggtggcggcctgaagggcgacgccatctgcttcacctccggcaacttgctaccacgacctcgacatcaccgacgactcctaccgcgactaagatggcttcaagctcaaccggtcagtcaattcccgcataagtttaggtgatcatgtatgtgctaaggataagttaatgagtataagatctaataattgtatcgtagtcaacacttaaattaataagattagccccatgtagtatttttattttcgtggttgggacgctttagataaattcatgcactaaaactagcgtttcagagcaagtttaatagtatagctaaccgttggctccaaattatctatagtcaatttaataatcaattcatacaataattacctataaatatatactacacaattaatatcttatcccatctgacatacacaaatacatcttagagtttgtgttgtagctgtagccagttgctcttctctcttctcttttatttcatcgaaacatgtttatagctagattatagtctctattaccacactaaattacaccaacgtaataaattgtattctgtccatttaatttacttataaaaataagtatctgacgtgacggccctcgctagatgggggaagccggaagcccaaagggcgtttaatttaataattcaactgctgtgcttctcctccggaaacgaagggtgactttagtcaaagactggtcaccaccccactttgcttttggcgacgaaaccctcgccgcgatggctacgacccgccgccggaccgcctctgcgattccctcctcatccgctccagccgacgagctccccggccgaggaggggacgcgctgggggcggagcgcctggagggttccgtaccggccggggagttggtaaaggcgaaggcgacgaagaagccggtcgcgttcgcgcgcgtctggtcggaggcggacgagctccgcatcctggagtgcctcgccgcgcacgtcgagaagcacggcgcgcccccgggtcgctcccagctgcccgaggtcctcgccggccgcggcctcgacaaggaggagttcaccgtctcggagatttacgagaaggtgcgccgcctacggacccagtacgacaaaatgctctccggtcctcggcccgtaccaggcgacaacaggttcgagctctcttgtgccatttggggcaaccccgtcgcgccaccaccaacctctccggctccggagaagagctcgattccggcgtcgggaaccaggggccgcagggacctagaggagctgcgtcctctgtatccttatctcgtcgatgaggtggagaggatcagcaccaatgagttgggtggacatgttctcaagatgggattggagttcatcgatgacggtacagccgtccgtatgaacggcatggcgaagaagcagagggttctggagctcaagacgatgttgaagctagatagtatgaggaaggaggtgacgaggacgttgctcaacaacatggattgacaagatcctccatcgtggtatgactttgtgcatgctgtgccccttttgttacatatagctgcacgccaatagttttaggatgcattagtactctatctattataagatggtaaggatgatccaatgatatgtgatctggtcatggattagtatatattagtttgcctagtaagatgatgctgatggtccaacggtatggatggcgtatgggttattaatatatgtaagtttatctagtaagatgacgatgatctatatatgatcttgtttgataccatcagccttatttatttttgcgcttgaaatgtcattgggccttcatatttgattggatgatttatggtcagctagttaaaatggattcagggattcagttaggcagaaagttatgtcagatgaaccagtactatattgactaaaattggaagtaacttgatgttaaggtaagttaaaaggacacttgatgttacagtatgttcaaagtagaaagttctcatatatataacaaagtaagttcattgaacacatgggatttgtgtactcgaaaaacctggaattgtatcttaagctgtcaggaccaccgagaaagatatctgaagctcccactacaaatatttggttttactactcaattccttacatgtctgctgaataaactgtgtattcaaatgcttagaatttagacgaagcgcaaagagcttaacacaatgaattgtgaggtatttagaacaattcgtccctatagatctatttgcatgatacaattttagagatcaaataagattgaatcaatatgtacgtagaactattttctatattaacgaacatgtataagtagttggtaaacgttatataaatacatttatgtaaaaacattataaatagagttggcggtggtgccagattcactgccaccaccatttgacttcttttagaatagcatagatagtcagatacagattattcttcctcttacaaatccataaaaaaacaataccgtatccgtatattttattttttgcagatagtgcctacaggcacatatagatgcctacaggcacaaatattaccgtatccgtaatatttgcaccaagttttagtaattcgcagtatcaatattgtgctgtgtgtactttatttttccttgaaaagtgctctgtggtcacttttgttttatcttttcatggggaaaatcaaattactaagaccttgtgtcgcatgggctgaaattttgacccatttatgtgtatgggccaagattttagttaaagttcctgccttgtaaactagtacatatggatgggttgggatctggcccattaaaacaagtcctgaatggttttcccggtaagaaattatatatttgttctgtatgaactcaattggttagatcaacctgatgtttgcctgatgaggaaagaaaacctttgcttcgtcattctgtacaaacatatatatt

SEQ ID NO: 31813 - DNA, 2772 bp, Oryza sativa
tcactgatgcgaagagttatctcaatcgggcaaactgccggcacgaatgaatatatctacatcggccctaagtaagcccgtcaccgatagctttgacccagacgaccagtgaaactatagtccgccacagatgacctatctctatcgggccacaactagcgcccgtcacagatgactactaacctttatcgggcctaaactagagcccgtcacagatgatactcatctcaatcgggcctaaactatagtccgtcatagatgactgatgacctcaatcgggcctaaactagagcccgtcacagatgactactgacctcaatcgggcctaaactagagccagacacatatgactagtgacctcaatcgggcctaagctatagcccgtcacagatgatctcatctcaatcgggcatttagttatggcccgtcacagatgactataatccacaaaaaaaataaattttgtttttttgactagcctcaggcctttgctagccatgcccgctgcaaaaatgacagaaacaaacacagatatccaatatccccagctcccagcatcacccattcatacatatgcattcacatacacagacatcaacatatttcacacacccacacattcacagccatctcatatttcacatccattcacatatttcaaatccattcaaatatttatcatatttcacctgcaaaaccgagttaattggatcaaatatttatttagcaagtcttaacataaacatatgaaatatatacataaatataagcatcacagttacatcaccacagttgcataataagtgttcatcattgcctaaacatagaagttcaacattgttcatcattttagtttaagcctaaacattcctttggggttaattatttcgcggaggatgaagctggctatctcctcacgaacctcctcaaagctggtagtcagagacttggttattgtgccctacattgtcataattccagattagttgatcgatcatatataagtactaaaatgtagttagtctatcacaattgagaccaccgacctcaaactcagccaaagtcttcaccttttctctatacagaagtcgcatgttgtggcacacatggaatccgcactggtcacctatttgttgcttcaccgagaagtcttttttgtggatgagggtgtcatgtcctgtcttcttgaggcctcctctttgcacgtattaggcccacgcttcatctatcgctagttgaattggggtccaatcatatgcgttcttatcaattctagagttcaggtaatgacatgtactccatttaggtgttatgaccagaaggatccaatgggcactgcggcattaatatagtgaaagttaattaagtactcaaggaatgtgtcatgctgttgtgtatatttagttaacactcttactatttattataggcacacataatgtactccttgtctcggcgggaccacaaggtgtcgtagatgtagttgaccattccttgacggtcattctggagatttgtgacagtgaccacttgtggatgaaggaaggcaacttccggtgcatgcttctgacaccattgccaacttaacctacacataggatcaacgatcttgtaaggaagttaaaccgattgttattaccagaatgagttgggcgacaatacttacaaggagtagcacttaaggaggcttgtgtccaccgctcggagcttgtagaggtcgaaaagatccttgaagtcgaccacgatataatttgttggaccaaggaatggctttccatcgtgctgtccaaggatatcggtagctttacttggcttcctggcgttagatttctccatgtagtataagtgaaggtccttgcaagcggtgcccattgcggcaagcacgtcatctccaaccaatggcatgcctagttggaactcctgtggagcgacgtatttcttcttgacctctttgcccttagtctcttcctggcccttgcccagatctagctttcttggagctagaagcgaggtctgcacctttcctccccttcctctcccctttgcttcgggtttatcgagagtaattctctgaggggaagagtgtgccttcctgctcttcttcatcggtgggggttcatgaatcgccttgctgtcggcctccgttcggtcctccccaaaatccgtgtcgtactgcaactgcacatcgtaagattgtgcatgacgatcttgagcaggaggggctgaaggagcagaggcgggtctctttggtggacgactgcctggtgcagtggttggcctcgctgtaaccctgatctcaatgaggtccttgggccattggatgaaggtaccacgggcatttcctagtgagaggacctcgtcgttcggtggatacttcagagggaacagctcgtattcgggcttcaccgagtcgacttgaacttttgcacagccggccctgagttgcgctccatgcactcttgtctctagggtcggcttgtacgcaagtccctcggctgctggaacagtgaaggtcggcatcaccctaactgtgagggtgcagctcgttggttcctgcgatagattaatcaatttttttagaatattatatatcatatggattcgttacgtctttcatgtattgagtaagttcacggttaccgttatgtggtcgacggcgctgtcgaccgatgttggattttccgccaactcagttgatgcgcaactgctgcgtttttcggtgggacttcctaactctttgtgcgcagcagcagcggcagcctgggggggatc

SEQ ID NO: 31814 - DNA, 30202 bp, Oryza sativa
  unsure (1)..(30202): unsure at all n locations
nnnnnnnnnnnnnnnnnnnnnnnnnnnnnnnnnnnnnnnnnnnnnnnnnnagtttgattagacacttactatagcttcgtatacttgttgatcttctgcatttggcatgaagattgtgccatcatcatgtttctggtacctagccctggcccagttcctagcccgagggtgtgggatatcgccaaacatgagcggtgtgcacgattcctccgcttcttcatcctcacgctgccattcctcttccttaccggcatatccggcggtaccaagccggtgcggatgctggttcctggtctggagcaagcgatatgcctcacttctagctctggactcgggggtcgacttcttcgcatggaattccgactagacctgttccgtgatccaaggaaatttctctcttggatctggatttgccgggttgtagacgaactcgccgactagcttagtcttgaagttcttccaagcagtgcccataaccttgaaagcagcccacctgagacggtcctcatgctccgcaggataatcaaagctctccttgaacgttagccaagcaatgtccttctctgcggccggcacgagcttgaagtcgtcttgcagaatactgaatttctgcctccctatgaccccacagatagacctaaatcggctcaatattttccttggagatgtccgcaaccctacggcgtccaccgctgttatgcggaaccgttccttaggaattttgttccctgtcctaggagtacgtgcccttgaggacccactagttgtcgtcgacattggttcgccttgctgagacattgtctactttttttccaaaaaaacaaaaaaaacacaattgagtgctacaatctattacaatgaattgaatgtcacttataaaaataaatgaaacatataaataaactaaattgcgcatatcacaatgatagaattaattgaatggcacatataaataaattaaacatatcatcaaatcctaaaatcataaattcacctcataccatctattcatccacatagcatgcatctatcactaaattgattaatgcaccacattccatctattcatcatcatgtcatcaatcaaaaaaaatcattcgtttaccatatatcatcaatccctaaaatcatctatcactaaaatcatctatcactaaattcattaatgaaacacattccatctattcatcatcatgtcatcaatcactaaaatcattcgttcaccacatatcatcaatccctaaaatcatctatcactaaaatcatctatcactaaattcattaatgcaccacattccatctattcatcatcaagtcatcaatcactaaaatcatctattactaaattcatcccaacatccacatttcatcccaacatccacattttcattatcaaccacatgcaggtagcagagggaggcgcgatggaggactcacatgaggtcggccgggggggctcggtggtggcggcggcgggatcggtggagggcgtcgccggtcggtggaggcggcggcgggctcggtgcaggaaggatgtcgccggcctcggtggtggctgctgttcgtgtcggtgaagaggcaagcggcgacgacgaggaaggccgacgccggtcggtgtagaggctcggtggcggcggcagcgggctcggtggaggcggcgggctcggtggcagtggcggcgggctcggtggcggtgncggcgggctcggtagaggcggcgggctcggcggcggtggcggcgggctcggtggcggtggtggcggtctcggtggcggtggcggcgagggaggacgacggcggcaaaggaggagttggcggcggtgctagggttctaaggaggcgggaaattgtagcgggacttagaaaaattttcgatccgatctgagaaaccctagttatattagagtgatgagtcatctcaatcgggctttgccgtagagcccgttacagatgactcatcggtgacgggctccatactaatgcccgattgagatgacattcaggcccgtcacggatgactcatctgtgacgggccctaagataatgcccaatagagatagattaatctctatcgggcttgaactaaggcccgtcaccgatgactatttttccatttcccagataagtctttatatttgtgagtacaaaatatatagctgctgtataataattcattttattagtcataacatattttcggatagtaaatgatttcaaatcgaaatatggtcaacaacaaaattgatcctctcatcaagatgtacaacttttattttggtcatttatctatataactttgtttctaacagcttgaaattgattttgacaatatgacaaatgtaaacagcatttgtgaggtcaatgtaaacaggctcttggggatcatcgtcaaggtcaatgtgaggtcttacatgaagattatggttgtattcttcttcatcgacgacgttgtcaactcctacaattcggcgctttccatccctcacgatgtgcatcttcttgtttgaagggtcttttatgtagaatatctgctcgacctgtttcgcaagtacaaatggttcatcggcgtatcccaccttagatagatctactaaagtgaaaccttccttgccggctttgacaccagtgcgtagattcacccaacggcagcggaacaaaggaaccttgaacttgacgtagtttagctcccagatctcctcaatgcggctgtagtatgtgtttgacccaacttgatcctggaatgcatctatacggacgccgctgttttgcactgtgcttttgtcatcttgtttgacggtgtaaaatgtgtatccatttatatcgtatccttgccatgtgtctatggtccaagacggtcccatccccaacaactgtactgtctcatttgggacatccgtggacattgtcacacgattcttgaaccattcgttgaaccaagaattatgttctctgttaatccatgcatcagatcgccccaagttctcatctcggattttcactaagtgctcctcaaagtatgggccaacttctgcatatgttggagcacagcgtaatgagcctacgcgtacgacgtttgatcgggcctaattcttttccttccgattgtgccaacacctgacaaccttccctcgtgacgagacgctggaactctgataggatcggcatcggacatgtaattggcacagaactcaatagcctcctcggtcgtgtaaccttcaatgatgctcccctcgggtttagctctgttacgaacataagacttcagaactcccatgtacctttcaaacggccacatttcccttagaaatgctgggccacatagttttgtttgcttcaccagatgaacagggagatgaaccattatatcaaagaaagacagtgggaaaaacatctccaggtgacagagggtattcacaatatcggtctgcagcccatctagatcttctggatctataaccttctgtccaattgcattgaagaaggcgcacagacgttggatcgtgtgacgcactttcggtggtagaatgcctctgatagcaactggcaagatttgtgtgattagcacgtggcaatcgtgagacttcattccaacaagttttagatcgtccaatttaacatacttacttatcctcgctgaatagcccgatggaactttaatatccttcaagcatgataacattgcgatcttctcatccttcgacagtgtgtggcaggctggagggaggtacactttacctgtctctgcatctcgtatgggctggagttcgctgcgaatattcatgtcctgtagatcaaggcgcgcgttcaacccgtcctttgtcttcccgggaatgttcaacatcaggccaaccaaactctcacacacattcttttctacatgcatgagatcaatgcaatgacggacatcaagatctttctagtaaggtagccgccaaaatatggattttttcttccacatacccttctcctttgtcttgttacgttttcttttcttcccaaactcattgcttatgtccttgaccatattgtggacctcatctccggacaaatctttgggagcaggctgaaattctcttttaccattaaaaattttcttctttcttctaaatgtgtgacgtagcgggagccacctccggtgacccatgtataccatctttcgtgatttcttcagccaccggcttcatgtatgttccttgcaatcggagcatgccttctttccttttatagtttgtccggaaagattaccgagtgcagggtagtcattaatggtgcagaacaatagaactgttagcttgaagttctcctgaccatatgcatcccaagtttccacaccttctttccaaagaatctccagatcgtcgataacaggctccaggaatacatcgatatcattgccgggttgccttggaccttggattaacaagcacaacataatatatttccgtttaaagcataaccatggcgggaggttatagttcgcaataagaactggccaagtgctgtgagtactactcatgtcaccgaaaggattcatgccatccgtacaaagacatatcctcatgtttctagggtcggcagcaaagtctttgtgttttcgatctatattcctccattcaatcgaatccgctgggtgtctaagcataccatcattccttctttccgtggcgtgccaacgtactaacttcgctttgttcgggttggcaaagattctcttgaaacgataaatgataggtagataccacacaacctttgccggaccacccctctttgacttatttccttcgtcagcacttttctttcgcttgtatcgagaagccttgcagacaggacaagcatccaagtccgcatattgcttgtggtacaatatgcagtcgttgggacaagcatgaattctacagacctctaaccccagtggacacagaacctgctttgcttcgtatgtcatctcgggcaatgtgttctcaacaggaagcatagccttcaaaattactaaaagatctgtgaaactcttgtctgtccatccactacttgccttcagcttcattaggtccaaggtaactgacaacttagtgtgttttgctttgcatccagcgtacaaaggcgtctcgaaatcacttaccaacctgctgaatttcattccatctctctcattctgggctgggtcctcaacgtcacgtaacatgtcttgcagcagatcgtgatccacatcaaccatttcaccgcctaatggagaaggtataaacatgtcatgctcattttcatcttcctgattatgcgcaccacttctgtctgctgctgctccacttcctgattcttgctctccatgcttcacccaacatgtatagccctccatgaatcctcgttgtatcagatgaccgtgtacgtcctctccgctatcaaacatattcttattcttgcaatctgcacatggacaacacatgtaatcactgtttcttcttatccgatcctcctccgcggcgttcataaaattaattacgccctttcagtactccgtagaatgacgtttcaaatttttggcatacatccaacttcgatcaattgctaaaaaaaaaacaaattagaggcacatattataatattagtattgcaaaagtaagacgtgatgaaattgctcaattaatgatttatattactcacttgattgatccattttaatcacttttgggaatttaatttctattttccttggaaaaaggacaaaaaatcgccccctacagcttcccaccaaaatagtgaacagtgggatacagttacactaggtggtggggggtatttatactgtgcaacaaatatctgtaacgtccctaaaacaatcaaccgtgacgggcatacaagtaatctctatcgggccttaataaaaggccgtaaaaaaagagtgtcatgtgtgatgggcaataaactatctcaatcgggcctctagttggagcccgtcacagatgaccctcatctgtgacgggcttcttttagggcccaattgagatatggaaccctcatctcaatcgggcctcaactatagcccgtcacagataagtgtcattcgtgacgggctttagttttatgccgatataccatggctgtgcgaccatatctgcccgattgagattacttccttgtgacggcccgcaaattccagtcttgttatgggccgtcacagatggaaggatctgtactagtgacataagagtaaataaatttcacaaaactacatatatcgtggcttaaaattagttttcatatagttaatcgaacaaataggattaatctagtctagcaacctgaatttgtagtttatgctaaaaatatgtgaaccacagagaaacacatctgatgttcccaatttcgtatatttagttctgctactccatgccttttatgtttgttgagcaaactgtgcatttgggtgcttagaactcagaaaatatagaagacttaacacgagcttctttggcttttgcatgtcaatcatgtggaagatttgtactagttaattcctcctcttataaatccatcaaaatattatccgtttttatgaaagttctgtatatatgtattaattggtcttcatagaattttgtttacagaaatattaatgctactgccgatgtaatcttcagcatatgtaaacaatgtcatgctttctcgtaccttgatcttgtcataattcatattgcgctgtatgtctagttgtctacttttccttcaaaaacgttctgtgatcagtggtttgttttttcttttttgaatggtaatataaaataactgaggccttgtataggatggctggaatcctggccctttcgtttcaatgggccaagatttttttttttaaaaaaagtaagcggtaggagaggttcctatagtgaataaatataaataatatataaaaaagattacaaaatacatatgtacatgaaaatgggccaagattttagttaaatttattgtcgtatactcgtggatgggttggaaaacaaggtttcagtggtttttctggttagagatgatcgtattattctataagaaattatcaatcagttagatcgatctagctggtatttgccagtgtcatttggaaaaccttttctccggtaatgaatacaagcatagtttgtgtactcattgcaacaaaaacataggagtaaatttcacaaagctgcatatatcgtggcttaatttgttcagttacctatatttttctaaatttaataaaatgtaagttagagagaatcatttaatacactataatgatttacttttgcatctacgttttgaaagacgcctatatataggatacttattttcaggcgttataaatagattcctctatgagttttcattttcagatagtctgtaaaatggcccaacaaaggcacattgccaatttccacaaatagtgtaatcaattcattgtgacaagtttaaaaaaaattatagaaaagtgctgccttttattgtagtttatttgacaggaaagattctctctaaaatatcttaagctcacaccaaaagatagagacaaacactactgagtttctctaataagtttccaaaaaaaaaaatttccaccatttagtaccactaaacacacacttcttcagttaagtttcttccaagccgcagacaggattatctcacaagcatcagaagtcatcaccgtaaaagacaagcggcctctgctgctctgcatcaaaccagggagttaaactcaatatttaaaattgagaaactatgtgctgattgtctataaatatattgttgatgtaaatttggaatcgattattccgcatgagtttgaccatgatgcacatagtgtaatgaagacatgagtgtggaaatctctacgcgcatagtggaaatcatcgacccaggttacccaatagatgcataggtaaatctcatgtcatgatcacaaatagccatcacattttaagttgttgatttagatgtaccgatatatctaatcttctcatcatctggaactaatgcaaagatatgagtaccatcaactgctccaatgcaatcgttaaaatgtggccacatgcgacgatctttcctaattctgtcatggacagtaggaaaatttggattatttggacgtacaatatcacgtcccaaatccactacgacgtagagtatttcaaattttcttgaaattgtctcaccgcaatgcttgaaacggttttgtgccctttggtttgatgaaccatcacctagtatgtagagaaaaattgcaagtgcctctaatgtatgcatgtgtacagtaagttccagcttatatttactaaccaaaaaatcatttaatgcaataaaggtgtggtcattcatacgaagcatcttgtagcattcacctggtgtggccaaagtttcttgcacccatcccattccactgagacgtgatgtcctaggctcagccttatccaagtagagagagtaatagttctctgcaattcttcgagttgtacaaaaattgcttgcagcaatagcaaacaattacatggcaagcaaatcaaattcatattcttcatctgatgaaccatttttactctcactttgacatctacacattaaaacaataaatattattagaacacagatatatcaacattcatgaatatatagctgaaaataagtcagtccaatagtagtgcataacaagttcatagtaggtctaaaaataagttcacattcatgggtatacaacattaattaacaaggtgattttatccaacaatagtgcatgacataggtactcaataattgttctcataattgaatacaactgaaacaacaaggtgatacaaccacaaattgttcagaattaaatttaacccatacaaacatatgtctcaaacacatttatagttctgaaatgcattgacataacttgattaaagggatacaattcatggctacaccacattcaactaatttacatacttcacttcatacttcttcttaagccatccaaagcgacctgtaggagtgcgcaaataattaacaaacatttccctttgatccttcttgataaatatttcaattgcaatgaaatactcatttatctgttcaacagcaccacattcctccaccaaggccataacatcctttatagaacaatccggaggatcctctcttgttttagtgaaggactaaatagatgataaagtctgtgaagagagttcattactctttgacatctcctctaccatcttttgggatccactcttgttctttctggacttatccacctttgagccactacctctctttcgttttgtacttggttcatcatcctctgtctcttcatcgatctcattatcatcagcaatatgaattgactcattggtgggtgttggtatagtgccttaccataaagaccaatggttgacactggtattgcgaatgtcttcaaacattttctgcagtagctcttcattttgcaagccaaccttcataaacttggtgcatcctggtgtatcctacataacatggcattatacaatgggttagaacaattaatttggcacaatagttatcaatttaacacattatttcaaaatacttactgctttcaattgcttccaacgttccacagtagctgtaacagtttcctttgtgttatcccatcctaaacatgtttgagatgtcaacttcatccaaaaattgtattcaaccctaagcttatcccacttattcttaatttgaagcctagtgtacctcaaacctgttcttgctgcaaatttctcaatgacttcatcatacctaggattagataaataggtatttggacgattacccgcatctacttgctcaacaaaaatctcatagacaactctagtgttgtagtcattccaatcagcagagcccatgggcattttaacacccttcgaaggcccattttgagccatgcctatcatccactgactcacacaaatcttttttttcaacacaaacatatatcataggttcaaatttagtacttaacatatatcatagttactacccacacatgacatgagcagaaatcaaatgtacaaatcaatttatttttcatgataagatgaactagcagcatgaaagtaacatgagcaaaaaataaaatgtacaaatccagccatatgtttggtgtactacagccgtaataatatattgtcattctcccgtgattataacctacaatcaagcaatcaatccccataaaaattaaccaaagttgagggagaaatgaattgtgggtagccattgtcgccaccaatatgacattgtcattatctgaacttggatgtatatctatttatctgagacaaaacaactggacagtgacaattgcctaaataattctacttctaggnaggtatgtgctttcaaatcattgcgcatacactgtcggaaagtgcatccttattcagaaaatatactagtaaaaaaagattatgacatgaagtattaagtgaaaagattgaagtgataatgtatgaactttcagtggtatataaggggtttaattttctcgtttcattgtattccatacatcagtcagtgctactaaggagtacatatgtatttattcatgtgctaaatctgaactatcaaattggtttactaaggtttggggataacttgcacacagatatggagaaatcccttcacaccgccgctgttgccatgctccaaaccctgctatcgtcaccgtgctgcgtgcacacagaaaggcgccgtcaccgtgcgccgccacctagttgcccaaaacgtagctccaagaggaggagagagagtagctctgccgccgtgtggcatcgcagtcatcgccgcagccgcctcctcgctcgtctcccctttgtctcctttctagcgataaggccccgagggcgacgagtggatgggaatcgcacccaccggttcaggttgatctaaggggtagtgcgatggcattttcctgtaattttgatgaaaagggatgggtggccctataattattttcagagtggagctgtggagccacgttttcgccgctccacctcaacaatacaaatttctcgagcaattcaccccgctccactccaaattttgtgaatctagaccgtctggcacagccccagctctatgtaagttggagttgggagctgacgctgtgataaacggggcctaaatgtgcaaatggtggaaatctctgctactccaccatgtgaacctcctctcggcggggcaaaaaaaacatctttgcatagaaaactattaaggaaccggcatgttggtatttcttacaatcacagattaattcgcaagcgtacggaatgccgctatatcacctccccttagagtaatctaatggtatcgaacacgaggaacgtgcatgcattatctacgatcttgattcaatccatgaacaacaaccttagaataatttggctagagaagattcctatgtctttttagttagttaattaagttaaaggttaaactctatctgtcttgctaagtccggccttgagctctatgatgtacccgaacgtgcaggtatacaaagaacaaacaatgttgtcaccaccaactgcctacctnacttttcatagagcacacaacaaacaaaggtatttttttaacctagacatgatgcctaagttattaattactattctagccatgctcaggaacttctttttttatccagagacctagtactagagcactcagttgcacactaatcgataaacacataccgatatatctcacataaataaactaattatagaacataaacaaactcaaatacttactttataaaagaagcatccaccgctgtacgagcgagagaagaaggccaataatcctggctttctccagaactccgtaggaagaatggcgacaacccagcactccataaaattctcgaaagaactctgatgtactaattatgaaactacaagtgagatgtactctacttgagctcaagtttatgtgtgttgaagtgcggaggaagacctccttttatagctgctaatgactgttcaaatggtggttaacccctcacaaccgtcattgggagttcatcccggtcttctacatgtaaggtggagataaggtgggccaagagtggctagtgggccccacctctctccacagactttctccagcagtttacaggtgggcacctatggcgattaaggatggtttggccccacttttaagtcggtttcgactgacttgtgcaccctccaatccttgtactcacatataattggccagaggttcattttaatcacatggtgggtgtattttctccttaaatgtcctgcaaacatatatttaccaaaactagtggaagtggttagtggtaaactcctaccactaagatttgatagtatatttgatacaacctctgtttcatattataagactttctagcattgcccatacacacacacacaaatatatatatatatatatatatatatatatatatatatatatatatagaaaaactattatatagccacctcccacctcagtcaaaggtcagtcaaagcacccccacatcagtcaaaacccggtcaaactgcctaccaactcccccaccacccacctcttctcagctctcgtcttgcgaaacagtgtagtaacgcgacagccatcgtgcagtaatactgtgtcttacgtgtagcaataacattaaaatttagttgaaatatagtcatgacggatctacttttgataagcattttttttctaacatcatggtgcaaatggttttaaaaaatcatacatcacatgagagatattgttattcgaagcttgggtttttttggatcttaactctccacaagtagtaatactatagcattactacttgttactactatctgttatgcgttactacaatcccatcacgacgttattgtaagtgtgtagtaaaagccataagttttgtagtaacaatgcgtcttactgcaatttatgaatagtgttactgcataaacatgtggtaacatgtaccttccatgtagtaacacttcaactttgtgcgataacaagtatatttagcatgtgagacttttaacccatatttttcttttgatttctggtttactaacgttctatatgttctacagtaacaaagtgttttactgtagttcttggatagtgttactacataaacatgcggtaatgtgtaactgtcaggtggtaacgtgtatatgccgtgcagtaacacttttacttttgtgcagtaacaagtatatggttagcatctaagactttgaacccatatatttttatttcaattcctggtttactgtaattcacaacaatattactgtcaaaagtgcagtaacgtcatatacatgcattgcagtaacactatattggagggaggagaccagttttcttgacaagagggaggaagaacgatttcttgtggaggggaatatgtagatgtattttgaagtttaaacctccacatgcactacagtatcattgtgaaaacggtattaaaaaacaatacatatcttgtgagatattgcttttcaaaaattggcattttgaactttaatcctccacatgcagtaacataatgtgtaccttgcagtaacaacggcctatacatgcagtaacatggttttaccaaatgtataaaattgttcaaaacacttctatatcaatcagacctcgctcaaagccaccaacagactttacctatagcccacctattcgatcttcatctcgtaaacatgacatagtaaaattacaattatcgtgcagtaacatagctacttggaagtgataacatacacctatcatgtagtaacacttctacttttgtgcagtaacaagtatatggttagtatgtgaggctttaacccagtaataccagtcacttgactgtaataacaacctatatattttgtagtaaccggacgcgtatcgttactacatgttttgtgccaaatactacaaggatttagcacgtatgagaagataaatttttactaagaaaactctctcacaactgaaaaatagcctactggttagtgccatgtggtaatttgagttgaaggtcttgagttctattcccattgaaggcaaattattcctttatttttttctctctcaaaaaaggagagaggtggaggggggatcgggagaaagaaggggagagagggagcgagcgctcgggtggggagaaaagaaggggagaggggaggagcgctggtggggagaaaaaaggggagaggggaaggagggcaggagaggcgtgtggggtgggggaatcgggaggggaggggggcatagaataagtattctatacctcgggtgggtgtagaatagtcttaccctatatatatatatatatatatatattaatgaatctagacatacatatgcgtttagattcattaacatttatatgaatgtgggtaatgctagaaagtcttataacctaaaacagagggagtattttctgtgtaggagttgaaagttaaagtttgaactttacgttcgtcaacagaaggctcagccttggttacccactaattgggctcatcacttactatgaaatgtgaacaaggcatcatctataaatagagagttggaggagaggatttgtacacgtgagaatgaaagaaagaatgagaaagaagccacacccccacatcttgtgcctccattttttctagaattatgcaatccctcttgaactatactttagcaggaggggttgcgtaatgcgttatcagcatgatgttctactggagaccaagaaagaagaagggtaagaaattgtagatctgcatcgtatttcttgaatcgaatcacaaaaatggattcttctctccattcttgatatgttttaccactcgcgataaacaccgccaccgccgactcggagtcatcggtggagagccaattcgggtgttaagggcagtgccactggttggaagttgtgcccctcgaacaaatctcggatcgagtcatgcacttcattgtgttgcgtcatgacatccaggttgcaaggttgtaggacgcccgtgtcccaccatgatcgtgcaccgcaacatgaaggccgcgaactgtatcacgcgggaacaatgggagaaagaagaaagaagaagaacgaaaaaaggaaagaaggctgtagccccgccactcctaccatggccatggagaccgccacatcgcaccgtcggccagtgggccaccgcatggtcgtgccactcctagccccgccggcacatggtcgcgccacacctcgccatcggatggccacgtgtcaccatcctcgcatggccgcactccatgctaagcgtcggatagtgccgggctgagcctccgacatcgtcgcactacaccctgtggcgccatggcttccgccgccattatgggagggagaaaagaaagaagaaaacaaaggaaagaaaaaaaggaaaaaaaatggaggaaaaagtagcaagcagcactagctagcgtagccgctgtcactgaccacccgcaatggccgcctaccgaccgctcaccttgtgcctgcccgtatgccacctccggcaccaaccatcgtgccgccgcatcctcccatcatcgtcgcacgactacttcgccgtggctcatagccgctgggccgtgccgttgcaccctcgtacttggccgtcgtgcgcctaggctgtgttgcgccgcctcagcttcccttgcccatgcgcatggccattgggggaaagaggaagaaatgaaacatagaaggaaaaagaatctcctacgattttacaaaaagtccattgtagtttttggaaattaagcgcatatttcttgcattggaaactttacgttttatacactgaattttctagaaaatacacaaataaccctcttcatttgggatatttgtttaaatagcatttgatatttgcaaaatccactaaaaaaatgtattctctcataaaagagccaaggaattttgaatatcgatcccaaccatccaagttgaggcacttttcttgttgatgtttatgattatgaaatttatttatcgcattttttattattgattatttgtaatgctgtttttacctttaactaatatctttgcgataaaatatatagaattgcatagaatatattggaattatttgtgaaaattttgtgtaccattatattgcaacatttgtacatgttacctgaataaaatttgcacatattttcgaatgactaaagatgattggcatcgcgaactagaaagttcgccaaatctagattatccctgacatatgcaaccaaagttgaaattgtactgtagtaggaagctctgaacaccattaactcaagtgcgctctatttattaacttgatgagattgatcaagcatttctatttgatatctcttgaatgagttcactagacgaatgagggcataggcactcttttgactgcacaaaaaagtggtttaaaggattatgatgcacacccaccactcatagagcaagaactatgcgcaggaatggatattttcgattcaaattcactaagcaaacgatccgaagagtatggtaatacgatacaccgaatttgcacccaataatgtgaaaactcttgatgctctatctaaacgcgatgaaagtcgcacgcaagtatcattagtacgcatacaagaagtatgcctagctagttgagactagaattatgtaatgttcaggatagtgttaactagaagaacattgccttcccaaaccaccagcacacagttgataatgaaatcaacacgagcagcttgtctggtctgtatttacctcaacgaaagaagaatctagaacaatgcactcatgagtatgagaagaaaaggaaaagcacactcatcatgaagagaactcctagcctatttgcatggctacggatgtagaatctcctatgctaggctggatcggtcctaaaatttattttagactagaaaaacattgtcatagctgccgagcaaaaagctcactgtcaagttaattgaatccaacgtaccggaatactttgtttaatcaattcactttgtcatcgtttgttgcaatttttgaatacaatattttttcaatacaatattttttaatacaatattgaattgaataaatggtttctaccctagtagagcacacatttttctctgcaataaaggattatttctagtataaaatagtatatttgagacgtttactattttgttgctttttcctagcacatgattataatgctttgaattttgtgttgcacccaaacattaaagaaaaagattgaattgtggtccacataaccacaaatagcactttaagagaaacaggcattttttttaaaaaaaatagaaatagaaatactatggcctttgctagtagcagcaattgaaaattttggccgtgccacgatcatattacctatggaacaaatatgcactttataaaaacatttattgtactatgaacttcattgaactctctaaaattatgaagatttgggttacactacttgtttgcaataatttttctgccatattggtcttagaattataagatgtatggtcatagcacatatatgcataatttccctaaataaggaagatttgtgtgccagtatgcaccagcatgagattaacacatggaccacataccacgaaggtataatttcagcatctctgaagtggattgcatggaatacttgcgctcctatttttggtactatatggatagaatgcttctgaattagtcaacatcccgtgtctatttgaaactgcatatttgccaagattgatccaacaagatgacgtgaactcgaatgaatttcactaatcatctttagaagtccataaggacaatgctaaagtagcatttgatgattggtgaattggcatagactagcattaagtaccaaatatcgagatgaatagactaagtgatgcggacatcactccttcggatacacacaacaatcctccaacggtcattcaaggaccgataacaagagctcgcgcgcgataattgaatttagaggtgagctcgttcttatgttcttctttgtacgaatttgagaatagattgctacctaatgattatattgtgattaggaacaatggaggggacaaggagacacttggagaacgacttagagtcatggaggatcatcgaggacatccaagtcaaggtggaggcccaaaccaagtcaacttcgagtgcaattcggagtctaggaccagtctgcactaaaacgggcacctaggtcatatacatgctcggattggggcgttctttatatggatggaaagctaagaagataacatttccaatcactactaaaaaagtgatttttctgtacgagagcccatgatttttgtaaacggaccataactagtggcgtctacaaaaatcgagcgtcattttcccatacggctccttaagtggcccatatggaaaaatcgattttcccatatgggcctcttaaaatggccacaagcaaaaatgagctcatttttgcatgcggctcacttaagcgcccacatggaaaaatcaatttttccatacgggccacttaaggagccgtatgcgaaaataaaatttgaaaaaatttaaaaaattgaaactagtttatctcaatcatatgaaatccaaattagatgatttttttcctaaatgtttctaaaaccatgctctatcatgttattgcgttcatattgctattattttggtcattttttcttgtgactttgtttaattatcaattaaaagtttgaatttcaaaacttcaaataatattttgaagtagtaaatgaattcagatgaaaaagtcatcaacaacaaagttgtataactcatcaagatctataacttatattacattcatttcctcatccgacaaagtgatggaaacattttcacaaaatttacatatctctctccatagtttataaaactatataagagatatacattttgtgaacaatgttacagataactttgttggatgaagaaatgaccaaaataaaagttatagatcctgatgagttatacaactttgttgttgatgactttttcagttgaaatcatttagtatttgaaaatgttgtttgaaattgtcatattttgaaaatcaagttcaaactgttcaaacaaagtcatatagaacaatgaccaaaacaaaagttgtagatcttgatgagttatacaactttgttgttgaggacttttccatttgaaatcatctagtacccaaaaattatttgaatttcctatattttaaaattcaaattttatagttcaatcaaactcggatggagaaatgacaaaaagaaaaatggtagatctcaatgagttctacaactttgtttttaactttttcatatgagtttatctagtgtcataaaaatcgatttgaaatttaaaaagccacatacgaaaaatcgatttttacatacggacgcttaagtagcccgcagtaaaaatggtccctcttccttccctgttccgcagttcaaaaaatttcacacctaaccctatcttatcctctcctctcagtcttctctctctcactctatctcttctctctctctctctctcagaccgagagcggcgcggggtgtggcgggcacggtggcggtgccgaccgatagcggcgcggggcggggagggcacggcgggcgcagtggcgacttcagtggcggggggcgggagcggccgcgggctccagtgccaagggcggcgggggcatcgatccgacggcggcggcacgacctcacatcgatccggcgagggagaggcctcgggctccagtgccaagggcggcgggggcatcgatcagacggcggcggcacgacctcacattgatccggcgagggatccagtgccaagggcggcgggggcatcgatccgacggcggcggcacgacctcacatcgatccggcgtcggcggcccgtttcggcgtggatccagcgacggtgcgacgacggcgtcgatccggcgtcggcggcccgtccccgcgtggatctgccacctctacctccctctgtcatcgccatcgacttccccgccctgccccgcggcgcgacgacggcgtcgatccggcgacggcggcgcgacctcacgtcgatccgcgtcggtggcccatcccggcgtggatccagcggggacgcgacgacagcatggatccggcggcggcggcctgtccccgtgcggatccggcgccgacaacgacggatgacggtgggagcggtgaagtggccgacgacggtgacgaattcgncagcgcggaggccggctggattgggcggcaatgggctagggttcggctttttttttatttcgctgaattcattttcgcatgcggctggtataggggaccgcttgcaaaaatccaatttttgcatacggttgctctagccgtatgcaaagatgacgatctttgcagaaaatttcgcacatgcggctggcctagccacatgcgaaaatcgttgtcgtccgtctgcaaagacgtattctgtagtactgaatagttttggtcccacatccaaattctttccgagtcaacgggaatcgaccgaacaagttgacgtacataatctgtcctggtgctgcgtcaccgtatttgtgtctttgggccgtgtatcgtgttggaacccattagggttgcatcaagggttggttgtacgaccctaaaatatatatatcaatactcgccgtaatcattatggtttgggttttgcttagattattctgtcaagaacagtttcgtcgctagatcggtttgtggaaccccaaattcaagtgcttaatcattcatatgcaattgtgttgcaatctatcttgttcttgcttgtgttcttcgattcgcatgcagtgattagccttctcgacgaggtcaaccgtgtttcggcacggttgataaccagaggagacgtggtgctgcgattgcagggctcagtagcgtgttcgttcagaagccggatcgatttgtgtcgcgactcctcccaaatcgactgtttatcaatacctatcataagattgggacctaacatccctcatcagtaagacccgttctaatatctatggattgcagtatttgctataacattattgtaatacccgttgtgtgacacatgtagtcctaaaagtaagtggattctgatagaaaatccaatatcatttatgaggataaagtagaatatgtcacacatatacaaattgtatatgagatacgtgagaagcaaactcactaagcatatgaaccccaagttcttctatgcacataaattggataaaaacaacataatattgcggaatgagttatgtgaaaatcatgcagatttgtccactaaatcatcgttgacatcttatcttggataaatatgtccgagaaaccgaaataatgagaattagagaaatgcaaaattcagagggagaatactgttaactcattccagaattttgatatgaaaaatcaagtgcccaaaatcaatatagaaatattgaataaagaattgggtggattgtacttttcttcccttggataagttttccctacagtttttaatcgatgtttttaatgagacaattcgtacgatattacaaacatatgctatctactcatttttctccaaaatttcccagtgggtttttacggagttttgatgaggcaaatgcatcacgcagtgagagctaatgttagaaaagggaaaatgttagaaaaccactggcatgtagaagtctagcctagttacccactagtttggcccatcactaatatgaaatgtgggcaagacattgcctataaatagagttttggaggagaggatttgtacacttaagaatgaaaagaatgaataagctaagaaaaaaagtcacatcctcatattttgtacctccacttttatagatattatgtaatttttctggactatacatggttgcataataataataggcagactattttgctatttcatggcattctgaaatatattagcctactctgctttccaaccgaaatccactgcagcataagtagctttttgaaaagaaacagcagcatatatatatatatattgctctaattaaagccaaacaccagaaaccaatagaaaatggcaaagaaagttattcctaggtccaccattgctgtaggatgggacatgtgtatgagctctagttcatttggaatctttaattcacatgcactccctaacttgatttaaaatacaggcaagcatcgtcaagtttcttttttatttgtttgtttattataagccgatagggagggcacgcggcgaaacatggcaacaacatggcgacatccgtaaagtacgagttctattttcatatctatgaaacctaatgattttctacttttctccatctagagttcttcccgaagctctatgaatttccctttcccaatactggattcgttcacagtgcaccagtcgatcgtcttatacagcactaataatcaattgaatcgataggaattcagtggcacatgtcacacgcactagaagagagagtaggtaggaaccatgcatatacaactatttagtaaagatgctcaaggaagcactggatccttcctgctaaacacagccacatgcatggcagtccctgcccaaaaaagatattcattcaataaaagagatataaagtataataatacatattactgcattttaagaacggtgaggggcggcaaacaatttttttaatgaaatatgatgacccctattttacatttagggttcaattttcagcaaaagttatggttatcatagaggtatgaaaggcacgcacctacaatggaacgtcaaaaattggaccttcctcgctactgcgctgggcacctgacctctgctgcacgctcgagagcccaaaccagtactttccgcgtaaaaaacatgcaagtatacgagtgaactaatgctcgatgactcttctgcggcggttctgcgctcagctttgatcgttcgtcttatttgaaatttttttataattagtatttttattattatgagatgataaaacataaatagtactttactcgtgacttatgtttttaattttttttaaataagacgaacggttaaagttggacgcggaaaaccatggctgcacttataatgtgtaggatcgaacacaagcaaccaagcctaccagagggggtgaatggtagggaaaactaaaaacccaaaaacttttagtggaaatgaaagttacacgcacaacctgacccacattagtcacacgcactcacaccaacatccacacaacttttcaaaccaattcatcgattaaatcatttgtaaagccaattgttcatcacaaatattaatcatgacaatgatttcacaatctcctccttgataaacacattggcaacatcttcacaatgcaattttatgtttttgaaaaataaaaaaaaatcacaagtgaaaagaaaaactctccccctttttaaaagaaagaatttctcccatcaattttcaatcaaagcacaaaattgactattttaaaatcgaaacaattcaattctccctctttcaagaagcatgcattttgtatatttctctccttttgataatgatttcatcaagaatacaaatgaaaaataataaccaataaagcaccaatgcaatgatgtcatgattgtcacttgtaataaccattttttttcgagagctttgaaatgtacctaaagcaattcaaggtcatgttttgcaagacaagggagataaattaatcaactagttaacaagcatgcatcatagtataaacatgaatcaaacatattacaattatgctcaaatcaacaataaggattcatgatttcaaatgatttataatgcaatatattcacaagcacataggttgaaaaataaacactatacatatatacctattgcatttatcactctttctcaaattagctttagcacaaaacaaccaagagaattttttaacttttatttgagcctttttgctcactttttttctctcaattattccgggtacatccttgtcgtcaagactgtttctaaggattcggcacctattatttttgctcacatcgaatacgtccttgtcgtcaaagactgtttccaaggattcggtattcatttttttcatattttttattctcttttcacaatgaacaattaaagctatttgaagaataacaattcaataaagcatatacataagcatttataaatcaaaccatatgctagcatcaatattgcatattttcttaattcaagtaacgaatttaagtgtcatgcatcatctcacttaaaagaaatatctaatcctcatataaagactaaaatgcatacaagctaacatagaaacaaatagacctcaattattttgctaccatgcacaagaatatactagaggtataaaacaaatctcttctttttcttatttttatttattttcagatttaaaagcaatgtatgaaaataaacatgaatgcatgaaaaagcattaactccccctcaaattaaccttcaattctacccgaaaataaatcaagaagaaatcaaagattttgaaaaagacatccaattgccaatgacatcaccaaggttctcatgaattgacatgtatccacttgtattaaaaaaactactacctgaaatactagcatatgaaaagctaataatcgagagagtagaaccaaaaatatgtcaatccaaaactaaattgatgttacctttaaaagcaatcgtcatctcaacgttgaacactcatggggagtatgccaccaaaatacctacgaacgagaagatgtcgaggcctccgtgttggggttagaaataagaaattttggaatccaacactgagtcacacgatcagtagaaccagtaggtacatatgcactaacaaaatcagaaccagacttacctgaaaacttaccttgtcgcttcacaaaagcatgatttgaattatatgcaaagttgccctgaggccggtctgaccgctgctgtcccagcggtctaaccgggctcctcgaacaaaaacctgatttttgccaccgtcgttttccaaaagaaatttctgtttcctttttctgtttgcgggcaagtcgaaaacaaaaaccaaccaaatgtccatcttttccacaaaaagaacaagtgtacttctcacgacaagtttgtgaagtagatgtttttgaaattgatggttttgcaacaacagaaggttttgcattcacaacatttgatttcgaagaagatgcattcaaagaagacatgatgccagcagatttaaacacagtgttcttaggctcagattcaatcaaaatttcacctctcctacagtaggaggatgtctagcatgataagcataagaatcaaaacctaaaccacgattgtgtgtgctaactttagattgatcaagaatcatgttgaggttctttttactatcagaaaatctttgcaaagaacttttcaaataagaaacctcttgagtaagaatagcacaatctttgcaaacatccaaaagacctttttgttttctacaagttgagcaaataaacacctcatcttgtttaataatttcttccatgtgtttaacacgccctaaagcatctttcaacttcatctcattcagaatacactttgaacaatcttgagaaatcaaaacaccattgttttgttttgccttatttgcacatgaagcattgaccaaagaacttgcacaaaaagcaactttgtattttttcaaaacgttcttggtcaaaatcaactcatcaacaacacgagcatgtaaagcaaatccaagagcaaaagaagattccaactttttagattttttaatctcaaattccaattttttgcaattaacagaattgacatctcgcaaagcattaatttcagaaaataaaacttcacaagattgacaattatcgtcattaggaatcaaagattttaatctagcaatttcagcattaagaatctcaatagtatgatccttctcatcaagaacaatagaacatgtttgaagtttcttaccaaatttgtaagcagtatattctaattgatcataactaagcttttcttcattatcatcatcagattcatcaacatcagaacttgcattacgagcaataaaagctagatcaacaacttgcttacctttgctctcatcttcatcttccgattcatcaaaagcttttatgatttcttggattaaccactgcatgcaatgtttcttcttctcctttgtgttcttcttcttgttcacgtcatcctctttgactctcccatcatcttccttcttgcctctcctaagcttaggacaatgtgagcgaagatgatcaagtgctccacactcaaaacaacaattcggttctcctcttttcctgttcctaacatttttcatagctcgagaaaatttgttagataacaaaaccaagtcctcctcctcgaactgttcgagttgatcatcagacatggcattaaataaagcaagaacagaagacttcgacgaagaagcaccaacgtccaaagaagtcgaagacgaaaccaaagcacttgacttagaatcgactttacgagcaagaatattcatctcatgagttttcaattttgtgtaaagcgaatccaaagtcaaagtagacatgttaacaaactcctgaatagatgtaactttcatctcccaaatagacatgtcaagatcattcaaaaagtgacgagaaatctcaaattgtggataatttgcatcataagaagaatcaacagatctaagatcactcaaaattttattaaccgagaaagataatcatccaaagcttctccaggtttcatcttaaatttaatatactcctttttgaaaagatcacgatgaagttctttaatgttatttgttccctgatgaaaattactcaaagcaatccaaatctcatgggcagtttgaagatgaacaacacgatcataatcagaacgagaaatcccactcaaaagaatattgcgagctttgcaattttgttcaaactcaatttttgcagcatcagtattaataactttaggaatcacataaggatgagaaacttttctccaaatatcataattctcacccataatgtaagattgcatcctactacaccaaaaaaaaaaatccgttccatcaaaaacatgaggcttagttgaaaacctaacagaagtagccatggcaaaaactttagatcgataaaaatccaaagaagaaaacgaggctctgataccacttgtaggatcgaacacaagcaaccaagcctaccagaggggggtgaatggtagggaaaaccaaaaaccccaaaacttttagcagaaataaaagttaccctcaaatcgatggaaatctcgacgtagtcctgtcgccgccggtcggaccgctcgcacgccgccggttagaccgccggtatgtcgtcggttagaccgccgaacccgatgaaacacaaatcgaagaactctcaaagtagatgacaactttattgcttctctttgtgtttacaaagtgcaacaacagcactccttacaaaaatctcgactaaactcgaaaccctaactaaactatcaactctacgctctccaaaaaccgataccgggaggacacaccctccccctctatttatactaaaaatcctcctactcaaagtaggagtacaactcctagttccactaggactctatctttaattatcaaatcaaattacaatcccaaattgtaattctctcaaactacagccgcagccaaccgcatcggactcgatctcctgcgcttgctccttcttgggcctatcgcacgtgggccgacgtgctactgctcctggaccggctcggcctccagccagctgccaccgaagcccaccgggccatcacacatgcatggcacaacatgcatgcatcaatcaccatacatacatgcatatgctacgaccagcatacacacatatatgcatacacgacctgctacagtaactcgaagcactgtagcaccatatacttctctctaatttcttccaatctccttggtgaacactggcacttacacgcacacctcgtaaagcccgttgcgaagatcactcccacacggtatccatccaccgtgtgccatctcgtatccaacttcgtcacccggtattcttgaccgtctggacctcaactcctccccgagtttagtcccgatctccaccgttgaccgaagttgacctccaagaatcctaactctagtcaccttctcacatggtatcccgaccacagtagacctctgctcctccctgagcatagtcccggtcctcaccattgaccaaggctgacctcaagtcacctacacacaatcagacaaaacaaccgtttctgggcacagatatcacaacctgacccacattagtcacacgcactcacaccaacatccacacatctttttaaaccaattcatcgattaaatcatttgtaaagccaattgttcatcacaaatattaatcatgacaatgatttcacataatgggacggaggtagtagtttttttttataaaaaatatattttcttaagttttggacgagtaggattacttcaagatttatgctaaaatattaacctcatccgctcattccattaccaactcaattgatccctatcttgacccgtaacacgcggataagactcccctagctttgtgaagcacaactacaaactgcacaaagtgaaggatctgtttccatagcacgtagtgccgaagtgcgccttccgtccctccccttggcccgcaccaacgaggcccgtcgatcatccctttcctaccacctccctccttctacaatatatattattacacatttacctccactttttgctcaggtccgacggaattctcctaccctacctctcctcccttttctctggcttctccgactaccagattcgctgctcctatggtcctaccttcctaacaacaaggcttctcatatataccatgttgtcaatcatgtccaacgctctctctatcttcaggggactgatgctagcactattgtcaccgtcgcatcactgcctaccactagtctttcaccattccgaccatcccaataaagccaccctcaccaccctctagccacctttaattagagtaagttttatcctaacaaagtaaaataggctctatgttttgtgatcggatggactaatttattttcgattggttgatgtaatgtaagtagctagcgaggtgacatgcgtttgggagttgctggttcaaaagaagaaacgtaggtcacatcaaaattaagtactcagcttaggtgcatgacatttgattaattatatgcactcctaccaaggagcaatatcatatgcttatattacagtgacaccaaacatagattacgtactaattaaatgcactgtgcacgtcacacacagcactgacgctatatcactttgctcacgagtcgcgcatgcatgcacccggccattaaatcacatacataatacacgtacaatacacacataaaaatatacatacgtgtgtcgatcggtgtgcatgtaaatataatatatatgtaaaaaccgatcggaaaaaggaaaaaattagaactcaataagagtatatatcagcagccagcagaaattaatatgcagtgacgatggccgggcgccgggggagctggatgggggatcacgaggaagggtggtggtggtcgtcggcggtggacggcagcaccgacagcaagcccttgtcctggaggcttcgcacggtttcgtagaggcactggcggacggggacgaagtccatgccgaggtcacggaggcgctggttggagaagaggtaccccttcaccggcggcgccgcctcgtccttgcacctgctcgggacggggtactccgggaaaagcttggcgagggcgcggcagaggtcgccgcggtgcagggtgctctcggcgcagatgtaccggccccgcgcgccgccgcagtcgtacacgcggacgtgcgcctcggcgacgtcgcggacgtggacgtacgcctgcgctgcgttcacgtacgtcttggccgaccccgtcaggtacttcatcacgtgctccgtgctcgcgttcaccgtcgcctgcagcagcggtcccagcaccagcaccgggttcactacgaccaggtccaccccacgccgccgcgccacctcccacgcaccctgctccgccaccgtcttcgcgtag

SEQ ID NO: 31815 - DNA, 23409 bp, Oryza sativa
  unsure (1)..(23409): unsure at all n locations
atatatatatatatatatatatattatatgatcatgtttccaactgattattaaggtcgtgttccttattatactgaaaatgaagacgaagctagctagagcacggaaaaagaagaaaatcattagcgtataattaattaaattttaatcgttacaaacttgaaacccatataaatttatctgatattagttttagagcaactcctatatatagttataaaattttctatattccatatataactatttattcttagaagttctgcacaagtttatactattaattggagaactatagatcgattgtaagaaaagttgtagttgttagaagcgtttcaaaaagggctgaacctatatacgttattattattattaaaaagagattgcagattattttcatgtaagatgaactatctttcgtaaatatgagtaattatgaaaataatcctgctctgtttggtctcaactacagaggagtaaatgacaattctggatatatttgcgcggtagtaggtggaggaaaagtatttggggtagttaagaagagctcctcaaaaggaaatggcttggtctttgtcaacttgactacgaaacaccgatgatgaccatggaagatgagaaatcaacgtcacctctttttagccacgtttggtaaaacttgacatgcgttaaaagctttgacgaaattaagcagacagtgacaaaccatgagcatgaattcagtaatcatcatatattagtatacataagttgatataagtcgtagtttcaaagatttgaagccgtaaagttatataacctagaatcttcccagtctcgtttaattattcttttcagatgaaaactaattacttagtatataacaagttgatgatctttaattattagcttgttattgaaggcgtatatatatattccctccgtcttaatttaaactcagttatgggtttgtgagtttaaagtttgaccgtccgtcttatttaaaatttttatatgattagtatttttatttttattacatgataaaatataaatagtactttatgtattgcttttttctaaaatcaactttataaattttataaataagacggagggtcaaaagttgaatacagaaatttataactgcacttaaaataaaagctaattaatttgcatgcatgttaattaactatgcatcggaggaaagctaattaagccagctactaggtacacacatgacatgacacgacatacctctgtcctcttgcagtattcgaggtcactccagcaggtgtcgtcgacgggcttgttggggtccctgtaggggttcatgtagacagtgccgatggaggacgtgaacaccactcgcttgatgccggtgtcggccgccgccgttatcacgtatctcgtccccctgatcgccggctctatcatcttctcctgaatttgatcagatcaaaccgatttgttagttactagttaattatactgcttgctcgatcgagaccgttaattgccattgaagtacatgcatgtagtttacatacaggatcatcggtgacgggggaggcagcgtggaagacgccctcgcagccggtgaaggcggcgacgaggctgtcggggtcgaggaggtcggcgcggaggaggacgaggcgctcgccggcgccgtccagggctctcaggtggtcgttcttcgggtccactgccaatatcgtcagcaattaatggagttagtactaaaactagctatatatatcaaattaattatacactcagcaattaaagaagatcgatcaagaagagtatgtattgcagtgcgtactagggttccggacggtgccacgcacggtgtagcccttctcgaggaggcgcttgacgagccacgacgcgatgaacccgccggcgccggtgacgcacacggtgcacccatggccggagagcgcggtggtggccggcgccgccgcggctgtctcgtcagtcggcatctcgatcagtcgatctcctccctgaatttcttcgagctagttaatttaatttccctgtgatatatgttatcacgccccctgcagggacgacgacagctacgcgtgtacagttgctagctagtttgctaggtacacctgtgtcgtcgtctgctagctaagctagggagcaagctgcaggtttttgagtggtgggtgcagcggatgcaaggagacgaggcacgcaccgtggctgtatttatagaggaaaacaacacgaatatggcaagagagacacagaccgagagcgagagtggttcaagacggttggaaaaggaaaaaaaaaatatggtagggcccatttgatggaagggccatcacacaccccagttggtgagaaaacttcttttattttccttgtgcgctcgtaattgattttgttcctatccattcccaaatagtacactccttattatcattttctcgaaagaaaatatttatcatcaacatttatattgattgcgctactattaaaatcttgatcatattaaaactttaaattatcagatatcgtctataaaccaaagctgtacggatatgcatattttaacgtgcgacatatttatataacactgtatatttttaaatatttacaaattcattactaaaattgtaggccggagtgtgatcgatcaaagtttaaggacctgttcactttgatgccattttcaaccttaccaaattttgataaagttgccaaaaaagtggctatatttagtttgttgccaaattttggtaactatataagaaattctgcttggcatcaaagtgaacatgccctaaatatatatatgataaatatttgagagcagtggtagtactcatcactagctagctggtaagaactattctacgaatatatgcatgatcagatttttcacaagcggttttaatttaaattataggacatcctcatcattattaccagcagattttcttatgaccagcctatagaaatgagcctggaagtttgaaaaaaaattcactttttaatagtgcgacaaggcacctgaagactggatatagtgaattactgaaaattattatattctacatgcacgcgtgattcagaagcttctgtaggtatatgtgcatgtcaggacatatagaagcgattggcaatatagctgctgggtcgtacgtaggccatcagctttggcctttaacttggattggagttggtacccagctacccccgatcgagatatcacttagagcagccataatggttatttataggctttttacaaaagatccatgtcagaatattttcctacttagaatagattaaataaaaagagagagcaaaactatctactaacctggagatagtctatagagaaaaacgtggcaatagattagagaactatagatacccatgtagacataccattgaagtggtttactattaatctaatctattgctgagatgtacatgttttatagatagcaccttactttaccattgcgggtgctcttatattctagagctggcacgattgctacattgaccacctggcgctattgaaatttaagataaatcaggatttatggacagtaaaaaaaactaatcaccgtctacacgtccagtaatcagattaacaacaacatgatccctgattcttgtaacacaggctatgttgctaaaatatttccttgaatatactaaaatgatttgctctttgaaatatgtgaagcacgtgattaatagttgtttacacctaaatttgacacataagttcaaattaagaaaaattaccaagatttgggaaaatcgccggtttcctccacagggccggtaagaccggcggcatgtggccagtcagactggcagagtccgagaccgagtctatttttatcgggtctcaggattccttactcgcgattcattaatatttacatttctcgatgcccatgtagccaatcttgtgtagaagaatggagagtcacgtgttaaatccgagaaagtcattaattaaaatgataggttgttggattgaaatatgcctatcaaaataaatttttcagatttgaaaatatatctatcaaaagtagatggagggagtagtatatataaagatgcacaaattccttgttgcaacaagataatcaatacctagagagacaaaagagaagtatatctatagtataatactaagcattaatatagtcttttctatcgtgttgacacttgttacactgcatacgcgcgtatatacggcatcatcgcgtcactgtatccaacccaacagtgaagtacaaatacataatttctctatgtatagtttgtgaaagagtgaagtgtacgtgctatttattggatccatggatattttgtgtaccaccatgaaattaatagccataagaatttattttgggaattagtctgtcggaaaaaataaaattctcagtgatcttttttctatcgtcttatttgaccattgtatacatatccaaatggaacacaaaaatttgttttttttcagcagctcctaacttttcggtgtagactagctacgagctattcatgaagaacagtacgaatgaatctatcatattatcattaagaagatactggctagctaaacgtacacttttcacctagctagctggacttaaagcacaagggatgagccgacgatcgaaaaaagcttctagaaaaagttgatataataatgtgcttattttcctgcacgacggtgcaatatattatgtacgatgtgaacgtgacaattgaggctttgatgccttcagctttactagtactactagattttcctttcaacttggacgtcgtctttttgaaaaagatcatggctagtgcatacatagtgcatctttatttagcacgctcaatacgcaagaaagcgatcgaacgtgtagaaatagaatcaaaaccggatatataaagctatagcatgcaagaaattaaattaattaagctgaagcatgaacaaattaattaacaagcatctctttaatacccaaaacaagcttttcttgcaccgatcgcatgcatgcatgctaaaagattcacgccctggaaattagcacaagacaaattctaaagtgggaaatcgggtatacttcgttccagtagttcttttttcccacaagttgagttcccttcacttttcggtcggtaagatgtctcctgttttttctcctcttttgccatttggccctcggaggcttagaatttgggatcgtgcacaccaattagtgagcatgcatatgggcactagaatatacaagcgtacactatatgggcatatcttgagattaacgaaatcaacacatgacatcttaatattgatatataaatacgtcacctgccaataaagaacatagatctactagaaaaataatttatcgccacgaaaaaaatcgtagcataatgctaaaattgtagcaataattacatgttgccacaatcttaaaattgttgctagccgtggttataaatagcgttgtaataggttattgcaacgatttttatttagttgtaacaaattttgatattgccataaaatggatgtggcaaaaaaatatattgcaacatttcacatcgttgcaatagataactattgccaccactccatgtgtggcattagttctacgtaccaaattaaatgttttaataaaaatatattatcctaactattttcttttgatatgttgttatggctaggattcgaacccaagatctctccctcacgcgcgctctacattttgtttacaaatgcatatcattctatttgagcctgccgatctgagatttgaatcatgaatttgagtagttaaaagatttcaaataaaaatagttaagttgtagaggactaaattgcatacaaaatttatctaaatccgtgcccatatgaaaagaataagttaaattatgatatgctaaattttttattgcaacgaatttgttcatcgtggcaacaaaaaatagtgaaaagtgccatgtactatgcaaattgccacataaattaaaattgtggcgatagaacacgtttttttgcaatagtaatgttttttgtggcgatagctcatttctattgcaacaaaaatactgaataaaaaatgtttgtatatcggtgcaacaaaatatagttattttccacagaaaattatcattgcgatagtacaatataattatttttcattataataaattggtggcgatagctcaattatctcgtagacagactccactaccataaacctaaccaattaaccaattaaattactctagctagctaccccttgctagtaatttgagtaactctatatacactactagaaaaaagatattctattaacaggcccatggagaaatcagcacatgatgtcttaatatcgatgcacatatcacctgtcaataaagaacagaacgtagaaagattacagattacagcacaataaacctaaccagttaaattagactctagctagccgtcccgtgctagtaatttgagcaactttatagacactactaaaaaaataattttctattacgaggcatatggattttgcaggtgtattttcaaccgcgatgattcgcctgcgtagttgtgatgggggttcattggctgttgttgacacaaaaaaaaatgaagtcctgggagatctgcttagctctggtgcaggttctaaattatttatgcggacgtgctagtcagtatgatcctgcaaataacaagagagataaattgatgatcaaagagtcgatcggctaacaagctgatgtaacgatactagccgatgtcgtaaggtaatttggaaccatgccattataattttgcaaagtttgagatatgccatcggtatctcaatgacatgtaggacccatatgagtcaatgacatatgggtcaggatggcatatctcaaattttgcaaaattattatggcatggttctaatttcccctaacaatcggctatatgttcaatatagattttgatacttggatcaaatgatataaaggcaatcagacaagcagtgagacttatagtcatacaacaatctaatccaatagaaaccaatcggccaataatggtatgataaaataaatgttgatccgatggttaaagcatatatcggtttgaaatctgacgtcattaaatctacatgattaagtaatcaatgaaacatttgctgcaattggctaaaatcaacttgtatataatccttataagccaatacaacacttaaacaatatctagataactcatcagctgaaacctcagtgaaacattgattgatgcctattaacttaaataaatataactcacaaccacaaccccataggtcaaacccaaccgatgcagcataaggttgataattgtctaatagatttaagcaatccaatatgacaccgatcaaagtggtcatgcattaaatttaatgaagacaataaaaccacacatcaaataagatcggctaaccctccgatgaaacattaacatgaacttatcggcttaacaagatttaaattaacaatctagtaggtcaaacctaaccgatgcagcacgagattgtatatgttaatctaatattcaatgagtcgataaatctttctaatgtgatggatagaacaaatctatctaaagtgacattttgtttaaagaaacattaacttgatcagaatataaatagtaatggaactaaagatatagacggtataccacataggtaacacttgcatcggcccgattagaatatcggactcaaccgaggaagtcctagccatgccaatgcaagcgaagatgatggaactcacttcttatcggaggtcgaactcaatcgatgcagcccatgtgcgaaaccaagaactcgtcgaaataaaacctcgtgggagtgtggcgatgcgctgaagatagacatattaatatgtgtagatagattacagggacctcggtgtacatatttatactcttaagctaataagagtcctaattgtacacgattcaaactttcgtaaagataaaagaaaatatacaagttctgatcgaatactaaacatactttcctaaaactaaaaggaaactgactgactgcctaattaatagataaattgccatgccacatcctccttaaagtcgacctcttctagatatgattcctttaaaattgattaatttacttaaccaactccatcaagaatccaactgctggtgaccgataatttctatcggatcattctaagactctgaagccgatattgtctctaggccgatgacaactttggagtttatcaaaatttggcattaacagctggccatttgcgaaatccatttttgcatgacagacggcttaatattataatgattaagcttctaattgtcctttttatatttttctaattggtccttctagtcatgttttatctagctccacgtaccagaccgtggttgcttctttttcccttttctctcaagtttggagaacacatttgctgcagctgtttttcttatgattcatcatgtgaaaattgtccgaatgaccggtcatgaggtttaacttgaagattaaggtagcttacattgttagcatgaacaattcaattgtcaatacaagttattcaggagttcatattaaaaaaagctatctaggttaattgttcaactcgcttcgtcaaaaataaaatatttgaacgatatacaaactgtgcgttgctagctccaatatagagaatggttgacatctcattaatttctcgtttaaaattcccatcttaggtcatatctctaagaaaatgtatagtagaaacaaataactcgacaagctgaacctcaactggctaggttccttgtggtggaaccaacccacccgggttcaaaccctagatttgatacgggtgctcgcatttacggctaattattctttcagtggtaggtgacgtacccgtcgacagcgaagcgtctgtggtgacttcgtcaatcggaggtgctcataggggtagggtgtgcgtgtgtgcgttcataggggtgagtatgcgcacgttgtgagcgcctgcatttgtacagtgtttctaaaaaaaagaaattactcaataaatcgtaaaaatatatactattaatgggtggctccaagctagacacaactccacgaaaatgattagattcctctgcttcttgttcacaagtgagcacttgcggcaagtgtatccctcaccacacaagagcatgtagctagtgacaaattcaacacgggcatcacgttgttttctacaaaagaatccaaaagtcgctcatgaattgtttttccaaatggttgttggtagcagtagcatagaaagcatgcgatatttgacgcaagtatgcttcaaataatgacctgcctgaagaatatataatgtattaattatgcaacatgcatgttacaatctattagaaaaatacacataccatacttggttgcattagagatacaaccaccaggtacaggaattcactattctacgactcatgcagctagcactcaaccagcttttcctattgtcaatgaaatatttttctaaaatctagcagagtttgcaggtgtattatgacaattttgtttagggcaactgttttatagagagtctagtgctttggcgctaactgtgtttgatcattcagtataaattgctaattaataaagagaatttgtcctcgaatataaattgctgatagagatattgttgcgtttcaacgaaatgtgccgaaagcaaaaaactgtataactgaatttgatttctccatgccacaaattttcacagttgtgctagcttccatcacagcttaaaaaaagtaagaaaagcgtagcacagttgccacaaaagaaccctaaaaatctccttggtaacgatctttgctattactacattcgtcctatataaaggattttgtccatattgttaatgtgcaaaatctattgaagtttgggacagagatagtatttgattacagttacgtaattaaacattataatagaccagttttgaaccttacaacataaaaaaaagattagctcgctcattaaaaccaaacatggaggtggccggggtggaagtggtgcatttactatttgataatagtagcatttactattataactactaccccctttatattattataagtcattttgatttttttctagtcaaacttttttaagtttgactaaatttataaaaaaatatagcaacattttcaatacaaaacaaatatattatcgaaatttatttagtattatatcaaataaaactaatttggtattctatatgttgttaaaatcttctataaattttgttaaaagtgaagaaatttgattagaataaaaatgttaaagtgactaaatataaaacagaggaggtacaaaacacatcatcgtggatggactcgaactctcatcccagagaattttccgaactaaattcatatcaatatgcaataattaatcgaagtagtatcaaaccagtcactgtcatgcatagactgttagaataattgggctaggcccaacttataatattaaatctcaaaggcccataataaatgttgaggataataataccacctctggatttaagcgagaaatatctcaacctaaatagggagttattggaggctccctgttgaccagttgaggtgggggtcggaatgccacgcgcgcgcgctgggccgggccgtgggcgtggctggcggcgtgcgtcacgtcactatccttttgcagccactaacccacgttcccacgattccctccgcaacagcgcgtccacgttctttctcctgatagataaggaggccgcgagtccgatccgacttcttagcttctttcccggtgttagtttctccctctccgcgcctgagttgctctcgcttccccgcttctgatctcttgcgcgcacgagagattggaagaagcagtgcctccgaaaccacaccttcgcctgagatctacaccgggtaggcgggtgatcaggtttttggggagtgcctcctgcacgactgctcatcgccatgtctggagttgctgctgccactactggcggaggtggtacgccgccgccgacaggagctggatccggagctggtgcgccaggaggaggtgccgtgaacgactacaacaacagaggcaattctgcctcaccatccagcgaagggccattctcggggtataatcttctcctcctgctactgctgttagcgctatactatgtgagctatgttcttgttcctgttctacatgatgcctctagcatgttatcgcgttactggtatgttcctgtttctgacattcatgatgtgcatagtatgctactggttatgtctgcttatgccatgatcattgtttcaatttcttggattaaaatatgccgaataatgactatatttccaacatagacgacattattctggtcttgagatcgacataaagagtctattgtggctgctgctgctctatctctcgtccgttcgtgtgggagtctaccacatgcagtatgcagtcagccaattgcatccgcatctagctattactcttcacccatccatgccacgagcgattgcacaccaatgtatgccactgccgccaaagcttgagccctccttcgcatccccaccccgccccactagcacgtacgcacgcacacccactacacgtatcgacgtataatgccaatatagacacatgcatttcaaaacgaaataaagatataaccaacgtattattgtgttatttaaattcagaacctatttggtagagcttaagcttcaactttatctcaactggagctggagcccaatcaaacagtttcaacttcacccaaaaatgagtggagtgggctgaagtgctctcacgaaataaactagagatgcggagctatgttctgctctacaactctatacagactcaactcttgtagttaattttaatttaatctatgctattgcaactttgttaaattaaagaaatactactactattcacgacatcggctagttgccgtcggtattttgtctaatttgaatgcctgcatgccactatatacgtcccataccaaaattcccctagccctcgtggtacacacctatcaagtttctgtttttccccaactcttcgtcttgctcagcaagatcggtgtcttgtcgtgagcaggatggcggaggcggcaacagtgacggtgatggcactagagctcgatgaggccgatggtggagcgggagcttgacgaagccaagccgtgcgtgggagctcgagggggatggtggcgggttaggattttgactgaagatggaacgggcggcgggtcaagagctgacttagacaacatggagccaatgaggacaacacgaagatggatcttcttgagacaccactggaaccgcagccacctggccgagtgccaccactcctactacttgctccgccgtcgacgcgactgctgccgctcgctttgcgatcgacactaccacttgctccaccgccctcgccgccgtactacaacccactgccgtcttgctctcgagaatcttccagcctcgccgagctacatgaatgactagggaagaagatagtaagttaaggtgggtcccacttgttagcctctaaggctaggggcattttggtccatatgaaaatacggtatgaacaaacgtagtccaaccatggttgagatgtatataatggcattgttcaaattttacaaaatactgatggcaccccgtcgatatcgcgactactagtgactttttttaaaaagtttggtaaagttgcaatgacatggattccaattaacccttaaatttaagagttggagccctaccaagcaacccctctgttggttttctcccatccttacatggatgcatacctctctatgtacaccaaaattaattttacaaagttggaatatctttataattgtttatgtattttccttgcatttttaggaagcatagatatttgtctcgatgattacgaagttatacctttatccgacgttttatacatatatacctctgaactaacactatgaggggtatatagacctaactatgactagaaacgtgatatcctgggccaattaggatatagtttgtgtggcccgttagagctatatgcgcatgttaataccaccttactagtttagcaaaggtggaaccaacttataagggttcttcccttcaaccacatcactcttgaattaaagtttttacaaaaatgatgctaaaagtgtgagtgggtctgtcgtcggataggctgggttacgtggtgcagactgctaaaaatggtattagagccaaaccttacagttgcacgggtgtatgtgacatcctgatccacttaggatgagacatgtgtggcccataagtgctgcttgtacctctatccatataattcctatgttacctcttttacacgaagcaagaatgaaagtgtaagtggggtgatatgtgtaagtaggctcacctgttggattggctgggccgcgtgatttttgaagacaggacgttatattaaacttgtttttcttaccagtttaaccatggtttaaatttggccagtttatttttttactttaaaaataacagaaatacctctccgagggaaaactctaaaaaaacaatttggaattgaaaaataacaaaaaatactaactagcttgtttgtatagaattctatttccatgtcccaaaaaaataggggtaaagattaaatgatgtgtaataggggattaaattctttatcaaatatagatgtatgaattatctgtttgacggctaaataataatagaagaattctataaagacaaacagttttcaggaatcgtgctacctttctgaggagtatttcaaaaactagaaattaatttaaagaaagtgttttattatgatgggtcaaaactttatgtaattcccaccaaatttgatttagtattaattgtggcatatacattaataattttttaattaaattgcactaagggactgttcagattatagccaaaataaaccttactaaattttggcaagttggcaatattattttttttatgtatttatcaaagtttggcaacaaactaaacatagacacttttttggcgactttgcaaaaaaatggtatggttgaaaatgacatcaatctgaatagcccctaaacatcctttttcaatattttgtatcatggattgaactttatatatatgcaagtgtcattaaaaatcccttgtgaaaagtcagtgttgttacatgtttgtgtaagctaaattttagtttttgctgttttcataaccttactctgtataaatattatatattctacatacagagactatataatgatatatgtattgaaagattatacaatctattaacttaataaagtaataaaaaaggagtctccacgttcgctctcatggtctagaagttctcacattaatcaaaagaaaataagagaaatagaaaaatcgaaggagattaggattaggtagaaacgaaaaagaaagaaagaaaacatctcatgacacgggaaaacggacaaggtctctgaaataagtgtgaactgggtactcctataaactaaatgtaatcaatcagtacttgtcatgccaataaatacatctcatagcaaaacacaagataaccaaagcaagtcataaatcaaaagttcaaaattaaaaaaataagaaatattggtagctagccgcgtaatctgcgcgggtcaccatgctagttaacaacataatagatatataccaggtcaataatagattcgaacaagaaaaaaggagtctccacgttcactctcatggtctagaaattctaacattaatcaaaagaaaataagagaaatagaaaaatcgaaagagattaggattaggtagaaacgaaaaaaagaaaaaaaaacatctcatgacacgggaaacggacacggtctttgaaataagggtgagctgggatacttctataaaccaaatgtaatcaattagtacttttcatgccaataaatatgtcggtgacatgggatcaggagtatcatgactagaggtttgaggcagacacaatcgcccacgtggcctggcaccatcgggggacgtcgggcccgagggtgatgtgttcgccctcctcttagtccccccgagggggtcgggccggacccgcctcggccccgagggccgaggcgccccgacccctcgtgggttntcgctccgcgtgtatggggtagggancncacnngggctcacctaaccacatttattgcgatttggctgagcgtgtcaagccgcatgtaacgcagtgtagtgcactcatttatccggtctgtgaccagtcacagaccggtcagatcgcgggttaggtggcgacaggcgatttgacgcacgcctcgccccatcctgtcaggacgagggcttctaggcgctcgtccccagctggagctagcgtgttacctcccagagatggcacgttagtcctggtcagatatatgccaggcttcatcctaaccattacaggcaagatgttgtgtgaagaagggcgaacatgtagattgctaagctgacacgtggtggacaagaatgaccgacgtgactggtctgactccggtcatgtcgtcagcagacagtcacgattccacgtcgcatctgctcccggcgaaagtggaggtagttgtgagccgtcccatcagaaggtgactcggacggcaactatacaaatctccgtccatttatgaaaaggtaggggaagtccccacaaaaaaggggaaaatggtgcatgtggtatccccttaagatataaaaggaggaccttgcccacttagagaggggggactggacttttccagattaggaacccagaacaagggagaggctgactcatactttgtagcttcttcatacgcgaatccaccaaaaacacaggagtagggtattacgcttctcagcggcccgaacctgtatacatcgccggcgtctagtgtgcttccggtctggcgaatcttccacagattgggagcttagagtctcacccagggtccccggccgaaccggcaaaggggggccagcgcggtctcccggtgaggagccccacgctccgtcatctggcgcgccaggtagggggctctgcgagtgatcttctgagctctcgcactccttcgtgtgcgccaagcttttcctgttcagcccaatggccgagccagcaaaggcgcgcgacctctccccgagtatgagcggtgacgacggggagcaaaacccacgccaccgagctcgtactccaccgccccctccacgccaaagtcctaggcaggagaaggcgctcgagagggctgaaggatccgcgacttcgacatccacaggaggtggagaagggcggcgagatggggagcgtcacctccttgtctacggcgacggcagcacgccccagggcgcgctccaagctgcaggcgcgctcctacgtcacccgcccgtcgcccatgacccggagtctccagcccaacgttggctggacgatgtggccaaattggtcatgactgcacggcagcgcctagatgctggtgggcggtcctccgccaccaaggcctctggtgctgccaccaccggctccgcgtcgtcgagacggagggcgcggcgagcggcaaccgctgttcgccattcggccgccactccttcgtcaacgcctccgacccgggatgatctgcgtggggaaccggatgcccgcgtcagtatcgagcgccggcgtaatggccgacgtgctccccacgcaacggagggcacctcctcgtccggagtgtcacctcaccacggacgcggggatcagccctccgtgcccccggttggtggtgtcggctgtagagcctttgtggcgagccttcggaatgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaaaggacaggtgcggggttggctaatgaacttgccacccgcatctgtccactcttgggaggatttgtgccaacagttcaccatgaactttcaaggcacatatccgcgcccaggtgaggaagcggacttgcacgcagtacagcgaagggatgatgagtcacttcgctcgtacattcagcggttctgtcaagtccgcaacaccataccatgcatccctgcacacgcggtgatctacgcgttcagggggggtgtgcggcacaaccgcatgctcgaaaagatcgcctccaaagagccccagactaccgcggagctttttcagctcgcggaccgagtggctcgtaaggaggaggcatggacctggaacccctccggttccggtgtggtagcttcgaccgcccccggatccgctgctcagacagggcggcgtgacaggaggaggaagaagaggtcagcccataccgacgacgagggtcatgtcctcgccgtcgaggccgctttgcgggccacccgaaaggggaggcctgcgggcgacaaaaagaaggaggccggcgctcccagcagggagcgcccaaccggcaagtggtgcaccgtccacaacacttcccttcacgacctcgcggactgccgcgcagtcaaaagtttggctgagcggacgaggaagtgggaggaggagaggaggcaggagcgccgagagggcaagtccccggcagttccttccggcaatcgacgaagtgaggctaagcagaaggcccccgccgaggacatcgatgacggcgatgatgacctaggtttccaagagcctggggccaccattgccactgtcgatgggggagcgtgtgctcacgtttctcgccggagcctcaaggccatgaagcgagagcttctggccgcggcccctactcatgaggcgacgcgccgggcgcggtggtcggaggttgccctcaccttcgaccagaccgaccacccaccgtgcgttgcccgtggaggacagatcgcaatggtggtttcccccactgtttgcaacgtgaagctggggcgtgtcctcattgatggaggagcagccctcaacatcctttcccccgcagcctttgatgccatcaaggccccggggatgatgctccgaccgtcccagccgatcatcggtgtgacgccggggcacacttggccgctaggtcatatcgacctcccggtcaccttcggtggacccgccaacttccgcacggagcgggtgaactttgatgtggcggacctcagtctgccctacaacgcggtcttggggaggcccgcgttggtaaaattcatggcggcggtccactacgcctacctccagatgaagatgccgggccccgatggccccatctctctccatggcgacctcaaagtcgcgctcgcttgtatggagcagcgtgcggactgcctcgccgtcgtaaccaagcccgagggtggcgatgagaggcttggcacatccgcccccgtcgccccgaggcagcggatagtcacgtgcgatgaggtcccggtcaaggaggttgccctaggcgacggcccgtccaagaccacacggatcggtggtcttctggatggcaaataggaagacgcgctcgtctctttcctgcgggcaaacgctgacgtcttcgcatggagaccggcggatatgcccggggtccccagggaggtgattgagcaccgtctcgccgtacggccgggcgcaaggccggtccggcagaaagtgcggcgccaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaacgaccttaacaaggcatgtcctaaggatccttaccccctgcctcgcatagatcagattgtcgactccacagcggggtgcgaccttttgtgttttctagatgcatactctggttaccatcagattcgcatggctaaggaggatgaggaaaaaactgcgttcattacccccataggaacttattgttatacaacaatgcccttcgggttaaaaaatgcaggtcctacttttcaacgtactactcgaatttctatgggtagccaaataggacgtaatgttgaggcttatgtcgatgacttggttgtaaagacgcgcaaccaagaaaccttactctcggatctagcggaaacttttgaaagtctccgctccgcccgcataaaactgaaccccgataagtgcgtgttcggtgtacctgcgggcaagcttctcgggtttttggtctctgcccgaggcatcgaagccaaccccgagaagatacgagctatagagcggatgcgcccccccagcaagcttaaggatgtgcaatgcgtcactggttgcatggccgccctaagtcggttcatatcgaggctgggagagaaggcgctacccttatttaagctcctcaaacgctccgggccgtttacttggacggaggaagctgagcgtgccctcactcagttgaaggcgtatctcagctctcccccggttctggtcgccccggagccaaatgaacccttactactctacttagcggcgaccccgcaagtggttagtgcggcgttggtcgtggagcgcgatgaggacaatcctcattccgcgcacccccaccctgtatagacttggcccgggagagagcagggaggagaggcccccgagccgaacggtggcccaaggcccccgacgaccggagttggccctctgcccgcttgtcagacggtgctaggagcccccgacccccaggaaggccctgaggccactgtgggaaggccgcacctatcgccctttgaccccgaggctaaccctgtgctgactcgacccgggaaagagcagggagaagaggcccccgagccgaacggaggtctaaggcccctgacgaccggagttggccctttgcccgcttgtccgacgatgccaggagcccccgacccccaggacggccccgaagccactgtgggaaggccgcccctgttatcctccgaccccgaagtcatcagcacagaagacaagtgcgccccgcgagactgcttggacgaagattgccccagggatgcggcccctagcgaagaggatcggcccaaccgaaaggtgcagcggcccgtctactttgttagtgaggccctccgggacgccaaaacccgataccctcaggcccagaagatgctttacgctattctgatggcctcgaggaaactgcgccattatttccaggcgcatcgggtcactgtggttacgtcttaccccctcggtcaaatcttgcataatcgagagggtacaggacgggtggtgaaatgggcaatcgaactttctgagttcgatttgcactttgaaccacgccacgctatcaagagccaggccctcgccgattttgtggcagagtggaccccggctcccgagcccgtctcgatccccgaggccagcacggacccctcgcagctgcctcacaccgcccactgggtaatgcagttcgacggctccctgtctcttcagggcgccggtgcgggggtcacgttgacctctccgagcggagacgtcctcagatacttggtccgcctcgactttcgagcgaccaataatatggcagagtacgagggactccttgccggactcagagtggcagctggactggggatccgccgcctcctggtgttaggcgactcccagctggtcgttaaccaagtctgtaaggagtaccggtgctctgacccgcagatggacacctacgtgcgccaagtacggcgtatggagcgccattttgacgggattgagcttcggcatgtgcccagacgggataacatgattgccgacgaactctcacggctcgcgtcctcgcgagcccagaccccaccgggcgcctttgaagaaaggcttgcccagccgtcggcgcgacccgaccccttaggggagacggatacgcctgaccggcccccaaggcctgtcggagtccaggcctcgggacccgaggggagtgctcccagttcccttagattgattgcttggatcgccgagatccaagcatacctcacagataagactctacccgaggaccgcgaagggagtgaacgcgtccatcacatctccaaacgatacgtgctggtagaagggaccctctatcggcgcgcggctaatggaatcctcctgaagtgcattcctcgggaacaaggcgttgtgcttcttgacgatatccatgaaggcgaatgcggagcccactccgcctcgcgcaccttggttggtaaagcttttcgccagggtttctattggccgacagctctcaatgatgcggtcgacctggtccggcgatgtagagcgtgtcaattccacgccaagcaaatccatcagccggcccaggccctgcagaccataccactttcgtggccatttgctgtctggggactcgatatcctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacggcccggtttggagtgcctaaccgtattattacggataatggcacccaattcactagtgaactcttcggcgactacggcgaagacatgggcatcaagctctgcttcgcctcacctgcccaccccagaagcaatggccaagtggagcgcgccaatgcggaaatcctcaaaggccttaaaaccaagaccttcaacatactcaagaagcacggcgattcatggatcgaggagttgccagcggtgctctgggcaaaccgaactacaccaagccgagcaaccggggaaacgcctttcttcctcgtctacggcgcggaagcggttctcccatccgagctcaccctgaggtctcctcgggccaccatgtactgcgaggctgatcaagatcagcttcgcagagatgacctcgactacttgaaagagcgaaggcggcgcgcggccctccgagccgcgcgctaccagcagagcctgcggcgctaccatcagcgtcacgtccgggcccgatcactctgcgtcgacgacctcgtcctacgccgcgtccaaacgcgtgctggattgagcaagctttcactaatgtgggagggtccgtatcgagtggtcggcgtcccccggccgggctccatacggctggccacgggcgacggcactgagctacctaacccgtggaacatcgaacaccttcgttgcttctacccctgaggggggggtcgggtgtcaggtttcgggctcgggccaaccccgcaccccctcgggcgtgcagggttggccgggggctgccacacatgcacattcttatttctttttttcagtatttcaataaaagcagtttcaatttcctaaaggctgtatctgtgctgttttttccttttgaagaatcttgacttgaaataggtcactcgcgctcaatcctgccctcgggggctcgggtcggctaaaatcgccaagcggggcccagaaccgagccgtgccccggggcgtggtgaactccgggggggaatcggcaaaaacccacaatcgggtcacccataaccctcggtcaccacgttcccggcctggccagtctcgacatgtggatctccccaggcactagccccgacccgcgccttttgaggactgggacctgggcacgaacccttaatcaagctaagacacaaaaggaccacggcacagatcatcctcatctcatacacacagcaagatgaaattgacacaaaaatttcctcatttttgattacagattaagttgatctatacaaaaaagaggcccgaaggccttagaagaaagaaaagaagaaaaaactgaagaatggcgggggtctgggggctcaatccgatgcgcccgggtcgccggcctcgtcgtcactgtcgtctgcaccaccggcattgccctcctcgtcggagttgggggcgaacgcgagccgaggggccgagccctcgaagctgtcgacgatatggttggcggcatcccagacctgcgcgcgcgcgcggtcctcggtcccaggagggaactcatccagcgccatccatggagaaaaattggggtccctggcctggtaactcgccaggacgagctccaccgccccttgggcgaggtccctcgaggatgacttaattgtcttctcgagctcctcggggagccgttggagagccccggccatcttcgagaggcgctgggcgagacctccctggttggcggcgtactttacggtccgccctctccagaggcccacttgccgaccggcgcaatctaggcgggagacggcgtcccaaagcatgc

SEQ ID NO: 31816 - DNA, 2587 bp, Oryza sativa
tgcataaggggctctgcgttcaatggggcgattgaaggcgtggggaaaagccgccttggaaaggatgccatgcggctcaggccaccgatggaagtaccggactcggggatgttccccggacccgtttggccctgagcgtcgcccgagggagtggacccaaacgacgtgcccgtatcctcgtcgccagctgccccgaaagttgtcgcttgagcgtcgcccgagggagtgggcccaagcgacgcgcccgcggcctcgtcgcgggctgcctcggaagtcgccatcgcctcgtcctggcgaaatccggctttctcccgagcggcttcctcggcctggcgggcccgggcggcctcctcccgagcggtttcctcggcctggcgagcccgggcggcctcctcagcttcccgtaggcgatccgcggcctctcgccggtcagattcccgcctccgggcctctgcggccgccggatcctcggcctcagactggccggatttggaatggcgggagggacgcgacgggatctcgctgaaacaaaagaaaagaccagaagacgaacaagatgggttagtgaaaactcatgttgagagaatgaatacagccacgatggatgagagacgaacctgcgagggggtcggttaaacgaccactttggaggggaaatgaggtttccccgagatggttctgtctcccccatcttgcggaaccgcttcttcttgcgctccccctcgggctgcggtgtcggcgcggcccctccgggcgcctgctgttagcacgcaccgccccgccctctcggggaggagatgggggaggtgttcctccctgcttcctcttcccccgggcgtcggcagggcggctgctccccgggcccctgtcgcgggacccagaagcacgaccccctcccggggtagattgttcccccctgcggctcccgcctgcgccgtcgtggccctttggagctcgctcctctgaggccccgaccgccatcataatggtcaggatggaggcgcggtctggatcgctgcagagggggaggattccttggggaatgaaggacacctccacggagttgagattcagcacccgttggaccaatatcttgaagtcctcaggagcccagtcccatctcactccctggtgggtcctcatgaagtcttcggacccggtgtactcccaagcgccccgagcgcgccgctggagcggcgcaatccgacgacggaggtagtcgccgtacaccatggcccctgtgagcccctgggatcgcaggcccgccagacggtcgaggatggcgtcatagccatccctcaaatctaccggcgcccgccagctggaggcctgcgccgggggctggctcggaagtcggtggcgcgcttcgtcggtgaggggggtgtagaaccagtcgctcttccagtcgtcccacttcttgcggagggcgcaggggatgtagcgattcagcaccggcccccgtggctggaagtagcagccaccaactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactctagaacatccatgaagaaagaagaaaatggtggaaccagccctgccattgcaaaggggagaaagaagacggaccgccccgggtagtctggcgccgggcgtccctcgcccagcgtgactatctcccggccggtggcagattccggcatgaagcggcgcggcagcccagcctgcctctcgctcacgatgcaggaaggcggcagcacgctaccatcgagcagagcggagcctcgtgccatggcgccggaggaagagaagattaagagcgagcgcgtgtggcgaaggtagggcacaggaaagaaggagttagggcgcaagcggcgaagacaaggggaataatggcgaaaggaaggaaacagatcccttcctcagtgcctttatactcttgccaacgctgtgcccggctcctcgcttctcgcgcccactatttcgccccctcgtttctcgcgcccacgctttcactaatcctattcgcccgcttgcggcgcatgaggtggatatgcggttgtggcagtcgagatagatcatatcgtgcgcgcggtaattacgctcgccgaccgaagcgacgttaccatatctccagacgaaacgaatcgccatgtccagattcgtatgctactcgagtaatgtggcagtcttgaagagaccgctcattattgacagccgagttaccactgccgatgtgcgtgatttgtgaccgttgggtttctgcccaattgtggagaccggtcccacctgtcaccaggccttaggagtggcgtcacgcccgaccgcttcccttaaagagggcgatcgccctggcataacgccgggggctactgtcggtgacatgggatcaggagtatcatgactagaggtttgaggcagacacaatcgcccacgtggcctggcaccatcgggggatgtcgggcccgaaggtgatgtgttcgccctcctcttagtcccccc

SEQ ID NO: 31817 - DNA, 4497 bp, Oryza sativa
  unsure (1)..(4497): unsure at all n locations
nnnnnnnnnnnnnnnnnnnnnnnnnnnnnnnnnnnnnnnnnnnnnnnnnnnaagacgatgtatgaagaactgataacatgtagattgctaagctgacacgtggtggacaagaatgaccgacgtgactggtctgactccggtcatgtcgtcagcagacagtcacgattccacgtcgcatctgctcccggcgaaagtggaggtagttgtgagccgtcccatcagaaggtgactcggacggcaactatacaaatctccgtccatttatgaaaaggtaggggaagtccccacaaaaaaggggaaaatggtgcatgtggtatccccttaagatataaaaggaggaccttgcccacttagagaggggggactggacttttccagattaggaacccagaacaagggagaggctgactcatactttgtagcttcttcatacgcgaatccaccaaaaacacaggagtagggtattacgcttctcagcggcccgaacctgtatacatcgccggcgtctagtgtgcttccggtctggcgaatcttccacagattgggagcttagagtctcacccagggtccccggccgaaccggcaaaggggggccagcgcggtctcccggtgaggagccccacgctccgtcaaaatacatctcatagtaaaaccagataaccaaagcaagtcataaatcaaaagttcaaaattaaaaaaaagaaatattggtagctagccacgcaatctacgtaggccaccatgctagttaacttaataaagtaacagaaaaaggagtctccacatttgctctcatggtctagaaattctcacattaatcaaaagaaaataagagaaatagaaaaatcgaaggagattaggattaggtagaaacgaaaaaaagaaataaaacatctcacgacacgggaaacagacaatgtctttgaaataagtgtgaactggaatactcctataaaccaaatgtaatcaataagtactcgtcatgccaataaatacatctcatagcaaaacacgagataaccaaagcaagtcataaatcaaaagttcaaaattaaaaaaaatatattggtagctagccgtgcaatctgcgcaggccaccatactagttaacaacataatagatatatataccatgccaataatagattcggacaagtacaagttgcatagaaaccgtcaagcagcttcctcctcccagatatcaaatatacatacaaatgtcatgtcaatgcagtgaatctggttcctgtgtttctgactttcaggtgcaactactgcttgacgtttgtggccacccatcagcttacatgttctagctaagatgatcgagacatcaacgaaacagaagtcggcgaaacgtgagaactcatgagctgaacgaatcttctcttgaatgatcaatcagcagtcaaatgctaaataagtaggagtatcaaggaaactgcatccagatcagtggagtagtttggatggaatcctcttcttcgagatgaattaatgcattgaatcttttgtttgctgatgtcatcaactgaatctgaaagctctgccagccagtcgatcacctttgaattaatctttcttcacacaattgacctgaaacttcagtcaataaaaactgtatttcctcgtaggaaattaagcatcactgttgtgtgatggaggtcagcagttctgaatattcggtgcagtgcaacgaagctgatcaaccacacatgccatgaatatatagtcaagctttcaacgagctagctacgacctggcttgctctcagatcgatcgacaaacttgaatttgtaaggttttgggtggcgttccgcggatcggaaccaccaacctattttggaatccaaccgtctctacttgcgtaaattcaaagaggatctcgttgattttggttggacgtatgtgtacattcaatttacccgatgatttgtgcaagcacattttcaacgttgctgtaagatgcggtcgggaaaaacgaatagtaacagctgatcatacctaagacttataatttaattttgtcatgtctgggaagcttccaacatctagcagttacagcgctttcagaacctttagcccccaaacagtttacatccttacgagcaagatcatgataaaatgaaatacatatacataaggatgtaattttaggggcacatgacgtcgagtttgcccagggccctcgggccctcgggccctcgaaaatatagagtcggctttggtgggtgcatcacttgaaatcattgttcattatccatgcatagatctgaattttgaagtccgggtaataggtatttcttatttttagcaatggactgcataccacctacacagattgacaaatcccacagattcttgtgtaaaatcaaaggtgtttttaattattattctgtgatgaacaattgggcattggagattattggttttgttatttggaatttattcacgaagtggttttggagatgattggattcacatgtgatcgtaggattcaatatgttatgtgaccagtcagaccgggctctggtagccggtcggaccgccggcatgcgcgcggtcagaccggccaacccgcggtctgaccggccgacactgtgtcggtttcggtttcgggttgtttgtttggatatccgtgattattttatgattatgacttctagatggatactatacgtatgtaatactgttgtttgctactaatgaatcaagttggagatagcttggtctcggaatatggtttctttgtttgttccatgtgtaagtgactcgatgtctcgggagagtatttgcggtgatggaccgagagttggcttggggataagaccacgtccgtggtggtcagagatcatgcaggatacttaggctagagttgatgcacgtggttgatggagattccatatggcatacgatggagttattgtgtgcgtatggaatgcggagtaaaatttggaaggagtccaaatttggtacgattggttatgtaaagtttctttcttgtactagagggtttcctaaggtatctaggactcttagtatgagtttagttcgtggctttaggctgcctacctcatgtataaatagagggggagcgtgaggcttcccggtatcgcttttgagagcaattgagttgagttttgagttagggttttgagtttactcgaaatttttgttaggagtgctgttggtgcactttgtaaacacagagagaaacaataaagtcattatctactttaagagtttttcgatttgtgtttaccgggtttcggcggtcagaccggcgggagcacggcggtcaaaccggcggccgcgacagcaagcagcagctgatctcggcggtcggaccggagatataatctctttcagaccgacggcaaccaggcggtcagaccggcaggacaactttggtcagaccgcgatccgtcgatttcgagggcaactttttttccgctaaaagtttttggtttttgggtatactaaccattcattcccctctggttggcttagttcttgtgattcgatcctacagcttgatgacatataacaacgttgctaaatcatcctagcacatgccaatccgtatgcttatatattaattcttgcatatccacaaaatcaataagaagggaatataaatctattaattaactggacagaccctccatcgttataaaatgtgacaagttacccattctaaggaattgttttcgcatgtaaactgatctccattctcattgatatatttcgtccttaatcagtactccctctgtgttatattacaagtcgttttttatatttgatcaatttttttagtcgtttttttatatttgatcaagtttatagagaaatttagcaacatctacaacgccaaattagttatattaaatttatcatttaatatattttgataatatgtttcttttgtgttcggaatgttattatatttttctataaatttggtcaaatataaaaaagtttgacttgagaacaagtaaaaaaaacttataatatgaaacggtaacttataattataatatgaaacagagggagtaggtaaccctaatttcttgggcatgacttaggcaaagctgtcggggcaaaaaaaaagaaatgatggttgcttcgtagagagtagggtagaattacgtagctagctcccggtcaactataaatgtctcgtccttcacccgcaatattaatgagcatgtcatctttccgtttcaaatcatgtacacttagagtagcctaattaaccttccaaaaaaatgatttctccgggccatatatgcaaaggatccaaaatattgttttcttctatgtattgactttttgtatcggtctttcgaagttgtccgaatgtttgctctttgagaatacgataagcaaaggccgggattgattcaattatctaaaatcagtggcgaagccagaagggttggagggaggaccaagccgttgcttcccctcgagaattcactcataatcacgttgatt

SEQ ID NO: 31818 - DNA, 3389 bp, Oryza sativa
  unsure (1)..(3389): unsure at all n locations
nnnnnnnnnnnnnnnnnnnnnnnnnnnnnnnnnnnnnnnnnnnnnnnnnnnnnnnnnnnnntaaaactttttatatgcaaaaggttttttttttcgaactatcaacccaaacattttattatttacaagaggattgaaatcaatatttgcttattattatgttttatcatctattcttatatagatacaatccgccaattgcatttaattgcaacaaaagagctgtcgcatttagccgtgtcatcaaacgtatttgcgattggattaaagtgtgtatgagttatcaaccattagatcaatgtttcttatagtaaagtagtttaaaaaccccaatgcaacgcgtcatattcactattgtttttataatcgttatcactcagcaagttggccttcatcaatatcttaattctggcttagccactgtctaaaatatgtgcaaaggatctagaagacctaacaacccacatgacaacattcgtggatcacgagaaccaaaagatgctgtaaacaaagaaataataatgcaaactatacatgtgtacgtatgtcggacataggagacatgaaggcagcaattgtgcgatctttcaggaattgaaaattacatgttttaatcttaatcaactaccattttaacaaattaataaatataagctcaattggttatgtttttttatagtgaaatcgtggctagatttaagttctagactcacaagtgcttacatttacgaataattatttttttagtgacaggtgacacatcagtcgatggtgatatccgtagtgatttcatcaatctcaagatatattggccagtctttcaaaaatgaaatgttgttataggtaggatctacgtatatgttttcatagtagtgagcattcacacgttgtgagcggttgtgtttatgctgtgtattaaaaaaaactaattagtgaaaatagcaactgcaaataaaaatatttcaaggcagttctgtgcacaatggctcggtgcctggcaagggattttggagtctgcttatttcagctacgggctgtaagccaaaaactaattttaaattttagaattatttttagtttttatgttgtttttgttactcggactaaaattaattttctttcatcagttacatgtacatgtcataatttaatttaaatcttggccgagaacaccggggcgtgcaggttggatgacagacaccggtgtttggcgggtcgcaggagcaggagacgacagacactgaagcgtgtttgtttaaaataaaattgagaagctgatgcaagaagacaggaacaaaattgttgcttgtgcccctcaattaggccgtgtacaaaataaagagtccgaggtggactcttaatcatttagagacgaaatagtaaagaccattatttttattaccattctttcctttaattttctccattctcatgcaatatgattaaattttaagagtcaactttgagtggttgttatgtgtagcaactattttttcttttcctttccaatctctttcatatcaccaaatttacttgcatgataacgaagagagcccgttattaaacatcgttttacatgctctagtttcaatcgtatatatatatatatatatatatatatatatgatgaggtcaataataatatgtgggttcaaacttttcataaatatattagttggaatctttctattttaaggcatcaatgagttatcccatccaaagattccccagcttacgctctactccatcggtagtgctttgcaataccacatttagcttgaagtattgccagttcttagttttattttaacaccaagtcttaatagagtattaacaaaaaggctgaattgttttgttatttagtgatgatcagctaaccaactaactttggtcagagttgtggctagtgagtctatattttgttttctatcgtttacctgagtcataagctagcgcgtttttgtttcgcttatgtttaatataaaaaaatggcttataaacaatttaaaaagataatagtttatagaaattttgcatacatgttcatagcaaaataaaaggaaatgttaaaaaataaactgtgatataaaaaccttaaaaccaactgaaaattaaaattaagttttaaaatttaaattcccgattatgcatataagctaaaggctaaaggatgtggatgcacaatttagagccagagaggaggtgcagagaggagggacgcccaatatttctattgccaaactgaacaccctaaacgccagccagatcgatcacaaatgctcgaagggactcgtaatgcgaaacctaagattggcatctcaaataagcgaaagaggaccaatcagaagaaaagaccaaggtgggttcagtggcatctcaaaatgcttaattttaataccaattatgcataagcaagaaggtgatctcgtaggataaggctcactttacataatttaggctcttaacacatagtacatactaacttttttaagttcaaatatacaaatataggtgcgtcatcttaattgggtgtttttctgataactgcttggagaggttgctgatattttatttatattgacttgatatcgtggaagagtaggtagaaattcaaaatcagcgtgctcatcgtccttactatctctaggacggcctgtgcaaaataaggccatactacaaaaacaaggacaagtccttggtttaattcatagggatggtatttttactatgcatggttctgcctctcatagtgttttcttaaaaatcctaatgcatggttctgcctccgagactgttttcttttttttaaagaaaaatcctaatgcagattccagaaggaaagttaaattgaggaactcttagtagcagagagttgacgaaatgaagcacgtaaaataacaagttaattgaaagcccatgttaggagcccaacatactgcagatgggccagctcagttgctcaaccaagccacagcccaatcaagtcaaggaatgcaatacaaaaggcagtagcagcaagacatccaagtatcgagcagatcgatcagaacgactgcggcggcggcgatgtcctggttccgggctgaaacctcggcgatctctcttctctacatctactcctacctncagctttctcttcaaggtctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 31819 - DNA, 708 bp, Oryza sativa
ggagagcgagggaggcgacgggaagctcggggaaggaggaaaaatgggggagagagagctccggggttagtttttataggctcggggagggagaaatcgtggccgggatgggcggcaacggccggcatggtggagtggcgacgtgggcacgtggcggggggaaaccggcgccctttttttgggggaaagagagagaagaggtggaggaggtggtggggatgcagttccaccgcttgggcgcaaagggggatggcggggtggcgtgtggggcggcaatggcggcatggtggcggttggaggcgggctggaggtgggaggaagagctgacaggtggggcctcgggtccacctgtcggccggagggagggggaggccggttgggggggggaacaaacttggagggggggagcgagctaggccggtctgagagaaagaagcatgtgggccgcgagagagagaaggaaggcttgggccaaaaatggcccaaggaaggaaggtgatttgatttgttttctttttattctaattgattaaatgcactttgtgatgttaaaattacttcttgagctccgaaaaatttacggaaaaatccggagagtattttagggcagaaagaatgttacaaaatattctcggccaacgatttttaaaggaaattttaatttcctctataatttcacttgattaatttgatttaacttttatttaa

SEQ ID NO: 31820 - DNA, 650 bp, Oryza sativa
tatgagttttcattttcagatagtctggtaaatggcccaacaaaggcacattgccaatttccacaaatagtgtaatcaattcattgtgacaagtttaaaaaaaattatagaaaagtgctgccttttattgtagtttatttgacaggaaagattctctctaaaatatcttaagctcacaccaaaagatagagacaaacactactgagtttctctaataagtttccaaaaaaaaaaatttccaccatttagtaccactaaacacacacttcttcagttaagtttcttccaagccgcagacaggattatctcacaagcatcagaagtcatcaccgtaaaagacaagcggcctctgctgctctgcatcaaaccagggagttaaactcaatatttaaaattgagaaactatgtgctgattgtctataaatatattgttgatgtaaatttggaatcgattattccgcatgagtttgaccatgatgcacatagtgtaatgaagacatgagtgtggaaatctctacgcgcatagtggaaatcatcgacccaggttacccaatagatgcataggtaaatctcatgtcatgatcacaaatagccatcacattttaaagttgtggattagatgtaccgatatatctaatcttctcatcatc

SEQ ID NO: 31821 - DNA, 379 bp, Oryza sativa
gaaaaggggcgatgctcggtggaggccatggtggaggtgggccgtaaggctcaccgccggcacgtctaggagcttgaaacccgtaaaaaggggccggcggaaatcgccaaggaaggggaggaggagcggggggctgccctcaatgccaccaccgggatgaacgaggcgcaagaccccctccgccttcaatacgggaactgggaggcggagctagggaagaagctctacgccgcccaaggggtgcttgacgctgccgctgcccgagaacaacgggcggcggagaccgaagcgacgtcccggcggcgcgaagaggcccttgaggcgcgcgccatggcgctgaaagagcgcgcctgcgtcgtggagagcgatctggcggacc

SEQ ID NO: 31822 - DNA, 767 bp, Oryza sativa
gcaagcccggccaccgcctattttcccctctccaccaccgaataaccacctccacggcaaacccgaggccgccgccacattcgccgcctccggtcacactcttccgctattgccaaccactccgcgcgacactattgcctccgctggctccgccataccgcacagcccctccggcaccactctactggctccaatcgctgttggaaccccggcctctccgctcgaggagagaatccgccgttttttctcatctccggccagcgactcacgccgccgtgagccacctctccccctcctaacagctctcctttcatcccatggtgcagccaagcccgtccgcccctttccgagcgacgcccgtcgccgaagctccgtcgcgtcgtcttcctgaggagccccgccgccgccggtcattgccgtcggccgcccctttcgccgtcgtgcccctcggtgagcactcccctccctctccctcttcctccccttcgtcggccgcctcccgggcctgctcgtgacgcgccaccgtcgccgggggctgtctgaccgggtcgccgttgccgtgctatgcacccgcgccgctgccggccgtgccgggcagctggctgccacctccccttgtcgcgccgcgtctccgctctctcgcgtgcgctgccgttgcccgcgtgcgccgtcgccgctggttgccgcgccgtcgctcggccgggccggcctgagccgtgcccgtgcactgccgccgtccacggtgccgctcgagccgcggtggaccg

SEQ ID NO: 31823 - DNA, 503 bp, Oryza sativa
aaagttgacatgcagattcacgtcttacaaacatataaaagtcttacataaatgcagcacaaaataaaagcgagcttattctagagcttgacatgaacagcgggcgacaccattccacaagcatccttgacggcacggatgaagcctactccttcgagtaacataacctccatctgaagcatactccaactctggggtgggagacagaccaagactgagtactacccactatactcagcaagtcataccggaagagaggtatgatgtagtgtatatataccaagggagctgagggtttatttgcataattctagcatttaaaagtaggtgttgaaagcagtaaaatcgttttaatgaattaagcaatattaatcatcactgcgcaacactacaccacgttgcaacaggcccaaccaaccacttgaactacacaagttccattaggtcaaattattatagatgagactaatcacggtgaatttgattggccacccataacaccc

SEQ ID NO: 31824 - DNA, 570 bp, Oryza sativa
tccctgatgaaaattactcaaaccaatccaaatctcatggcacgtttgaagatggacaacacgatcataatcagaacgaagaatcccactcaaaagaatattgcgagctttgcaattttgttcaactcaatttttgcagcatcagtattaataactttaggaatcacataaggatgagaaacttttctccaaatatcataattctcacccataatgtaagattgcatcctactacaccaaaaaaaaaaatccgttccatcaaaaacatgaggcttagttgaaaacctaacagaagtagccatggcaaaaactttagatcgataaaaatccaaagaagaaaacgaggctctgataccacttgtaggatcgaacacaagcaaccaagcctaccagaggggggtgaatggtagggaaaaccaaaaacccaaaaacttttagcagaaataaaagttaccctcaaatcgatggaaatctcgacgtagtcctgtcgccgccggtcggaccgctcgcacgccgccggttagaccgccggtatgtcgtcggttagaccgccgaacccgatgaaacaca

SEQ ID NO: 31825 - DNA, 598 bp, Oryza sativa
agagaaggcgctacccttatttaagctcctcaaacgctccgggccgtttacttggacggaggaagctgagcgtgccctcactcagttgaaggcgtatctcagctctcccccggttctggtcgccccggagccaaatgaacccttactactctacttagcggcgaccccgcaagtggttagtgcggcgttggtcgtggagcgcgatgaggacaatcctcattccgcgcacccccaccctgtatagacttggcccgggagagagcagggaggagaggcccccgagccgaacggtggcccaaggcccccgacgaccggagttggccctctgcccgcttgtcagacggtgctaggagcccccgacccccaggaaggccctgaggccactgtgggaaggccgcacctatcgccctttgaccccgaggctaaccctgtgctgactcgacccgggaaagagcagggagaagaggcccccgagccgaacggaggtataaggcccctgacgaccggagttggccctttgaccgcttgtccgacgatgccaggagcccccgacccccaggacggccccgaagccactgtgggaaggccgcccatgtta

SEQ ID NO: 31826 - DNA, 1278 bp, Oryza sativa
atcctttggtttctttctttccagatttcccaggctatgagtaggattaaggatcgcagcccgttcttgggcactttccttttattggctaacatttcccactattcgtgtacgctttggcatggctcccaattgctcggatccaattgctgataagccacccagttggccgtcagtctccagatccttctggtgtatctacaggaagctaaaaggtggcatgccgtctcgttcgtcatacggcataggaggcacactccgctatttggccatcctcttgtagctagtcgatcggaagtccagactctattttgaatcacaagctacgcataaagtttgcattttgcaggggcccaagatttccaaattaggggattgaagttggtgccgactgttcctagacactgagccttgtatgccgaagaggccgagtattctccatgattcgagagcttccagacgatgtgatccgactcattttggtttagcatgatgtcctgggttgcgctccatagggacacaagctggctgatcagttccactgtaaaagtagtgttcccatttagctccaatttagctccaggtcatcgatccaggtgtcattttcaatgccttcacgtagcgatttgcttcttttcttggaaattgcatagacgagcggcatgctgtcctttggtctttgcccatccagctaggcggactcccaaaagcggatcgtgtttccatcccctattgttattttggtagctgcggcgaagagaagtttgtccgtttcatcacacggtgtctctagtcccacccacggcttggtggggtgtttccattcatgccagagccatctcagtcgcaaggccctcgtaaacatctccatgttcagaacccctagtcctcctagtgtggttgggaggcacgtccttttccagttcaccttgcatttccctcctgtaattttccacgtttgaaatatatgcacggtgctcctgtttgtagtttggttgcggtcacccgcgatttgtgaagaagaagacgaagaataaaaagaaaaagaagccgtccattacttaatttgttgcatattaaagaattctccgaatttggcaccatcgtcctcaaataaaaaaaaagaacacattaattggatttttataagaatggaactctaccagaggaaactaaaaagaatataaaaaatttaaagaatcctgcaaatcttttttatcacggtaaccatgcataattactgtcgataattcccctgatgaaaattaacggcgttca

SEQ ID NO: 31827 - DNA, 6032 bp, Oryza sativa
taaagaatcctgcaaatcttttttatcacggtaaccatgcataattactgtcgataattcccctgatgaaaattaacggcgttcaggaattgacacttttattttcgaaacgacctgcacgatataatgcgaattttcacattgatatagaagaaaaaaaaaaactccctccgttccaaaatattaaaactgttagccctaaagatttgtactaaaatataacaacttctctatcaatattctcttcccaaccaatcataatccttcaccattcactttttctacctaactctactactcaaccaatcacaaccctccaccattcatttctacctacgaatacttataatctagaatggagggagcacaaaattataacactgaagggtgtaactaggaaaaaccaaaaacaaacacaccaccactgcttgctagcggctcctaacacaacctcgaagatggcacagtaccaaaccgactaccgctaagcgtgaccaatcgttacgggacaagaaaggggatcacaatgcaccaccgagaaccaactccaaacaaaagattaatgatgtagtggggttgagcagggagagggtgagacaagaagatccgctcatcccccacgccaagcttgtgacaacaaccaatagaccacccaagaccaagctgaggggaggccgtaaaggtggggaaatgtagacctccaagacgcctttggcaccaacgtcgcccctccaaaaggactgagcatggttataagaaccgggaccggactggcagttcgaccagaaaaaaccagaactaaggctgcgtcggctccgcaaacggaccggcgaaaacccatcaaaccgggtggttttttgccgaactagaggtggttcgactgctgagggctgctgcaatgagggattgaacccaagacctccttgttcccatggaaagactcatccaccacggcatgtcgcctattgtggtagtattgtagcacacatttatttaaaccattttaaactggtggtttgaccggtccaaccaacaaaccagttaactgagtgccctaatggttcattaccggcccggtcttaataaatatggtcaggaggggagaggaaggcagcccgacaactccacaaagagggatcacgaaacccaaacacgtcatcctcagataactccaagctaggctttcacctgctacatcctctcccgcacctgtcatcgccacccagagctccaccaaccaacgacctccgctagcctacaactctatcgtatcggcaccacagtgatggtcagcccagaccagccagcaccacctcccaccgcctagcatgacgcgatctcccacgaggccgcgcagatagagcaccctcttccccaatcaccaccgtcatcgtcttgccaaaagagctcccttcgatcggaaggggctagccatagcaggcgaggagcttcatggagagaaaataaaggtctgattggctagaaggacagacctgccaccagctgcagcgcttgctatcgcccgcatcgcctcggtcgcacctgactcaaccggtggtctcggtcgcgcagccaactctaccgttcaacccacttgtgcccactgctcccaccaaggatatgccaaatccagtcattgggaaactggatccagccaagacggtgtcggatcagcagcaaccaaatgcaccgcaaccgccttctcagcctgctgcacggcatgcctatggtggctaggttttcgcccccgacccacccacgaggggacggcgtgagggaagaaattgtgtaaaattaattttttttttctggaattggtactgttggagcgagatagaaagatatttgcacattcctgttgcgaatctttgggccggtaggaaattaaagagaatggcttttcttcgaagaacacgtcgatatcgtgtacacagatacacagcacgtaacttacgtgttgaacgtattgattaccaagttgatgtggtggaagtggaaaatgattgcacgatcgatgctgatcgctgctcggccatactgaatcgtacccgttaactatttcacattgaggcagttggagggtgaattaattttctgatgctgactgaagttaagtcagccaacccgctgttattagcaaacttatccagcccgccattaattttcttttttttttagaattacacagtacaacgcagacactcataactcacgcgcactcacccctatgaacacacgcacgtaaaccctatctctatgagcatcttcgaagactgggctagcaaattcttgagagattgacgaagtcaccacaggcgcctcgctgtcgacgggtacgtcgcctaccactgaaagcacagcgccgataaatcctggataattcgctcccatggggagtcgaacccaggacctcaggtgctactgaggtggttgcagacttaatcttctttatgtatatactcgttccatttcggggttataagatgttgtgactttggttaaagtcaaactgtcttatgtttgaccaagttttttaaaaaatagtaacattttcaatctaagaaaaatttattatgaaaatatagtcaattattgatttgatgaaactaatttagtattatattactatatttatctaacagtttaactttgaccaaaatcaaaacgtattgtaacctgaaacggagagattatatgtataacacccatatgggcaccatggtctccgggcaccaaggtatgaaataaaaaaattcactcaaaattttaaaattttgaattttaaataaataaataaatatatgtatgcatttatctatgtatatatttatcgataaatatgcatttatttatatgtatttatttatcgatcgatggtggtacatgtttggagaatacccatctcaaacttcttctgcgtgaaaattattaatacagaaaatatgaactataaagggagggagaaaaagaaagaaagtgataagaatggcagttttaacgatttgaaacacatgattttcttttatcagagtataatcatctgatatcttcttctgaagatttaattacaataaataaatagaatagtatgatcggatcatatattagataaatagtttaaaataaaatataattaaagtgaagagaagagaatgagaagaaactagccatatacggtctgtggtaatgtcagggtgcccaatttttcttctcttaattgggcatcagagaataagtattttcccaaaaaagatggtagtggttgttggagttctaaattagaaagatcttaactttagcctataaatcaatcactctcaaattacaaattaatttctgacctgtcggatttgaagacattgataattcctgtctttgcttttctttctcttcttcttctctctggttctcttctctttacctcactagatcacgtcggcctttaggtctccaccggcactgccctgagatagccgaacgaaccccttctagtgcttaagccgatcgggggcgaattagggttttagattagatagggcaagaattgagtgtcctctcctcctacaatttgttctcttttatagcattggtgaggcccggagcttatcttgaatttaggaatcaaaaattcttttaaccgatcacaaaacaaccttatctcttatcttcttatttggttcggattgtgtgctcatccgaaaaatcaaccaatagtggcgtctacgagtaacaaaaattcatttggtggcataaaaggaaaatatattttcttttatacatagaaactcaatatcttttaaatggcatataaggtattccctctaaaatagggacaccttatccgttagtacaagcaactaagattggcttgtggttgcttttaattttgctttatagatcttgatattgtacttataccatgtttatcagggtcctgctaatgcgcggatgatcgctgggagtgagcgatcacccacactcccctccgactatgccgattcctccctcttctcccctttctcctccccatcttatcttcctactacagtacaccacaaaatttttttaaaaaaacaaaagttagaaaaaattatggatagaaatgctatatataaaaaaattgaatttaaattcaaattcaaatttgaattcaaattcaaattcaaatttgaatcgggtatgtaaacttttgacttataaactttggatctataaactttaggtgtataaactttagatccatagaaatactatatatagaaaatatttgaattcaaattcaaatttgaatcagatataattcaaattcaaatttgaaacgggtctataaactttaggtctataaattttagatgtatagaaatactatatataaaaagtttttgaattcaaattcaaatttgaatcggatatataaacttttgacttataaacttttgctctctaaactttagatgtataaaccctaggtgtataaactttaggtgcataaatttactaaaataggaaagtaatgcggtgccaaaaaagaaaaccaggtagagcgagggaggggggaatggggcgatcgctagccaatagctagggcgattgatcgcccattagagtttccgtgcttatcatgacttcctaatgtatcttttttatgtgtgaaaactgaaaaaaaaaagaaattcctctctcctcttactttattttatttgtgatttggctctccatttatgtatggaagcaaattagaaattcctctatcctctatatatagctattttgatcccccaattatattgtttatctatctcgtatcatcaactttatattacgaggcatgcattaagctccaacaatggtgatgtccataatgttagcatgccaccaatggcatgcaataagttcccaacaacactgatgtctatagtgttaaatagcatgccacctattgtaaaagataatgtggcatcagattaaatgaatgaaacgatgaaactagatcttgaattgagacccagtttctatataatattaagggtattgatcaaatatttgatgttaaattagcacagtaaattggtgatatgtgtgcaatagaatagtgctatatatagtttctagatgatgtggggcatatagacactatatattaacagtgtcttacagcactgggacggtcgtccttatgggagtcttagtgcttcttcgtctcagttatagagttccttctttttttctcacggttatattaaattgtgtctttcgagctgagtttctgttgtaatacgccgtatttcagttcataacatcttatcgatctgtactctattgatatacacaggaagattggattcaaacttgaagatgaaagggcaaattctggttaacggtcgatgtcagcaacttgcatttggaacctcggtgagttcaagtgagaaaactattggagcatctaattaatacagcccattttgattagtattattgaagagtctgtcacctcctgatggaaaacgtacgaattaccccccgaactatcgcggtcgtccgaattatccccccgaacaacaaaaccggacattcttcactcccaactatacaaaccggacgaattaccgccctcgacccaatccgcggtggttttggtctacgtggcgtacacgtggcagtccagtcagcattttatttttttaatggtgggacccacatgtcagacaccactttctttcttcctctctttctttctctctctttgttggtcagcagcggtgcgcacgccggtggctggcacacatggcgcggcgcgggggcgggctggcggacggcgcgcgggaggtggacgggatgggggagaggcgggcgccggcggccatggcagagaggcgagccatggccggaagcgtcgggaggaggacgggggacggcggacggaggcgcacgtcgggagctggagcggcgtcaggaggaggacggggaggaggaacaagagaggctgaagagagaggcagtggtggcggatgaggaggccgttcccgcgaccg

SEQ ID NO: 31828 - DNA, 1922 bp, Oryza sativa
attgggtcgtggggggtaattcgtccggtttgcatagttaggggtgaagaatgttcggttttgtggttcaggggggtaattcggacgaccgcgatagttcgggggggagagataattcgtactttttccccttctaatccccccatagtcgagaagaagcgaacatgttcactacgataaaaataaattaacatatgattctagccaaatcttttagccgtgtatagatgatgattgcaattttgtctacaataaaaatgttgtgaaatttcacatggtaaaaaattacactattaataacagggatatatatttagctagtgtaatagtataatcaatccaatatgctaccgaacttctttagacttagggggatttacaatcatgacactgcaaacattaactgcaaacattaacgtagctcaaatattaaggatagagccagcgagagagaacgagaaaaactggtgtctgatctaaaaacatgaatgtattgtgaatgcatgaatcaatcaggcgtacgtgacacaagagaacgtgctaatggcgacactaacagtgcgcgaggccatctactactcggcacagatccagctgccagacaccatgactatggcagagaagttgcggcgcgccgatgaaacggtgagggagatgggactcaccggcacgctggacactcggatcggcgggcggtcaagcaagggcatcagcggtgggcaacaaaagcggttgagcatctgccttgacatccttacacgtccccggctgctgttcctcgacgaacccaccagcggcctcgacagcgccgcctccttccatgtcatgagtcgcatcataggcctcgctgccagggagggcatgacagtcgtcgctgtcgtgcaccagccatgcagcgaggtgttcgagctcttccatgtcctttgcctgctcgccgctgggaacaccatcttctttggcccagcttcaatggctgccgaggttagtcgatctagtgtagaatcattctgtgtatatagtcgtttaattagttaaatgttatcgctgttttcagcttgcaatagttggtttaatttgcagttctttgcttcaaatggctacccttgccctccaatgaggaatccatcagatcattttttgaggactgtgaacaaagattttgacaaggttagatatatagttggtccaagactccaattcaagcactattaatgaaatatcatgttcttttggataatgagtaattatttacaaatctgtcctctgcaaacagtatctgcacaatgtcacagcagcccagcaacaaaagagaaaagaacaaaaataaaataaaaaagatgctatgaaagtacgggaatatatcctatgcgcacaaaattttcatgcatactccgtgtacatcatctagcaaatatcacagaaaattccataaaagcatggacacatacttccaataatattacacttatgtgtaaaatcttatcttcaaatttgcatatatgtataatattgttgggatacatgtctaatttttctataattttttcacatttgctcgttgatgcgtacaccatcaaatgtccggcaacaaaactgggtgacaccaatttgcttgcttttgacctgttacctttcaatttgctaacacacaggagagtgaagacagactccggtgcatgccagctgttgcagatgaagcaatagacattttggtgaattcatacaaatcctccaacacttcggaagtcgcaaaacaggacatgcgtcacataaacgagatggtttctgctctaaacttgtgtacatattatatttatatgtacaacatacttattcacaattatacatgtttgggatatatgtcacaagttatgttcatattcttttaggatcgggtgacgattggaagaaaccgagctggt

SEQ ID NO: 31829 - DNA, 21262 bp, Oryza sativa
ttatatgtacaacatacttattcacaattatacatgtttgggatatatgtcacaagttatgttcatattcttttaggatcgggtgacgattggaagaaaccgagctggttttattaccaagacacttgtccttaccagacgttcatttgttaacatgtatagagatattggatactattggttgcggatggccatttatatttccataagtgcttgccttggcaccatattttacaatatgggctatggatccgattcaattcgagtaagtgaagataaaatgttggctgttttcacacaaatggctgatagagtatgcatgtaccaaacatatttattaattaattttaattgattcttcatttcaggctaggtcatcaatgttaatgtttattagcaccatgctaaccttaatggcaattggagggttcccatccttcgtggaggatatgaaggtatttatgaattgatatgtcattagcagaaagagcaaacatgtttactctatataatttgttaaaatcgactgaacacacatatagaccaacgggcataaatagtaaaattaagtcagtgaacttggatacgatgtctggaattgattattcaaattcatactactgtaccaaaagattcaacaaagttatcaacacgaataaaaattttccatcaaggacatgggatagtgctatttaattaagagagagtaatggaaataaattcattttcaatttaggatattaagaaatcatgtgaagcatcgcatagaaaagccttaaataatctctcttatgcatcctaataaaattcacaaatacttgcaatgtcttttgactctggataaaaatatttcaaacccacagctttcatttagtgaattgagttatactcaattaccattactaatatttaaatagccatgtaacactccgtccgcacttacaacatattgtaaacaatcaatatcagcttacaatatagtaaatcagattctagaattagtaaatcatgaaaataatattattgagatccaatggagcacagcttaatattcattaatttcgaatttcaagacaatcagattgtgaaaaataaactaactgagactacataccaactacaactcagtatttattaatttgttattaatatttgtcaattcgtaaattttagattgttaaataaaaactactacaacgcataactccaactgagtacacctacctatattataaactccgaacttaacaaatcgaaacactatttgttggacattctctggccataggtttgatagatgcacacatgattaatgtgggaatttttaccttttctagcttgtaggattaatgcagggcttcttgtgaagcctctacttattatatatataaaaaaacccccaacttatttactaaaaattccagagtgaaaatttaataattttattaaaataatttaaatacttcgcatctgtacaataggttacatttcatgtagataaaaaaaatcgaaatatgcaaggttgatttatcaaatgaatttgcatttgtgcatcacatttttcttaatatgtggtcttatatatctacctttctcttcctgttgctcagatctttagcagggaaaggctaaatggacattatggtgtaaccacatttgtcatctccaatacattgtcatccacaccatatcttcttcttattgccataatacctggtgcaattgcgtattatcttagtggcttacaaaggcaaattgaacattttgtctattttacgttagtactttgttcatgcacaatgctagtggaaggcctgatgatgatcgtagcaaccatcgtaccagatttcctaatggggatcataacaggtgctggtatacaaggtattatgatgctcacaagtggattcttccaacttcctaatagccttccaaacatagtatggaagtacccaatgtactacatctcctttcacaagtatgcactgcaggggttttacaagaatgagttcttaggtttagtactcaaccttgaaggacccataacagttagtggcgagaaagttattgctgagttatttcaagtggaaacaggtcattcaaaatgggtagatcttgcagtactttgtggtatgattatgacctatagactattgtttgtagtgattatcaaggttcttgatatagtcaagcccatacttaaggggatgacatttaggtgcaacactaaatgcattcatggcatagagaacctttgcgccccctcgtgattcttgttggaaaatagtatatctaatattgtaatattgcttggtgcacttatatacagcgagaaaaaaatgtagtattgtatttatattactcaatataagtatgtgactatattgtgaacagattcactactggagaaacgctttttagtcccggttaggaaccccctatagtaccggttttctaaccgggactacgaatccgggactaaaagatgtccagttttagtcccggttgaaataaagagactaaatctttagtcccaattggtgctaccaaccagtactaaagttaattttttcttttttttcttttctggcgccaaatatctccaaatcattagaaaataataaatcacaaatcatagattgggttcgcacatcacagattgttcacacatctcaacatcccaaatcatccacatcaacaactcaatatctcaacatcccaaatcatccacaacaacaaatcacagatcattcacacatcattctcaaatcacagatcaaatcaacaaacaatcattcacataacgagaaggaaaaaagaaaaaaaaatccatgaagcctgccaccacacggccttccgcgccgggccgccgtcgctctgccaccgcctgaccgccgcctccccagcccagcatgggcccgaccgctgccgcccctccccggcacaggcccggccgccaccgcccccacccagcacgggcccggccgccgccgtctgcttctcccgcagatctgaggaagagaagagaggaaaacttaagaagtgtggaagtggaaggggagaggaagagatgagagtgaaagaggaagatgaggaagagataagggagagataaagagtggaggggaggaagagataagggtgaggactctcagatgcgcgcggagagaacgatggaagagagagagagagagagagagagcgcgagacgtgggaaactgatttgtagtcccggttgtttataacaaccgggactaaaaatctgattattagtcccggttgtttataccaactgggattaaaaatagtgggggacctgccacgtcgtgacaatgaataaaccggtacaaaagatgatctttcgtcccgttaccaaccgggattaaagatcattgcacttttaaaccgggactaaaaatgctttttagtcctggttttttaagcaatcgggactaatgttgtttttgggcaaccgaccaaagatggtttttctagtagtgattccttgcacataatgatgctatatcaaaaatatttttgattctacatgatatatgtggagaaaaatatatttattatcttgccaccattttgttgcaacgtgtgcaccgagcctctggtaatctagatctggttctaatagtcgaagcagcaccttgatcatgaatcacaaataaagtaacttctgattttggcggtgataggatctaattcagctagcaagccaattaagattgattgcttagatcaccttctgaaaactaaaaaatagaaccttgacagccgaaattccattttttagtccctacaacaacaaagacacggcaacgacggtgacaatggtactaacctcaccagaacttaaaactctaaacatactaatgctaagaccagcaacatgacacaacggtacaacgcaaaaatcaacaaagcaaaaattaaaaagaacaacgcaacaacgcaaagatggttaggtaatggatgaaaccttttttttgaatggctattttctggttataggaagataaaaacacaccgagcaactaaaactctgataccacttgatattaccctgagctcgaatgtatgtgctcaaagctctgattgactagatctttcggcgagttaagataactacaatttgggagagaagttgtcgactgtcacgcccagaaattcccgaatagaattccaagcagaatgtgcattaaacccctgtctaggaccggctagggtacacaaatgacaaagttgacatgcagattcacgtcttacaaacatataaaagtcttacataaatgcagcacaaaataaaagcgagcttattctagagcttgacatgaacagcgggcgacaccattccacaagcatccttgacggcacggatgaagcctactccttcgagtaacataacctccatctgaagcatactccaactctggggtgggagacagaccaagactgagtactacccactatactcagcaagtcataccggaagagaggtatgatgtagtgtatatataccaagggagctgagggtttatttgcataattctagcatttaaaagtaggtgttgaaagcagtaaaatcgttttaatgaattaagcaatattaatcatcactgcgcaacactacaccacgttgcaacaggcccaaccaaccacttgaactacacaagttccattaggtcaaattattatagatgagactaatcacggtgaatttgattggccacccataacacccgatgagactactgaaacatgaaacaaagctatttttaatggtttctttgcattttcctagatttactgagacttcaatgggcttaaacggagctcggatgaattttctatgaattttagaatattctctctattttattactattaacagatactccttaatgatttattgcgcaataaagaaccctgctgatgtcatcaggagggaagcggagccggccggcgggccccacctgtcggtgcacaagggcgccggtccgcagtggaccgagtccaaggactggggtgcggcgcaccacatggcacacacatgtggcattgacgtggcagccacgtgggcggcagccgaacggccccaatctaccgagcggtagatcggacggctgcagcggcacgggcacagctcgatcctgggccggccagccgtggcgggcagccgcgcacgatgcggtagtggtggcgctaggagggagagggggaagatccgagggttctcaccgaggggttcggccgacgcgaagggagacgacagtagacggcgacggcaagatgagtgggtggacgacgtccggagcggtctaagggagctaatgagaggacttagaggaagagaagaggtgcgaggcgagcggaaatgccgtccgaaggcagcggaaatggaggggctcactggtgtgctgtgaaaggttgttcccggtggcggttgacgacggacaatttgcagacgaggtggccctcgcgctttcgaacccgcggcagcgatgacatggctcggctcggcgcggcggctagtggcagccggagcggtggcgacggcggcgaagatgggggcgacggcattagagtggtgggtgcatgggagcgggggtgacatttataggggcgaggaggtcgggcgtggccaggaacggccccgattttgccggcgtagtgggggaggtggagagagagagagagaggtgggattcgaaaattgaatcctggccatctcgcgggcatgggtgcgtgggggagttgcgcatggggtgcgggaggtgggcgacatgcgcgggaaggtgggggatgtggcgcgaaggcaggggtgagcctgtcggtgccccaagagagagagagtgatgaagggcggacttcgggagggggcgcaggcagcaaggaggattggggcctgcggcccaagaaagaggaaaaagggaggggaaaggaaaaaggaaaaggaaaaaggatttctagggatttctttaataacatagactgattttaattggtttaaattatctccagggctctgaaaaattccgctaaaaatcctattaatgtattttgacatggagaatccaacaaaaatcccaccatgtcgattcccattattaatcgcatttattaattaatgattagctctaggcttgatgaaattcaaagctaaaggaaggaggacttcaggatgtgacaaacctagcccccttaaacggaatctcgaccccgagattcggaaaagctggcaaagaggtgcggatgggcggcgtttaactcgtcttctctttcctaggtgacctcttcctcataatggtggctccactggaccctgcaaacctggtgtccttgtttctggttcttctcacgctggtttcaaggatgcggacttgtttctccacatatgtcaaatcctcttgaatctcgatgtgcttagaactagcctattccttaggtacgctcaaacatttcttcagttgagatacatgaagcacatcgtggatactagccttgctagatgggagctcaagctagtaagcgacttcacctctgcgttccaaaatcctgtatggtcccacaaagcgtggtgccaacttgcctttgggttggaagtggtgcactccccggagtggcgtaactcgaaggtacacatagtcccgggcttcaaagataagctatcttcggctgttgttcgcgtagctcttctgccgagaccgtgaaattcttatcctttccatgaaggttctgacttttttcctctacatcactcaataattcggtcccaaacaattggcgttctcctgtttggtcccaaaatagacggccatttgtaagctggcctgataactattgttgtaggagaactcgctataaggtaggcttttattccaaactccgccaaaatcaagagtgcaagctctcaacatatcctccagtatctgattgaccctctcggtctaaccatcagtctgattgaccctccacaagggtcctgctcaacggctcaccgcgcacacccatcaagcacgacaggggtcttcatcaaggggacccgctatcccctctcctctttatcctggccattgacccattagttgccgtgttggaaaaggccaccgacctcggctatctcacccaactaaatgggagaacaccacgcctacggatgtcactttatgcagaggacgctgcaatgttcgtccggccgacagtcagagacatgagccacttagctcaaatcctacactccttcagggacgtaaccggccttcagacaaatatgaaaaagagccagatcacgcccatccgttgtgttggcatcgacatacaagagatcttacgagtcttccctgcaaacatcactggcttcgcaatgaaatacctgtgtctcccgcttgtggtctccaagctcaagaaagtccacatccagcctctgttggataagtgcaaggccagattggcgccatggcaaggttggatgatgacagcggcaaggagaacaactttaaccaagtccgtcctaagatcgcaaacaatctactatctaatagcttaaaatcccgaacagtatgctccattcaattgataagatgaggaggaaattcctatgagtgggaggagaggatatctcagttgggaaatgcaaagttagttggccccccaacaaagttagtcggtgtgctagacctggactggttcacccgagcgctaaggttaaggtggttgtagtatgagtggacggaaccgaacaagccttggaatggcactgcactctcctgcgactagatagacaaagacctcttcgcaacggcgacgacaatccttttacgggatgggtagacggccagcttttgggattcgcattggcttgagaataagaagcccaaggatatcactccagctatcttcgcagcctccaaacgcaaaacaaggacagtgcatgatgcccttgacctcaacacatggatccgggatattgatctgctgcgtataactgaggcggatcatctgtgccagtacatctgcctatggacattgatacaacgtgccgcccccctaattgatcagaaggattcaatcgtctggaagctgacagcaaattgaacctactcttctaactcagcgtatagactgcaattccatggagcagcaggaacgatctatatccagaccatttggaaatgttgggccttgcctaaatgcaaattcttcttctggctagtcatccaaaacatagtatggatggcagataggttgcaaaagagagggtgggctaatcaacatttttgccccctctgtcgcaccgtgccagaatcggctctacaccttctagcaaattgcagattatccagaaggatttgggctgaactacaaaggtggacagggttagaccttcggttgcaagattgggatgggtgcgcaacggtagaagaatggtggtattaaatctcacgcacggtgaactgcccaacaaaggcccttaagttgatgatcatcttgatttcctgggagctgtgatgcgaacaaaatgccaggatcttcaggcatgcggcctcaactcccgccaccatcatcgccaagattaaagaggaggcacggacctagatcacaacgggagcagcaaaaatcattgagttaatctctgcaggagagtagtgcctttctgttttatttttttgggtccgattttcagtctcggaccctgttaatacttagttggttttttctccttctctatcaatataaaagtggcaaagcttttgcccttccttcactaaaaaaataaagaacttcatagtggaaccaaaggattagtttggtagttggcatgttgtgtgtatttgagcacaccaaccattaaccccccccccccggttggcttagctcttgctattcgatcctacaagtggtatcagagccttgttttgttctttggattttaaccgatctagagttttagccatggcaaacaagtttactactaagcctcatgtttttgatggttcggattttgcttattggtgtgataagatgcaatcttacattatggctgaggattatgatgtttggcaaaaagtttcacagccacatgttattcctgaacagattgacactattgctttgaaaactgagtttaataataattgcagagctcgcaatattcttttgagtggaatttctcgttcggattttgatcgagtttcgcaacataaaactgccaatgaaatttggaatgctttgaaaaacattcatcaaagaactactaacattaaagaactttgtcgagatcttttgaaaaaggaatacataaaatttgagatgaaacctggagaagctttggatgattatcttggtagatttaataagattttgagtgatcttcgatctgttgattctgcttatgatgttaattacacataatctgaggtttctcgtcactttttgaatggtcttgatatgtctatttgggagatgaaagttacatcacttcaggaatctgttgacatgtctactttgactttggattcactttacacaaagatcaaaacacatcagatgaatattctttctcgtaaagttgattctaagtctagtgctttggtttcttccgcgacttctttggatgttggtgcttcttcatcaaattctactgttcttgctttgattcattccatgtccgatgagcaactcaaacagttcgaggaggacttggctttggccgctaacaagatttctcgagctatgaataatgttaggtacaggaaaaaaggtggtccaactcatcgctttgaatgtggtgctcttgatcacattcgttctgcattgtccgaagcttgggagaggcaagaaggaagacaatggtggagagaagaccaaggacaacaaccccaagagcacgttcaaggggaagaagactaaggagaatctcaagaagatgtttgatcaagttttgttgatgcgaaaaacacacactggcctggaagatctgcttaacttcagtgcaggtccaaaatcttgcctttaggttcgtgagcatgccagttgatttgatcctgcaatcaacaagaaacaaaacaaaagaaaccacggttaaatccataaacgatagccgatcggccagcagccgatgacatatcatttattcttgagccgatgtcatatgtgaatcgatcggcagttacaaataagcaaggtaagactaaatctactcgatcgagtacatatattaacgctatacaatctttctgtcgatgtatatttaaatcaagtgattgggatagatcagtcgccatgccgagacagtacaaaccacttaggtcgaaatatacattaacatgaagattataaacgcttatatcatagccgatcagatagatctagcatgtatcggctaatactccgataccactctacattaagatattaaaacagatatactatatcaaacaaaagcctaatataatttattgtgataagatcttaacgcaaagggcagacttagcatatcaattaaacatataaaacataaagctaaatcaggtaagatcagctgaaaccccgatactatctctcttgataatcataaaacaagctagatatcacaattataaataacacataatagatcgaactcaaccgatacagcattaagcataaaggcaagtatgaaatctagacaagatgatgagaatctacaggagatgatagatacatgatacaatctagattaataacaaaatataactctactgattgtttcctaacaaccagaaccagccgataacaagttatataatgcaactagcatagattgaaacatgtatatgataactcgacggattacttagacagggttcaagtatcataaagatggaagtattaaccccgataacgcaagccgccataacaagttttacctctagttgaagatcgaatcgatgcagctcaactcgaaagcaagaactcgtcgaaaaaaacgaaagtaaaagggtggcgatgcgccgagattgtattgaacgaatgttaattgattacatgggctcgggtcatatttatacctgagatacaagatatgtccttaccggacacgacgcttatctctaacaaactctaagataccataagtctttgcggcagactcttgcccaaacatatctctaaggaaattacataaaatatcctaattaatatatacaattgcctatccgagagccctatctccatcgcggcaatcttcgtgaagcatcttgattgattctagaaacatctttgaaaccgccattatcagaatcggctgcatcaccttcatcggctgtatcaatcatcctctgtccgatccatctcagccgatgcagactccagctgatgccttcgcaaccgatgcatactctgtttttcgaatcaatctctttatcgaatccaccttgatcccaatgtcgaacccggattatgacttaccatatttggttgtcaacaagtctatgctgcttttgagccactaaccaatgtagatggtgagagtgaagatgaagataagggaaagaacatctccggtgtttgcttcatggcacgtggtgaatcgaattcagagtgtgaagacaatgatgtgagttcttttgaggaagctattcttattttaagtacaaaaaataagaaatgtgagaagatgtatagaaaacaggaatatattattaaatctcttaattctcaaattattagattaaaatctcttattcgtaatgatgaagactgcaaaaattgtgaagttttaatacatgaaattgaaaaaaaaaattagaggtgtcaatgttgcacatcatttgaaaaaagaccttctctttctcttggatttctcttgcacacacacactttggatgagttgtttttgactaaaaagttgttataaaaatatcaaattgtttttcatgctagtttggtatttaacatgatttgtgccaaaaagttaaaacaacaacatggtgttttggattgctcaacatgtacaccaaacaagatgaagctaaaagatgcattaggtcatgttgagtacatggaggaaattgtgaaaatcaatgaagtgctttcttcccccaaatgtcgtaaaagcaaaggtgtcatggtagattgtgaaaattgagttaatttgcaaaaagagatttcttatttgaaaagttatttggaaagattttctgatggtaagaaacaacttaacatgattttggatcaatctaaagtgactagttacaatatgggtgttggttttgatgttcatgactatttcaccaaaaatcaacctaatgttttgagtgtgactgaacatggtgaaattttgacaaaactaagttctaagaaaataatttttaagtctactggaattatgccctctctttctacaacactaaaagaaacaaaaacaaatctttcaaaaccatcttcttctaaagaaaagtatacttgttctttttgtggtaaagatgaacatcttgttggttttgtttcagattagctcataaacagaaaaaggagagagaaattgcagttgcaaaattaaagtggcaaaaatctggttttccctcatggaaaccggtcagaccgcagtgggtcccgcggttagaccggtgaccggtcaaactggctactgagcggtggtcagaccggcggtacagaggcggtcagaccagcagtaccccatcggtcagaccagcttcggagagatttttctaaaaattctcaaactatttttgcatgtggatgtatgcctatttgatctactggttgtgtgtctcagtattggattcctaaatttcttttatctaaccctagtactgaggctttgacgtcttcttgtgtgtaggctttggtggcaaggaaggagaacgtgtggatcgtggattccggttgttcgtggcacatgaccggtgataaaaattggttctcctccctcaaacaggcatccaagactgaatcgattatctttggtgatgcttctactagtgccattcttgttacaggtttttgttaaggtaaatgacaagttcgaattgaaaaatgtagctttggttgaggacttaaagtataatttgcttttagtttcacaaattgttgatgaaaattttgaggttcactttaagaaaactgaagtaaagtatttgattcttgtggtgattttgtgctgaatatttctcgctatggaagagtgtttaaagctgattttgaaaatcttgtttcacctgtgaaaacatgtttggttgctaagtttaaaaaggatgtgatgaattggcatcgtggacttggacatgctgattttgatcatcttacgaggttaagtggtttggatcttgtttgtggttgggctaaacttaagaaagatcttgatttgatttgtacaccatgtcgtcatgctaagatagttgtttcttcacatgctcctattgattctatgatgacgcatgcaccggaacagctattacatatggacactgttggtccagctagagtgcaatccgttggaggaaagttgtatgtgttggttattgttgacgatttttctcgatattcttgggttttcttcatggcaactaaggatgagacttttcaatattttcatgatttgtatcttcgattggatcttgaatttcctggttctttgaaaagaattcgaagtgataatggtggtgggtttaagaatgcttcatttgaacaattttgcaacgaaaaaggtcttgaacatgatttttcttctcctcgtgttccgcaacaaaacggtgttgttgaaagaaagaatcgatctttggttgagatggctagaacgatcttggatgagtatcatactcctagaaaattttgggctgaggcggttaacacttcttgaggtcaaaacttggaaaaacttatgaacttcgatttggacgtcaacctaaagtttcacatttgcgtatttttggttgcaagtgctttgtcttgaaatctagaaatttggataagtttgaggcacgctctaccgatggaatgtttcttgggtacgctgcacattcacgtggctatcgtgtacttgttttggaaactaacaaaatagttgagacttgcttttgatgaggctagtccaggtactataccagaaattgtaggtacattgtcacaggttcaggggaggatggtcgtatttttaaagacgagagcgacgactttgacaatgaggttggctcggccggtcagattgggcgccaggcggtcagaccgctagcacacgtccagtcagaccggcgtaggatgtgcggtcagaccggccaggttcgtcgggttctggttttgttgatattgatcgtgatggtcctccagaggctacaacttcgactagtactggtacagaacatgaaacaacttcagaagtcgttgctcctttgcatattcaacgacgacatccgctggaacaaattattagaaattttggtgagcggactacaaggtctaaggactcatgatgtttttgcaaattttgcgtttgttgctacttttgaacccaaagatgttactcatgcattaactgatgaatcatggattaacgtcatgcatgaagaacttaaaaattttaagagaaataaagtttgaattttagttgaaccaccctgtggatataatattattggaaccaaatgggttttcaaaaataaacaaaatgagaatggtttaattatgagaaataaagctagacttgttgctcaaggttttactctggtggagggttttgattttgatgaaacttttgctcatgttgctagaattgaggcaattagatttttgttagcttttactgcttcaaaaggttttaaattgtatcaaatggatgtgaaaagtgcttttcgaaatggttttatacaagaagaggtttatgtcaaacaaccaccaggttttgaaaatcctgattttcccaaccatgtttttaaattgtctaaagctttgtaaggcttgaaacaagcacctagagcatggtatgataggcttaagaactttttgcttgcaaaaagttttcaaatgggaaaggttgacaaaatgctttttgttcttaagcatggtgataatcaacttttcgctcagatttatgtagatgatatcatcttaggttgttcaactcacgctttggttgtggagtttgctgagactatgcgcaaggaatttgagatgaacatgatgggtgagttatcgtactttttgggaatgtaaattaaggaaacacctcaaggtacatttgtgcatcaaacgaaatacacaaaggatcttttgagatttttcaagatggagaattgcaagccaatttcaacaccaattggttctacagctgtgttggatcctaatgaagatggtgaagctgttgatcagaaggagtatagaggtatgattggatctttgttgcatctaattgcttctaggctagacatacaatttgttaagtgtttatgtgcacgctttcaagcttctcctcatgcttcacatcgtcaagcagtcaagcggataatgaggtatttgaatcatatacttgagtttggaatttgatattctacttcatcttctatatgcttgagtggatattccgacgctgattttgctggttgtagaattgataggaaaagtagtagtggaacatgttattttcttgttacatcattgattgcatggtcttctagaaaacaatctactgttgctcaatcaatgctgagtctgaatatgttgctgctgctagttgttgttctcgatcagattctttgacttatatcaactttgaaagattatggtcttacttttgagaaagtacctcttttttgtgataatactagtgctactaacattgctaagaatcatgtacaacactcatgcacaaagcacattgatattcactttcactttttgagggatcatgttgagaaaggagatgttgaattgacgtttttggacacaaagttgcaacttgctgatattttcactaaaccattggattcttctcgctttgcttttcttcgtggagaattgggaataattcattcttttggcatggtttgagggggagttttgtacatcatggttttatcaatcaaaatttgacaataagaaatattgagaacaaagagctttgctttatacatatggtattttcttgtgcatgctagcaatactatgaaggtttatttgtgtctagcatagcttgtatgtattttagtctttttataaggcctagatattgtttttaagggagatgatgcatgacacttaaattctataacttgaattaagaaaatatgcaatattgatgctagcatatggtttgatttataaatgcttatatatgtgctttattgaattgttattcctcaaatagctttgtaatgtctcattgtgcaagcgaataaaattatctatgagagaaaaaatgaatacgaatccttagaaacagtcttgacgacaaggacgtattcgatgtgagcaaaaataatgggtgccgaatccttggaaacagtcttgatgacaaggacgtacccggaataattgagagaaaaatatgagcaaaaatgctaaaataaaagttataaattctcttggttgttttgtgctagagctaatttaagaaagagtgataattgcaataggtatatatgtgtagtgtttatttttcaacctatgtgcttctaaagatgttgcattataaatcgtatgaaatcatgaattttgattgttgatttgaacttagttgtaaaatctttggttcatgattatactttaatgcatgcttgctatattatggatgggttcatcttctttttattgcaacacatgacttgatatgctatatgtatgctaagctcttgaacataaatgaacataattcttatgcttcatgaaatcattgtcaaaagggggagaagagaagagattgtgcatgtttttcaagtcaagggataatttctttgttttcaaaagtgagagaagttttcttttgaattttgagcatggagtacacagtgtgttttttgctttttaccacttttgtttttatttttccaaacaacaaaacatatttgatgggtttgccaatgtgttcatcaagggaaagattgtaaaatcaaagtgtttttcattcttattctgtgatgaacaatcgacatatgtgattattggttttgatatttggagattattggcgaagtagttttggagatgattggatttgctggtgatctgcaggtgttgctgattgtcgggtccggtcagacaggccaatggttgccggtcagaccggtgtgtattgtgcggtcagaccggtcagcccgcgttctgaccggccgactctgtgtccatttcgattttgggttgcttgtttggatattgttggaggtataccaagaacttgggcaacaggcccagaccggaggcaagcggcgaaggtcgaggagaaaaccatatgggcgaaagccacaaggcgaaagccgtggcttggaatgtgccaacttcaccaagcgaagaccttgtcagagggccgcgcgagcgaagatgatgaggcgaaagcctcggcacaaaggcacgggtttcgccaaagtaccgaacctcaccgtcaggaggcccagcgggctacttacgccttcgggggatttcggcaaatagatgggccaagccatttaagcccaataggggcccatacatgtaaaggacacagtgtgccctcaataatgtccctatcataaaggtaaccatgtaaattcacttgtaaagtctaaatcctaatagggggaacctgtaatagggctataaatagccccctagggccagataatagggtgatccaaaaatttttcactaagcaatactattgtctttcttttccaactatcaatggatgtttcatgtttatggcttctagatggatactatgcgtatactatttttcactaagcagtactattgttgagagaaccacgcctttcgacgtgaagcggttgtctatttgacaacagatatccatagatgattcatgtttatggcttctagatggatactatgcgtatgtaatactgttgtttgctaacaatgagtcaagttggagatagcttgatctcggaatatggtttctttgtttgattcatgtgtaggtgtcttgatgcctcgggagagtactgccggtgatggatcgagagtcgacttggagataaggcgatatccggacggtcatatatcatacgagatacttaggctaaagatcaatgcacgtggttggtgaagattccatatggcatacgatggagatattgtgtgcgtatgggatgcgaagtcgaatttggaaggagtccaaatttggtatgattggagtttgtaaagttggtttcttgtacagaaaggtttcctaggaggattaggacttcttgtatgagtttggttcatggttttaggctgcctacctcatttataaatagagagggagggtgtggcctcccggtatcgcttttgagagcattgagttgagggttgagtttgggtttcgagtttagtcgagattttcgtgaggagtgctgttgttgcactttgtaaacacagagataagtaataaagttgtcatctacatcaagagttcttcgatttgtgtttgcttgggtttggcggtctaaccgacgagacactggcggtcagaccgatggcatcgcggtggtcagaccggcggagtagcagcggtcagactggcggcggcttcaggcgacgacagctgatctcggcggtcagaccaaagatacaatatcggtcagaccgatggctttcaggcggtcagaccggtgcaactacttcggtcagaccgcgatccgtcgaaattgagggtaacttttatttccggtaaaagttttggtttttgggtacaccaaccattcacccccctctggttggctaagttcttgctattcgatcctacaattttaagcaattacacttatagaaacttagtctaagatggccggaccgatgaatacaatgcgcgcaacacagttttcactgaccagtaggcattttctctatagtgtatgtttccagactcagtattattaatgaatcattcagacttattatattaagtgatttggtacaattcagatatgttctcagactagctgggaaatgttatcagtaatcagttggatatgtattatttatcgattatcgctgctgcatataacaaaatatttccaacaaattacataactttcacgcaattgagaactatgaacaattcactatcgtgtttcatctacaaaaaagttacaatttagctgagccttcctatttttctatgagtacacacttggacatttgcacatctgaaataggtgggaagctagtgaaatatcatcttcactttataatttgccttcctagcagttctgttcgcttgaatgggaagatcacttggtgggggaagcatgaatgtactccagttccgtaaaataaccagtctgcaggaacatgtcaaaatcattgatattttaaattaggggatgacttattgctctaatgatatccactgaacaaataagctggaaaacatgcatgataatttcatgcagatcatcttttttacgtagagggacgctagctattcaggatctaaaagttctatgttacttggcagctcaagttacattaataaaaacaaaacaagacttaaagaaacctaataagtatatgtgtgtgaaaaatatgagagctttcagcggtgtgttttgaaaaatattaatatatcatactgacatcaattttgccacaattgcacttctagtagcaacatgggtggtaatcatattattgtatcacctccaattactgaaaggtgctattttggagatacgtctagtttaaatttcaaaatttaagcatcaggaacttttaaaagtattgagatcagatgtatgaaaattatattggttgatttgtcttttgaaactaaatcataatattatagtttatttgttttacaaataagagtttgtggtgaaaactatacttcaggcagtaccattgtacaaaatggctcgttttcatgcacagagggatttatatttttttcttttcttagttttttgttttttagaattgtaagtactagtttatactacatgttttaggttttagcacctctgcagggccactgttctttactaagatataaattggccctgccctgcttttggttgatacggtataaggatcagagtaagtctatgtactgtactgattgcaatgtaatataagtggataaagattaaaagaaaaactcaaaacccaatttcctgttgctttggatgcatgcataccacacagggtaaaagttaactcactttgcagaatcacatgaaataaatactttttcgtaaaggatcagattacctttttcagaaagaaataagtctcaactttcctatccatgtttacagcatccaagtcctatgtcagatatacaacctcaagtgtaatgtatgtgctctaatatattatgcagctttgaaggccttcttcgaaataaaggttctaaacggaaagaagaaccaccattttttaacttcttagcgtcatacatttcattccatgcttgaactatctcgtcaatcttgaagctcaatcctgcagaacaaagaaaatgtatcagctatccatgtaccaaccttatagctagttacagaatgttaatctgaaactcacatgtttgttttactaattgtatgatataacctgactacaaattgtccaagaagtcccagtttctcaaccataaatagtttatcaggttatgctagtgaaccctgatatctaacaatgcaatgttgtaccgcgtggtttgcacacatagttcaccttatgttattgaaattgattgttcttggctagaggtaaactacaattgttcttggctagaggtaaactacaacctggatagataaatcttatgcatttgtgtctcagtaatggattcttgatagattacattagccttgtaaccctgctcggtaagtcttccacctgtgaagaatccaattgcagggaaatcaggtggaaacaactttgcttcttctttttttcgcagggctggcgaaagccagccgaagtttattaagaagagggggaaacaaagtatacaaaggttacagagaactttgcttcttcactcattcacatttttacttactcataaactgctgcagtcgtagaagcccagtgtttgtaacaacttgtaatttta

SEQ ID NO: 31830 - DNA, 6514 bp, Oryza sativa
tcactagctattccaaaacaaaaccgtgtagtatcgacccaaagtaacattttaccaaaagttaggtcagaaaacttgcaaaacaaaagtagcaatgttaactgaacatttcacgaactaattattgcaatgtacaggaaaatttgcttacatagacaagatgtttgggagtagatgatttagcaggatttcaataaataaatattgagtaacgcgtaccttcctgcgttttctcatttgcacagtggttctttatcatcacactgatgtcaggcagagatgctcccccagtcttaaatttttcgattgcttcagtaagactttcctcccagctggataatcctaacttgaattccactaccgaacgctcatagagaatggtaccccatgaaatgttcagctgtgatctcatatttgaagcttgctcaaacgcttcatctgctgagaactcctttaaatgtccattcaaacccaatttatccagtaaaactttctcctttttggatttagatagtccttttacacgcagatattctattccttcccacatttcgatccccttttccatattgtcctcagcatggttgaatagttcaaggacttcggttcccattcctatcttgcatgcatctgcgtaacgccatgaaagctttgcttgctcaaactgttgctgtccgagtgcaatgagaccttcataaaagtctggttttacgtccactgcctcctcaaactttttcccagctttgacatactcagcgcatgcccattcatatgcatttttgacctgcagaagtattgattcctgtgaagcatcatcagataaaagtaatcgcttctttgcacgagacatgtggacgttgccccaattgaacaatgctaaagctgccatttcctgaaattttgcctccgcggattgaaatatctcctgggcttcttcacttgtgatggtttcttccatggcttcatagtacagcctcataccgaggtcacgtagatccacatatgcatcagaatcaaaaccaacatgatacttgaatagacgggcaaattgtaccatccagtcatctgtataagaattcttttcaccgccatgcctagaacttccacattcagacatggaattgtgatttctttctaacttactgtaggaggtagtgggcatgacaagatccctagtgatctcacgatcaggacttacctcctttatatacaatcggacaggctttagtggatctagttcctcaacccatcgcagttcttcagttgaggtaattgtcaccaagtcaccctctttgtccataaatttaagaaggattgacttcaagtgaggagtgtacttatagcgagctatgtccatcagctgcatcagagttatatgttctggaattacaacgatccgtatgtcatctccacaaacaaacttcacgctcttcattgccctcttgttaacatctttgtgattcttatgcttgtctctaccatggattgttggcttgagcgtggatcgcttttcctgcttatcctcaccacgaccaatatgcctgtctagaaaatgcttttctcggctgccgttggcatacctttcaaacttgtccgtgtgcttttcttgcatgccgagactattggtttgtatctgatcaatatgcttttggcgtttgtccacaccactacagaatggatgggtttcctgcccatgactgcctctaacatgtatctctttaagatgcttctgatgcttctctttaccatgcttcaggttgacacacatctcttccatattcagtgaagaatgctgcagtactgtcttcccatcgttgctggctcctcgactgcactgcccttgcttcggcctggtctcctctctgtacttctcttcgctgctccggttttgttttatgtgcatctgctcagtgtcgttttcttcgggtcttgcatcattctgcacatggttgttcccattgcatttctcttcctcggcagcctcatcatcctcttgcatatcctcttcatgaatcatttcccacacctcttcctcaactatggagtttctgaatttgcgggataccttcctcttgatcttatcttttgctaaaatagccttaggctcctcagccacaggcgaaacaatctgtttctccagcaaaacgtctttctcctccatcagctccttgatactctctgatagctccaatgcagttacattgcttggttctaagctcagcaccttctgtacatccttgcaagcgagatccagcttatccagtgcttcgaaacaccgtgctcttttcagtaatgctttcgtatactttggtgatgcctccaatgccagattacactcctcaattgcatgatcaaggtcctcaggattcatgtgcatgtagcaagcagcagcgttgcagtggagaaaggcgatatcattgtgttcctttggaaggagctttatcgcctcgccaaatttgatggctgcctcctcatagtcccttctctggaatagcctcgtcccctcatccttcaattcaatagcttgtcctatgatcaggactgcatcatcattactgacctctgggaggggattagtctcttcaatgttgttgggttggctgttcctcgagctgctttcaccatcatttgctcctaattcacttgtttcattccctcttggtgtagtagtactctccatgctacaagcctttcaatctcccacacaaaagaattgactcagatgatgatccgataatttcttttggagcaccacctctcctcctcttgctgaaaatcaagaaaccgcggaatctcccgctcttctttccgattaaatttgcaattggaacaagaagaaaaatcaattgatatggatgggaaagagagattgggcagcacgattcgctcctccctctttcccatgcaaatggaaaccttaccctatcctggcaatcccatcgagaatgcacgaaatatagttatacaagaaatcaagctggtaattggtgtcctaaaatttgatcagaatggaaatggaaggaaagaaggaaaggagcaaatgggaaagcaaagcacaaggaagcatactacaacgaaggagagcggacgtaggatgggatgctagcgaagggaagccacacactttttgggtgccacctagcagtggccatccatgtttgctttttttggtatgtctctaactgccattaagttcagctggttttaaatccttgtgtttggaacttggcgcaacttttgcttctctggttagcacattggagaaagaaggggctgtctgcgcatgcaaactatgtttcctaattttaggaccggttcaaaatagattatctaaaattagtttcctttaatatacacttgttagttgtcacaaataaagtagaaatttatcacaaaattcctcgttgtggccaatctaagttagaatgccatgatgtggttggtccaaccatgctaaaaaacgagctgctcaaaacccaaaacacaagctgacctctaaccaaatcctctagtggtcaggtcacgacatagcgtcggacacttcaccctcaaacactgtttttccgccattgcctatatttagcgtaatctagccaattatctctaatgtattgggccatcaatatattccaattcaggcccatttgggccaaatattcatgtgtggtgggattagtgccaatatgacaatttagataggtttgggccatcttataaacccctgcattccaaccataattctccgagttaactcttttacactaagcaagaacgaaatgatgatgacaaattaacccttttacataaggctcatacataagtagtgtgggatgcccgaccacacaggcgccccaaaaatttggggcctaaaattttaggggtcaatccaatttcatgtgttctcgtatgtttcaagatattcttatcctatttatgtaagcttcacatcccctcccgtaatctctacaaccgattttagggtcaaaaatctggccttctattgagccacgtggcacaataaaaattttagtaagacatctccagaaaactaccacgtgtccatgaagaggagctaagagtctgcttcgttggaagttgtctcctgtacacatacatgatacacctatcagaaatctctagaaaactcgaagactctccgacggagagattacctggtcgttggagaagatgaagaggtaacactcccgtgcacatcatggtaaataagtgtgtacagttcatggcacaaattctatagatttgcaacttttcatatggtaccacgaaaaaatgacgagtattgtggctcctttaaacaacatttagaacacctttaaataatgtgatttgctacactaaattttaacttaaaaattgattgaaatttttattcgaatgtaccttctttttgtttcaaaaaattgaactagattcttataaaactttgcaaaatttatattaactttgtatttaacataatgtcattttaataatcaacacagactccattatacatattttatcattgttttcccaaactacatatctatacaaattaaaatacaactaagttttcatcaaaaatctatcgatatgatatttacaatttaatagcttatgatatggaaatttgaggatgtcgtctttttgcaacaaacataatgcttcttaataacacgaaaacgaatgcaagggctataaaaacaagcgtcggcacgcttgttttctagtgatctagctagaacgagcttagttttcttgccttccataagtcctcgattgtaattataaccatctcaataccatgactcatgacgacgacgtgcgcacatattctaggtaatgaggatttcatttttatacttcataaagagaatatagtcatcaggatgtaatgatttcctaagtttaaaaaaccattgccgttgatggttggtaagctttctcggtcatccatgtgtctatatattatgttctatatattatataaataacttgtcattagacgtgtactattcttttttaagagtgggcacattagatctaccgatagttcttctacactgatagaaaagatcaccagcaacgacatgaatgagcaaagcatagcggcagtggatacctatacaataaattgtaaatatgtggcattaagtgaaagtggctacatccattgtgtatttgcaactttagtctatatacatagtacaaagtaaaatcaactcttttgattaataatacaaacaaacgagcgcgaacaagtcaacttttccatgaccaaagctatggtaacaagtaaataagcatcatttcctatatatattttttaatagaagacggcaagagaattgccggttatattaggaggaaaaataaagttttacatcgggggtacatagaaacaaaaacaaatgggtacactgcttgacatcgcgtgtataataaaataggaattaaggtggtttaaaagcaaaatctctgtctctgatgtcctccaggatggcagagatggtatgggctatgtttggtgattggtccctgaaaatcctcgcgtttctcatgagccaaatatgccaccaggttggtacaagcgctccaagtctttgccttgcctgtactttcgatgatgaagatttgatgttcagcacgtaatcctagatgttttccagagtagagaaggcagggatttgcttttgtcgagagacttcttgccatatttgctttgttactttgcattgtctgaagaggtgatcagtgtcctcaaaagcctctgtgcagagctggcaaatccaattgcatggccaatgtctgattagtaagttctcagccgttaaagtcttctggtgtaggattagccaacccaggaatctctgttttgactgcgcctcagctgtccatatcattttaaatgatttgtttctctcagttccaaagaattgggcatggtaggcacttcttgcagagtagaggccatctgtagtttgtgtccattcaatcttgtcttcagtattcactaatagctcaacatggtgtagtaagcttcctagttgtaccagctcatgaaggacttcaacgtctgttatttgtctgaatgaagcaagccagacattgtttgtaaattcagttttgacatgcctgtttttcctgattgccacctttttagacgcaacctgattgccaccttgaaaaggtttggtgagatgtcttttggacacaggccttcgatccagttgtctttctaggaaagagtcttctccccattacctagggtgatctttgtgcaggcatgaaagagctgtacatcagccttgttgtagggcaaatccaatttttcccaaggcttagaaggatcagtccatctcagccaaagccatgtgagcctccaagctgaagaaaatttttgaagataatgaattccaaggcctccaaggattgataaattttcgatgataaagaattccaagcttgccccaggcttaatgttttctggcttatcccctttccataagaaggc

SEQ ID NO: 31831 - DNA, 6140 bp, Oryza sativa
ccacctacactatcccagaaccaccacacgttctccctccaacgctcagttgatcggatagggttttgggattttcgaggagaagaaggtcgtggagagatcgtcacctaaccacgaaaccagcctcccctattagtatagcgctgagggagatcgggggcaatccaaattatggaaggatttggcgctaccgatcaatgcgtgtaatcacgtagttatggaaattgaattgcgttaatcccggttggaaaatggcgtctgagattttggcaacgggtggaaaaccgccgtccgagatttcttctcgatttccatgccaagagatattctttcctaacattctccccccgatcttgaggcaaatgagtttattcttagaaaaatagatttactaaggcaacgcgtcagggtagttatcatatcctaccaagactccggtacctatagttcactatatagttcactatatcttaatgggaattagttaggactaatgcccctatttccaggatcttagtcttaatcaaaggcaatcagttattcccatgccggctacatgatttttaaataaattgggaggtaagcctttggtgagtggatccgcgagcattgacttagtgctaatatgctcaatcttaatggtttgatcctggattctatctttcacaacatgatacttaatgtcgatgtgtttggcagcaccactcgacttgttgttacttgaatagaatactgcagctttattatcgcagtataatgtaattggtctagaaatgctgtcgaccactcttaaacccgggataaaattcttaagccatatggcctgccccgttgcttcataacatgccacaaattcagcatgcattatcgacgatgcagtcaaagtttgtttagaccttttccatgaaattgctccctttgcaagagtgaagagatatcctgatgtagatttcttagtgtctacacatcccgcaaagtctgcgtctgaataacctaggacttcaagttcttcagatttattatatgtgagcatgtaatccttagtgccttgcaaataacgcaagacctttttaacaaacttccagtggtctaaaccaggattggactaaaatctgccaagcatcccgataacaaatgctaagtctggacgcgtatagacttgagcatacattaggcttccgacagctgaagcgtatggtaccattttcatttgatctgattctaatttatttttcgagctttgaaatatccgaatttatcgcccttaactattggagcaggtgttgcagagcacttactcatattatatctttctagtactctgttaatgtatgatttctgagataatcccagtactcctttagacctatctcggtgtatttcaatgcctaaaacataagatgcctcaccgagatccttcatatcaaaattagatgacaaaaattctttagtctgatgcaacatagtaatgtcactgcttgctaacagtatgtcatccacatagagtactagtattataaattttacacccttagtcttaatgtaaattcaattatccacctcattctccttaaatccaaatctcttaattatttcatcgaatttaaggtaccattgccttgacgcttgtttaagtccatagatagatttcttaagtttgcaagccaaatggtccttgccttccataacaaaaccctcgggttgtgccatgtatacatcctcatgcaagtcaccattaagaaatgcagtctttacatccatctgatggagctctaaatcataatgagcaacaagcgccatgacaattctaaatgagtctttcttagagacgggagaaaaaatttcattgtaatctatttcctctctttgtgaaaaaccctttgctacaagccttgccttgaaccttttgattttccctttggagtcaagcttagttttgtagacccacttacagcctgctgttttggctcctttaggaatttctactaagtcccagactccattatgactcatagattttaattcatctttcatggcttcaagccatttggataaatgttcactcattattgcttctttaaatgaggtgggatcatctacattcccaatatcttcacctaaataaacctcataataatttagaatggcagatctcctctcccgttgtaatattgtaagtggttcactttcgatcactagcggttgagaaggttcttcgagaatttcttcattttgtgccccagaagtctgttgagtgtcattatttaattcattattattttcaacatagtcggtatcaccagaattttcatctggtgctactacggtctgagtcacaggtacaacacgaggtaccaaatttattggaatattattctcttggatttccggtgtaacgttagcccgaatttcctcaagattaatttccctttcctgtgagctccccagacttcattattttctaagaatacgacatgtctagtttccacaaatttagagacacggtctgggcaataaaatcggtaccctttagatgtctcagggtatccgataaaatggcagcatacagtcttgggatctaatttctttagttgtggattaaatattcttgcctcagcatgatagccccacacatgcaaataattgaatgtcggttttcttccagtccataattcataaggtgttttgggtaccgacttacttggaactcgactgagtatgtgtgcagctgttttaagtgcctctatccataaattcacacacaaagtagaatgactaagcatactccataccatgtccataagtgtacggttgcgacgctcagccactccattttgttgtggttctccaggcatggaatattgggcaattattccatgtatctgaagttattgggcaaatggaccaggactttgcccataaggagtatgtctcccataatattctcctcctcaatctgatctcactaccttaatttttgcatcatgctgattttcaacctcagctttgaatattttaaacttatcgagtgatttagatctatctttaatggggaaaacatatccataacgggagaaatcatctgtgaaggtaattaatgaatcatatccatcaacatatgttactaggaacagtccacatatatccgtgtggattatttctaatggacacgtgctcctagtagttcctttcttaattttcttagtgaattttcccttaatacaatctaagcaatgatccgcattcgaaaaatctaagggttgaagtatctcttccttaatgagacgctccattctccacttagaaatgtggcctaaacgacagtgccacaatttcgaagacgtctcattatcattacaggcattcaatatattcataatatgatcatccaaagagagcaaatagagcttgtcttgcacgctaacaagaccaatatcaatattattatacttaataaagcatttgtccttagaaaaattacaatcataaccactgtttgttaaaaccattacagaaatagcttcctcttaacagagggagcataaagaacatcatgaagtaaaagattattaccacttggaagtcgatgatgaagctccccaatggccatcactttaatttcagctccatcagccactcttaggatccactccccctttcttagcgtcctcacggaacggaatccctgtaatgagttcgcaacgtgcacagtggcacctgagtcaatccaccatgatttatgagaaaattcaacgtaaagtaattcatcaacattagagacaatatcaacattagtacctttcttagcaagccaagccccgaaagccttcacagtctgtctgtgcatgaccttctgccttgcaaaacttgcaaaggaacttaccagcagagttctgacctgctagaacctgagctttgcccttatgggcaccattagaagcctgagtggaaggagtgttgggcttcttcttcttgttttgggagttgctggactcccctcgatagaactttttcttaccgcccttagcaccatgaaggaggttcagctgatccttatgcttctgtttgtcagccttctgacgatcctcctcctcaacagaatgagaaatgatttcttcaatggaccacttatccctctgattattctagttaatgatgaaagactcaaaatcagaaggaagtgaactcaagataaaatggactagaagatcatcattaattcccatgtccatactcttaagctctccattcatagcacccatctgcataatgtgctttctcacaccatctttataattatagcacatggacattagacgcttaattatagagctagcgtaagacttagaagaactcctgaagttcctatcaatattttctaagtaagtcttaacatcatcagagtccacaataccaccaataatgacatttgatatggcactcttgatgtacatgagagaaatcctattggacttctcccattcattagttttctcatgatataagttcagtttctcctcataatcgtgctcaacactaaaaggctcctcaggacggtcctctctgatggcataatcataatcgagtatgcctaagttgagtaacacgtcagccttccacttagcataatttgacccatcaagaggcttaatgagtcggatctgaccaaaagctgaaaaatcatgaagaaaaaaatatacataagtacatatatgcaattaatttgtgttggctcaattagttacataattaaacagaaataaattcccctaattacatcaccgttgggcagaaataattttgggaaacataattatgaataaatttatgtgaatttataatcaacgttggtcagaaaataaattcacatcatgaaaaacaaatatctagccaaatttctcgttggttccatttagctagaattaaattaataagcctccataaaatttttcataatttttcagcaattttaagcgatataaatggtactaatgcaatttctaaaaataaataagtgaaaaaggctaaaatctaatagcgcagcccattaataagtcggcctgcttaaagaacatgtgcggcccataatgcacgtgtagtgtggcgcggtccattgcggcggcccaaggggcttggcggcctgctaacggtgccagcccgatgcaggaacgatccgatctgtccgatctaatggacagcttagatttaactcgaatcggtgagaaaaaaaaaacataaaacatgccggttctaaccctaaccctactttacttcatttccccgatccccttctttctcgtcaatatgcggcggcggcggcggcgattttgcggcggcggcgcgcgcgcgaggcggcgccgcaacggcgcgtgatgcggcggtgcgcacaagggggcggcgcaagcgataggtggcggagcggcgcggtgacaacgcgcaacggagagggctgcggccggcggcgccccgtgtggcaggctgatgccgcacggtctgatgccgtgccggtgcccaccgtccccggttctcctccgcgcgcagccggggccatggcggcgagccttgagcagcgcttaatcgaaacttaatccgaataaaacatgattaatcaacatgaaccagaatgtgattgcatcaaaaccgacatgagaacgagggcttagatgcattttatggcttctaaacggaatgatgggatcattaggctatagcagtggctctgataccaaatgtagattatgcgatctactgacatgagtgataagcctaacatgatcaccctaatgcggaattcttagattactgaccgttgtttgaagccattgatgcggtccttgtccttgtcggtgtagacgaagtagtggtagcagtaggtacgccggcttgatcccaaaggggttgccggcgatcacttgcggggtagcgacggccttccggtcgccacctacactgtcccggaaccaccacacgttctccctccagcgcttagttgatcggatagggttttgggattttcggggagaagaaggtcgtggagagatcgtcacctaaccacgacaccggcctctcctattagtatagcgctaagggagatcgagggcaatccaaattatggaaggatttagcgctaccgatcaatg

SEQ ID NO: 31832 - DNA, 1128 bp, Oryza sativa
aaaacagttgggagtaaatgacaattgcgcgcgctccagacagatatgaaaatgtggctggatccatttgaaagtagacttgataagtttccatgaagtacttgcacgccaaaatcagagttcgcatgaagtcgtgccgcccgtcagaagttggcgctgccctgcagtccgaatccaccccgcgcgaatcctcttccctttggatcctctccatcgttcctgagtaagacacgagtgcacgcgtctccggggtataaagaagaggaatatgaactcaagaaagaactcacctgataatttagttgacgtgcacgagcgcgggtaataggaccatcatgctgtacatggaggcggcgtggatgtatcgatggtgtacatggggggaacgtggatgtatcgatggtgttgatgtcctcatcatcctccccttcttgcatttgagtcgtcctcgactcaagctcatcttcttctcccaaatacagcttcaaatctgcaatgttaaatgtgggactaaccctgaaatctgcaggcaaatcaagcttatatgcattctcattaatctttgctaacactttaaatggtccatcagctctaggcatcaatttagactttctcaaattaggaaatcattcttttcgcaaatgcaaccaaaccaaatctccaggttcaaaattcaattcccttctacctttgtcaccagcaaacttatacttagcattcatgcgctctatgttttctttagttgtctcatgcagttttaacatcaactcagcatgttgcttagcatcaaaattcagtttttcagaagatggtaaaggcatcaaatcaattggaggacgaggcaacaaaccatacacaatctgaaatgggcacatttttgtagtagaatgcaaggaacgattataagcaaattcaatatgaggcaagcattcttcccacatcttgatatttttcttcaaaacagccctaagcatagtagacaaggttctattcaccacttcagtttgtccatcagtttggggatgacaagtagtagaaaacaaaagtttagtccccaatttagcccacaaagttctccaaaaatggcttaagaaattttgtgtcacgatcagaaacaattgtgtttgg

SEQ ID NO: 31833 - DNA, 13530 bp, Oryza sativa
tgtcttcttggcaccaaaatgtgccatcaaaccgcctccatgcgcttcctgcaacaacaacaagcgaacggagctagctggaatgcatagcttgttagctctgaaaacaaacccaccattgatgacgaatttgttccatattcttccatccttacaatgcagcaacacatcattaaaatcagcatcatgcgcatattggtctttgattgtttccaggccaaaaatcttatagtcaagttgtgtcaacaaagtgtatctcctagacaaagcatcagcaatgatgttctccttccctttcttgtgtttgataacataaggaaaagattcaataaattcaacccatttagcatgtctacagtttagtttcccttgactacgaatatgcttcaaagactcatgatcagaatgtatgacaaattccttgggccacaaataatgctgccatgtttctaaagttcgcacaagagcatacaattccttatcataagtagaataattcagaacaggcccactcaacttttcactaaaatatgcaacaggttttccttcttgtagcaaaataccacccaatccaatcccactagcatcacattcaagttcaaaagtcttattaaaatcgggaagttggaggagaggtgcatgggtcaacttatctttcaacatgtggaaggcgttctcttgtgatgtgccccaagtgaaaggcactcccttctttgtaagcgcattcaatggtgtagcaatggtgctgaaatcctgcacaaagcggcgatagaaccccgcgagtcctagaaaactccgcacttgtgagaccgttttaggagtcggccaactctgaattgcctcaaccttggcttgatcaacctcaatcccctgcagagttacaacatagccaagaaaagaaactcgatctgtgcaaaaggtgcacttctcaaggttaccaaataaacgtgcatcacgaagagcattaaaaacagcacgtaaatgattaaaatgttcacccatagacttactgtaaatcaagatatcatcaaagtagaccaccacaaattttccaatgaaaggacgcaaaacctcattcatcaacctcatgaaagtgctgggtgcattagttaaaccaaaaggcatcactaaccactcatacaacccaaacttcgttttaaatgctgttttccattcatcacccaacttcatacgaatctggtggtaaccactacgcaaatcaactttggagaacacaatagagccactcaattcatcaagcatatcatctaacctaggaataggatgacgatatcaaatggtaatgttattaatagctctacaatcaacacacatacgccatgaaccatctttctttggtaccaaaattaccagaaccgcacatggactaagagactcgcgtacataccttttatcaagcaactcatgaacttgacgctgaatctccttggtttcctcagggttggttcggtatggcgcacggttgggtagggaagcacctgggattaagtcgatttgatgctcaatgccgcgcaccggtggcagccccggtggcacttccttgggaaacacatcagagtactcctgcaaaatgttagcaacagcagggggcaaagaatgctgcatatcgtgaagtgaaatcaaagcatctttgcataccaaagcatagacaactgaaggtgatgcaatcaactcattaatatcagatttagtagcaagtaagcatttgggtttcaaattgattgtctcaggtttcttgccattagattgggcttttttatcactctcacatttggatttggcagccttagcaacatcatcacgcaaaatatcttcaggagacatgggatgcaacacaattttcttatcatggtacagaaaagagtactggtttgacctaccatgatgcatagaatccctatcaaattgccatggtctacctagcagaatattacatgcttgcatgggcacaacatcacattcaacaacatcatggtaatttccaattgcaaaattaatgtgcaccagttttgttacctaagccttaccactgttgttcagccattggatgtagtatggatgtgggtgcggtttcgtgctaagtgaaagcttctccaccatctcgctgctagccaagttgttacagctacctccatcaatgatcatgcggcaacaacgctctttgacgacacactttgtttggaacaacgtgtgtcgctgattttgctccgccttctccatttgtgcgctaaggacacgctgcacaatgaggctctcatagtgatccgcaaatgcagccccaatgcgctcttccggtggtcattatctgcatggtcagccgcaagcaaagcaagtgtatcatcatcgaaatcactagcagaggagtactcaccatcgtttttgactaccaaaactcgcttgctagggcagtcacgctgcacatgcccaaagcccttgcaacggtggcactgaacatctctcgttcggcctgtggatgccactgaagaagcactcagtgctggctgagcagcctttgtcgctgacttgtcactagatggaggaggtgctgcccgactggttgcgggtgtggaagatggagaagcagtacggccggccggaggagtggtgcgtgtctgccatgatgaagttttacctgcagaaaaaatagccttggcactagcacgtcgtccctgcacttccctttcagccttacaagcaagatgaaacaatcgggtcatattagtgtaatctttatagtctacgatgtcataaatctcgcggtttaacccacccaaaaatctagccatggcagcatcctcagtttcctctaaattacaacgaagaaagcccatttgtaactcctgataatattcctctacactgtctcaattgttgcaacctattcagcaagtcacgtgcatagtaagaaggaacaaatctagcccgcatgacccgtttcaaagcatcccaggtttgtggcatgttattaggatttttcttgccatgttctatccatcaaaccaaagcaaaatcggtgaactcactagtagcagctctaactctagtgttctcaggaaactcatatcatgtaaatttttggtcaacagcaatctcccaagagaggtacgcatcaggatcatattttccatcaaaaggaggaaacttaaatttaattttagaaaaagcatcatcattgttgcgtacctcgcgtcgacggcgaccacccatacctcgtcgattgttgtgtagccgtcgatgatctcgagcatctcgatcatcttgctcagtgtcagcaatatattcatcctccaaattatcctcgacgtactctccgtcaatgtcatcgtcattacccccaccattgcctccagcattgagagcatcaaaatgcctcacaagtgcagcaaggctagtgtcaatgcgggcgaccgctgtctccagccctgtaagcttagtgttggtgaagatctgcgtggactccaattgtccaatcttctcatttgtcacctgcaaatctgtctcaagtctttctgtgtgctgcttcactttccttgtaaagtattggatggtgcctttggtgcgtggggaatgagatgcaccctcctcatctttattctctggacctgccatgatttagaaatgaaggacaacaaaacaatggagtatgtaatgtaagccctacacaactattgggatttagcttttgcaagatgctcactctcacttcactcgcaacttgtctcacaagctcttaccagttcttaccttgcccacaggagggggacagcaacccataagttagcaaccgtggaacgaggtgtatcggtgctgtagcaacaagacctgtcaagctgtagtcgggtttgtggtggagctgttggtgggctgaaagcaatgctcaagagaaaactagaaaccacgttagccaaagcaaattgaataatcgctcaagggtatagtgtacagtgctggtcctaggctagtcgaagtagagacgcgagcctaaccacaaaggacgccacaaaacacaaacccaaacagcaacgaaaacaagaaacggtggtggaaggtggtgacaaagggggaatggtggggtgtgctcgctggatcctcttttttttttgcttgctctctctagtgctgaggagagagacacaactttttttttatttttattttatttttctgatatttttttcacaaccaggagcacactggaaccaaccacagaaaatcttatctcaaacggacaaagtatgaagcttgtagaattttttcaaagttctatgcgaataggtcccgaagcttctcgccacaaaaacaaaattttgcaagaggaatttggcaattttaaatttgccgaacccggcgaagtgggggagaatcggatgtaactttttttttagatgtccgtggatatattataagcctaatttcgagtccgtctgaaaaagatatgactgttttaaggaaggtcactcgaatcagtgttctatttcttttctagtggcggcaagatacaagacaactcacaaaagctatcggcaacagatcaaacacaaatagaaagtgatttggtgggtgactgcgacggcaatgacggtggtgatgacggaaaaattgatgaaggtggcgatgtgcggtggtggcaagaactcgaaactctaatcgcctaacactaagaccagcaaattaacacaaccgatgcaatcgaaaactcaacaagccttaactaagcagtactagtaaaaaaaagcacaatggtctataggatcacgggaaaactaatctactatttttttttgttggccttttctggactataggaaaaaaaaattaatgacgaagggaagggtaaattctctcaccgatgaaccacgctctgataccatctgatgcgaacccgctagggtttgtggcccgatctttcgatgagaggtaagggataactcgattggatgaagacgacgttcacggcccgactacaaccgtccaaagacgctgcgccttagcaaccgatacaccgtctccaatggtcgccgcgaacttgtggtgcgcgtcaacccggccacgagggcactcgtcctgcaagcaatcgaagaacaagcaagaacaagtagaacaagcactgaaattgctagataaagatgaaagtttcactatcaaacacaatatggtggggttccgattacaggcagacgggcggtttagccaacacgcgcgctgcgagccaatagcaagtagctatctctatcatcaaaacccgaatgttcttggcggcgactagaggtataagaagaggggaagaacgaccatagggtcgtgctccaaccctaggacgcgcccctaatgggcccaacttggatacacagcccattgggccaaaagaggtgatgcagcaccatggacagaaaacagtcgggagtaaaatgacaattgcggccgctccagaacagatatggaaatgtagctggatccatttgaaagtagacttgataagctttccatgaagtacttgcacgcccaaatcggagttcgcatgaagtcatggcggccgtcagaagttggtgctgccctgcagtccgaatccaccccgcgcgaatcctcttccctttggatcctctccatcgttcctgagtaagacacgagtgcacgcgtctccggggtataaagaagaggaatatgaactcaagaaagaactcacctgataatttagttgacgtgcacgagcgcgggtaataggatcatcatgctgtacatggggggacgtggatgtatcgatggtgtatatggggggaacgtggatgtatcgattgtgttgatgtccgcatcactttcctaacatggtaaggctgacaggtggtatattggaatagaggttaggacaaatttcactaaggtttctctgctagctgagctgaaatattttcctttctaacctggaattctggagccaattttttcaatgagagggatgaaattgtcacatcttgattttcttcttatgatttataaattatttaataaattattattagaatttatattaaatgttcattaatttacaagtgatgttaaatgtgggaaataaaatttcctaaatataaagcatggctggatttaattttcattaacttctccatggttaattatactctctgaaattttcctggatttttcggagctcaattcctaattttaatgatacacagaacatttcagtaattaatcatatattaaattaatcataaaatggccctcttataattttgctaaatatttatggtgttcaagtactttcatgatttttcttgaaattattcgagcattggaagtattttttaacaattcaaagatcattttggtgattaatttaattggaaaaagtaattaaattcccccttttccttttcgggccgaattaggaaaagtcctctcactctcggcccagtctcctctcagcctgctctccctctctttcccgaagtccattttctatccttcgttcaatcgggccgaggaaaaggaagcccagcgaaagtctactttagctcctcagatactgttcatcttccagctccagacagagcccgagcccgtcctgtgcctgtgaagccgacgccgttttctccacaaatccggcctctcctttcgatcttttccgaaatttgttgaggggatttgtttcacttatcctcctctatcttttcccccaagaatcggactttatcccgaaaaaatcaacgcggaatcgagctcgattcgtgtttatctctccaaaccaaaccctagaaaatcccggctccgattctctcgttgaagggtcaatctctagctctcgtggctataaatagagtctcctccctctcctctttcgtttgctaccctcgcccgagctcgccgtcgtccgtagcaccctaaccggctccaccctagcgccaccgacggcgtcgatcccacgtggttgccatatcatcgccttttcagctgccgtccttgccatctaagtgtcacgtcatctctcagatcccacggggctgccatctaaaatgttagatcagatcaatccgagccatccaattttggtcaggccaaagttgatctcagccgtctaaaatcaatataaatcctgttatcccttttcaatggcatattagttctttttactatatatcgtctactaaattcattccaataattttcggaggatgctttagtcttatatctcagttataaattatttgtaaattgtttaattaatttggaatagtcttttctttaataggtttaattggaattaatcttgtaaaattcataactaattcatatgaagtcagaatgaggccgttcaagtctctaaattcatctaaaatcatgatctacatgtttgtttactttttatgtattatttatttggtttttattagtctttttctctgttttgcgtgttagcttgtcgtttccgtcgttgcgaaggtttgtgaatgcgtcggaagtattcaagaagattaattgaagaccgattattgcaaggcaagtcacacagatcccaaacaaaatcctttgagcatgttgatcctatatttaaattctctatttatttcaactgtgcatttattttcgaatgtcaccgggtggtgtgaacctattcctttgttatggccactttgcattgattactctattccttgatacctcgggtaataaattgattagcttgaaccttatatattagtttggttcagctaaatgctatatatatatatatatatatatatatatatatatatatatataattgcttagccatgcttagaaacattagctcattaatgggatgaatcatactacattattatttatgattatatttaatggtatctcacgatagttaatcgtgttatgataattaattgataattaaaacttgtcaatggtgggttgtgagcacatggttttgtaggtcgtgctcatgacaattaaggaccggttcgcgagctactgttgtgagacattaaccgtaccaaccacaagccagcgtgggcaacggctttaccttttgtatagcatggttcattacggggtgctagactgagaagcggcgagaagttcatgggggtcgctggggagtccatgcctctggttatatttatagagggggtgattatgatgcaggaatggtgcactgtggtgagttgtgttgtgcgaggggtattgtcacagttcctttccgaggtatcgtggtggtattgaggcgcatggtgacatgtcgtggagctgtgtcttgtgggtacagtggtacacctcaggccagagtaaaactattcgaatagccgtgcccgcggtcatggacaagttgagcaatgtttttcgtgattagtctcacacctctcacaataattattgatgctataactggtaataatttacttaactcctggtttggagttagatctgtacagccgggtatggttgttcaggatggttgggcctgagcagcatgggtgtgttgttcagtgttgaataacattgattaattactctactgtttttcaattctcaaatgcttgttaaatgctgcttttgcaaatgagcctatattacgccattctttggtatccttgtgcacttgcatatttgctgtgtggcttgcggagtatgtcatatgctcaccttgcaataatcaatcaacctcagttgaagaaaaaggatccagaaggagaagacgtttggcttataccccaattgagctgcctatgggagtggagctgaagcaatcgctagaccgttattcggctgctgtttttcttttggtttgtaagtatgtaacgttattattatgatggatttgtatattaaattgtcagtttgtgtacctcggctgattcctggacgaggattctatgcacaacttagttcggaaattactagtgaatttctgggcgtgacagaaatctaccttccatagttttctaaggtgaagaggtaggctaagtaactggttgggaagccttgaacagctcctaggaaatccagcaacaactgttgcacatcaatgttttcacaagcaattgagagaatttgagttttgtgcgcattgttcttgagactagttgctatgccaaagtgttccataatggtttttagattggataattcctgggctgttgggtgcaagaagaaagctacatcatctgcaaagagagaggttctaaacctcaaaggtccaccattgagtggggataagattccgtgatgctcagcttgttttataatgaagttaaggggctccattgctaataaaaatagtaatggtgagagaggatctccctgtcttaacccctttgcacgttgaattgcttggcctgggcatccatttaggatgatcttagaggttgaagttaaagagtgaatacatccagtttctccatctcagcccaaagccaaaagttgttagcacctctattatgtattgccaacttacagagtcgaatgcctttgagatgtcaagtttgagcaacaaggtgggtgttttccttctatgcagtctcttgaccgggttttgcacatacatgaagttgtcatgtatagctctcttccttatgaaagcactctgattagtggaaaccatctcttgtaatattggtgctagtctatttgccaagattttttatattattttagcaaaactatgaattagatttatggtgatgaaccctgagttcctctcgacactcaaggctgttgttggcccgatcttttggtgagttgtgataactacgatttgggagaaacgttgacgatccgactacaaccgtacgagacgttgtgttgcgccttagcaatcgatacacctctccgtgggttgttgatcttgccggtgcagatcaaccctattcctgcaagcaaatcgaagaaacaagcaagaacaagataaaagcaatcttatattgcaaataggaatttaatacaaatgataagttggggttccgaagaacaagcaaacggacggtctagccgacacgcgcgctgcaagcaagtagcaatggctaaactttaatctatcaaacccaagaaactctaaaggctacctagctatttaaggaggtgggaggacctctaggtcgtcctccacctggttggggcgcaccccacatgggccccacttgggccggggtcccaaacaaagttacaagcccattggcccatgacaggtgacgcaacaacttgtttttgtatttgcggccaaacaagatggagtctgctgataaagccagatctgttggaaagaggactccgagaactttccatcaagtactcatgggccgaaaacggaggtcgtatgcagattcggtagccgtttgaagtcagcagtgtagcaggtggccgaatcggattccagcacttagaggacttgatcttgatatcatcttgttcatccatgatgtgagctatggttgtatctgtagtagccatggtcacatcatcctccccttcttcacggaaaaccatcctcggcttttccatatggtgctcgccacatagtccattcaaaataacctatttcatccaatcaaaactagagaaactcgatgttgtgtgattagcaataacatgtttctctaaatccgaacaaatgaaaactctatgcaccaaatatattcctctatcattatattcgccaaagatatggaaaatagcattagttggacatggcaaatcagacttagcatataatttctccttcaaattatcgagctcacaaaaatcatcaaaatgaatatagcccaaaatattgaaagaagatctcaattcactctcctctacttcatcatcaatgtgaacaacatgtttaaaatcagcacacaatgaaacactagatatagtatgttcattcactagttgtggcatggatataagtgaagtactatcgcacaactcttctttatcacaaggaacagaatacaaatcaacttgtgacaaaggcaattcagaagtaggttccactaaagtttgctctaggtcagcatggaaagtggaaaaatgtaattcatcagaagcatactcaccttgagtaatttctgcaccatttaatttaccttttatgccctcttcagataatgtagctgcatcagccatctcctcattcgcgagtgatggaagtgacatctcaaacatatcgttcttctcattttggagacttttctgaacttcctgcaaaacatcagtgataggaggcacaagcatatcttgttgctccgttggattctccaaaattttgcactcaacaatgcaagcaagcatgaacaattggcctatatgattatatgtcacattaacaagcccagcctgaatattgaaattaagccctctgaaaaatctagtcattgtgttctcattagattcttgtaaaccactataagtgatacaaattttaaaatcatgaaagtactccctaacagttttgtcaccttattttagatgttcccatttctcaaggagagcacgtctatagtatgaaaacacaaatctttttctcatcagtattttgcattcatcccaagtttcaagcttattccccacagtatgccaccaaaaagatgcagaaccggtacacttattactagcagccttaatcatttgagcattagaaaaatcatactcatcaaattgtttttctactgctagctcccaattaatgtatgcagcggaatcatactttccatcatagaatggtaacttagatgcaacttgtgcaaaattatagtcatgtacctcatatgcatcacatgaagaagtcgtcatatctcgtcgaaggtgtagaagtcgatgttctcgtattcccttgcgcaatcctgccatggttagtagcaaacaagaaacacacacaagaatatgcacgctcctatcaactactaggtagtggtagctaaaatttcacacacactcaagcttttcaccaagctcttacaagttcttaccaaagcaagcggaatggtgacgtacaccgactcaaccaagcaccccaatggaggttggatgtatcgatgccttggcaaacacttgctgtacggctgcaattaaatctgtggagctctgggtaggcttaaatatgtagcaaaggaatagcaaatgctcaaatcagagaacgcaaagttgaataattgttcaaagtcaagtaccggtaccgtgctggtcctaggctagaacgtactagagacgcgagcctagacacaaacggtaccacaaaatagcaccagaaacaactcaagcacactccgatgtatgaaagcaaactcaaagatacaactaatttttccttttgcttctttctttccttttctttcttttctattttcttttctttttcttttctctttttttttcttggtgcggcttttcttctctttttttatgcacctttctgccctttttttctttcttttttttgattaattttttttaccaaaaacagactcaaggacctcaatgtaagatcacagggactcaaatgtaaatatgaaaattacagggactcaactgtaaagtccacaccaaaattaaaaattataaaaaatggaatgctgaatttatgccggttccgtttttccaaacagatctcgaaaccaacaccaaacgaaatttcaccaaggtgtttgacacaactcggaactgagataacgtgatttggagagggaggagggagtcggactgtcacggtggtggtgggtacggtaagtgggagggttcggcctggccctccacaagtggaaaccaaatccaatcaaaaaaaaaactttccttttcttttctttccttttttttctttccttccaccccaccgaatccaaactgatctgctatattcctctattcttcctcacacacatgcacggcatagccaccaaacagaagctatgcaactcaagaactcaaaaactaaccgacaaaaacttctgaaaactacgaaaatagaatcgtggcagcgagccgattccgttttcgtaggtcccgacgacaacagagacacggaggcgacgacgactgtggtataaaatgtgaccagaactcgaaactctaaatggactaaacgctaagaacagcaacacgactcgacgatgcaacacagattcaacaaagcaaaaactgaaaagaacaatgcaatggcacaatatggctaggtaaatgatacaatttttttttgtctggctattttctggttacaggtagaagaaaactcaccgagaaatgaaagctctgagaccacctgatgaaccctgagttcctctcgacactcaaggctgttgttggcccgatctttcggtgagttgtgataactacgatttgggagaaacgttgacgatccgactacaaccgtacgagacgttgtgttgcgccttagcaatcgatacacctctccgtgggttgttgatcttgccggtgcagatcaaccctattcctgcaagcaaatcgaagaaacaagcaagaacaagacaaaagcaatcttatattgcaaataggaatttaata

SEQ ID NO: 31834 - DNA, 4956 bp, Oryza sativa
gaaacaagcaagaacaagacaaaagcaatcttatattgcaaataggaatttaatacaaatgataagttggggttccgaagaacaagcagacggacggtctagccaacacgcgcgctgcaagcaagtagcaatggctaaactttaatctatcaaacccaagaaactctaaaggctacctagctatttaaggaggtgggaggacctctaggtcgtcctccacctggttggggcgcaccccacatgggccccacttgggccggggtcccaaacgaagttacaagcccattggcccatgacaggtgacgcagcaccttgtttttgtatttgcggccaaacgagatggagtctgctgatgaggccagatctgttggaaagaggactccgagaactttccatcaagtactcatgggccgaaaacggaggtcgtatgcaaattcggtagccgtttgaagtcagcagtgtagcaggtggccgaatcggattccagcacttggaggacttgatcttgatatcatcttgttcatccataatgtgagctatggttgtatctgtagtagccatggtcacatcatatgggcctgtaatgatctgccaatgaggcatcgcccttctttggcaacagaccgatgtgagcactatttaattcctcaagctagttttgatttaggtcggtaaagaattttattgcattgaacaggtccagcttgatgcgatcccaacatcttttgtaaaaggcgccaatgaaaccatcaggccaggggcttttttagatggcatcaattttaaagcctgttctacctcttccattgtaatgtcatcttcttgatcctgcaagtcaaaactgttcactcccaggttttgctagttgagtgagaaaactctgttatgcaccgttccaagccttttgtagaagtatgagaatattttttcctctttttcctggtttgaggtggcaattccattttcagtttgcaaggattagatgaaattgtcccttcttcttgcactggctttgatatggaaaagcttggtgtttgcgtcccctctcctaatccaagttagtctcaatctttgcctaattttgattttgtttaaggccgctagtcccagcactttgcttttgagagtggaataaaaagttctctcgtctgtggataggtttctactttcctgggccaagtctagttggaagatgacttcatttgcaattgcaagttgaagtttaatgtcaccaacctgcttcgactcccatctttttaggtctcttgctagtctcgagagctttaatctaaagattgccagggggtttgttgagttcagaggcctatagaaggaggggtattgcagccaaaaactctcaaatctaaataccttcactcttgcttgctcgtcctggccgattagaagcataggggtgtgaacaaaacaaaagctggaaaggggcaagagtcttgagtgctgaaacagaatgtcacagtcaggggtgcaaaaacatcgatcaatctttgtttgtgttgggttaggtgcacgtcacgacggctacctcatctgatcaaccccaaggcaaggatgatcaaggcaaagaaccaatatcacacaacgagcagagaaggaagtctgcgcgggagagacagcctaataaattgtataactcgagtgtgtggactcagtgatattgggctgggccactgtaagcgagtgaggcccattagcgcaatgctataagaggccggcatggactggattgaatcgaacaatgtagaaacacttttcctgaaactaattcaaatctctcccaattctattgttgttcttccccaaatccctcttcctctgctgctcttgttccagtctcaattccgattccttcctagctaaaccctaattcttagaagtcgtgacaatttggtatcagagccgtaaacctggagaagccacgctacatatctcgattgcaactccaagtcgaagctatggagaagcagaatgtggatttcggcaaggtgctcttggagattcaggagttattgggggcgctgaatcgtgcacaggtcgagactcaagcggtggtcgtccagcaggatcaaggagttagcagttggagacctcaagtggaagctgcggttcaagagctgcgctgggaggtcgaggagatcaagcaacaattggatctcgccagcaaatcacagcaagcttccgcatcgacgctttcccctcgagttccgtcgacggacgaggaaaggaaggcaccgctgctgcccacgccaccgccaacttctcttctggcctcggcggagggtggaagcaaatcggctcaaggccaccattagcttcagagttaccggggaaagacttcagggggaaacatgaccctgggtccaaccccggtcaagggtacgtatgattcacactccttgcagtttccaaaatttgatagttcgggggttgaaggtataatcaccgtgttccaaagttggatttccctaaattcgatgggttggatccccaggactggtgtatgaagtgtgagcactatttcaatgtgaataacatgtttcctggtttgtgggtgagggtagccaccatctattttgtgggaagggctgcatcttggttaagatcttctagggctcatttgcgttttccgatgtggggggatttttgtgctgctgtgtcggagaaattttatcgtgaacaacatgaaaatttgatcagacagatggatagtattaagcagtcgggaacggtttgggagttttatgagaggtttgatgaactgatgaaccaattactagtttatgatcctggggtgagtgcaaaatatttgactcatcgatttattgaagggctgcgaagagagattcgtaatcctgtactcttacagagaccaaagaccctcgaaactgttttgtctgtttctttgttacaggaagaggtgttggagaatcctcaagtttccagtgtcaaggaagtcaagagaatggaaggcaactctagttttcgatcatcaggcaagggaccttggccattgccgcaaccaccagggaagagtggaagtttctctttgatgaatcgtcctgaagagaaaagaagcactgatactgttcgcagtccgacaaattcaacagataaagtgactgctctcaaggcttatcgccgagcccagggattatgttatatttgcgtagagaaatggtcccctactcataagtgtgctgcatcagttcaactcaatgtggttcaggagttgttcagtctctttctggagggaggagctcaggaaagtcaagaaatctcaattctatcatatgctaaagccaatgaactaatggcgatctcagtgcaggcaatacaaggttgtgagccagatgggactatgcgcatgctttggtaagttcaaagaacaaaaatgttaattctagtggattcaagtagctcaaggagttttattagttcacaaattagcaacttgttttaaagggggtacaatctttttgtttgacaaattgtctgtcagagtggcttattggtgggtcgcctaaactgttgaacctttgattcctcattgtgagtggcaagtgcagggtcacagatttaaaaccactttgagaattttgccttttatcaactatgacatgattttgggtatggattggctgaaggagcacaatccaatgtcagttaattggtctcagaaaactatcaaaattaacttgttgggagcagtggtgactctaaaaggggtttagtctgaactgtctaggtgtgatttgttatcagcaaaggagatgcagcaattgcaacagaaacaagcagtagctcatatggtccagctttgttctccctctcaagctgaggtatctgaagaaatgccaagtgccattcatttattacttcaggagtttgctactgtttttactaagccaaaggggttgcctcccacaagacaattcgatcacacaatacctctgattccaggggcacaatcggtgaacatgagaccctatcgttacacacctacccaaaaagatgagatcgaagctcaagtgactgaaatgttacagaatggcatcatacaacacagttctagtccctttgcatctccaatattgttggttaagaagaaagacggatcatggcgtttttgtgttgattatcgtcatctcaacgcaattacagttaagaataagtaccccctgccaattattgacgagttgcttgacgaattgtccggtgctaagtggtttacaaaattggatttacgtgcgggatatcatcagattcgaatgaggactgaagatgaacacaaaacagcattttgcactcataatggtcattttgagtttagggtacttccatttgatttgactagcgcaccagccacttttcaaggggtcatgaacagtattatgtcctcattactttaacgttttgtgcttgtgttcatggacgacatcttaatatacagtcgcactcttgctgaccatatcaactatctaagggttgttttccaaattttggtaaaacatggtctgaaggttaaacagagcaagtgctcttttgctcaacagaaactgtcttatttgggtcacagcatcagaccaaatggggttgctactgaagaagataaaataaaggctgttaaagattggcccacacctcagtcagtaaaggacttaagaagtttccttggtctagcaggttattaccaaaagtttgtgcgcaactttggtattttcagtaaaccattgacaaatcttttgcgcaaggatcagcctttcatttggaatactgtgacagatgcagcttttcaaaccctcaagcaagcactaatatcagcacctgttcttgcgatgtcggatttctccttaccatttgtagttgaaaccgatgcatcagataaagggattggcgctgtgttgatgcagaatgatcaccctatagcctttctcagta

SEQ ID NO: 31835 - DNA, 612 bp, Oryza sativa
cttttccctagcaaaaattcaattaataaatggttggaagaaattatttgtttaaaggcaagaaagaaaccctaaattaataaatgcaaataataatcggaatcggcatgtggaatttttcttgggttctacatgtcaaaatacgctaacaggatttttagtggaattttcagagcattggaaataattttaaccaattaaaataagcaaagtgcaatattaaatccctggaaaaaaaatcctttcttctttttctttttctttcctcctttttcctctcttcttgggccgtcggctcggcccatttcttcccgcgccggcccgctcctccctcccactcccgaagttctcccggcctccctctccctctcgggcgctgacaggtggggcccacctgtcagccctttccctaacctccggccgaccacgcctgcgccaaccgccgccgaaaccaccacccatcgccgtccgccttaccccgcttccgcgccccactccgcgccctgcgcccacgttgcccgccaccatccccactacttccactcgcgcgtgcaccccgcaacggagggattcaaattcgaaactctctctatcttctcttcattccccacg

SEQ ID NO: 31836 - DNA, 800 bp, Oryza sativa
ttgtcttattcaaaaattttgtgcaaatattaaaaacgaaaagttgtgtttaaaatactttagataataaagtaagtcataaaaataaataataattccaaattttctttgaataagacaactggtcaaacagtgtaagaaaaatgtcaaaatcctttatattagagtacggagggagtagtaagcaattaaaagagttaaattttgcgtacgcacgcacctccactgccttcttcaaggcaggtctgaaatcggtattgccgctggccttgagcttgtctaccaaattttccagcttcttccggctgtccgctgaatttcttgtcagcccgtactcgctgacgaccgcgtggttgaaggacacgatggccagccggtcggcgtcgcgaaccaacttgatgatgtacttcatggcgatcttgagaagatccagcctcgacgacatgtgctttccccggacaaactcctccttgttcatgctcccgctgacgtccagcaccgcgaccaggtctatgggggcgcgcttctccggcgccaccaccttgggcgcctccaccgtcaccagcacctcgaagtcgtccttccgttggtcccgtgcgatcgccgcccggatcggggtggtgctcactcgcacctcttgccggtcaatagccgccttcgacgttgcctgcactagctagctagctcatcattaatctgatcagcgttgggaagacgaaaagtagtgtactacagtattagatagctatatatgttatctagctgtgtactgtatttgccatcaattcgatgaacattca

SEQ ID NO: 31837 - DNA, 2050 bp, Oryza sativa
  unsure (1)..(2050): unsure at all n locations
tgagctagtgtgttcatgcctatcgatcgtaggaatggcacatgaaactttgaagtgaaaattgtttcctttttctcttagagatgaagtgaagcaatggtacactatgtctgtcaagaaattccacggtcaatgggaggagctaaagtgcaaattttgccttgctttctttccattaactcgtataattaatcttcgattagacatcatttctttccgatagaacaagaaggaatctctcagtgcagcctgggccaggttgtcattgttaacttagtctagcccagacttgtctttgcctgaccatttgttgttacaacattttcagtatggattagacaaggagtctgttgcaaatctcgatatttccgctggaggatcgttcgcacacaagacaactgcagaacaaagagaactcttagatctcatcttagagaacgattctttctgccgaagcgaagccatccgggaggtctagattatctgtgagaaacctctgcacgtggagtcgaaacccgactcaactgccgaatcctcattctaggtgctggagccggaggaagaaaaaaattcatcctccagaaattccattccaattcagggataatcgttatgaagataatggaaacaccctgaattatttcaacaaaaagaagcctcatcccaagtatgagccgttcgagcaggcgatgtttgttttttcattcatttcttccgaatctattgtccatcttcatgaaactgaacgactctcatcatcgtcgatcaagcgtaagccttgtccttctagcctacagaacattgttcttgtttatcatcaagaaacaactatgttcttgcatgatgcatctcttgaggaggaggatcttcaggcccacagacaagcttgatgcctgcatcgactctagaggatgagagaaaacattccacaaatgaacatgaaagtttttctttcaaaattccccaggattcattctcacataaggaattcctagagtcctgtctgattagtgacgtttctctgtgcgaggaccacaaccaccttacggtcctcatttctaacatgtttagaagtgtggttctggatgcttatatttatcataaatactacaaatcttgtatttgtttgtggcactaatcttgcagcatgatgtccctatggtcgagcttgagaccataatcaaagcactgccaggagatagtccagattactacggtaagtttcttttctaataaaagcaagaacctatgtttaggattgtatacatcttcgggtattcttggtcgctaagcatttcaggttgagattaagaatgagggtcagacgatgcctaagtacacggttagctacatcaactttacactttggcgatcctcggtatgggaacactctataggagactccgacatcacacacttggtttttgatgtcttgcgacacaaaagtccaagtgtggggggaaaggccgacgagcttgtgatgacgagttccatcaatcaaggccatcttggtttaaagttggtgttagtcccaccttactaaaaaaagagataaaaaaagataaaaagaggagaaaagagagacgaaaaaaaagaaaaaaaagatgggagaagaggaagagagcaagagagctgacatgctgtgtaatgccctagaaaaaaaaagaatagcgtatagtatatattggaattccctacatttttttttggtgtttgcaattagaagaaaaacaatagttatacgctagttgggctagctttcggccagcccaaggcccagctgccccctccacacccccaagaccctaggaggtcccccccacctccccctagccgtcatttggtaccctggggcgcccacctccccctctggtcgacctcccccatgcctgccctactgcagacctgggaagaagaagaagggaaggagaagaaagggagagaaggaagcggacggaatcgaggtgaagaaggaaatgaggggtttgattgccgcttcccaaggaggcctaggtnnnnnnnnnnnnnnnnnnnnnnnnnnnnnnnnnnn

SEQ ID NO: 31838 - DNA, 3665 bp, Oryza sativa
gggtttagatcaagtgttggaagtgagtaagtttgggttccaccgatttattcctcagccaggtttttcttgctgatatgccccctgcgcagttctgttttggctgcttttccggccaacataatgggttttcctgtgaaaagtctctatacaaaagttgtagataacgtggagatctatcttctgaccagatggcatgattttatatcaagtggtttaggaggtatcaatttctgaagttggctgtctgaatgtcgatgcatttatctgtagtcgaggttcagagggattttaaaggatcttaatgatggaatcagagaatcttgtacttacagaagttgtagaatatgctgtgatctacctcataaaaaaattgttagcttttatcttgtattttgttgtcagtgctcttttgaatgtttgttgcatagttttctgggcagatgcacttatctgttttgtgccatgttttaggccagctaaatggaagaattcaattttgttatctaaatgaaagttgtaactcttgttctgtagatgtcagaaatggtatatttttctatgttatgtgatgtagaattggaggtatcgaatcgttaatctatgctgcttttataggaagattatcggtgatttgctttatgttgtttggggtgggttcccagcatagaaagtgaatgtgtgattcttgaatgattatatgtgtgttgtttgaggctgagtcggtgtttattcaggtgataccacttcggaatgcaactagagttcatctcgtcatcggtaaaggcaagtaaatgtagcggtggtttgctacagctttaacctgttattttcctaccttcactttaaaattatatatcaataaccaataatcaagatagtattacaggtcgtagcaaggttttacctatctgaatcattgcttatcgttattgcactgtttatggttatactttatgctcttggttataataaccttatactggtctccatctaaggaatgtggtttcgatgttatactctggaattcatactgcatttgcatcacacttgcattgcatttgaagttatgctgtgaacctatggttgcgaccgtaccggtacatcatcgtatattgtcgtaatacgatgcagcttcacaccttgttgggtgcgaaggcaggagtacataccattgcattgcatatgcacatattgcaggatgttatgaaaactatcgatcgaagatgtctttgagaagtgttttcttctctcggagttgtgaatatatggatttgattggtgatgtcatgatgttttagtccttggatattgaacttgtctttatgtgaatcataacttggtatttaatcagctatataataaacctgtggtttaaataggttgttaaagccgtttgcttgctgagatttattctcaccccttatagtcttttcaggtacttgttgtgacatgtttgcatgaagggatgggattagctacactgttgcacaatatgatctcacttagtcatgattattgtaatatgttgataagattacttgtgtttagacataatgggttaattaaataatagagttatcgaccattgattaactttttttttcgaggctatccgtataagtcagtcagttgttgtatcatacccttgatctatatattgaggcttccgccatattgtttttaaaagagagatgctgctgaaatttctttgttttggcacttttatagggttctttagtggcatcccagacttgtgcagttttctagggtgttacaggatgtatctaggtacagccagtctctctcttgagcttatgtgtcgcctagggttagctttcatccactcctagtggtgcacagcttttcgctctcgcagcatccacacttatgcaagcaagaggagatgccctcttctttttataggcggcgtttgctccagttcgcagttgcacatttgccaataaaaaagagatgcttcctacatctctacaatattgtgccaacggatcataccttcaaggcaaaaggtcttgcacccgacgtgtgtgcatgactaaaccgctcgcctgagttggcatggtcgaggtgccttcctccgctataatccgcaacgagatggaggagaaatctacaatcaaatgtgaccatgcaactgccccaaagattccaatatatccatcatgttggcggtaagtacactcaggtatgcgaaagataaaacaaggttcaccaagcatttactcaataatatcaccatgtgaatatggcttgatcatacatgattatgtttaccttgtctattttcatatactctggtttgggtatttccatagactttttaaattaagcatggtgcttaggttaaaattgtttgctttaatcaaattagacatggagttgagattgattaatgaaccatcagagttaatatgttcatcgacattggatatatatcttctgtggactaacccctacaggaaagttttcaaactgacaggtgagtcctcaagttcaattctcattggaggtaagtcagggcccgggaaacaaatcagtaaattgctaacatgcaaaggaggagcacaccatcttttgattatgttcatgcaattttacatcagccctgtatgagattttgcttaaacaaaaatttggtgaacaaaaaaaattaaaaaaaaatgttttcaagaacaaaagaagtgtctctcaaaaaaaaataaatggcaaacttttgggctcgacgcttcttaagttttgaatacaatttctctttagcgtggatgtgaacaactaatcttgaggctatgataaaatcttttcaattatttatagtctctcgggtatttactgtccactaaccgtttgtagggaataaaatgacaatcaacagcagtgtacaataagttcaaacacatatatcacgctccttggcctcataggaaagagatgcacatggaaccaacagaacaaatgcaaaacttggtgcattcgattcggttctaagcttggtaagatatatttggtaagaatcccaaacatcttgtgtatcctcgcctcatatatccatcctgctacgatacccaccatatccattgtggccataaaataaaaaaaagataaaaaataaaaataaaataacataaaataaatttggctccttagtcttccaaccaagtgagtcatttttgcttcactcttgtctttgtttttcttttttgtgtccaacaaagagtcccatgtacaaagagaagtgtgggggtgatcttgcacatcaacgccgtaatcaaagcaagatcaccccagaagtgatgagccatgacaaaccacacaaggaaaattgacgcagtcagacccaataaggggtcaaccaaacctccagttcggctgaactacctctaacatgaatcgtcctctgttttttacagagcgcaagtttgcacattattcatttggacatccattctatcttgagtttagtttgattatcaattctaacatatcgaagataattaaactcaagctagggatggtacaattagagtttatggtctctctgaaaatgacatgcaagcctattattcttagctcattacttgttgcttgtggtgatatatccaatagggaccccatgccatctaggtaattgatgaatgagatatagt

SEQ ID NO: 31839 - DNA, 3615 bp, Oryza sativa
aaaaaccctaagttgatcttcatgaaaagttagggtgacttgagtcaagactattccatttctcaattgcacgggatcgcatggtagacactataaagacccacaagtacaagtatggctttgaataatttgtttgtatgattattagtaaggaagtcataatcctattgtatagtccatagccttcactcgggacgagcaaaggttaagtgtgggggtgttgttgacggtccttaaatcataatatttgatggtcaatactttcatataataaaataaaatatggtattgttgatgcaaaaacacacactggcctgagagatctgcttaactctagtgcaggtcctaaatcttgcttttgggttcaaggtgtgccagttggtttgatcctgcaccccccaaaaatcaaagaaagaaacagagttaaatccataaacgatagccgattggccacatgccgatgacgtgtcgtttgtaacctagccgatgtaacgtgaattagatcagcaatgaaatataaagcaaaaagaatgttagatatagtcaatcggctgtagatatcaacagtatataatctatgtatcaaaatatgtttaaactaagtgattgggatagatcggatagattgccgagacagtataaatcacttaggtctaagagtactttaatataaagattatatatgttgatagcatagccgatgttgcagatctaacatgtatcggctaatactccgataccactaagatatcaaaatagacaaaatacattaaacatggattaatcaagtgttaaagtagattaacagattaataacaagcttaatatatttaattacagtgagatcttgatataaatggcaaatttagcatattaagtaaacctaaagtaaacaaaataaccaaatcaggtaagatcggctgaaaccccgatgaaacccaaatcggcaaccaataaactggctagagattgatattctaattacgacttataagatcaaacttaactgatgtagcaataactatgaaaagaagaacaatatctagaaaatcaagtcattggatgaatcatagagtggtagatatgctatattgtaggatcgaacaaggccagacaaacctaccagaggggggtgaatggtagggaaaaccaaaaacccaaaatcttttgcggaataaaagattacctcgaacgaagttgagcatcgccagtcgaaccgctcaatcaccgccgggcagaccgccgtattcttgccggtcagaccatgtgcacacctacgatcagattgctgcactcccaccggtcaggctgccgccctgcctgcggttagaccgtcgggacccagaaacactggtagatgacaaactcgaaatgtagattagaacttttcgactttattgcatcaactagtgtttacgaagtgcaactatagcactcctcaccaagatctcgaattaaacttaaaaccctaactttctctcaacttgtatctcactaaaactgatactgggagaccacaacctccctttctatttatacatgaggtaggctgtgcaaagcccacgaatctaacacaacttaggactcctatccacgtaggaaatcctctcttgcaagtatccaactcatccatttccttatctctttcaatcttcccgaattcggactctcctccaaattcgactcctctttccatatgtacacaatccacttgtataccctatgaaatcttcatcaccacgtgcattatcctctagcctttagtatcccgcgtgatctcttgatccctcgacgtctacttctcccaggtcgactccgatctatcaccggcaacactctcctgaggccttaagcaacacctgcacatgcaacaacaaagaaaccatattccgagtacaagttcatcccaacttgactcacattagtataacaacagtatccatacgcatagaaaccatctagaagtcaaatccccgaaggaaatattcaaatccgacaaaacaactcgaaaccaaaacaaactggaacctgcctgtaataccctgaaaagaaacattttagtgtcggcttcgggatggtttataatatcatggtagcatttagttaaataaataatgtcttaggagtgggccaagccaacctgggccaaagcccatgaacccaatcactcctctcccatctaaaaccctagaggaggaggggccggatttcccctcttccccctcgcggcgcctcttccccctccactcctttcctgtgcgtactttcttctccctctcctctccatcaaaccttgctgtccgtagatctgcaccttcatagcttggatcaagaagcgaagtggaaaaacggaacgaggaggaggagaagagaagaatgatgggttagatcggagtttccccgccgtttcccacgggatatgaaaggaaaaccctatgtgaggtttaccccccctgttgtatcagttgttctagggtgattttagtggtttaattcgtggtaaacaaaggttagagaagggtttttgtttgttgtggctcggtttggtagttctcctccgttggcagatttgcattgtttcggtttttttgttgtttcgggggtctaaatgatgttttctacgaaagtgtataactaggaagttgtagaaaattcatagacctatcttctgaccagagggcgcaattttatctttagttgtttaggatatatgaatttttgagtatgactgttgtttttatgtcataatctggacattagtagattgaactgcaattgggggatccaaaaaattttcaaaaagcaatacaattgttcttttcttccaaccactgtcgagagaatcacgcctttcggcgtgacatagttgtccattcgacaacagctggagccatccgtggggacctccgaccgaaacactgagagtgagtgaaaccactgatgccaccgaagaagatcgtcagtgtcacgtcccaaaacgatcctaaaatatatcctttaaattatgcctagaataattaaatttctagtgaaagcctccaaaattaaaatgtgcaaagttaaaagtcaaacaaggcttagaggatttttgtatatttcctaaaagcctaaaatgtgtaatcaaattttagtggaattttcagagcacaaataataattattaagaaataaacaaagttaaaatgattttataaaaagaaaaaccctaaaatcccttcccctctcttgggtcaaatccggcccaactccctcccccatcttttctctccccggggcccactcggcctcccccttccttcccgcgcgagcgccgctgatgtgtgggcccgtccgccaccctcgctgacgggcgggacccacccatgaacccccttcttccgccgttcccttcgcccctgcccgcgcctagcgccgccgccgccgccaaatccgcagtgcctagccgcccccgtgtgaaattgaatgggggaaatattccccccgattccctctcctttccccccattttcccctccccctcccacattcaaacagtcggatttgctccagcaaatctcggcagcgccattgatgccgaccgggactctcggctgttttcctttccctcccggcccc

SEQ ID NO: 31840 - DNA, 1077 bp, Oryza sativa
gcatccatcaggcaacacttataaccttgtagctgttgccgtttattaacatctcgtggtaaacgggccgaaaaggagacttggtcgtcggaaaacccttcaccaccatgaatttctcatttttatctcgccaatccccagagggaggccgatcgcatatttttcggccgcaaacctgccaacaaggcataatggaacagtgcaaaaggagaaataccagcaaaatcaatcccacattccagtgaaaacatacgattggcgaaatactaacttttgattaataaaattaaggtcataatggccacaatacggcaacggctcccagccgaacatgtaaggcacctatatacatgagcaaactaccaaaaagcctaaaaaggcgaaggaggaaaaaaaacactagggtgaagggcctcacacctcagggtggtctcggtcttcatcgcttggctccgacggcctagggtccaccctggggttggtggcagcggcttccttatccttcgtcaatttttcaagttgttcgcgaagccgggtcttcgtgcaatccttgccgccatcctcccagaagtccttttggaaggccctcaaggccgccccggagcactgggaattctcgagccaagcccccttcaatagctcaggaaaatctttaatatggtcgcagccatgctcctgaagcaggctaagcacaaagcccgctgaaacgcgtgcgctgtagtctccgtaggcgccagccacttcaacaaccgagtcggtgttgacggtcgttatcgatcagtttcgaccgtcaatactaccaaaataggagagagctagtgatgcttacaatgcataaatgtgttagagtaataatattccactagtattaggtatactaacctttttgtagagaatgaaaataaagtggaggagaatcgacatcaacgcaaatgataaatcaatcggacgatgtcaggaaccagacttatgaataaatgggtcaagaactcagaactgacatgacaaactgggccaaaattcacaagtctacggagaagaacaacggaggaggccgccagctgaaattgggctaga

SEQ ID NO: 31841 - DNA, 333 bp, Oryza sativa
ccgtatctccaggcgagacaaatctgctcacccagattcgcgcgctgctcaagtggtgtggcagtcttgaatagaccgcccattatggacaaacaaagttatcaataccaatgtgcatggattgagaccgttgggcattttgcccaactacggagaccggtcccacctgtcaccaggctttaggggtggcgtcacacttgaccgcttcccttgggaaaggaaattgctctggcataacgccgggggctactgtcggtgatatgggaccgggagtatcatgaccagaggcttgaggcagacgcaatcgcccacgtggcctgccacctttgggga

SEQ ID NO: 31842 - DNA, 616 bp, Oryza sativa
gtcgtcgtcgccaatggagtgccagctgaagaagtacctggtgctgctggccaccctggtggcgacggtgacctacgcggcggggctgaacccgccgggtggctcgtggctggaggacgccggcggcggcggccggtggcagctggccggcgacgccatcctacaggacaccaactactggcgctacatcgtcttctactggttcaacgccatctccttcgcggcgtcgctggtggtggtcagcctcctcttcctcctcctgcacaagggccggccaccaccagcaccaggggaccaagctgctcacgctcacccgggcggtgatggtggtcgacctgctcgccctcatgggcgcctacgccgccgggaccagccatgacaagttcaccaccatcggcgccgccgcgctcgtctccgccaccgccgcctatgtcatcgtcttcatcgtcccaaccctcacggcgaaaacgacaccgccgccgccgtcgggatcctgatgttgatcgccatcttcgtggcgaccgacgcctatgtagctgggctcaacccacccggcggcttctggcggagcaccgaggccgccggcgacccggtgctgccgggcctccatccaatc

SEQ ID NO: 31843 - DNA, 1403 bp, Oryza sativa
acaatcaagctattggaagcttcatagagtggtagatatcctatataatctaagccaacgtcgatatgtaacataatcggctgctccctagcgatagatattagccgactagaggttagatagcgatattgtcagagattatataagatatatgataactcgacaacttacatgaacaagattagagtatcataaagatgtaagcactaatcccgagaacgcaagccgccataacaagttttacctcttagttgaagatcgaaaccgatgcagctcaacccgaaagcaagaactcgtcgaaacaaaacgaaagtaaaagagtggcgatgcgccgagattgttgttgaacgtgtgttgttgtattacatggtgtcacaccctaaaaatcctaaatgtataaattgttgtttaattggaattattagaatttattttaaaagcctagaagagaagagctaattttaattaataaattccaatataaaatggggccagataaaattttattaaatactttgcttaattctataattcctagatttttctgggatttatttgagctaaggaagtatttttaataaatggaattgcatttcatgaataatttaaattgaaaaaggtttttaaaagtcttcttttggctttgggccatcggcccaaaaccctctctctctccccccagcccaagtcggcccagcccgcagccgcagccgctcgcgcgcgcgcgtccgcccgctgacaggtggggcccacctgtcggacccgtcatctacctccggccgccgccgcccgaaaccctagcgccgcgccgccgttgtctccttctaaattcggccgcgtctttcccgatccggtgaaattgattgaggggaaacaatcttcgggatctcctctaccttttctcttttggaatcatcggctaaaatcgtttggaaatccgtggattcgaggtcgaatcggatcggtctctttcctccgaaccccgatctttccttcgcgtcgccggtcgccgtgggccttcgccaccgccctccaacccctttaaaaggatccccggtgtctccgctacccgtcgccaccctcgccttcgtctctcgccgtcggaagcgccctagcgccgtgtaacctcgtgccgttgtcgtcgccgccgctccagccgtgcgccgccaccgttccggtcgtcatcgtcgctcggggaggtcgccatcgtggtcgccaagttgccgccgtccttgtccgccccttcgccatcgctgtagaccgccggagcaccgccgtcgtcgtcgactcgaagaccgtcgccgcttcttcctcatcgtcgtcgccgtccgttcatcttccgccgacgttttggtcatcggtgagttcgccgcgtcgcgctctacgtcctggtgccctccgtt

SEQ ID NO: 31844 - DNA, 1090 bp, Oryza sativa
  unsure (1)..(1090): unsure at all n locations
catgtactgttcatgcttgtttatgtgctgttttggtgattttgctcttttctgcttagattccgacgtttccggagagtccgttttcgcaggagaagaatttgaagagttccaaggctagcaaggcaagtcacacagatcccaaacaacccttttgagcatgttgatcccgtttaaagctattgtttctattcaactattgcatttattttcgaatgtcattgggtggaattaacctattgtttgttatagcccttttgttcttgattactttattccttgataccttgggttaatataacttgactagttgagctttatatatattggttcagctagatattagatgtgattgcttagccatgcttagaaacattagcacattattgggataacttataattcattattatttaatgatgattttatgttagttcacgatggtcaatcgtgattggttaattaattacttgccaactaaaacttgataatggtgggttgtgagcacatggttttgacagtcgtgctcatgacaattaaggaccggttcacgagtttcggatgtgaaacattaaccgtgccaaccacaagccagcgtgggcaacggctttaccttttgtatagcatggtttattgcggggcaccagactgagaagtggcggagataagcccacaggggtcgctggggagtccatgcgttgtttataagggggtgattatgatccaggaatggtgcgctgcggtggagtgtgttatgcaaggggtattgtcacagctcctttccgaggtaccgtggtggtattgaggcacatggtgacatgatgtggggctgtgtcttgtgggtacagtggtacacctctgatcagaataaaactattcgaatagccgtgcccgcggttatgggcgggtctaacaatgtctttcgtgattagtctcacacctctcatcgtaataaaagatgctataattggtaataatttgattagctcctggtttggaatggtatattcaaagtttggagattgatctgtacagccgggtatggcnnnnnnnnnnnnnnnnnnnnnnnnnnnnnnnnnnnnnnnnnnnn

SEQ ID NO: 31845 - DNA, 814 bp, Oryza sativa
  unsure (1)..(814): unsure at all n locations
nnnnnnnnnnnnnnnnnnnnnnnnnnnnnnnnatatccatttaaagaacatataaacttcaaatgggcataacttggccatttgaactcggaattggaccgttcaagtctctaatttttccttaagaagtcaagaacccatttttgtgctttgtttctgcttattatgtggaatttattagcgtaaaagccttttcttttccgttggtcgtgtagacgctgcagctttggaagatccgctctttgtggaagttgaagccggcgtttgggaaagtgagcaaggcaagtcacatcatccttgaacatattgaatcccagtttataaaattattttgatttaaattattgcattatcgctttatttaaattcccgcgttatcacggttttactaagccatgcctatttacctttgttatgaccgtattattgttgttattgttattattaccttgtccaccctagattaaacaaaaccccaactagtggatactctactcatggtaccactagtatgattttaggtagatgcttcgctgtttaattagacaatattaggtggttttataactttagacttggggaattctcatatcacttggacactttggaattgttggtttattgtggaattggattcacaccgccccctctattcaaaatccccaaaatggttttaggctgggctcagggtgcatggttttgatagtagcacctcggccatataaggcccggtcttcgggcctctgttgcaaagcacaaccgtactttcaaatgtctagtgggtaagccttagtttgtggctcaggggatcctc

SEQ ID NO: 31846 - DNA, 4388 bp, Oryza sativa
catccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctattagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactatttttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaaacattggaggatgaagttgtaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatctttagttccggttggtattaccaaccgggactaaagttacgatttttagtcccggttggtgttaccaaccgggactaaagatcccagggggcctgacaggccctgacagcattcgaaccgggactaaagatgatctttagtcccggttggtaacacaaaccgggactaaagatcaaatatgcccgttacccttttgaaccgggactaaagatcatctttagccccggtttttattgcaaccgggactattgtggaaatcggccgaccgacgaaagatggttactccaccagtgaagcgttatagttttgtgattaaattgacactaaacctataattttacgataattctttatttaatctttattttttatacccatggttagtagcgggagtagcttccactaaaagtaagagggagaaggagcagttgcctatgggaagcaagggaacatggatacgtacttgcacgggaggggatccctcccgttacgtagatttctttgttttcgtttagtagaaaaaatattcgtgtgttgtaacggataaagactatttttaatcatattgttgttatattttctttttctaaaaagtatatgggatatttattttgatagtattgatatctaatttggaatttttattgggatgatggtcatatcatatacgttgatttcttatagtttggtaagaattctgaagcaactaggactccgactctcgtcctaagttaacatgcatgttttttaaaaggatttcttatacaactccttatacattcctaaaagtgaaagaacttaaaaaccaacttaaatacgaacgatgtaccaaaatatcagcggaaacatctttaatttttataatactagaaaaatgcccgtgcgtttcaacagttgaaggctaattttaattttattattattatatggtttagttaaagtgaaattcactatgataattcacttagatatatatttttctaaaaaatcatgagctgtaattaggattatgatcatttaaagttagcatgcgagttttttttttaaaaaggatttcttatacgtctccttctatatttctaaaaacgaacgaacttaaaacccgactcaaatacggatctgtatttataaaagcgaacaaacttaaaaaccgactcatacacgaataacacactaaagtaccagttaaagcattttaaatttttataatagtagagataagtagagaagagacagatatttaagagataaaaaggattctcagttagtataacccaagcccagcccattaccacggctaactaactagcccatgtatatcgatctatatcggcccacaaagttgacaaagttggtccacgtcgatctatatcggcccataaaattatcgaacttttccctcggacgacttgcagaaattccattggaataagttcatttgagttccttaacttattaacgaatccgattttcgtcaatcaaccgaaaatcagatacaactggtccttcaactgtgcaatataggtccgtttagatggcggtattagctaacatggcgcctacatggctaatttgattcggtcttcatctgacgtggcattaacgtgacacacgaagcaaaatttaatattttaaaaaataaaacaaaatattttggcccacatgtcagattaaaaaataatgagacccacatgtcagatcagattagaagaaatataacaaatcttgagaagagatcggaagaaaaatagagagaaaaaatagttggaaggagagatggataaaaatatgaggcactgcttgtatggatccgaggatccttgctggtatagatcgggattatgcaggtcgttgacgccttgggatgcagtgctcccatggggctcagatggtggctcgatgtggtcgtcggtggcaccaagtcagggaatctcggggagaggagaagccgaagaggtagagcagggagagagggtgccgtggtgctacgatgaatgccgccggctctggggaggaataggacacagagaagaaactagaaaggggagctggggagaggaggaagaagagggggtgtgaatgattatgtggggcccatgtgggctccacctttaaaaaaattggtgtagctaatatgtgggaccaccgtttttattatttttctaggataaaatagtcacgtaagcgtcacgtcaatgccacgtgggacgaagaccgagtcagatcagcacttaggcgcagcgtcagccaaaaccgtcttccaaaccaccgaggaacctcgtttgcaccggttttaacagttcatggaccggttgtatcttgttttaggttaaggacgaaaatcgtattcggtgtaaagttaacggaccttatatgaacttattccaaactgcatttggctcggcctgtaaaacacagcccaatcccgttcataaaagaagggcccattacgtagggagttgggctgggccgaaggccattccaaatcactcgtctaaagaggacgtcgaagacgaaggcggcggctgcctcgcctagcacgctccggcaacgagggtaaaatcttaaattcgtaattttctgttcgtcacatcatcggtacccaaatttttcgttcatccaaccccccacccaaaatctcagtcggaattctatcatcccccaaccaaaaaaaatcctaatcggaattcaatcacacaaatagaagcatatacacatgagtccgcgtcaaataacacaaaaagttttaatccgtgttagatcccaaatacaagaatagaagaacagcaaacggagataaaaaaaccaaatcaatgaaaaatcgagtggagtttgctgctgccgccgcctcctcctatggccacatcccgcgagtggccgctggcagtggcttgccgagctgcgccgccggcgcccgctaccgccgtcatttcaaccgaggggggaggcaacaggggacggagggagccgccgctgacgccacccgcggctgctgggggcggagggagccactgctgccaccacccgcagctgtcgcgaggccaccgccaccgccagatctgcctgccgcgggagggatgagggtggaggaaggggagggaatagctgtggggaaacggcgctggcggtgggtccccttcccgtcgccgcgccttgccaggagacgggaggaagagggggagatgggagaggagggggccagggaggcgagacggagggagcgggcgccttgtcgctgtcgctggggaggagaaactgggagacagagagagcgacgagagagaagcgaaggcggaggattctagagatggagaaattggacattatgccactgccaatagtgggtttcgccacaatgccattccccggaatagcgtcgttaaaatgccactcacaagagatgccaaacatttgttttgccatttaggcca

SEQ ID NO: 31847 - DNA, 11823 bp, Oryza sativa
  unsure (1)..(11823): unsure at all n locations
gaatatggcaaagcaacggtttggcatcggtatgaaagtggtattttacgataccattccgcaaaatggcattgtgtcgaaacccactctttaggagtggcagaatgtctaatttctcctagagaagagataaggttcgagaggaggtggggtgatatttttctttgctgttcaggtgaatatctatataatgcagtgcatgtcaaaacgtccatgattctcaattggttagcctagaaaacctgtgccgacaggtcatgggtccgattccttgatcactttggttagctttcttttttctggttatcatctactgttcttttcccttttccttttctctccaatctaattcatagaaaaaaaactaaaaataaaaattagccaccaagagaaagttagtcttttttttaattgctataaaaccttagttaatgttaaatctggtaaacaagaaatatattgttttcaacatgttaaaatatttattgtgattttagttaaaattattccgttgcaataataatttattatgagctattatatttctctctattatttgagaccttttctagtgagcgaaagtaccaaaacagtgtgaaaataactttagatgaaaataaatatttttagttttaatacaccgtagcgaagcacgggtattttgctagtaaataaatagatgcagactgccagaaaaaacttggtaccaatagacaaatccaacagtacttatttaggctaaattaatattctgtacctcatgactatgatttaatagtcaatgattattattgattccaaaaggaacgatctaatgtgactccttaacgagctgtttttttatatatatttctctaattcgaaacaagagcctggctcttctttattcattgctacaacattttttttgaacgaatcattacaacaaattgaagagagtggaatcaggccaacattagtttgacaacccagagaggaatcattggccaattactgctgtcactcttcgtattactgatccttgtgttaataatagtcataatatagtgttgtgattgtcatgtcacatggactcacgtgcaggttacactacatcatatcagacagccagctgcaaactcggggaagctatgtaatgcaatgtactaaccatatgcattagttcgaaaacaagtctgactatgttattagtcggttagccacatgctatgtggtcaagtcattttcagtaatgacacttgcaggaaaaaaaaatgatgattcgcaagaaatttcgggtgaaatttctgcttaattaagttttgcactgtactgagctcgctagaagacagatgctttgcatagtttgctgatagatagattgctaccaagacagtagtagagctccattcttcttcccactgctccttaactttgtcccctttgtgaaggagatcgaaaagcttgcattccatggcaaatccatggaggattgcagccatgggctctgtcataaccgtgctaggttggttgctgtcgcctatcatcagcttgctcgtgaacaggttcatctcctacctcttcgacgcttcgccaaagatccaagagctggagattcagactgtcccgaagctggagcagatgctgcgaaagatagaggaagagaggatgcacaggaaagcgaagaaggagagatcagccgtgcaaaatctcgacacgctggcgaagctggtcaagtctgccttgtacgaagcagaagacgtcctcgatctcattgcttatcaccagatcgagaaggatgtcatcggcgatgacgagccacagggaagcagcagcaaatggcatccgcacatcgacgatgccatccacgcttgcaagacgagctggattgggagatgcataaccactctactggagtgggcacagggtttgtatcgatcgctacgcagcagatcagctgcgctgctaccgatttcttgtagcagatgctgcgggtcagcttctgactccttgctggagcggcttagttgcttgtccaggcaatttgatttcatcagatgctgccaatccctgttcatctggtcagtcaactggtttgaggttgctcgctcttatcgagattggttttatgatgcaactggcatcacagccacaggttaccaggttggttaccacttctctgccccctaacacacacacaccccaccccaatctagcaatgcatcttctctcaatctaggggaatgttcctattttgcatcaacactaatacactatgcaaaaggagttacaatgcacgggctatgatcttggtaaaatttatgtcgcgctcctcaattttattcggaaatcaatagttgctggaatgtgttaaagggtcttagtgtttgagacaccactaatgttactacatctaatagttcaatttttgaagtaacaagaaaaaatttccatgttctaaacagaagcactaatttagaagaaaacaacatctattattaatcaggggacaacagtcgtcagagagtagaactagttcagtatatatatattttttaaggaagttcagtatgtagctcacatggtcctgttcttttgtgctgaatggctaaattggttgaatagctcaatgattaaagataattattcaagtgtacatacgaattgaattgatactataaagtggaaatggatttaaaagagtttcctaataaattcgtatatagaaagtgttcgcaaaaaatgcaccatttaggagcttggaaagtatgcacattcctccaccattccattctaatcattttttttgttctttattcttccagctggaggatggtacagcagtatattctttcatgcctgctattgctagatggaaattgaggaaaagaatagagaaactagaaaacactgtcacaaacgtggagaactctccctatttaacacagacaagcagtggtgcctggaatgatattgtcaacatgaacaggagaagcattacatcgagtagtacacgcaaggtattcggtagagaccgggagcgtgatatgataagaagtatgcttcgtgaggatgattctttaccaagctccagtagcaggaaatgttattctgtaatttgcatatatggcattccagggtctggaaagactacactggcacagtatgtttgtgagtatgaaaaggaggataaagatagatactttgacacagtcatgctaatttatgtttctaagacttacagactggaagatatatttcgtgatatgctcgaggagatcacgcaaagccggcattctgaaattagtgactgcagaggtttggaagcaaaattggtggagaatttgagaggcaaacggttcttgttggtactggatgatctgtgggtcaatgatgagaatcatgagaagctgctttctccactcaatgttgggaagtcaggaagcagaatcctggtgacagcccagagtaaagaggcagctctaggctctaataggcttattccaatatctgatctggaagaggagcaatacttctcaatgttcatgcattatgcacttgacagtacaattttcgatgatcgagaatacataccgattgggaggaaaatcgctaagaagctgaacagatcacctattgcagcagtgacagtggcaggtcagctctggagaaacccagatatcagattttggcaaacaaccgcgaacctcgatgtgctgaataagaccaagggagctctttggtggagctataatcaacttgttgtggatgtcaggagatgcttccagtactgtagcatcttccccagaaggtatgagcttgaacgtgacaatcttgttcgtatgtggatagcgcaagaatttgtgaaggacaatgatggaaacaatgaggacgtagaagatgttggtcagtccctctgacattagcaccggtgagtacttcacagttcatgacatgttccatgaattagcgaagacgatcgcgggaagcgactgcgtcaagatcgagaaaagcatcacggaacatcttcctaaatgttaggaatttccccagcgatcactagcaggaaaccagacgaacacaacacacgcgtactgtggctaaacctgcaaattcgcagaacagaggaaacagagcaaattttgtgcagcgcttaactcagctgcttttctgtttacttccatatataaaggaacgaatacaacggaaacaactaaccaccaagaccacttctcacgccatgctctagctgcgtccatccccacaaccacacgacgtgatccgagctcccagcacaagacgcgggcaacgagctaaactcggataccctcataacagactccacacgatggctatcacacaacacgtgagctcatgcgtttattcagaaaaaaacgtaaacatgcagataactaatcaactaactaaccgtggcacacaagattactgctaacaaaactctccctaagcttgatgtgccgattatacaggaaacataccaatttgttcccacagctcctgaaacttgattcgagaaagcggcttcgtcaggatatctgcaagttgcccttctgtgccgatgtaactcggtgtgatttccccattctccacggcttcacgaatgaaatgtaattttgtttgaatgtgcttacttcgatcgtgaaaaacagggttcttcatcagggccagagcggattggttgtccaccctgagatcgacgacttcagttgctgcattcctgaggtcaccgaggagccgggcaagccaaatgccctggcatgcagctgttgcagctgcaatatactcagattcacaggaggagagtgctacaactctctgtttttgagactgccagctaacaggatttttgccgagaaagaaaattactcctgtggtgctcttgcgagtgtcaatgtctccagccatatcactgtcactgtaaccctgcagtcctccttcaccttccttcacatagcggcacccaagatgaatggtaccagcaacataccttatgatgcgcttcactgccgccaagtgttcgtccgtgggtttctccatgaaacgactgacataaccaaccgaatatgcaaggtctggtcgggtgttcaccagatagcgcaagcttcccactagacttctgtattctgtcgcatcaactagcgatcctgcactttccttgctcagctttagacgtggttccatcggtgttgcacaggggttgcagccggtgagcccagccttctccacaatacgcgacgcatacgctgcttgctttaaagtgatgattccagcttcttgatgtacctcgatcccaagataaaaactcaaaggaccaagatcactcatcttaaattcagccttcatctgctctttgaatcccttgatcatgccactgtcacccccgacaattaccagatcatccacatacacaccgacgagcagtcgcccactgccatcgccgcgcgcgtacagcccatgctccaacgggctctgcttgaagccaagtttcttcagtgtgcagtctagcttggtgttccaagctctgggtgcttggcgaagtccatacagcgccttatcaagcctgtaaaccttgttctcctgtccatcgatctcaaaccccggtggctgaacaacatacacctcctcaatcagttccccattgaggaacgctgatttaacgtccatatgatgcaccatccaaccttcctgcgcagcgagagcgagcaacaaacgaacagaatcaagacgagcaacaggagcgaatacctcatcaaagtcaattccagccctctgcacgtagccctttgccaccaatctcgccttgtgtttgacgacgacgccctgagcatctttcttcagtttatacacccatttcagcccaattggccgatgtcccgaaggcagatcgacgagcctccaggtcttgttctcctctatcgaagagatttcatcgagcattgcccgacgccaatcctcgtcgcgttcagcttgagcgaacgctgccggttcttctccgctcaccatcatcagctcttcctggacctcacgattagcgagacctggcagcatggccagccccagcacattgtccatcgtgcggaaacggagtggtgcgtcgtcgtggtctgcatcaagattagcagctgctccagttggtggcgacacaaattcaaccgccggcgcatcgccatgcaccgaaggtgttcggccggctgtcggtgagtctgatggcgttcgcggcgatgatgaagatcgagcaggcggctccccagcgtcttggcgtgttcctgacagcgagccaggatggtacaccgtggtgtactcaacgacgaagtcggtgtcgagatcagcggccgcctcagcatcccagtcccactgggccgcttcatcgaagacgatgtcacgggagatgtgaacacgccgagtagccggatcatagccgcgatacgccttggaccccggctcgtagccgacaaagatcattggacgactcctgtcatccagtttcttcaggttcggggtggtcgtcttcacgtgtgccacacacccaaacgtgcgcaaatggtgcacggccggcggaacgccgttccacagcgcgtactgggtcttgccgcctatacccttggacgacgacctgttgagcagatacacggcggtatttatcgcctctccccaaaacatacctggcagccccttcgccttgagcatactccgcgccgtgcccaccacggattggtttcgccgctcgacaacgccgttctgttgcggagagtagggcgccgtgagctcgcgccgcattcccagctcggcgcagtactcggcgaactgtgtagacgtgaattctcccccgcgatccgtccgcaacgcgcggagcttgcgtccactcttcctttctgccgccgcctgaatacgcttgatggcagccggcgccgcatctttggtggagaggagggcgacccacatgtaccggctgtagtcgtcgacgagtagaaggaaatagcggttgccactgggtgtcgccggcgtgatcggtccacagagatctccatgcagcagtgccagcggctcgtcagaccggcaaagtgcctgccgcgggaacggcgacctccggtgtttcccggcgagacaggcctcacagacctgatcaacctgcgacaaacatggtagaccacgtaccagctcctccttgcccatcttgcagagcgccctgaagtttatgtgcccgaggcgagcatgccagcgccacgcgtcttcgtcggcgtgtgccgccaaacagaccgggcgcgccaggttgatgtcaagcatgtacagtcgccctggggtgcgagggatccgggcaagcagacgccgctgctcatcccagacccgcatgatgccatcctccgccagcactttgaagccggtctcatccaattgcccaatgctgataatattggcagcaagacggggaagaaaataggtgttcgacagagtgcggtgctcaccattcttgcaggcaaagagaattgtgccccgtcctgcgatccggaccacggatccatcgccgagtcgcacgttccaagtgatgttcgtgtcgaggtcggcgaacgccatcctgctgcccgtcatatggtttgacgcgccggaatccataatccagcgcccgggatcatggtcagccgcgtcgtcgagcgctgcaaatactttcatctccacgagttccaccacagcttggtggggcagtgtgggcgtgtatgcctccggagccggcgagtagaacgtgttaacgcaaccggcggtgagcaacataaaagaggtgctcttttttatacttcctggcgacgtgagcctgttcttcgcgcttggacttgctcctgcagtccttcgcccagtgcccaagtttgccgcaatttgcgcatttgtctcccttgcgcgccgaaccagagttcgtgctctcggggctcgcagtcccgccgccaccagtgcgccctctcccgccacggcgcttgccgcggccgccagagccgcccgagtcaccccgctttgcatcttgatccttcttcttctgacgttcagcccactcctcctcagttaggtacagcttcccaccggcggtgtgcgacgaggattgcccagaatcctcagcggctttcagtctgccagtaacttcctccatggacagagtagagatatcgagaagagtttcaatagacaagatgagttgattgaacctgggacgagctacccgaaggtacttttcgacgactttatcagcaggttcaggatcaccgagggttgcaagctggttgacgatggttgtgagccgtagagcgaaatcttccacggtctcatcaccgcggaacgcaagcgattcatactcagcgcgcactttctgtgcactcgccttgcgaatccggtcgttgccgactcgcattgtcttgatgcattcccaggcttcccgggccgacgctttggtcgccagggtgccaatcatttctggcggcacggcactgcagatagcgtcaagagccatccggtcctcatgcagagggacgtccacaccgtcgggctcgatcgccgcccacagccagcgagcctgcagcttgatcttcatcagtagcgcccagtcgttgtagttggtcttggtcagcagcgggtagttcaccgagccgcctccttctttcaccacgcggtggatcaccagcccgcggtcacccccgccgctgcccgtggcgcggccgccggagtcatgaggagtgtgcacgatcggtgacgacgagcgacgacgcggcaagaagacgccttccaatgcgcggtcacgagtccacttcctaaaccgtgctctgataccaattgttaggaatttccccagcgatcgctagcaggaaaccagacgaacacaacgcacgcgtactgtggctaaacctgcaaattcgcagaacagaggaaacagagcaaattttgtgcagcgcttaactcagctgcttttctgtttacttccatatataaaggaacgaatacaacggaaacaactaaccaccaagaccacttctcacgccatgctctagctgcgtccatccccacaaccacacgacgtgatccgagctcccagcacaagacgcgggcaacgagctaaactcggataccctcataacagactccacacgatggctatcacacaacacgtgagctcatgcgtttattcagaaaaaaacgtaaacatgcagataactaatcaactaactaaccgtggcacacaagattactgctaacactaaacacgttcgacatctttgcatcgagtcacagtgaaatattgttcccagagaagattttggagcttaaaaacttgagaactcttatcatgtgctattcagtagagggaatgaaccaagatgattttgagcgtgtgctgaagaagctaacaaagttgagggtggtgcacttggatttgagacatttgagcagggtgccaccatgcatcggtggactgaaacatcttcgttatcttggcatcatgtcacctcctccccacagcctgattctgccggctgaattttccaagctttaccatcttcaggagctctctgtcaatcctaacactcgcttgcattgtccatcccagctgaagatcgccaacctgatcaacctgaggtacatgctgacatggtatggcctgaacattcctgatgttgggaagctgacatctctccgagctctgtatcacttctacgtgaggaaggagaaaggatacgagatacagcagctggagcacctgaacaaccttcgtggcaagctgttcatcgactgcatcgagaatgttcagagcaaggaggaagctgttcgagccaggctatctgacaaggtatatctcactgagctgacgctacggtggggtggcactgacgaacgctgctcgaagaaagcgttggagtcatacaagaagctgttctttccacctgtaacagagatcaagcaacatcaacctccagaacttcaggaggaggttcttgaggggctccgtccaccgtcggggattacagtactttgcatcagggattacggtggtgtgatatacccaagctggttgacaggagacggttgcgacaaggaacaggaacaagatcgcccggcattgcagaatcttatgttctggagttgcaagggatcgagtgatcccccaaagattggtgaattcttcacctgcctgcatacactgtcagttacagactgcagctggaactatttgcctgtcaaattgtgccgcctgaaaacactcagggaattgatcgtccaggagtgtcccaacatgatgacactgcccaagcttccccaatcgctcaagagcattgtaatctctggttgccacccttctcttgcggacacctgtctgacccctggacatccaaattggcgaaggattaagcatatcgatcagcaaataatccgttgattaatcatcttgatatactgcatacggcacagcatttgtggcgacgtccagattagctaaacatagcatccactgcatgtaattgtaagctatcattctgtttcaagttccatctgtacctgtatttattattgttgttgttttaaaaccattggtgcaaatagttttgcacgtctagcatgtaccgcacgggtgtgcagatgaatcatccatgccattgccctcatttctcctgttaatttactactactatcatgaactatcacgcgtttgaataagaattactagatcataggggcctacctacatgtaatttgccagaaaacctgcgtccaaatcttgcaaattttagaccattagatcacaatccaactggtcagatcacatccaaacctncataatcctcttcctatcgttcttcgcccgcatcctttaatttccttccacttgcgttcttcgctcgcgtctactccagagggacagactgatgaggtgtcctcgcccccaccattctccttcgtctccggtgacaagagctaccgcctaacagagttaacaaataatccaggtctatcaggataaacggacaagaatcagatcatactccaagcccttcagttaactttaggaaatccatcacatcttttaatattaattaatcggtcgctctgcataaatccaagctattggaaggttcaacttaaagagaaattgttgttacaatttagcaaactggcgcaaaagaaaaacaaaagactagtgttttacatagcgggataatctacgcgtcatattccgcactagaaaacttgttctcagggtagaacactgcaacaactggatttccaccgaacttccttccatgcattgccgtctttgctttggtggcgccgtccacatctgcatactccaagaaaacctggatggaaaggtcgtacattagaaagattacagacgctcttcaatgtttgtgcgatgcaatacacaagacttacctttccaactccagcaactggtaatccactaggatcagggcgagggatgacaaccttaatcagattacctaaggaagatacttgtgagtaaacaaaagggagaaaacacctaggaagaccaactaaataaacaaaaagtatcaatcgaggcaaaaggaatccgaaaacatgcataaactctcaacgcaagaagatacatatggggttttagcccagcagatgatcaaactaaaccggagtttagaggcaagggaggaaattgcgggtgagaagttggaaattaccatatttgcctgcttccaatctcatgtcctccataatgtcttcatactcctcgtcatcttttaattcatcagccgaaaccacctgggtcaggcacacaacctttgtagggagtgctccaacttgatatacaag

SEQ ID NO: 31848 - DNA, 3770 bp, Oryza sativa
atgcatagccctttgagttaccagtttccctatccttcacaaggtcaaatcctcgaagaggcccaaaggattcaagcaactcccggacttgagcctcagtgaagtaatatggaaggccacccacgaaaatacgatctgggccttctagccctccagctgaaccaggtgttaagccaactgcagcaagattcagattggggcttggctggctggggcccaaggcagctgccagagaagggttatagtctgttggtctcctaaccttcactggagccccttcaaacaaaatgccatccagtgccattgcattgcttgcttcctccacagacctcatttccacaaaagcaaatttcttgtcatggtttatgtagacattaagaacagcgtcacctggaccagcagtatttcctccaatagcagccatgacttgattaaagtatattgcaactgactgcagtaaaggaaactaatgtaacaattccacagtaatatgttgcatgcgggtacacactcgtgcactcccatacggcttttggtttgggtatgggaaatgggcagtaagaaagaatgagtgattaaatacacagacctgttcattagcagttggaggaagtccaccaacataaacacgtctcgcgtgtcgagtagcctgagagaaaaaggtgttaacacattattttgttgacatccttatcaataatagatgcagtagatgtcacaacaactcatacctgttgcgtcattgcttgcggctggataacaaggggattgaactgcttcaaacaaaatttattattacaggcaaataaaaattatttacaaacataaataaaaaaatgattcttttggcacttataatacattaaaatactgacaggttacctgtccaacacccatcgggagcatgtttggaaacattccaggaatagcagtgcccggaaactgacctgcaatttatcaataaatttctagtacagagcataaacaattagcaaggaaaaaaattccaccattagaactgactagttctcaccatcagtctgggtctaaaatagatctagctgttcagtatccaagcctaagaatgaacaaaatatgtgcaaggacaaatataatagacataatgctagcaaccagtaatacttgctagttgaagacgaataagatggtatcaaaccagagcactgattcctccttgtacattaaagctacagtaggcagctcattccattggcagcagtgggggcaagtaacccaagattgccttcttaccatacacatacacaaaacagacaaacaacaaaagaacacaagcaaaaaagttttgctcagtttccagttaccaagtaataataaaatggaaacttacaagttattcacttattcatattagtaactatcacatgaagtgcatctgcagcagataggtgcctgaggggtgcttacggagcccactggttggtattcttttttatcctttaattaaagcaccaatgtctctccaaatgcatcatgtagactactataaaataacaatttgcttgttctcctgtcctcttactattatgtgtagaatgctcaaggccgatcatactaagcaaatattaactgtattggagttctactaggtataacatccagacatatccaccaatttactaggtataacaccaagcatcatcctgctacggcaataatcgaccttaatggactagtaattcaccggtagtttatggcaacggcaataagatagtgtggcattatacagtgataaggatgaagaattatagcggccgaagatataattcattctaaaaaaaatactcatgtacatcaatcatccagcccagcaaaattatttttcttaactccattgttcaaatgtcccactaaaattattattcagaaaaagtgccacaaattgacgaggaaaagaaaaatgaaattgagccgtttaacttagttgatgagagcatacttggggttggaatagcaggaaattgtggaaccacagcttgagctggaggcgccatatcaaatccactaactcgcttgctgctttagaaaaatagtttagtagatattagtggttagtgataaaataaaacttaaaaagtaaagctgaataacacataaaattagcatatttaacaagttataaaccggtcatcaatgagaaccagattaagaagactaagccagtaaaccatactgccatacatattcaaatacgaattgtacatgtctgaatttgataatacacaaagaaaatatcaggaaaataatccatgcagagaaagcatatataaagtatgtccaaaattgctactatatggaataaacaatttaactaaccatgacggaaaacatagtatgtgcacggcagctaaagaagatgcaaatggaagactatgcaaggagcttcctttacatacctttttgaacgagagcgagacctagatctgcgatccctgcccctagaacgagagcgtgagcgagaccgatgcctgcgacgcccatcccgttcatggtctcttctcctgtattaaatataaaccacaagattggtgtgggcatttgactaatcatgtaggcatgtataagacagttgaatagctctaaatctaaaagcatttaacacatttgataaaatgcattcattgcaaggatgcatggtttgtaagaaataaggtgcatataaaacagaactcccttaacaaagaatacctttcagaatcacggcttctgtggcgatcatgatcatcagagcgatctctgtgttctcttctttcacggtgatgcctatggtggcgatcccgatccttgtccctgtccctatccctgtccctttctttgtctctgtctttttccttgtccttgtcccgatctcggtctcttcctcgatctctgtcacggtccctgtggcgttccctgtccttgtctttttctctttctctatctttatctcttggttttgataatccgtcttcacgtgaatgcgtatcgccctggacattcacattacacagagacacaataaatatatatagttcttggcggaaggaaaaaataggtaaacatggaagaattgcgacatgctcccaataaatgcacaatatgagcaatcaaacgaagaaatacctttcatttatcaagcaactttgatggttacattaaatggttgtataattaggaaatatagatgtacatttatagaacataccaaaagttgcacgtgcctattcaattagtttcagagaaagcgaagtgtgacggtaactatttatatgttaaaattttctgattctgagtgcagatggttatttgacaggaaaacattcagagtaattaaaaaaaagggccaacaaaaagactcattactttcctgctttcgtcgatcagccaaaccctcttttccataataaactacataatgctcatcactctcaacacccaatttgaccaaacaagctaatgaacagccagaaacataagtccttggcgtggcgtaacggatcaatactgccggccccactcaaaccacattatcccccaaagcaagcatatccaaaaaccctccttgtatgcaccaatcccacaactccatctcatacctaccgaccatatcttcggcaaacgaatctactgcatgacgccaaggcaacccaaggaggcagtagaatttgacaccaaggagcaccagcacaccaacatgagaacaaccaaatacgcaaaaactcctgccccacgggaggccgtcggctcccccc

SEQ ID NO: 31849 - DNA, 5358 bp, Oryza sativa
  unsure (1)..(5358): unsure at all n locations
nnnnnnnnnnnnnnnnnnnnnnnnnnnnnnnnnnnnnnnnnnctccttcatcgcgtccctgctcgccatcacgttcaacgtgtactacgagaagcttgacctcaagcgcatcaagttcccgctgtacgggctcaccgtcacggcgatcttgggactcggcggcgcctacgccgccgggagctgcagggacagcaggcacaccggctatgttcttggcctgattgtcccggttcttgtctgcatctttctccagtggtttcttgtaggatctaatgccatcagtctcccttttggtaccaggtacgcagtattcatcttcatcatgcatttctaatgccatgcctagcctttttttaattttttttatcttttcttgttacttttttaaaaaaaagtcacaaccgcgcgctccaaacctgaattgcattcaaataatttaacaaaagtctgaaagcaaaacttctttgtccttaataaaaatcattatggtatgattagattcatatttcgaaacattttccaatgatgtcaatttcaagatcatgagcaatataatataaaatacaatggtcaaagtgtaggatatataaaaccacattaggtcaaaaacatacataccctacatttttccttgcttcatgtagtacatttatatgcaggagagagtccaaatatcaccctaaactttgattgaaacaccaggagagaaatcacctttaatatcagttgaaaaccgccattaatcccgattatagcaaccgtgacaaaaaatcgagactaaagatctcgatctgaaccggtactaaagatgtatacccattaattccagttagcaaccgtgacaaaaaaaaatcaagactaaagaaccggtactaacgatgcaaaccaagtcaaaaaaaaaatatgtgggatgtgggaatcaaactcaagatatctcacttcagccctcacgcgtgttacgatcccacctaccttacacatttgacttgaatagagatgatttccttttgaactaactcaggaggcatctttagtaaaaatatcttgaatatgggttggtgttacctactagtactaaaaatacatctttagtaccggttgataatatcaacgggactaaagatccatcagcattaatctcgattggtgctaacaccggtactacagatgtatttttaataccggttgataacaccaaccggtactaaaaatgtttctagggacttgggcttttagaaccggtactaaagagatttagtaacgcttcttaatccatccgaggtatttgtatgtttggggcattggataaaagatgagttctctagtagtaaaagtctatctagcaccctaaacttcgaaaacggacatacaactctctgaactttatagtactatttatataacccgataagatgtttttaatctaatttgtatataagttgaatgagtttgatcacgtgacatatacattagatatacatgctaagatcttcacttaaatatcccttctttaatttgtaccctttattcaatctcacttacaaaatgagtatcaacataataataatatggcaccactatataatataaattgatgtcctactaactaatcatatttaaatatgtatattagttattcaaaaccactcgtttaagccttcaaatatgcaaaaacaccatccaaaaccaccttagagagtaatatacatggtattacaaagtttaggagaatgggtgtttgattttaaagttcaaggtgcttgacggatttccatccaaagtttaggggggtatttgaactttttccttatgtaaagatatatggaaaacgatcatagatttatattgtgtattgtaggaaatgattttacttagaaatatttgaaaactgtaaaactataataaacgagcacatgctcactgagaaccattgataggtaaagaaactggtacggtaaaagaaaaaaaaggtccatggactcaatggtgtcttgctcccaaaagtatgtagacatgagccttacaaaatgagcctatcactagaactatttcactattaacatctatactttattgtaccagttttgcttgaacatgatcatagatccacaaagcacatgctcatcgagaaccattgatctaggcgacatgtttgttctcccttcgaaaggctgatagcaaccgagcacgcatagcgttagtcttgtcctcgagtctatgggttggagtcgccaacttgcagcggagtgcttttttttctttttcctgatcatagtctcttagggctataatcttataatttttttcctgctagtccatgccactgcacccaatgaccttgcttccaatccggactgctcatcagctcaagctcttcacaccttgatgtgttcataatgcccaactacttgtgctccacatcattaaaatgctatcagtcgcctgccaattttattcccttgtttttagcctcgacccgggcatgaggaaattctagcttgctccatcgctgcttatcatcattgaaaaaaaatatttctattcatgctttctacttccatgaagatagctctacgatcatccatgccgctggcatgggcatagaaaggaccagtactaggggggctgtagcatttctaatagtttgagtacatatcaattaagaggaaggaaaagaccttcgtgcccctcaatcaagacctagggagatgtagtgattactgattggagccatttaaggccacatattgggctaaccgaacaaaaattaatttgtttcacattgttaactatcatttcaatcatgatgacatgggggaccgggggggggattgattcggtgagaatttcttgcatttttgtacacattttttgagtgctagaaattcttaattccacatcatcaatttcgagtaccaaaagaattattctagactgcaattgaactatctatttaattgtacaggggaagtaaacaatacaacaatgatctagacaagccttgtgaattaattcagctccttgccattcttgcggcgatcgttgcttaccaagcaggaatagatccacctggaggcgtctgggcagacaatggggctagccacagtggagacccaatactcctgacaacacaccctaggcggtacaaggtcttcttctattttaactcggtggcttttgtggcatccctagtcatcatggtgatgttgcagaatgaatttctagttagaagccatgtactggaggcagccatgatacttgatttgttttgcctcataggcgcgtacgctgtcggaagttgcagggacacaagcacttccatttacacagttgccttggctggtggtgtccttatctatgtggtgattcacattctcttctccacactagaaaagaagtcggacaagcagggtgaggaagacaagataaaggagcatcagttggagaagaagcgtgagttgttgctgcttgttgaaatcttggctgcaacactcacttaccaagccggcttgaccccaccgggtggcttctgggaaaatgatgagtttgggcaccgtgcaggcttccctgtcctactagacaagttccctatccgttacaaggcatttttttattgcaatgcagcaagcttcatggcatccgtggctctcatcattctccttctcaaccgaaatctgtacgggccgggcataaagtgctatgcgctctttgtctgcatggtagcgggcatgttcggcctcatcgatgcctatgctgctggaagttcgatgcatctgcgaacctccatcgttgtcttaatattggttacggtagtttttgcagctgtagtctatgtggcaatcatcggtcgtggacaacgtgcaaacataaatcaacatcagtcaaaacaaacacaaaatcaacaaaccaacaaggaagatggcatgatggacacaccaagacaaacacaagatcaacaggaagctgacatgaaaaagaaagccgacatgatggccaagtacttaatgctagcaggaatattggctgcgagtgtggcctacctcacgggcctaaaaccacctggtggcctgtggagggatgaaggtaatgggcactctgctggcaacccggtcctctacgacatcgacaagcgtcggtacaatgcttttttctatagcaactccacttccttcatggcatccatcactgtcattgttttgctgcttcgaaggatgaccaagggcgatgaacataaattgcctctttggccaatgcacacagccatgttgctggacatgcttgccctcctgggagcctacgcggcaggcagtactcggaattggtgcacattcaaggatgccatcctgcttctcttacctgtgttgggctttgttgttattcttttcttctggaagaaaggaggtgaagaaaaacatgatggctccaaatagaatcctactatcaagtctggccctgaacatgcttaaaactgatctagtgtcgaatgtctcatatgacgttcttatatagcggcggattaattacacaggtccatattttcaagaatatatacaatagctgcttttgcttgatttaagctttctgaagttggagtccaaggtgtgtgttgagatgtcgagttgtttgctcccatatgtattctttgttggtctataagagaaaactgaataaaagactttctagatgttattatatggagccaaagtcacatatcgagtcgtctatagatctccccatactgtaaatggtatatttcatgggtatgtatgtcaataatgaagaatccttgtactaccaagtcacaaataaatggaatttatggagttgccttaagtcgataattcatttcaaactttggttacatgttatgtttatgtattgggtatcgatatttgaaaatgatatgagtattatttttctatgtttgaaaatgatcttgaaatacagtttgataaaagtattattttcctatgtttgtaaactattattatgaaacaagaagtactagctaagagctgcagagacaatgtggcacatgttggcgggtccgaggtggcgttgtggggtgggagaggaggtcaaggaggtggtggtcaattgacatggataggacaagaaaacgggcggtgttatgttcttgatgtgcccctttgacaaaacagttgccatgcccgctcccatcccatcaccagaaggcacaagtaggggaaaaactgtccacaccgctgcagctggccatcattacactgccccatcccattgccaagctgccctccacatcccatcatcgatggatgagcatgagtagagtggagagtagtcgccagcaactgctctcagacatccccaaattccatg

SEQ ID NO: 31850 - DNA, 7721 bp, Oryza sativa
ctatgcatggaagcccatatccgtccgtaacacaaccgatgttgttccaccaccgtcacactttgatgcagccgcctccaccaccgtcgtggacgccctcgcggtcaccaaaccgtctggcctcttgcagacaccatctcatggctaggtgcggaggcctagatccggctgcgacctggcgacaggggtcccaccaccggtccggttttttccactatgcctggcgtcccaccaccactacacctcatcgcctctgtcaccgccaccatcctgggctcccgcgcagccgcctctgccttcgccaccactggggaagccagcgcaaccggcgtcccaccaccaccacacctcatcgcctctgtcaccgccaccatcctgggctcctgcgcagctgcctctgccttcgccaccactggggaagccaacgcaaccgggtcggctcccgcagctcgctgcttgtcggttgcccaacaagagagggagaagaccctgccgctaccatccttgcaaccacacgatttccaatggcccgctcaggcggtagagagggaggaggaggcaaggaggcgggtggtgttgtggcagcctgaatcaccaccattgttgccccaagcagaaagacacgggggccaatatcttttctggtaggaatttactgttagtaattgatatcataggtatctctaatggttaataacgtacacaatgtttagagattctgaccaaattgttattggcttatatggtacaagatgcatgaaaaggatagaagacgatataaagtaaagttttgcctactaaaaatgtagggatcggatatgggtgtagaattgacctgcaggcataatgaatataacactatagatgaattttaaatcagatctatgatagtttaaattctgatataaaaaaaatactagagtaaaagaaagtagaggggagaatgcttccgatcctttatcattttacactcccgctctcttgtttctccttctatagacccttgtcatctatcaatgccaatcagacccggagcccgggaaagatttcctctgctttcaccattatttcagctgtcttctctgctccttctcttctacggagtagtatttagcgtgcacccaaatccccaccactgcctcttgctccggcgtggtcaatgagagctacttcctccatcccataaaaaaaccaacctagtaccggatacacatcatccagatttataggaatatgaaatatcatatccggtcctagattcttttttataggacgaagggagtaagttgctgtcgccggcggccggcctcgacgttggggtacaggttggcggttgttagggagccggaagcgaacatgtgaatcatagactttgatctgactcatcaaaacagatctgcagagtttgataggactcatctctctctactggtctactctgaaaatagagttgtcctcctccatgagcatcgtacctttctaagaaaaaaccgtctaaaaactgtctatccaagcatatgtacatgttttcacaagccaaatgaaaactagtgctttcacggcccatgaaaaaagcaagtgttttcacgaaaagaaaagtgaaaagtgaaataatcactaccaaaaaaaaaacacctcatgcaagaaatagtacgtgtttgcaagacccacttaaaaaaagagaaaattggaaccatgccattataattttgcaaaattggaaccatgccatcctaacccacatgtcattgactcatgtgggtcctacatgtcattgagataccgatggcatatctcaaactttgcaaaattataatggcatggttccaaattaccccttaaaaaattactaatgttttcattcacgacccaccagctgaaaaaccacgtaggaaaaactgtcataaaaccgtttgtccatattttgtcattaagggcctgtttggtacaactctagctccagctccacctctcctggagctggagctcagccaaacagtttcagtttcacccaaactggaagtgtagttgggtggagctctctcacaaaataaactagagttgtgacgctggctttagacagctccacaactctactctagactcaactcctgaagttaaatcttcaaattcagttttaacgcatggcagtatggcactctagtcaaaaggaaagaaattttgtatttcgtcattgaatcttcagatcccgttgaaacacacgggcatggcaatatagcactagtcaaaaggaaagaaatttacattgaaacgcaagaagcacgaaggttagctacggacgaaatcctggtgtgactatttggaaaaatcctaagcattcaataaaagtaagactcctacctgcataagtttccgagtcttatgctgtgtatattctttgggtgtagagaccgatttaatccattattaaaaaaaaatttccgagtctttctgtttttcaatgattcctttcgtctcgaactcgatctaattcacatctacaaattaatcgatttgtggatgagatgcgttgatctaattatggtcaaaacctacggtctgagctagggctgaaaagaaagcaattaatgggcttttggcccgaatccaaggaagcattttcataaactttttcaattataatgtataatgataatgatatcccaatgtttcaatttattacttagctcatagtagctattatatcactgaaaaacatctttatctgttgcaacacacgtcatttttctatacatctatacctatatgtctagttaaaaaatacgtaaggcttccacaacttattttttcgtccgtcatcgtctctgagccagcccattcggcctttttctcacactccctttttctctccctcttgggccttcatctctctttctcttggactttcctcctccggccgaaagtcatctccttttcctccccgccttggcttgctcccccctccatccctcggcctggctgtgtttgggctcggcccagccatcgctcatcctagcctttttcaccgcgcgcgtctcgattcgccgcttgttcttctctcttgacataattctagagccgccgccacatcaatctgtctcctcatatgtttcctctttcaattgtaaaaatcgattcctcacccctcacttatcatttccccatgatttttctttttaatttggcttaaattcaccaaattaatttctgtttaactgtcgccaatgatggcccggcgatgagctaccccgtccgtttttatctcaagttttgcggaattgaatacggattcgcttcgatattgaaacggaccaagagcgaatgtgcataaaatccagtgagagatgaaacagaggcggatctatattgaaaaaaaaaatccaaagtttcctacctgcatacgtttccgatcgagacgttctatatttcagtgattccttccgtatcgaactcgttctaattcccatcaatctacaaaattaatctatccgtggatgagacgcatcatatcgataactcatcgtcgtcgtcctcctccgatctgtttgtctaggttccgtggcaggtacagcttgttgtacccatgggtcaaaccacttccaagtctgccggcgacggtaagcccaaacccaaaaccacctcggcggcggcagcggcggcggccgtcgtgagcgagacagcaaccgggtcgatgaccatgaggatcgccggctactctcaaaccaaggggatcggcgtcggcaacagcatcaactccagcaagttccacgccggaggccacacctggtacatagcctactaccccgacggcgaccgcgaggagtactccgactgggtctccgtctacctctgcctcgcccggccagctgccggcgccgcggccgacgacgtcgtcgaagcgaaattcacgctcagtctactcagcgggacgtacggtgcggtggtcgaagagaagatctgcacggccaagaaattctccttcgccaatggctactggcaaagttgggggcatacaagattcatcaagaggaagaagatggacagtcgattgtggtcgtgtctacatctagacggtcaaagtttctatatcagatgtaatatcaccatggatattatccgctgtgagcgggccaccacgacggtggcggtgccaccgcgggacctgcaccggcacctcgccgccctcctcggcagcggggtgggggccgacgtgcgcatcagggtcggcggcaagctgttcgcggcgcacaagaacgtgctcgcggcacggtcgccggtgttcatggcggagctcttcggcaataatggcgggaaagatcagaaggaggcgaaggctgctgctgcggcaactggcaatggcgttattcggattgatgatatggatttgagggtgtttcgggccatgcttcagttcatctacaccgataccctgcctaagatcgacaagggagacacggcgttcatggctcagaatctgctcgtcgcggctcataggtatgggattgagaggctcaagtcgatcagcgtcgacatgatacgcaaaggtgcatagatgatctacagacgcaacaactacaatgatgctagcacagtatggttgccacggttaaaggagagatgcttcatttaaactaatatgtgtttattcttgtatttaaattaggtccatttgaactaataaatttatatgcatgcatatgggtacgtcattttgtagttaacgtgttttataagaccaatttatcatactttcatttgtcttttgaggatcagtttgaaatattgaatcattttttagaaaacgatgaagagtaggtcgtgggatcactttcggccgtgtggcaccatgtattcgagtttagactttagacattaagcaggacactgctcattcatttaactaggaagtacgcatatatagtttacaaaatatctgctatattgttatgtatgagatgaaagaacacaggaaacaaaaaatacaacaatatctcgagaactattcgaacaataggtgaccaaaagctattatgggcttagggaggctaggcccaacagctggcccattaaggcccatagtactgttgatgggcgtgaacagagtctgcattgcagtgatgtcatcaccaggaacccacatattatgtttgggtttaggaagaacaaaaaatactagtgacactgcacgtcagtagtagcctctagagatcgctatatttagtgtgtccccagtgcattttttttctgaaattttcattacaaaacttttatctggaaaattttgttctaaaatcattcatcttttatatataaaagtttgtgcttagaaggcacgtgtatcaaacagtagttccaatactctaattaattgtctttgttaatcctcttagaccggactgagtgtttgatggcatttttgcagcggctagaacgatgaacctgatagccatgatcattaggtatatgtgaggccagctagctctccatttcatgtgtgcatgcgccatgcaaatatagaaatacacactgtgcccaatctatacttgttaattagtatatatatgcgtgtgtatactgaatcaagagcaagctagctatgtcagtcggccggtgaagcaactacgtacatgcatgcatgcatgcatgcatggcagtacacaaatatatggtgcttgattaagggtgaggtgattaatgggcttaattaagaaatttaatgcgcctgcccctgggcttagcccatatcaatgaatgacacaatcacggcgtattatacatatccacagttttgatttatcggctagatgagtttacttatcgatcaaattagagagataagctggggtttcaatttatctgaacaacttctgctcacgcgtgcggaagagataaaaccagatgaattaagagataaccaacaaaccaattgattctatctttgtaacaaacttgatcgagttagttacttctcgcgagcgctggcgaggcgcttatcaccggactgtggcccagcagcagagaaacaaagcaaattacaaatcaagtttatctctattgattgtttcttatctacagaaataatgatgaaggaatcgccacccagctgcgcacgcgcgggcggctgggcctccatctccccgatgctccagaagttaacagagctcagatatttgacaccgggagaggctaagagataaaataaaagaaggatatgaacaaataacaaactgatcgatcgagccttatctgcaacgaacttgacgcggacgaaacggcgcgcggacgcggcgagcaccgaccttaggcccctatataaggcgtcgacccctcggcagcctggggcattgacgaacttatccacaaattgatccaccaacgcattcagtatccacaagccacccatcatcaacgcatctgcccatccagcatcaacacatccatccatcaactctcatcggcgatccatccatcgaagacacgcaccggcggcggcgagcgacttcggccggagtcccgacgtctggcaggagagggcgcgcgcggtgatccgatcattagcaagcgcaggagaggagcttgatggctagtcaaggtaaaagctagcaagattgtttcgttttctttcatctacagcacgcacacatccatgcatagggatccatctgcacgtatcgtcgtcgccggggaagtcgcggtggccgattcatctacgcgtcacagaagcctcatcgatgccggcgtctgttcgagctgacgctgtgctacttgtccctggactcgacgctgctaattcaagctgctggtgatgcatctacccgaagctgcgacctcgccgagatgccggacgtccttgatttgcaagcttcaccgcactggagcgggctaaccatggaggaggtcatcgggaagccgccctgccggagcgcgccgaggatcgccggagctgccaccgactgccaagatttctatccattcccatgccggaggtcaagtatcacgcatggcgtcgaaaccagcggatgacgatggagacaagtatggctgcagtacgaaggaaggacgacgggaggacggcgagccagtgctgttggatggcaacaagctagctaatgcatgttgattaagttaattattgtggcaacgtggccaaccaatcggaggacgacatgtcatcactgctacagtgccatgcacaaaccaatgcgtgggctgaagaagtcctattggtttttcttattcgtcccaaatgagatgccgagctttgattaaatccgggtaccgtctacatcaaccatctttaataatttctccctttcctaatctaatctcgacgcaactgctgtgacgtcaagtcgttcgagctacgcaactccatgcatgttgttcaagaccgacgaggctagacgacggagggcgggcgaagtcgatacgaaggccacgctaccaacaccggcgcacggaccgacgaggctgtggatcgctgccggcgctcgcacacacacatctacatcatcatcccaaccatgcatggagaacgcgaagcgaagacgacgagacgaccacaagcagcttaatcggaggttctcttgcaggcctagacttgcggaggtaattaactgggagcttttcgaggccccaggaaccaggagaccacatcgcacaagtcagatctgtccaatgacagattatggaggggatcctctagagtcgacctgcaggca

SEQ ID NO: 31851 - DNA, 8853 bp, Oryza sativa
  unsure (1)..(8853): unsure at all n locations
nnnnnnnnnnnnnnnnnnnnnnnnnnnnnnnctgctgtgacgtcaagtcgttcgagctacgcaactccatgcatgttgttcaagaccgacgaggctagacgacggagggcgggcgaagtcgatacgaaggccacgctaccaacaccggcgcacggaccgacgaggctgtggatcgctgccggcgctcgcacacacacatctacatcatcatcccaaccatgcatggagaacgcgaagcgaagacgacgagacgaccacaagcagcttaatcggaggttctcttgcaggcctagacttgcggaggtaattaactgggagcttttcgaggccccaggaaccaggagaccacatcgcacaagtcagatctgtccaatgacagattatggagcgcgcatacatatatattacattgggaatttgtatttatgatcttttaagattaataaagagcatgttctctatgttttgtttacattgtgtatttaggtacactggcacgcccgcacatatatgtatctctaaacaaacgagatcttagacgttattttccaccctaaacactgagtgtattactttgtgcagcacacgaataaatgacttgtatgttttgtgggcggttaatttgacttcgatgttcagtaccttgtgggctgtagagatttgggagcatagttttcataccttggccctgtttgaaggttgtagatgaaggctgtagagatgttcagtgccttgtgggctgtagatgaaggttaaaaattagtgcacacaaaacgagctcgttattagcacataactaatcaagttttaattgctctaaatttaaaattttggatttacttgataatttaaagcaacttatatatttaaagtttttttacacgaaacacaccgttttaatattttgaaaagagtactaacaacagcggaaaaaaaatccaacaccttatccagaaaaggacacatattgtataggctttcggagtaagaaaagcaaaatgaaaccaaaacacacggggttccacggttatggtgaaactatctatggtcacagccatgatggtggagacggagttatatacttgcttccttcgtcatctcgtaaaagtagtatatatagtattgaatacgaaacattctaatattacgaattcaaataattatatttagatttatggtattaaaatatatcatgttcagaatgggacattagaaagcatgatttaacatgtcaaccaccttctaaattaatttcaacgtgtgggcccatgcatttacgttcagtctggccttgtactatacattgcacccgctccatgaaagtgatagcagtgacttgtccacacaggtcgtcgctgcctcgatctgcttaacatgcgaccctgtctttggaatgcaagagattcagagaaaccttacgcttacgcgtgaggcagcatagctagccatgattctcaccgtcctgctcatccttggctgctgcttcttcttcttgccgatgcctatggtcgccgcccagccctggatgatctgcggcagcagcaaatacacggcgaacagcatctaccaatccaacctcgacagccttctctcctcatcattccttgtcgtaagcggcgactccagcagcggcgccctattcgccaagggctcccgcggcgccgccccggacaccgtctacgccgtcgcgctctgccgcggcgacgcgaacgcctctgcctgcagcggctgcgtcgacgccgcgtacgcggccgcgacggcgcggctctgcccgctcagcaaggacgccgccgtcttctacgacgagtgcgccctccgcttctccgacgaggacatcctcaacatggacgccttcggccgtgtcaacacctcggccgcagttggcgtcgcgccgctcgtcctgatgaacatcacgtcggagcccatgttatccggctggaacaccaacatccaggggacaaaaaacttcacccaattcttcatcaagacgatgaattacatagtagcacaagctctctccacgacgaagcactacgctgcaatccgcgtggacatggatgatgccgatgcaagcaacaccgttacccttccaaggaggctcttctgcttggcacagtgtgctccagatttggttgaagatatctgctacaactgtcttcagaatttcagcgatctggcgacggccaacttcgccggtcggcaagggggacgtattcttgctctccggtgtaatctgaggtatgacacggataagttcttcgccggtgagccgacgtggagctccgggtcgtcgtcgaatgcactagttccaagtccagcgccacagcccgccccattactgccaacatggccaaaacaaaagagtaagcaaaacacgcccttctttgacatctttgcgtagagactatctttacttaagcacctccatcacaaaatataacaatttagtattagataggagacacacacatatatcctattacttacattgaatctggacaatccctttatccagattcataatcgttgtagtactaggttgtgtcacattcagttctaattttgctatatttgagagtagtagtaattaaagataaaaattactttcattatctccttaccaagcttccaacaaaacaaactaaccatttgctctgaatctatagagcccgtagcaaaagttttggtccctgctttggtagctccactacttgcattgtttctctgtatcatcgcttccatcatattgagaaggcacataaaaggtcagatatatatctacataaaaaaagttacatacatgcatgaatgcataaagagctaaatcaactgatattatcaaaccaattctacatttatcaggtaagacgaacgcggatgaagatgaagcactaatttgggggctacaaggaagaagttcagaattcactatttatgacttttcgcaagtattagaggccacagataatttctcagaagaaaataaacttgggcaaggaggctttggtcctgtatacaaggtacataagacgaaaaatctgacaaaagttatacacatatattattcgttaatttacatggagtattatgcaattcactctctgctttggccgattatatcttgatcataatatttgtcaagtgtcaaaagtcaattgaaactgcaaattaactcgtgtcactcatccatctcttttgcacttgtctctagggccgatttcctgatggggtggagatagcagttaagagacttgcttctcattcagggcaaggcttgacagagttcaaaaatgaaatccaactcatagctaagctccagcacacaaatcttgttaggctcttgggatgctgttaccagggacaggagaaaatactaatatatgaatatttgccaaataaaagcttggatttcttcatttttggtattacttcttgctgtaccgtaccgcaaataaaagatttggttcactaactctaactgcgaaatgtatattctttgttatatctatgttgaattgatttgcagatgaaacaagaagagctttgatagattggcataaacgcctagcgataatagatgggatagcacaaggacttctgtatttgcataagcattctcggttgcgtgtcatacacagagatctcaaagcaggcaatattctcttggaccgtgaaatgaaccctaaaattgcagattttgggcttgcaaaaatatttagcgtgaatgataatgaagggaatacaaaaaggatcgttggaacatagtaagattttattataaaattcattagctgtacacaaaactgccaatactgttacctcacttcaatgttttgtatgtgcatcttttcagtggttatatggctcctgagtatgcttctgagggccttttttcaatcaaatccgacgtattcagtttcggtgtgctaattcttgagattgtcagtgggaaaaagacatcaagttttcatcgatatggtgaatttattaatcttcttggccatgtaagttttcatcatataataatgacttgagtttctaatcttcctaaaatgcaaagcgaaaagatttcagtagtatataaaattaaagtcttttttcgtacttcttcgatagaagaaatactaatgtcatgtagattgttttcatgttttttgcgatcatacaccttgcaggcatggcagatgtggaaagatgaaacatggcttcaactcgtagacccattgttacccaccgattctcatacaatagagataatgagatgtattaacattgctttgctttgtgtgcaagagaatgcggccgatcggcccaccacgtcagaggttgttgcaatgctaagcaacgagactatgaccctacctgagcctaagcaccctgcatttttcaacatgaggctgacgaacgaagaggcgtcaactgttattgcggcatctagtgttaacggtatcacattatctgctatagatggcagatagtgttcaattctcttgctcgaggtcatgtgagaatgttttgtatttgtacatttttccattcaagagctttcttttcatttctaaaattataaatcaatatactcccatcatcccagaataagttaatttagtacgggatatgtgatacatgccgtactagattaacttattatagggcaggggtagtatataagaacaatacaatggcaatgttaggcgtgtgtcgtgtgtaggcaaacacaactgcacgaataatgcaccaacatcactagcaaactaagaaccaacacctaggatcatcatgtgtgccagtttatagaaaaattggcaccagtacacttcaccatgacacaaaattaccggcaaatgtctaccgctaaaaattatgaattcattggcaaattaccatagaacacaactcttttcgtctctatatatgtaatcacgctcgctagctgcagggatgagagcaagtcttcaagtcctcctattaaattaattattatcatcgatcgtgcgccaaatgactcggtggtgtactcaagtctgtattgcaagattgtccatatgttggagtgtttgtgtatatatatatcattatcatcatcagcagcagcagtgatagaaagcagaagtgtcaaggataaccctgtgcggcaccgtacgtgccgttaactccacaagtctttcgtccagagtcttctctatagctacatgcatggcctccggccacatggtttgcctagcaaacataattgcccatttgaacgatcgatcacatctggccaatttggcttagggcctatttagttcccaaacaaattttttcatattgtcacatcgaatatttaaacacatatatgaagtattaaatatagataaaaaaccaattacgcagttgccgggaaattgcgagatgaatcttttaagcctaattacgccatgatttgacaatgtggtgctacagtaaatatttgctaatgacaggttaatcatgcttaataaattaatctcgcggttttctggcggaatctgtaatttgttttgttatcagattatgtttaatacttcaaatgtgtgtccgtatatccgatgtgacaactaacctaaattttttccccaactaaacaaggccttagccggccccgtgttgtggtgttcgtgtctatcgcatcgacaataatattggaacaccaccgccatgaaactgtaacaaagtaattggacagactgttcaattacattattcatcactattatctaaaagaatttgaatgtatttttaccagacaaacttggagtctaatctgccatttccaaaatctaacccctataactacaccccatccccatgatgttgaaacttggtggaatggaaccaaccatgtgggaagcaaagttcaaatgcagggtatcagaggcacactactaactactttggtggaatatttggctagaaagaaacagaagaatttttcaaaattcttgcctctcagtaaatgaagtagcataccttatcaaacaagatatggatttgtgcaaaatagcttttaagccccccctgattttattttcttcttaagctgtatttcctctttgttatagtccatgtaaactctgtaaactctttgctgggtttcggccttttccctaatttaaattccggcagatctcctaccgtcgttctcctaaaaaaattctaaaagaatttacattattcactagccactatgtggtaatagaacattcatttcactcacagatactctaacaatccaggggctagtgacaaactggaccacctattagcaacttgccccatccaatgaagagcttgattgtctatatgagtggtgggagatgctctctacttgtcaatgcgtaaccaaggagaaaggacttcgcacatgcacttagggacgaatcctgaataagattagagggacactcatctcctttctccttcaaccattcattatcttcctcctctacctcttctccccctttccctctccttctatcaatagagatctagcggggtaggggggattcaatcggtaagtctccctagcatccacgctggattcgcctgtacatgccattgtccttctatgtgtatgttcgattggtcttactgccacaactgttgtagctatggtggttgtaaagagctaccggctgcaactgttttgaactgccttagtttcagccgctgatcggcagttagcgctgttgatcagatccctagtcatttggaaaatatgaaaattaaagaaagaaattagagagcctttgaacagaaggagaatttaacgatcgatccttttggaaaaaacaaagaagaatctagtacgtggatgtttgtgaggtgaagcgcctgcatgagctcatcatcctctctatatagccatatgtctttatttttgtcgcacctagaaggtgtaatttttatcttttacgatccgatggttctcgacgcatctctctagatgtgcccagctcacgaaatagacaagtttggctgctcgctcgcttctcctcctcgagatggacgatgctcctctgaatttgtgcagtttatagttgcaccactgatatgtaagccataatgaagtgaggtgcatatgttcagtgactacacaaggtaagaggatccacttaccctcgagacggttttgacttttgagtctatgtcctctctcgccttctgtcctcaatgcctcactctaattagtccccggtccactaaaatataggcccttaaaatatgaatgggccattatctcgactcattaaaacgaggcggagtgaagaaatacattcacgtgaatttagtgggccgggcacaaactgatcacaccgaaggcctatgcatgtgaatgggccagatatatatgggcccattaggaggtggtgattttggccaggcccaacaggttaattagcgggttctaataattgtggttaaagttcacttcaaaacaaaatctgcgacgactgaagcttttctcacagccggactatacgtttccgaagtatcgcgaggtcgttcttgtaattcccatataatccgtgcaaatatgtgctattgaaaatcgaaaatgctatacacacgacgaatttgtgcgactatcgtacgactagtcgacagcgtcatctgtgagcgtgagctgtttacttagtgggctgtgattgttgggccttttaaaagcccaactccagccgaagctccgtattccggcgtcgattcctcttctcgatattactctatacacagtcgtgacttttcatcttctgcattttctttctcaccgtaaaccctcattctaatcccctttgtctcctatccataacaatcagttaagattaatcggaaaatttttttgcggcaaccacaacagagtatccacgttgaagctaacagaaaggtatgagaaagttgttgatttatttttgcctgacattttaggctctggttttctaggcccgatgagcaattctattaattttctcaattcgtttttcaacatctcttgtttttccatgcttgcaaacacatacatgaccatatttgatttgcttttaaaatcgatttaattttccttgccaaattaaggtaatggacaccaatctatgttctgatgatgagcaagaagatcatatcatatcagatgaagatggctttgcaattgaggaggttgagagtgattcaaatgctctggtagcagataaaaccaaactgttggagccaaccaaaggtatgctatttgatagtgaggatagtgccacttgcttttacattaagttatgctcgaaagttaggattcggtgtgataaaaagaggatctaagaaaactgaggatggcaaggtgagatatttcacacttgcttgtagcagacaaggtaaggcacagtacacatcaacaaataaattcaagcctaacccctccacaaggcagcagtgcccagctaaagttaacttttatcttcatgatgagaaattctgcattagtacgcttactcttgaccataatcatgttgtaagtcctagcaaagcaagacatctcagatgtcacaagaaacttgatttgcaagctaagagaaggctagagttgaatgaccaagcaagaattcgtataaacaagaattttagttctctagttatgcaagctggaggctatgagaatcttcaatttggtgaaaaggagtgcagaaattatttgcaagatgtacgaaagcttaagcttggtgctggagatgcacatgcagtttatcagtatttcctgcgtatgacgtccaaagatccaaactttttctatgtcatggacgtggatgaggactctcgactaaaaaatgttttatgggtggatgcaag

SEQ ID NO: 31852 - DNA, 676 bp, Oryza sativa
  unsure (1)..(676): unsure at all n locations
agggctacctatgaatctttttcagatgttgtgacatttgacactacgtacttgactaacaagtaccatatgccatttgctccttttgtcggtgtaaatcatcacggggaatcagttctattaggatgtgctctgctatcaaatgaagaaactgagacttttgtttggttattcagatcatggttatcatgtatgtcaaataaagcaccaaacgccataattaccgatcagtgcagagcaatgcaaaatgctattatggaagtatttcctgaagctcgacacagatggtgtttgtggcatatcatgaagaagattcctgaaaaacttggtgggtacttagaatatgaagttattagctctacattgtctaatgtggtgtatgattcattaaacagagatgattttgataagggatggatgaaaatgattgatgaatttagcttacaggataatgaatggcttgctgggttatatgataacagggaattatgggtgccggcttatgtgaaagacacattttgggctggaatgtcttcgtcgcaaaggagtgagagtgtgaatgccttctttgatggttatgttaatgctagaaccacacttaagcaatttgtggagcaatatgacaatgcactaagagacaaagtannnnnnnnnnnnnnnnnnnnnnnnnnnnnnn

SEQ ID NO: 31853 - DNA, 646 bp, Oryza sativa
cctattatgccgtcgttgttgggcgtctacgtcttcaccgactggcttgccttccccgccgccgactggtgtttccccctgcacggctggcctttatgcccgccgctgttgggcgtctacgtcttcaccgaccggcttgccttcgccgccgccgactggtgtttccgcctgcacggctggcctattatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgctgccgccgactggtgtttccgcctgcacggctggcctttatgccgctgttgttgggcgtccaccccttcaccgaccgggcttgcctttcccgacgcccgaactgggggttccgccctgcacggctagcctattatgcccgctgttgttggggcgtccaacgctttcaccgaccgggctggccttcgccggcgccgactggggtttccgcctgcacggctagcctattatgccgctgttgctgggcgtccacgtcttcaccgaccggcttgccttcgccgcccccgactgggtttccccctgcacggctggcctattatgcc

SEQ ID NO: 31854 - DNA, 927 bp, Oryza sativa
taaggttaacacaaacaatcgtgatataggtttatgatttttttttataggatacagcaggagaggctcctactgtggtttaggtttttatccttatgctcatcatactagacatcctgcctgttgttttaggtgttggtgctaggagtggtgaaattttgattaaacctaaaactaaagacactgtttaaatttgctagcatcatgacttctttaaatgcatcatcttctaaatctgatgttgtgattgcaaaactgcctgttgctactcctgttgctaagtcatctgtttctgtttttgcttctaatcaacgtgagaaatacacctgttcgttttgtggtaaagatggacatcttgtcagtttctgttttagacttgctagaaaacagaaaaaggaacgtgaaattgcttttgcgaaaaagaagtggcaaaaatcaggttctatttcgaggcaggcggtcagaccacagtagaactggcggtcagaccgacgctctactaccgatcagaccggcgatagacctatggttagaccgcaggtgtctcagtgatcagaccgacctcgggaaattttttctaacaggaaacgggttgaattttcttctggttatgctcctgttggttctggtcgtgtgtctcagtactggattcctaaatttttattatctaaccccagtactgaggcttcgacttctgcttgtgtgtaggcatttttggtgaggatggagaacgtgtggattgtggactccggttgtatgcagcacatgaccagtgattctccttcctcaagaaggcgtcaaggagggactcgatcatcttcggtgatgcttctactagttcgataacaactactggttctgtcaaggtaagtgacaagtttacattgaatgatgtcactttggttgagaatttgaaatataatttgc

SEQ ID NO: 31855 - DNA, 573 bp, Oryza sativa
gctggcggagatcgcccgagaggtggaggaggagcgagaggccgcccttgtcgccaccaccgcgatgattgaggcgcaggactccctccgccttcaacacgggagctgggaggcggagctgaagaacaagctcgacgccgcccaaggggttcttgactccgctgctgcccgagagcggcgggcaacggaagccgaagcggcgtcccggcggcgcgaggaggcccttgaggcccgtgccatggcgctggaagaacacgccggcaccgtggagaagggcttcacggaccgcgaggccgccactgctctccgggagacgacgctggcggcgcacgaggccgcctgcgccgaggaggagtccgcgctccgccttcgcgaggatgcactcgctgagcgggagcgagctctcgaggaggccgaggccacgacgcaacggctggcgaacagcctctccctccgcgaggcggcgcaagaggagcaggcgcgccgcagccttgaatgcgtccgtgccgagagagccgcgctggagcagcgggctgccaactcgaggcacgggagaaagagctggccgcgagg

SEQ ID NO: 31856 - DNA, 814 bp, Oryza sativa
agaagacgcccgctccatcacctccggagacgggtgaaaaatccatgaaatgaacgccggaggtacggtcttgcacgtcggacttgaaatgacgccgccctcgccaataggtaaattggtatgtatcctcatatttattttcaccaatttgatttctgcatcatcaaagcatgtttgaatttctcaaaatttgcatttaggtttgaattttgaggcaaatattcaaaatgaatttttcagagcaaaattttcaatcaaaatttagtttgccacgaccacactggccgttggaacccaacggttaaaagtggggccggttgggcccactaggggttcggccgaaccggccaggcaacggtcggccgccacttttggcagaccaacggctagtgggacccacatgacagtttcgaccgttgttggtgccctatataagccaaccggtcgagagagaggaatccaccccatttcaactcattttcatttcctctccaactttgctctcaaaatccatttcaagttttgcaagcttgtctcaaaatcaaacactttagttgcatacacaagttgtttcgttgaagctaaccggtgggtagaacttcttgctatcctaacccccgccgagttagtccattcttatttgtgcagaacgaggcgatggttgtcccgtctgttcaagaagggatctggctcttcatcgggaacgaccaccgacatatcgatggaagacaccgacataccgacaagcctcttgaccgacaccaacctcaaccttatcggtgatcaggaattacaagcctaccatatgctgaag

SEQ ID NO: 31857 - DNA, 4278 bp, Oryza sativa
  unsure (1)..(4278): unsure at all n locations
taaaaatgataacttttaaatggagattaaatctagtgattaaagggaaattgaaagggaaaatgatggagaatagtttgagggagtagtgcagaattgatttttgtaatcaattggagaagggaacgcatggagagacagatcgacatgctggcgatgctagggtttggcccgacgaccaaaaaaccggctagcaacgaaaataacttatggaaaaaacccggaaaaaagaagacaagaaaaaagtggatgggaaaaaaagggaaaacggagaaaaaagatggacggaaaaaaaagggaaaaacgaaaaaaagacggactaaaaaaggcaacgaataaaaagcgggtgaaaaaaaaggaaaataaggggaaaaaagactgacaaaaaacccgaaagccttacctaaatgccagtgcgtcacactgggtaaaattttccctacatgtgcgggatgtgaatgatgccctttgacatgttgtctggatggttgcaacgttggaagaacgttcggaagaaacaatgcgattgtgtttgcacagaaagcgacggatggaaattttatgtgatgaacggaaatattgatatcttttaagtaggtaagtctaaaaaaaataaatggaattttgtggtaatttatccactttaactatgagaatatagtatgtgttgatacctgaagaaaatacgtggagttaaaccgacgacacacgtcagaattgtgaaaattggtgttattcgtttgcattttatttttcttttttgaaacctttataactttttttgttaaaatttatggtttttttctcattaaatattgaagttaagaattgatggtttttatgttaatattaaaaaagtaaaatagcaaggagatcataccaaattctgttgcacacagggtttcccaaaccgccggggacggggttaccgtgccccgacggtaagcacggttaccgcgcggtaaccgtggcaaaccatacgaaaccatgcaaaatttatcaaaatttcaaattattttttaaatttatttgaatttaaggagattaccgtggtttttctattaccactgtaaccatggtcaccggtggttttgcaaacccttgttgcacactaccagcctgaccaggtgccagctctcattttcttgacagccactctctctttctccatgtcttcctctgtctctctctccctcatctatatctatagagcaaccaaatattcagttagcaatttatgttgagcaaccgaataatcagacattatacccgcaccaatgcaattcccagaagatttagctacacagattatactattcatgaatactataaagtcggtacgcatattctaagattggaataaagcacctgaattatataaagaagattattctattgaaagtagaagttttacaaaagaagaggaaaagatacaagagactttaccgaactccttttgaaggctccgaggactannnnnnnnnnnnnnnnnnnnnnnnnnnnnnnnnctagcactatactaacactaaacttgtagagaacctttgatctttgctgggaatgaatgagaggaggagctatttataggccatgagttgcatttgggagagtggagatgctccaagcatccaaggagcatattctccttagcttcatctccttgtgacatgtgtccagcgatggtttcttcagtttaactggtcataaccgtcttgggacatggataactaccagctggtgaagaattaggctaattgggctagctactggttcagccgaactaggcccaatcagcccacaactttgcaggtggacttcttgttgattcatcaatccagtgatgtgaattattgggcttgtttactcgtgcgtattttgtgttattggcccatcttttcacaagtttgcttctcgatagctttcgagtgatcgttcgtttgctttctgtcgattctcctctatttatatgtgcttctcctgcgtatatgttagtagcatagtacatagtggaaatagacattttatttggaatttatgcattgcaagcatagctagtcttcagtaattgggaaatattgacggtcgaaattggttgataacgactgtcaacaaaccccccaagcttaaacctttgctcgtcccgagtaaaggacgaaaggaaacaaagacttggttgttgatcaggagttgctactatggtgtatatctagaatgtagaagtgcacagtttgagtactctctctcatgttaagtaaatatgcatagtggcttacccttatgcctaacatttgtggaacacacgcttctcaccaccttaggcaattgagagatagaacagatcatagagcaccattttctttttccttgctcagttttcatcccggatgggtttcaaggatttttgcaaataaaaactatgttcctcaaatgattctcttgatcactcaaagtgtatagatattttattcctcacgaaagataatgccctatttgaatcctactctaaggttgaatatgtggagcttggttgggatcaaatgaggcatacttgtattctcataaattactaagtcaaaaatctagactaaagcagatagcaaatcatacttagatcaagatcatgcaaagtgtgtggaatgtgtggtggaaaataaaatttggataaagaaaatgcttctcctttgtgcttatacttctcctccaaattatcctttgtttttcatggagagggtatggctatatattttcatcacgctccatattttgatagagcaagactttattcatcatttttttatagccacacctttctctccctttttcttttctttttgcaaaagatttttctttggagaagaatgcatgaatggagagctttatttgtcgatgatgacatggatatgagtgagatgaatgctaacttccagtgtagaagcttagcatgtgtgcatatgtgggtgtatgatcttgttcataaagtatgaaagatatctacacaagtcacaaaatttgacaaagttcaatggaactacaagtaaccaaatattatataaggttttcaagtgcaaattatatttggctgtggtaggaataaatatatcaaatgaggaactttgaaatttatcattttgaaaaacaaatcatccaaaatttaaatcaagcttggatcaagatttaagcaactctatttcactatatcatatctcacaacagcttaggcttaaatcacgcagtgtgcaactcacatctctcaggttcccggataatggttggctaatcattatttaaaacttgagagagtacttaactatgtacagatacattagagatataaagcagagcaaatattcatcatttcaatgtggagaactaggttttcttacctagcatggtaaaatctatcctatatttttggtattttatattttgcaaatttttatgtttttgagttataaatgcaaatgcaagaattgaaacatgcaagaaaggaaatatgcaagataaatgcagatacaagtcacctttgcgggggagagacttctccccccaagcttgctccttgctcatggtccagagtaagcattgaatccttgatggcggaagtaggcttgcagatcagcttgttgttgttgcatcatattgttgatatttgagaactgtgcatcaacactttgctgctactcctgcgcctggatcacgtgtccttcgagggactgttgtcccagcgagaggaactcgagcaccaccagctggaggttggaggcacgccacttgagcctgctgagttggtgtgcccccagcgcacctcatgaggcatctgccactaggaactgccggcactcggctaggcagatcctccagtgctatgacgtagggcttgggcccagccggaggcatctctagctgatttccagccactctcataagcatgaccgggtggtgagtacgttgaatcctcctgttcatctgctgccattctgcggttactcctatgtgtcgcacctgcacgggattcctctatcgtctgcaggggaatggttagtgcataacagttatacaaatgataccccgggttaggtaacaggatttcatttctacaaccgggttggaagaatactaaggtcacatctgctccatgtttcaaagtatgaccttgcactagttatgattcatttatataaacacgagagactgagatataagcaatttgatcatttgtaataaccccaagccctcttgctatacaagtgatcaaagaagtgcattttataggagcgg

SEQ ID NO: 31858 - DNA, 4168 bp, Oryza sativa
gtgatcaaagaagtgcattttataggagcggagacctctatgctctctacccactgcctaatcatgggttgcacaggagaaactctaatctaatgaaccatggcatatataataatcatctcattatcatgaacaggtctaggatctcctctaggaaacaaagtcatggcaatccatttatgtataagtctaagagttggattatggatgtcattggttctgggtttcaacccattgttttccagataacaccaaaatccacatccatacctgttttccggagtagctcaggatcgtatgctcgggtgtgagcgaacgatcggttcttcaacatctggtaggtttgcttctctcgtctgtcgacgaggtcgaggtcgtcatctgtcaggagctgtgaagcatcgtccgtgtcctccatcgacatgtcggcggacgaacgatcactcgcattatcggatcgggagccagatcccttaagcaagcgagagagccgtctcctcatgactgcacaaaagcaaggatacaaagcgaactcgagcgggggttagtacaagataaaatacccgccggttagctttgtaccaacagcgacttgcaaatgtagcgaataaaggattttaaatataagacgagcttgcaccagcctggaatgaatttgagagcaaaatagaaatgagaaggagtaaaaattgagttggcatgagatgaactccttctaccggccatcccttttttatagtgcacctccaacggctataattgtgacacggacccactaaccattggtgtgcaaaagaagggaggtgactattgcctgttgacggtcgtcatcgatcagttacatccgtcaatattaccggaataaatgaagaactagttatgcttgcaatgcatttagtgtcataataaaataaaaaccactagcacttggttcactaaccctttgcagagaatgagccataaatggagaagaatcggcatcaaaacaagcgaataatcaatcggacgatgtcgagaaacagaattgtgtgtagatgggccagaaactcagaattgacacgatcaatttgggccaaaattcacaagtctacaaagagcagaagcaaaggagcccgccagccgaaaatgggctggtttggcctagcccagggttcggccgaacctccctcacggccgttcgatccaagtggacggcttggatcactccccaatgacggttagagggcaatcctgacaattccaactgccataaccgtcattggcagcctatttaaggcattcactccctccatttcttcacacactccaagcatcgaagctctcactctctctcaagtttagtttagtgttcttaagctagtggagtaggaatagaatagtagtcggagtctggaagtctttggaagagttcgggtatggcctctagtagctttcctttcttcttttgcaagactagtatttaatttagaatattcctctatatacgactctagtattgtaatattttccgaatatatgaataccagctttacaatatgtccgagatattatgattatactgctagcttttctaggagatgcattggtacgggtataatgtttgcatatgcaattactctatgtcatgacgatgatattagagtagtatctgggtagtttagacgtgggtgtctagattactagggtatcattatttgggggttatatgctgcggatgaaaggtgggccgctgatggtgacagctcgctacgggtattcccccctgcgtgtatataatcctaagttaattccctggggagggtactcctccgtatttagccctggttgtatggtccatgacgggctgtcgtaagggaactcggcggtcaggggtggcttctcgaagtaccaggagggcatcagaaagggggtaatagctagttaatcatatatttaggatgtatgtacactatgtatactagaagtataggaatagattcttttctatattctttccacttagcttagagatttaatataggaatgagtagcttgagcttgtgtgtcattctaccctggaattatctttaccccttcttaggcacgactagtacaagtaacatataaatattagtttagttctctctattataatcttcccacgggataaacaaatacgatacccttggaaaactctcaggtgaaatgctacaatggtatatccgtgcgcttgcggataatctctgtaaccataatataccttgactatttctggcgccactgctgggaattatatttctagtaatgtcgttaggaaataccaacaagcatttctggcgccgttgctggggaagatttataagaagagattcctaaaactaatatcttatatttacctctgtatagtcaatatcctttgcaggttaaccttgttgttttcaccctttgttgtgaaaatagggtagtgtataattgtttttgacctgccggaaaacttccaggaaaatccataagtcttcttctgaagcataaaactgcgggttgttcccccgcagaagactcttccgacaaagaagccaaacgtactagcgccaccaactttcaagaccatggctgacaagactcttcgcgagttcgctgctccctcctctaagaatgtggccactgggccgcagctcaatttgggagacatggactttgatctgaagtccagcctcattacgatggcgcaggctagcccattctgtcgcaagccgaacgaggatgctaatgcacacctgcaacaatttctggagatttgcagcacgtacactgtgaagggcgtcagtcctgatatcgtcaggctgaggctgttcccattttccctcctcgggaaagcgaagaagtgattctatgccaatcgtgctgtgataaactcttgggaaaaatgttcgacagcattcttgtcaaagttcttcccgatgggcaagattaatgcccttcgtgggtgaatttcgggcttctagcagatgcggggatgagtccattccggaagcatgggaacgtttgcaggaatacgtggccgtctgtcctcatcatggaatgtacgactggctgatcctgcaaaagttttacaatggactcactcccacgtcccgcaaccacctggatgcggcagctggaggagctttcttctctaagatggtcagaggagccatcgacctcatagagaagatagtctctaacatgggttggagcgaggaacggctccaatcccgtcagcgaggaatgcacactgccaaggagacggaaatactcgctgcaaaactcgacctcctaatgaaacgacttgacgaacacgacaagaagccccaatgcaccgtcaaggccttggactcgcacatcacgtgctaagtctgtggcaacacgggacattctgggaatgactgcccagagacccatgaagaggcgatgtacatgggtaacaacaacaacaacgggtaccacccgcaaggaggtcaggggtggaaccagccccgtccgtatttccaagaaggcaataaccaagctaactactgacgcacttaataaaaagatggttgctaatgacaagatcttagaaaatataaatgtgaaactagatggctttgcttccgcattccaaaaccagctaagtttcaatgaaatgattgaaacccagttggcacaattagctgctctagttcctacaaatgaatctgggaggattccggggcaacccgaaccctccatagaaaatgttaaggcgatcacgacgaggggaggtaagtccacttgcgatccgccataccctaacaatgcaggtactagcagcaacagcagggaaacaccgtctgacgcagcggctgaagaagaaattcagccagaaaagaccgtgccgcagcattactgcgacacgaggttgctgccattcccccagaggatgaggaagccgtcagtggacgagcagttcgctcgtttcattgaggtgatctagaagattcacatcaacgtccgttgttggacgctatgcaagtgccaacatatgcacgttatctcaaagacatcctcaacaacaagtgaccactaccgacgaccgaggtggtcaagctgacagaggaatgcagcaacgcgatcctccacaaactcccggagaagaagaaaagattcgggggtgtcccacaatcacttg

SEQ ID NO: 31859 - DNA, 995 bp, Oryza sativa
gcaggtcgactctagaggatccccctcttcatcgggaacgaccaccgacatatcgatggaagacaccgacataccgacaagccttttgaccgacaccaacctcaaccttatcggtgatcaggaattacaagcctaccatatgctgaaggaccggaagttcagccacactcgggcgtacgatccggaacttctgaggaaaacaggtatggatagtgattttcatgccatttggaatgctgtaatttggcagagatttgcagtagtagatgaaccaggttctcatttgcttaatatacaatttctgtgcactttgaaagaatcagaagatggcatatcctttcttttttccgtaaagagtatacgctttcatggaaaggattaagtacacttcttggttttcacgataactgtaaaaccgatcttcagaaaggaattcccgggttcaagaaaaacagattttgggaagacatttctggtgctccaacttgcagacgtcctaggacaaatgacatccataatcctacacttagacttatgcacaaatggattgctatgactttgtgtagacccccatttttataacaggaatcaatcgtgtaaatagtaccatttccctggatcaagtagtctggtacacacgaattcatagctaaaataccaagtgcacatacacgagtgtctaatacgaattattacatcataagcccgcaggcatagtcttaaatcatcggaccgagcggtccggaatacatccaaaagcagaaatagataaggcagcggaattcaggcagcggcatgccattgccacaggcaacaaccgtactaagacctactgagcgccatcgtcttcatctccctcctggtagtaggcatagggatcctccgaggcttcatctcccgcttctgattaattttatatttgcaagggtgagtaccaaccgtactcagcaagccatcatagcaatgatgcacatgacagaggaattcaaaggatg

SEQ ID NO: 31860 - DNA, 2227 bp, Oryza sativa
cccctctgtccaccatccattgtgatcccaaggatagcttcccgccattgagtcgttatggttttctgaggacgtccacattcccgcctcttaggaagtggctccatcagcataaaaattcatcatgcaatatcccatcccacacaagttaagaatttagagtctagccaagtgtaatacatgtcccggtgctcaataaccgcgagcacggctattcgaatagatttggtttactcacactgcagtggatgtacactttacccgcactccgcgactacccaacacatgagcctcgtcccaacacatgagacacgtcacggcaaagcttttcgataacctcgcattggcagtacccgctccatgaacttaaatcctcatgcactctaggcgtccatgtttctagcagtgagaggagttctggcgctcccggggaaagagaagtctcacacgcatattaaattatggttcaagttaagttctctctctcacacactcatggcagtcctaccaatggcaacaccgatatagggcacgcctctcggccctacctcaacggctgtcccatcgtagcgcacctgcctcaatcaggggtgaaccatctatgcagggatactgcctccacttggctatctaatctgctaggtctatacccattcgagaagtacggttgtacggggggtcgtttcatgcttaacttcatggctcggtccttaattgactagggacggtactagccttttccagataccacccaaatcctccgtccgccccagtcgaaaacagttgttttaattttatttctcctttcacaaatcatgtcatcaacatcatggcaatgtggcgctcatgtctccacatgccgcatctcaattaccttcccgaaggtaattgcccaagcatatagcatttgataaatatgagtatgcatgattctacaatagcatttctaagcaattgtcatagttgactagggactcatacgtaagcatggttacaaagatttaagggtaaacaataatcaaggcatggcataatcacaagtaggatgttcattatttcatgcaatttttatttgtaaacaaaacaatttcgtaattaggatcaacatgttcgaggaatagtgatgacttgccttgctcagagtcttgcaggtctcggccttcgcttggatccgcaactccctcgggctctatagttacgtgcaaaaattgatttgaattcggttagaattcaaataaaaatccaaataaatccaaatgaaagtcgaatgtgaaagtcgattcctttttattaactttactatctgcgaactacggcaaacccaatttcgacttaaactattttgcgggcataaatattttgttgtcataagtttttaatttactcttcccgagcattatatccatataataggttagaaatttctattaagagctaaatatcggaggaaatcctagaaatattatacaatttaatttattctatgactaaacgattaaatataatatgcggctaagattcttagtaattaaattcgaatttctaccgtgaaccgatgacttatagagattaccaaaaataatctataataatctataagaattcatctaattgtttagttattaattatatctaaattactaccaattttaatctaatctgatcaagaaacatattttataattaactcggaatttcgatcgaaatactattacgctcgaagaatttccaaaaataatctatgattaaccccgaccatttttatttcctaaatcctcctaatttctcccccaatttcccttctattttctccttttcttcttttctattttcccaatttttctctcctctttttcttttactctcttttctctccctctctttctttttctctcttttctctccctctctttctttttccctgccggcctctcttttctttttcttttctttttttttccttctcttctctcctcccggctcctttctttcttcccttctcttcctctatcctctttcggctccttctcctcctctctctcgtcctgccttccgcgcccggctgaggaaaggaaaaaggcggcggcggcatggcttaccggcggcaacggcaatggcggcggcgcacggtggctgcgacggcggcggcgctcggcgactgcgacggcggcggggaacgcggctcggcccaggcgcggcgcggcagctctatgcgacgactcggcgg

SEQ ID NO: 31861 - DNA, 823 bp, Oryza sativa
cggcgacgggatggcgacggcgacggcccggcaaaggtggcgcgcggcacaggcggcgatgggatgcacgcgcagcgcggggcgggacgcgacggcgacggcgcggccgcggcgatgagatggcgatggcgacggtggcgcggcggcaggcgacgagggcgacggcgcgcggcggctagcgacgatggcgacggtgcgcggcggctcggggcgcgaggcggcaacgcgcggtgacggtggcgacagagacagggggaaaaaggaggagctgggttaggggaccccgtcgaacactttaggtgcaatgaacagtgccgttttctaattaacccgattttagtgtaatttccgtataaatttgattccacaattcttaattttgcatatatgcattttactcaatatttgtgttatcttaactaatgaattcaccctagattaatattactcatattttatttttatgtaatttatttgagttttaattagggttaattcttattccatcgtatttaaatttaattgatccaaatatggtcgcgataatattttatttatttctatcccacctaatctttattttgtatttattttaccaatttgtttttaaggtttattcctaattaactattctttactcacgattaataatcttcgatatcaaattcagataaaatagacgaataagatcggcatgatgtaattagtttaaaaagtttttgaaaatccgtatttttagagttttgattttgtcggtcgaattttcagggtgttacactttgtttcctagaggtgatctttgacccattcaaggagatgaatt

SEQ ID NO: 31862 - DNA, 2112 bp, Oryza sativa
agtcatagcaatccatttgggcatgagcctaagtgtaggattatagatatcattcgtcctaggtttcttgcaaattggagcaccagaaatatcttcccaaaacctatttttctcgaacccagaaattcctttctggagatcgattttacaggtatcgtgaaaaccaagaagtgtgcttaggcctttccatgtaagtgtaaactcctcatggaaaaagcaaaaggaaattccatcttccatttctttcaaagtgcacagaaattgcaaagtaagcaaatgagaaccaggctcatataccacagcaaatttctgccaaccaacagctttccaaatagaacgaaattcagtatccatacctatctttttcagcaactccagtgagtactctcgcgtgtgagcatactcccggtcggccagcatgtagtaggcttgtctctcccgatcaccgacaaggtcaaggtcagcgtcgttcaggagttgtcgtggagcttcggcttcttccatcatgatatcggctgatgaacgagtactagactcgtcatgatgacttgatgaagagccggatcccttgaacagacgagacaatcgcctcctcattctgcacaatggagcaaaaacggactaactcggcgggggttaggaatgacaaagatttcacctaccggttagtttcaccaaagcaacttgtatatatgtaactaagtattcgaatttgagggaaactatcaaagcttgaatgaatttgagagcaaactttgtagagggaatgaaaatgtattgaaatggggtggaattccctctctcggccgactggctcttatagggtacccacaacggtcaaaaatgacatgtgggacccactagccgttaccctgccaaaagtggcagggaaccgttacctggccggttcaaccgaacccttggtgggcccaaccggccccactttcggctgttggattccaacggttagtgtggtcatggcacagtgcatttcgtggaaaattttattttggtttgctctgaaaaattcatttgaagaatttcctcaaaattcaaaagtcctaaatgcaattttgaaaatcaaatatgtgatgatgaaaaattcaaatttgttgaaagcaaacatgcggatacataccaatttacctgttggcgaaggtcgcgtcatttaaagtccgacgtgcaagactgtacctccttccaattcagttcatggattttccactcgtctccggaggtgatggagcgggcgtctttggcttctccctccacaccttctttggcttaggtggggatggcggcttcttctgagccagctgctctaacttcttagccggtattggtggttttaccggtagcctccagtaacggttcctaggcatcgttgtttccttctccaggaaattctgcatgaatttcactaggctgtccgtcttgggtggctccacttcgacctcttcaatattctgcgggttcggcccgtactttattctgaccatggagcattgttccgtcctcggttggaacttaaacttcttctccttcccattgatatggaatcggatactccccgttcccacgtcaatattggctcccgcgatgctaaggaacggacgccccaggatgagcggcgtcacctttcccgactccatgttcagcaccacgaaatcaaccgggatgaagaaatcccgtatcttgactggcacatcctccgctatccctgccgggtaacggactaacgagtcagccagttgtaggcgcatcggtgttggtgccaacaccatgaagttgagcttgtcgaaaacgtcctttggcatgacgctaacgctggctccaaggtcgcacaagacctggtcgaattgctgtgccccgatcgagcaggtgatcatgggacaccccgaatatttcttctccgggagcttgtggagtatgatgttgctgtattgtttcgtcagcttgaccacctccgttattgggagcagtctcttgttgttgagtatatcctttaaataacgggcgtatgttggcacctgcatagcgtccaacaatggcacattgatgtggattttctggattacttcaacaaaatgagcaaattgctcgtccactgac

SEQ ID NO: 31863 - DNA, 1484 bp, Oryza sativa
tcggtcgtccatcccatgatgaggacaggcggccgcatactcctgcagacgttcctacgcttccggaatagactcgtccctcgtttgctggaaacttgaaattcgtccacgaagggcgttggttttgctcattggaagaatttcgaaaggaatgccgtagagcatttgtcccaggtgttgacagcagcacggttggcatagaatcactgcttcgctctcccgagaagggagaacggaaacagccttagcctgacggcgtcgggactgacgcccttgatggtgtacgtgctacaaatctccaggaactgttgcagatgagcattggcatcctcattaggcttgccacagaacgggctagcctgcgccatcgtgatgaggctagacttcaagtccacgtctcccatgttgatccgcggcccaatggccacattgtcagcagagggagcagtgaactcgcggtgagtcttgctagccatagtcttgaagattggtggcactgatacggctggtttatctgtcggtagagttttctgcggagcaacgactcgcggtcggacgctccggaagaaagcttctggattttctttgaagttttccggcaggttgaaaccagtcatgcactaccctgtttccacaacaaaagtgaaaacaaccaaggttagcctgcaaaggaaaatgattatatagaggcaaatataaaatattagttcaagtaatctctattatgaatcttccccggcacgggcgccaaaaatgcttgttggtatttcttaacgatattactacaaatataattcccagcaatggcacataaatagttctggtatattatggttacagagttcatccataagtgcacagatataccattgtagcatttcacccgagagtattccaagggtatcgtatttattttattccgtgggaagatcatgtagagagaactagactaataatttatacattgcttgtgataatcatattctaagtaggggttaagataattcaagggtagagtgacacacaagcattaatactcaatctcataatatattatctaagctaggtgggaagaaaagagaaagataatctattcctatacttctaatatacatagtatacatacatcctagttaaccgatatactagctaataccctctttccaatgccctcccgtgttgatgtagaaacacgaggcctgggagatctgcttaactccagtgcaggtccaaaaagcttgcctttaggttcgcaggcgtgccagttgatttgatactgcaatcaacaagaaataaagacaaagaaaacgcagttaaaccgtaaatgatagccgatctgccagccgccgatgacgtatcatttatctttgagccgatgtcatctttgcatctttgcatcgatccgcagtcatgaataaataaggaaggactaaatctattcgatcggctgtaattattaacaatatataatctttatgtcgata

SEQ ID NO: 31864 - DNA, 739 bp, Oryza sativa
ggaagtttggcgctctcttcgatttctacctcaacgagtgtagctttccatgaggaccggaagctactcactcttatattaaatctctaagctaagtggaaagagtattgaaaagaatctattcctatacttctagtatacatagtgtacatacatcctaagtaatatgattaactagctaataccccctttccgatgccatcctggtagttcaagaagccacccctgactgccgagttcctttggacagcccttcatgaccatacaaccggggctaaatacggaggagtaccctccccagggaatgaacttaggattttatacacgcgcggaggaatacccgcactgagctgtcaccatcagcggcccacattcatccgcagcatataaccccaaataatgatacccagtaatctaagcaccacgcctaaactaccaaatattactctaatatcaccatcgtgacatagagtatttgcatatgcaaacattatacccgtaccaatgcatctcctagataagctagcagtataatcataatatctcggacatagtgtaaagctggtatttatataatcggaaagtattacaattccatagtcgtatacagaagaatattctaaattaaatactagtcttacaaaagaacaaaggaaagtacctagagccataccggaactcttccgaagacttccggactccgcctactattctgttcttactccactagcttgagagc

SEQ ID NO: 31865 - DNA, 845 bp, Oryza sativa
cagctgtaatggtaattatctcggaatattcttgttcagtacattaattatcctctggctatattagcatggagttcttccagctagcactgaaagtagtggtctagctaatcctgttttgagcctcactcctcttaataatttccaatatgagagctcctcctctcatatccattgttatgagaatggcaacggggtcttccagctagcaccatgtcacaccctgaaaatcataaatatataaattgttgtttaattggaatttttagaaataattttaaaagccttgaagagaagatctagttttaattaataaattccaatataaaatggggccagataaaatttcattaaatactttgcttaattctataattcctagatttttctgggatttatttgagctaaggaagtatttttaataaatggaattgcatttcataaataatttaaattgaaaaaggttttaaaaaaagtctcttttggctttgggccgaaagtcggcccaaaacccttctctctctccccggcccaagtcggcccagtccgcgcccgagccgccgctctcctctctctctcgctgtcgctgacaggtggggcccgcctgtcagatcgtcgtctacctccggccgccgccgcccgaaaccctagtttcgcgccgccgcggttcccttccaaattcgatcgatcctttcggtttccggccgaattgatagaggggaaacaatcttcgggatctcctctaccttttctcttttggaaacatcggctaaatcggtttggaaatcgttggattcgaagtcgaatcggatcggcttttctctctccgagcccgacctttcctt

SEQ ID NO: 31866 - DNA, 758 bp, Oryza sativa
taaaatttaaatgaagaaattcgcaaatattcatttaaagaggatataacggcaaatgaccatagcttggccatttgaactcggaattgggccgtgcaaatctctaatttttccttaagaagtcaagaacccatttttgtgctttgttcctgcttgttatatggagtttatcagagtaaaagccttttcttttccgttggtcatgtagacgctgcagcttcggaagatccgctcttcgtggaggttgaagccgacgtttgggaaagcgagcaaggcaagtcacatcatccttgaacatattgaatcccagtttataaaattattttgatttaaattattgcattaccgctttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctgattaattaggcaacattaggtggttttataactctagactttgggaatattctcaccacctggacactatggaatagttggattattgtggaattggattcacacgtccccctctattcaaaaccctcaaaatggttttaggctgggctcggggtgcatggttttgatagtagcacctcggccatatataggacccggcttggggcctttggtgcaaagcactaccgtactt

SEQ ID NO: 31867 - DNA, 1240 bp, Oryza sativa
gaccctcatcagtcttaatcttatcaatggaaattaattaatattgtagactagctcgtgaccgccaatgcaaattaccaagcgcttaatgtggaaatgggataagggcagggttttcaatttcgaaattaaatattatacttgggggttaccgaaattttggaaattttgagccaaaattatttgaaaatttgactgtatttgaataaaatttgaccaaattcaaaaacattgcaaaaaaccaaaaattttgggcgagatttgagcatgctggtggggggctgaaatttcagaaatttcgaaccgaaatttcaaaccctatataatggcgaggcgcccatgttttcttccgcatcgggcacccgttgggaagtgttttgacattcgatcaggacaccagacatgaaaagtgacacaatgtgagaagaaatttagagggaaacatatactatgtacattagtttttcatgcacaccaactaacaaataacaaatgccactaagaaattttagaaaaaattggacatatgctttaaatagtattgcatctatatgtgaaatctgatatttaaattcatttttagtcataacaaaagagacaaaattttgacatattttactcttaaaactgccagattgttcacttttttattacattgttttgcgatagtgctgtaatatttcttggtccatcgtttctttagctgcaattctgcaaatgcaacgcaattgaagcatcatgaaccactcaaattaaacaacacgcacagagaaaacgcacatgcagtgttagggtaaacaatcagtttaaatgtttgaaaaattctgggtaggatagctttcgttgggttcaatgcttacctgcgtagcaggagaaggtggaggacatgatcagaagaagcatcaaaaccgccgcgatggagtaggacatcctcttggtagctgccattaggagattaatgaagaaacaggctccgatcgagctgttattgtacagtatacagtaagtatgtatatatatatatatatatatatgtatgtatatatatatatatatatatatatatgtatgtatatatatatgtatgtatatatatgtatgtatatatatgtgtatgtatatacatatatgtatacatatatatatatatatatatgtatatatatatatatatgtatatatatatatgtgcgcctgctctgtttcccaatgcgctcattgttgggcacctttgctcatg

SEQ ID NO: 31868 - DNA, 18006 bp, Oryza sativa
gtgtaaggctgtgtttagattcaaagtttggatccaaacttcagtcatttttcatcacatcaacctgtcatacacacacaatttttcaatcacattatctttaatttcaaccaaaatccaaactttgtgttaaactaaacacagcctaaggtttctttgctgtcatttcaaatgttccagcattaaatgccccttatatctttgtacagttaattgttgtcatttttgttttggatatacacgtatttatatatgacaatagatctcttcagatgtgcaaaattttgaacagaaaaaagtttaattgggccgacaagcgttggcttgtcctgttaggcctgcaagcattatgtatgcatgatcggttcatgactactcgcccatgaaaggagtatgcatgcttccccaatgtttcggtataaatagatcagtgaatataaggtaactatgctatgttaattaagaaatgtacgctctgactttaataattttatgcgagatatgtgacgtcttatatgtatatggcgagagattggagtgaaacaaattataggaactatacaatgctagcaaggtatcatgtataaacagttaatttgctaataggtaacttaggatagaaaatagtaacataagtatagaatctggcactcgtaattatattccaagttacaacaacctctaattcttcatgttgttttcagccagcacagtttcccaccaagcgactcgcatgagcttgttcaacttttgctaaatattataaaaatttattattcggggttatatgtgttctaataaattatatagcactttgcaaatttattcatagtaagtcatgtagtatatatactaacctaattttatgattcttaattataagatgtaagagggaatctttagtccaggcttaggctcttacaaacaaaaaaaatcatagagattaatccttcaaaatccaaatcctttgtttttactccaaaccgaataactccaaaagtttatcattgtttacatgtcctgcagctatagattaattacccaattttagagatgaatcatcaattgaagcttaaataatataacactatatatattctaaaacaaagcagtttcattaagaacaatccaacttaattcctttattaatttggggatactctagcatttatatgcaggcatgcatccttgcaaaatctaagaacaacctcagacattattttccattcaaaataaccgtatgaagtttcttgattatgttaactcttaattaaacctcagacattattttccattcaaaataaccgtatgaagtttcttatttacgttaactcttaattattccccccagctgtaccaatttaattgggccagagcagtatctcaaatatgtggtcggccaaatttagttgagctgagaaacgctggctgatcttgtcatgtctctatttctaatctatggattatttgggccgcaagggaatacggttgtcaaagcatgtttgcacgtgtaacgtcgcgcttttagccagacgttagaaactaattcggcaaaatcataatttcaaaaatttggttctttgtgtgcgagtctaagtcgtgccgtggatctcaattcaaatcccgttgttccctctcatcgccatcaaaatccccctcctcaaaatgtcaattctgattcaactcccaatgtcaaacaccgaaattcaatcccgtccttgaactccttgccaatatttctcttggttctgagaataccaaatccccgtttggaattccttcgtcaactcctccctctcatccaaatcccaaatcccgaagtccaaatatcaaatttgaaattcaaacctaaactccaatactctccaaattcaatctttgtcaaagtctatttcgcctcccttgtcaatgggctgttcctctctcccggcccatcccctcctctcggcccagctctctcctgcgcgtgcaccggacgtgctcggagcgagcgagagagcgccgtcttctctttcccctctgtctcgctcgttctctctcctctctcaccggcgccgatttcccgccaccgccatccgaacctccaccgccttcgtcactccggcaccaaatcccccgcccgtcgccattcaatttttggccgcgccagccgctccttgcacgcgcgccatgccgcctggtcgccgccgcgtcagccctgacgccgcccatgccctgttgccgcgtcgtcggttgtattcttgggctgttctgagctgcaacctaagttaaggtaaataagtcctctatttattttaaggattgcgatgaatcataattgtcaccgtgggtaccagcgctatgtcctgggactggtactgagatcatggtttcgtaggaagcggttcgcactgtttttcctacgacacgctcctgtcaggtaccgttgtacagcggtatcagattgggtgtgacagcacgatcacacaattttgtagcagaatgcatgatatgatgatctatacatgcttgattaaataaccggttcactcctaacacacaaatgggatgaagggaagaatgcatgcttctcccaaaatctcagtataaatacgttaaggaatgtagagtagctattgtatgtcacaattaccttatatgtaagattattaaataaggactaacccaagcagtcacgtgtgcggtcgggagtgagatattggggtagaacaaaattaaatggccatgtctatccttaattattgatttgatcatacttataacttagaacaaacataattgttgtgaaataatcaatatcttttagaaataattatccatacactcgcatgtattctattcctgatggatctatcacatttaacactagaaaatttatttaattctatagaagatatgatcaatgatgccatgtcagttaccatcttcatctggtcttatgtttgtgtaccacaattattaattatacttatttgtgttacaaagcacttaatttgaatatgaaatcaactacatgcacacattttacttgggctagaatggtgtcatgacacatatgtgggcgccaaaatttagttgggctgagaagcgctgacaggtcttgttacacttctagtagttctctaagtattgggctgcaagggatcggaacatccctgtaaatgcatgtatgcatgatcacacaattttgtagccgaatgcatgatcccatgatctaatcatgcatgcatgatcaccagcatcagtgacggcaacgcccatggatgtgcttgctgcctctgcaaattaagctctgctgcctcctaacatccaaatttagttgggccggaaaagtgataacacaagtgttgaaggctccctcttaacatcgaagcgttggttgattgatatgcagttctacacatgttaggctagaatgggattggttgcatcctgacctgatggccgatacactactcctaaagaagcagatcgttcttcttttgacctttatcgatagatattagcttagctagcatattatatctctccatataaatacgtaagtatataatcatagaaagctctacatgacaccaaaatagtgtaaattggttttaattaaacatgtgtctgccccgcaaaaaaaaattaaacatgtgtctgagtaatattgttttgaggtgaaatattagagtgaaacatattaggatacccatgtctgggttttgtagttggttattattggtatttgttacagttaccaataaatccaagtgtatgaataccgctgcaacactccacctaacagtatttcaaggatatcgaataatagatgtgtatatctacaaacatgattctaccatacaaatggtaggcttaaactagaggggattcctatgaattaattaactaagcttaaactaaataaaaatctatcaattggtgtccagttcatccctggtctaccaagagatctatgtaagtaaacgtggggatagaagggatgatggacatggttgtcacacctgctgtctatcatactttccgtggagagtcacgtagatattaatttaagtgcctacctcactataaatttggcgtctatgtggcaccttctgtctgccgtacttactttccgttgagagccacgtagctattaatttaactgcctacctcactataaatttggcgtctatgtgacattgttcatcgtgctatatgtctatgagagaatatgattagaaaaataaataaaagaactcaacagaacccacatgttatgattagcttaaataaaaataatattgtagaacctagtaggccagcggcagagggtaatcgatcacttgagcaccgccgtgggatgttgcttccccattatcgcaccactagcctactgaccgcatcgctgaaactgtcctctgtgccgagctcgagacggtaagagctcgagccttagccaacgcaggggaggacgcggcgacaatgatggggacgatggtggatgaccaccgttgtcatcgcacgagccgatgatggagcaggactagccacctctagggctaggctggccagcactaagctaaggtgccctccttgctctctcccgttgtgtcattgccagctggtcatgcatgtgccagaaggcatagcagctccgatccctcatcatcgccgatcactctggccaggtcaggcggtgatctcggtggagggtgcatcactcttgttctcgtattacctcttagcaaaagtgtactgaagcatctaggtgcataaggacgactgcccaaccatgcaattgatctagtagctcttgaattaaccggaacttacgtcgatgacacgttagcacaggttttctggtcacaaaggacaaaattaccattcaatctatcgggggagtttcgatagcggaaggagtctccctatctgattttagggttgagaaatgtgatttaaactggggctataggtgagaaaggtaaaatggacggtttcctttgcagaggcagcgatcaaatacaagcggcaaactcaatctctctcattttctttttcccaagagaacacggtccgcctcggtttccaaatttagttgggccggaatggtgcaatagtgaacgcttgcgggcgctgggccctaaaatcttacttgggccgacgttcagtgggacacagaggccgcatgaaagtccggctgatctggttgggccttgtagtcgtacggctcattatgagttgcattgggtcgaaacgagatttgcaaaccaattctccatttaattaacccttttttttgtgttctctccgaaggaagtaataaaagaggaagagaagaaaattttgatattcgttgcagttctgttcagagtaaatggaagagacaaaatcgatgcagatcctgaatgtgatttcagctatatcatccctgttttgcactgttttcttttcttattttgaatcttttctgaatacgcatgcaaatcaacctttgcgaccagctcgcgtgatacacaaacacacgattacaatgttaggaaacttgttctcaaggcgcaaaacttaccgtgacagaattgcatgatggagagatgctacttaatttgatgtctaaatcgaaacctcttacacaacaatcttgctctactagcttctcttacacaacaatcttgctctactagctagtgtattatatatagaacatgttggtgagagaattttatgtttgctatcagtatgtaatactcttgggagattcgaggaaaacaaaatatgcatctcgtactctaaacctcactattgcattgttctccacttatattattcatgtagtaacatctgatatgttatttaccacagcgaaattctcttttcaagtcagtgatgtaaaaacatctaatctgttagttgccacggcggaattctcttataaagttgactaggaaaaatacccgtgcgttgcaatgggtgttgactagaaaaaatggccgtgcgttgcaacgggtaaagacgtttcttcaatgatacaacatatatgagtagttgagcaataaattaaaacattagggccactatacattataattaaaactaaggataaacggccagtcggccatcatcaacgatgaagattaaatctaataaattaaagctgaattgaaaagagaaatcgtgaaaaaaataatgaggaaaaactaatccacttttgcaattaattggaggagaaaacacacggaaagacatattgatgtggcagcgggacatattgacgtggcagcggtgctaagatttggcccggtgacggcgggaggctcgcacacggatgggaaaataaacgaagcgtgattggaacaaatatcccaccaaaacaaggacaaaaaaaaatccaacccattctaaggaaacaaaaacaccatataccatgtctgcacaattaaattctcttggaacatctccccttgcctaagcaaagagggaaacatgagtttgactgatcttacattttcaaacaaacaacggtgataacctctttaatttcatcataaaccccgagataaggactgcatatgaatcacattttgtatgcatatgcaacatgtttttctccgaaaatgtcaatctataacaggagcatggcatcgtcccttcagttcagatcttcaaatattatctgaattcaatcctcgatctgataagtagtgtttgtatcccataagcaaagcctgcataataccgacaaatcaaaagatcaacacaagctagctatcttcttgcagcaatttcagacctgctgtagcaaccagcagcctgaccattgaccaacctgacaaacgaagggtatatgaactgaaatgcctgaatttcaagcaaaattcgtctttaatcccctcaaggaacctgatatatatgttctggtctttgcaatttttttttgtccttcacttcacatcatccatcaagtagcttgatgaatcatgagtcaaacacacttttagctagctagctagttgcttccagattacctatcatatccgttgattttttttgagcaggctggagaaatcctgattcaactctgccacagcacatagcacttaattactgcctgattgtccaatcaacctcatgtaaaaaacctagctttccacttgcaagaatatcagcagatactcatgtcatcgaggcgctaatcgtgcactgactgatgcgtcgcttcagaggaagaaaactgcaaagctcgtgcttgcctgcctgcatgtcaaggcgacacatcttaatatggaccttatcgttttatcacaattcacaatcctatcattttgacaatgggaaagttttctttttctgagggaatgtaccctcgcttttttattttatatactacgatttttttagaaaaaataacaacatttaaattaatatgtgacataccactcgataaacaagtacaaatttaactttacagattataacaaataataataaatataaatttgaatgcccatactaactctgggcctgttcggtggctgcagtcgctgcaacagtacacacgttgttcagatcgctatgatgcagcggcagtgctgcgttgcagccgcagccacgggctgccgaacacagcctctatttgttccttttattacaacccatcgaagttaaatttaatcttaatatgtttgtgcaattatatatctcatattaatttatcttaacatttgaaaaagttagtaacaactcttttgagtcgtcgtgaaaggcagcaacaacctaacagtgacgtacgtgcaaaaccacggtacagttatcagctatagcaacgaaagaaaccaaaacccctgcagctgaaaaggaccataatattttgcagaagattcgcaggtttctgtcaaactatttggtgttgaattgacacacagtacacgaagtcattatccaagcataccaccattgacttgaccacagattgagatgcatagcttagattttaatattatataacacaattattttttgaaactttgatcagaaatattttgttaaattatttagtaacgtgaagtaaaaaaatattatcacattgtcatgctaatttaaaacgtgtatgcttgtttgttttcttcaatatttttaagaaaaacgaatggtcaaacaaactataaaagttaactgtattatatatattaaaaaagtgtgtattggaaaatatggtagtaatatactccttttgtttgatgttgtgatgttggttagctcaaaattgaactaacagtgcgtattaaatgtttggaaatggaaggagtattaggttcggacaaaattaggttgtgctcagggacaagacggtcccaatcactgggaggaaatttaacagtgctccggctttgaaatgtgtgcatatatatgttggtcgatgacgtggcgtacgtgcaaagttgcttctctgccgaattaaccggcatgttaggcagccgttgtggcgccaccttggccggccatgttggtgccgtgctgctccgacaatatagttgcttatgtaaatttggttgcagatgtgtcaaattgcttgtgggatatgaaaacttataacccctaattaaactaccactagtaagtaagtgtgcacgtacaaagcacgtcatacttctcatcgtctgctttgttaacttattgtcatagcttatactcgtttcggtttcaaattaattattatcatattttagatttgtctgatcagatcattaattcttaggaatgtatgtataatttaacaacatatgatttatgtattattatgaaggtatttctttacgatgaagctaaaagtataaaattttgtaatattagaccatatgagtgcatagaaattaatggtcaaagattgaaatatttgattcagaacaaattaacctagaatgcaagtaatctgaattagatggagtactcaaattttgaaatttaattaatataaatttgattttagtttcctttttttcatcatattctattttttcgtaactgtagcttataagtcgagtacatataataaactgatgaaaaagaattcctcacgatagcttataagtcaacaacatattataattgaattgataaaaataattttagggtaccacaaaattatcaccgttgaggattttatatttacatattcttagctgttctaaagccaaacctgcgagtgaaaagaaaactttgaattaaattctaaaatgatggggacgtattgagggtggtcgactgaacttggatctcattaatttgcatgcattcctaattattggacagttatatgtccgaccaacattttactgatgtactaggcgtgctacaaagagttgtggctgatcatgtagttaattgatggcttaatatttggctttaatatgaaggagaaatggaacaataattcttcgtccgaaacatatatcaaatgaaatttgctgagcagagattaaatcaatacttacatggcatgttttactgcattattatcatacttcttccttttctaatttttatattagaagtcgtttgattttttttcttagtcaagctataagtttatagaaaaatatactaataattttaataaaaagtatattattaaaatattcaacattaacttaataaaactaatttggtgctgtaaatattattaaattttttaataaatttaatcaaatctaaaaatttgaataagaaaaaaaatcaaatgatttataatataaaacagagagtacttaattattcttttttacaggaaacacagcaggagatactcctaccgtgatgcattgcaaaagacagagagtgtttacgagagactgtagggtacttaattatgtccaacagccacctaccaacacgaggggggttaaatcactgacgcatacgcaacgtactgtttgcatttcttagagtataaacagtactgtttcaattagcaccgctgtttcttgaatcttacaggcactgtcactgtgtagtactccattatgaaaattaagaagtttggtgtcagttaacaaagcaagttcaacatttaattaatttcctgcgacgagccaaagcaaagtaagtacaaaagcaaactgagtacatttaattttttttcaccacacatatcggatgagccacaaattaaagcggataaactgcacctagggcaagcgtggagactgaaaacataattcttttctatctatacgaatagatcgaaaacatattcgctttgtaggtctaaaattactcagcatcagtcattcaattttttttctctgtggaccgtggagaaagctggagaaaaatatattgtaaaccgttagacagattttgatgaaaccaaattataacagtgtaaatcgataataatagttgtatacaaaatataattatgtatatatagaattagaattgtatattaaatttaaagttagttttaatatatgttgtaaatagacacatctaaatagacgtataacaagtccaatcttacaatctcacgcaaaattacgcagaaaaatcccctagttgtttttcattacaaacaattaagcaaatgaacttctttactgcttgatcttcttagatctgcaaggaaattaaaaattctactatcattagtcagctcgacttatcgtgagtgtttgtgattatatctgaaatgatatggttgcacctcgtcagcgatagattcatgcttgttgcatgtatgcagtctccatctctttcttgtggtactcatacatttttcttccaagcacgctaacaaactcctttggctgcatgctgcatctatctcaagttctcaacccaaaaatgccaactttggcacgcaaatcacgcacaaatcattggccaccaccgtgtataatgattatttagttatatggagtgtagaaacacccacataattccagatgacacgtggtatacaagttcaggttaagttattcagaggaaaaagttcaagcagtacctgctctgttgtttcacatgtaccaatcagagaccaaacctgctgcgatttctcacaattcggcagctgttgattgtgcctactgcctagatagaacttaacatcttaacggtattttgacctgtatgtgctggcctaatcaatagcattcatccatcaactgaagaacaaagaggccattcatggttcagagttcagactgaacctgcaggccaggtagctagtactaatgtacaagtgcttgtacatgtgagaagctggtataccgactgcttgcacatgtggcgacaatgtaaccgtcagattgaacaaaaattgaagccgatcacacctactgtagttctacagtccctttcttccctgccatgaatatacatgtactatggctactagctcatgctggacggttctcaatgagatcaagacatctagtgtgcgatctatgaccaaatatctaacatgctatcctgaataagaaagtaaactgtgcattatttatttcagagtttgttactaaaggagaaggacagccatgtaggcatgcatgccatgcatatggtccctgaaaattaagtactagtaataagtatggaactttcacctatctatctatctagctctttcatgcatgatcaggcaggaaatccaagtgttgtcttgtcctataaaagaagggaccattgatctacctctccacaattcaatccatttcttcctctaccatactatacctagcttgccaccaacaacagtacaccatgcccaagaagaagctgtcacataggctgttctctgccttggtatccctactccttcatgggaagcctatctctagatcatcatccaacaccaacaccacattgccacacccttccttgctgcacaagtcctcctcaagcttccctcccatggagaagctcgccgcgaaaaccctagtactcgacgtcgaaggcggtttgcttagatcatcctccttgttcccctacttcatgcttgtggcactagaggcaggagggttcttgaggggccttgtgctcctcctcctctacccattgctatgtgtcatgggaagtgacatggccttgaaggtcatggcaatggtgtccttctgcggtttacgggcaagccggtttcgggccgggcgagccgtgcttcccaagtggttccttgaggatgttggggaggaagggtttgatgtgatgaggagtgccatgaggagggtgtgtgtgacaaagatgcctaggatcatggttgaagggttcttgaaggagtacttggaggttgaggttgtttcaggtagggagatgaaggtgatttgggggttcttcactggcatcatggaggaggaagaaggtggtgatcaagaggaggtgttgcttgaggagaagaaaatgttggttgatgttgtgggcttctctacccccttggagttcctccaacatcatctctcacattgttgcaaggtataatatgtcataagtaattaattcaacatgtaaaatttgcatgtttgtgttaattcttatacttttttatatatatatatatatatatatatatatatatatatatatatatatatatatatatatatatatatatatatatatatatatatttgacttaacttgcatgtgagtttagatcacctagctaaggtagctagttttacatgtataaactcccctttttggtttgtgtgatttagctagttcaggtattagacatgcatgtaatacgcgtgattggattgaaacaacgtatataatatctgcatatttacacctgaaagtaaaattagatgtaatagttaattacgtgcacgacgtcttttcaacggccggtctcatgctgatcgtgcaatcattgatcatatatacatactttttttcctctttttatgtattctttttgtatctcatcatgtgagaccaacaaaagcataatatctgttactgttagacggccactcattaattttcccagaaagaatgtgacctttaccatcaagtcacaggttttaccccttttcccaaactccccagcactttcccgtgtcaattaaatttaagaatattttgatagtcctccaaaaaaatagagaatattttgatagaaatagagaattttcctcatgtgaagtagtactgtatagtgcatacacaacatttcgtcaaatctctaattaatctgaccatttaatcacacatgcaacagtttcgttcccacgttataaaatttgagatctgaattactgtgtatgcatttcatcttgtcaaatctgtaattaattcgaccatttaattatacaacagtttcgtgttcccacgttaattaaatttgatcagaacaatttgatacaactaatactactattttcaaaattaattcccctcatgtgcattgctgtatgcattccatcttgtcaaatctgtaattaaattgaccatttaatcacacaacagttccattccccacgttaattaaatttgagaacaatttgagatacaaccaataccactattttcaaattaatttccctcatgtgaattactgtatgcattccattccattccatttcattttatttccccaaccacttttgagatttgctagcagcatagtgtggtgccaccccctccctcttgtttgttggagtagttttttttttcgcagtagtccttttcttttcgcaattggttgttgcagtgattttttttttactctcttccagcatacgtatgtctagccgattgcgttgtgtatcaaaacctctatttcttactaatatattgacgtacaatccttttacgtattcgcaaaaaatctgtatttaatttgacaagttaattattaattactcactcacacaacacaggaggtgtacctggtgacacgtgaggagaaggcgaggtggtcggcgctgccgcgcgacaagtacccgaagccgatggtgttccacgacggccgcctcgcgttccggccagccgccggcgacacgctcgccatgttcacctggtttccctttggcgccgccctcgccgtcgcccgcctcgccgtcgcgctcgccgtgccgtacaggtactcgacgccgatcctggccgccacgggcttgtcgtggcgcctcaagggcgaggcccccacgccgctcgccggcgccggcgacgcgcgcgccggcgcgggcagctgttcgtgtgcaaccaccggacgctgatcgacccggtgtacgtgtcggtggcgctggaccgccccgtgcgcgccgtgtcgtacagcctgagccggctgtcggagctgatctcgccgatcgggcggacggtgcggctgacgcgggaccgcgacagcgacgggcgcgccatggcgcggctcctcgacggcggcgacctcgtcgtcgtctgccccgaggggacgacgtgccgggagccgtgcctgctccggttcagcccgctgttcgcggagctgagcgacgacgtggtccccgtcgggatcgccgtcgacacggcgatgttctacgcgacgacggccggcgggctcaagtgcctggacccgctctactacatcgccaacccgaggacgtgctacgccgtgcagttcctggagagggtggacacgtcgccggcgagggagcggagggcgccgtccaccgacgtggccaacctcgtgcagaggaggatgggcgacgcgctcggctaccgctgcaccatgctcaccaggaaggacaagtacctcatgctcgccggcaacgatggcgtcgtcaacaccacccaagacaaccactctgctccggggaagaagaagatgcaataattatgaattagattagccaaaaaagttctcaaaaaagttctagatagatttcggttgttcttttatctttttaattatttttttatgttgctgggtagtttaatttggtgtgtgtttatactgtatttcattcttgcttcagtttggctggtgtgttcatcaggttgatttcttctgtgtgttttaatcaaattaatgattgtatagaaacaacaagaagctggcaccatcaaggagcttgtagagaaagtactactacgtgtgtgaattaattagtgcatttaatttgttaggtatgctcgaccattgttgcaatttgcttgttttaaaaaaaatctatgtatattttcttagggcatattcaaagatagagtctgatatagtcttttagtttatttgtagactatgattttataaccattgagataacaaaggctataataattagtgaactaagataagtttttattatctttcttttctcttccccaagcaaagtttctttttataaatgctaagaattgatgttaagtcattgttaagcttagagcaagtttaatagtatagccagctactagctccaaatcatctatagtcaatttaatagttaattcatacaatagttacctatgaatatatatactatattattaatacctggtcccacctgtcatacaaacattgccatcttgaagttagtgctacagctggctataaatctgtagtctgctgctcacctctctcctcatttatctcctcgaaatatgtttatagttttggcttatagtccgctattgtacctactcttagtatgtttctctctctctccttcctcctcttttttctactacctatgttctaaaataagtttatttttttatccattacacacatatcaatacaaaagaaaaggactagaatacacctactttatcaaatcctaatgtaaccattcatcattttatccacctctaaatacaattattttctacatttacaaattccgatgcattgattactctaaaaataaacttaatgtgggacagagtaagtatatcagcaaacttaccttgttacctactcaaagaacctgctattaattattgtacatactctgacatcctattaaatgaaagtgaatatgggaatcatagacttgctgtctctctgaagaaaatcccaaaaggagaaaatggagcatcttggacttgtagtaccacaaattttgggtaaacatataatggaaagtgatctaggagtaccatttatcaactatttattgttcattatgaagactggcatatcctagctgaaagataaaatttttggaagtttgaacattactcctgtctgttggaagaaatatgcaatctatcatgggtccattccatgaagatgacataatagagaagcaacaatgcaatccacatgccactatctcatttaataaaacatttatactagaatatgtaaaccagcacaaaacataataaactgtcgctcttaattttgaaaggatcataatcttctgtactgtctaaattgaagacatgaaaatgccattatgtattttattcaagtatttaaaatggccatcatgaacttaaaaaggaatcagaaaaggctttcatgatcttctatacggtctaaattaaagacatgaaaagaccattatgtattttattcaagtattttaaatagccaggatgaacattaaaaggaatcagaaaagctgaaaaggcttcaggcaagtgaaaaagtgtctaaattaaagacatgaaaagaccattatgtattttattcaagtatttaaaatggacaggatgaactttaaaaggaatcagaaaaggtttcaggcaagtgaaaaaggaagaaccatgcaaataattgcgtttgccgggagtcgaacccgggtctattgcttggaaggcaattatgctaaccgttggactacaaacgctatttgtcagttattaatcaaatttattaatgttcaaagctaagcacaacgtgtgacactactaatcattgtcaggcaattatctatggtgcctaacaaaaagacggtggaagcgattaatggatcataacttcataaggatcgttgcacaatcattttctagcataaaactaattaatcaagaacctctcactgtcatgacattcatgcatagattgacgcctatctcagagggaaaggaagtaaatgtatcacactctatctcaagcaaacaacgaccccaatgaaaacagcggccatcgacccatgcattcgacgtcgatcgtcgacctgcaatgcacactgatctgctttgcttggttgcgttcatgtcggctcagagttcatcagcctacgatgcttgagcttcctgatcatggtggactctgcctgcccctgctaattccggtgaccacgtagtacaacgaacaggagtctacttgacttgtagtagtagtgctgtgcattcaaagttcaatagttgaggtgagctatttaacaccagccatcacatttccattagcccatacgctgcaaagcaatctatcatcatgggccatgaatctataatcatggaccatgatctatgaacaaagtggtagttacgtactagtagtactgtattaatgcaccgccgagttgtacgcacttacgaggggagagaacaaaaatgtgatgtcatgtttaattcgtctacatcttggtcgccgtctgatctcctcatgatctgaaaaaaaaagctggtgatcaggattggatcacatgctacctaccaacagaataaaggttcagcacaggaacggacccccacaagagaggccctgatcgaattctgaaccaggggaacagttatgttcagtaccatgttattactgttgcagcacgagctccttcgatccccaaatgtacttatgtactatacatgtgtgctcagcttgcgtgcccacactgaactggtagaatcagatctccaaaacttgtagtctagtgtaatggacagaccaaatctgagtagcaaacctttgatgaaaccagttgtttcttgctcgtactgtctcctttcggtgattgaactgccaggaccaccacggcgctcgtccaggataattgaactgccgcgcttctgctgcgaccctgcatgaaaaagcaaaatgttttgtactgaatcagtaattacggtgagttgtaccgtggaaactttaactgcagacttaacact

SEQ ID NO: 31869 - DNA, 4516 bp, Oryza sativa
aagagcatccacaagatcagctctttggtgtagtagtaacagatttaatcatttttctaggaacacatggaagactttgcatataattgcattaattttctcaaggagagaataggaggaaaaaaacatggagaagtcataaaaacaatcgagttctttgttcaagccacccgtcagattgccaagggatcatgatagcctggaggatttgaatttcatatcccaagtgccagacgcaaatgtagaagagagcagaaattaaacaagatgtgtgggatgcaaggaacaaggctagctaagacacaatgatttaatcatggacaacaagcattctgttgaattccctgggcaactgctcccaggacagactcaattaagttgcaaggaaatgtagttgagatctggataggaatggcatggttcatgtcaattattgatcagttccttcattttagtgtatccgtggagtagtatgcaagttgcagccgcagcaagccatcaacagtagatgagaataaggtggttcgaactgtgacattcttgtgaggacaaatttcaaaatcaggccacacagtttctcaagcaatttgattgcacgcattaatttaggtgtccatgtcctcttattcactgtatgtaaatcccatcaagcatatatacggcggattcgaccaacagtacaactatactgcagatacagcctgccaatactgcagacacagcctgctacagaatcactgtccatgccactgtatagataggatgacttccaacaacccaacaactaaatgaagacatatgtgaatgtgagctctaaaaaaattgaattagttgtgttaagatgtttacttgattatattaacaactgatggtcattacataagcaacaaaaggtggctgagacatacttacagagatcaccaaagagatgattatactatatatcagagctgtcactcatccagtggtttcatccagttgcgtctcacctcagagctagggtccgaaatcaaattagcataatcttgatctatgtgtcagttaacacttccccaggatataatttttgtaaatcctaaaaggattcgtgcagccaagtaccatcgaaggttccaaacaagcatcaatgctactagaggtgttaactgctgatccttgctgcagacgaaaaaaaaagaacagattagtctcagaaatactttttgaggctgtagagaattgagagacaccaaccacaacatgaaaagaagaccagtatgataccatgaatcagtgtgacaacattgtccaaaagcaaaagatgtggtcaacattatcccattgttgtcattgcaccgactctactatgaaatctgacaaagacaccaattgtggaaaagaaccatgcaatcagctgatcaatttctcccatctgacactacttgtcaatgcaccaagtatggaacataaaaatcaatgtactggaaagtggaaacagaactaaaggcactcacatatgcgcagtaatgacaatcactgttcccatgcaaagggagataggagttaatttctcatctttatcattttttgttctgtgtcctttggggtgtggaaggatcttctgtaggcatgctcaaacttaaacattgaaccaatagcccatttgtggacgactatctcaccaaaaatctgaacaagaacatgatcctactttgaagtggtgaaacctatatgggtctctcaacacaatttccctattaaaaaccatgctaaccagcttaaataccagatgacagtctgaacagactctgagattcttgaatattcttactgtagatccttctgggacaacgataaggccatatgccaacgcaagtttctcactatggttccaaaggttctgctccttctgctcttcatctgtatcatgcagtgcagatgatgtgtcagcaatataacctacttccctgagtttcagcaacatttcatctaactttgcgtagatcttctctgcatgcttatgaccccggtcaccaataccaaaggtgcttacttcattcttaagcttaagccaactgcaagctggtcttttgtttatattgatggttttcatgtgacttcgtaatttgtcaacatccgcccatcttgcaggggatcatatagagtcgaccagcaggcatgcaagataagctgaatcatggaatggatccaattcaagaagctttttggcggttttcctcccaatttcaagatttttgtgggttctactagaggacaacaaactccgccatatcagatcatttggtaagactggcatttcttcaataaatttctctgcctctgcaaaccgacctaagcgtccgagaagatccactatgcatacacaatgttttattccaggggaaacaccaaaggaagaagccatagagttatagtaatctatacccttgtctactagaccagcatgactacaagctgagagtagagcaacaaacgttacatagtctggctttctacccgttgcaaccatttgcttaaatgtttcctcagcttccttgaaatacccatattttgcataaccagatatcagcgtattccagcattgttgaggtcgaatggcttggtcaggaaccacttgcaacatttcatccatctttccacatttcccatacatatccattgcagcattaacaacgtatgagtctgaatccagcccagatttcataccaagaccatgtagctgcatgccttcttctaatgatgcgaggcttgcacaggatgacagacattcagctaggcaaacacgatcaagtttgtttccagcatgctgcatatcaatgaagagctttagagcttcctctccatggccaagttggacattcgctgctattatggcattccatgaaacaatgtttttgttggtgatactattgaatatattagtgcttgactctaaattgccacattttgcatacattgtgattagagagttagcaacatactcatctgacaaaaatccagtgcgtattatgtatgcatgtaagggccttccataattatgcagatcatttgaagatgcgaaagaaccatggatatttatcattgtaatgtaatttggctttatccctgcacttctcatccaagaaaatacttgcattgcctttgtaccatcctcaagtactgcgtagccaccaataagtacattgtagctgacaatatcatgagtcggcatggactgaaaaactttctcagcatcttccatagaattgcatttcccatacatcgtgatgagagaattaccaaccagtagatttctctgaagactcaactgcaatacgatggcatgaaccattttgccatctatcaaggctcctggacttgaacatgctcctagagcactggaaaatgtcaggtgatttgggctttcctttgtatgaaataactgacctagtgtcttcaacgcgtcggtgctattacagttctgcacataggatgaaatcatagtgttccatgatattaggtccccttctactcatgttccagaacagaaactcagcatcactcaattttccagcagcagagtacatattaaccagagcattaattactgttactgatgaatccagactgctcctgagacacagggaatgaattccacttccatggctgaaatgatctgaggaggcacagacagacatcaagctgcacagggttgttgcatcaggccttaatccatgatgacgcatatctgaaaacaccagaaaacatttgctgcagattccttgatgtgagtacatcgatatcatcgcgttccatgaaatagtatcatgttcctccattcgatcaaagagcttctcagcatcatgcacccttcccaagttgccaaacatggtaatcaacgaattcgccacagagacctggttttggagtccagagacaatgacctgggaagcaacctgaagcccaggcacctcattctcgagcgatccacacaagctgaccactgtcgcgaacgcatttgcattgcatgggaccccatccctcctcatctgacggtaagctctcaatgcctcttccaggtaaccattggatgacaatgccaccatcagtgctgtccacgacacgacattcctctcgggcatctcccagaacaacctctgcgcatcggacacgatcccacgggagccatacaagtgcaggagcgccgtgccgatgtagacgttgcccatgagcccggccctgtgggtgagcgcgtggatggcggcgccgcacgcgatgccctcgtcccggccccggcgctcgcacgcggtgacgaggctggcgagcgcgaacccgctgagcgggacgccacgctcccgcataccgcggagcatctcgaaggccgtcccgtcgcgtccgcagcggacgcagccggagacggcggtgtaccaggtggatggggtccggtcggccatttcgtcgaacaggtggagcgcggcggcggcggcggaggcatcccgttggcggaagtagaaggggtaccgagctcgaattcggc

SEQ ID NO: 31870 - DNA, 2228 bp, Oryza sativa
aatctaatggaaaaagtacaccgaaggtccctcaacttgtcatcgagttacaaaatggtcccctaaccgcaaaaccagataccgggtgtccctcaactaataaaatcgttagtttagatcctccggtggttttgctcccggttttatctgacgtggcggctgagtcagcgtgcaacccacgcgggtcccacatgtcagaatgtcaggttatctctcccctcttctcttccttcctcatctctttctctgacttctttcctctctacagggcggctggcgggtggggaggaggtccggcggccaccgccggcggcgacggcggcggcgcatgcgacctcggggtcggaccatttgacaggcccgggaggcggcggcggcgacacggaagaaggaaggcggcgacggctgcgacgcttgagatgggagaaggcgcccggcggcgccggcgcgggaagaagttgtcttcggcgtcgtgcccgctccgcccgccaccgcctgctcggctcgccgctgccccgcgctcacacattcccaccgccgacgccgctgacggcgcgggcgcgagatctgcggccgtggacgacgatggcggcggcgtcctcgctctccccatcccgctccctgtcagtgccatcttcctctcccgcagcgcgcctgctcgccgcttgtctgctccgccagccggctgctccccgcacagtctgcggtggcgaaggtgaccgtgccagcatcgaggtcgtagccgaaaatcacccaggctatatatagctattagccaattctagagccaaacgagaattcagttgcaagaagtaattttcttatatcaccgctctctacaaattaaacgaaccccaccacaagaagctagcacatatgagctagcacgcaggatcgattggatgatgatgattatggaggtttctgggagagcgcggatacgatttcatgggcatccttctcgatatattgaacgagatccatggcaggccgctgtgaaaccatcttcttcatccgctccgtcattgatagcaggaatgtcttgacagatgattcaaggctctcaaactgcctgccgaccgatttcacaagcccatccaattcttccagatccttcacgagtgttttattccaagattaagttattgctgaacaaagaagaaaaagtaccattatattataaaggatgagatgaattccgaagcgccttcttcggcgatcgtcgactccatttgtgttttcagcccctcgtacgcacggttgtaatactctcctacctcctgtgcacaagaatttaattgatcatgcatgcatgacaatgtataataaagtactaattaattaactaactaacattcccatggtttttgcagcaaccgtcccatatattgattcctggcgcgtagaggttggtaatgcgctaggcctcgagtttgattattctttcttgcctgcggtcagccggagtgggggggtgttgcttgcctggcggacgaccgtctggtctatctcagatgttcaccttgcggatttctctcttaccgcgttggttcggcacctttctgatgttgccccctggtggctctccatcatctatgggacacaggaggagcctgacaagcttcgtttcttagatgagcttcgttcactacgctcctctcgcacggggccgtgggccatcgtaggcgatttcaacctcattctcgaagctcgggataaaaacaaccttaatctcaatcgtcatatgatgggtcgttttcgtcggctcatcgacgagttggaactccaggagctgccgcttcacggacgttgcttcacttggagcaatgagcgcgagtcgcccacgcttgttaagctcgaccgcgtcctcttctctgcggattgggaggagcttttcccctcttgcctcctccaagcggcctcttctgtcgcctcagttcactgtgctcttctccttcatacctgcgtcacctccccaaaagcgcatcgttttcgttttaaggccttttggcccaagttcgacggcttttcttcaagtcgtgcaggacgcctggcatccccctgccaacctaccccctcttgctgctcttgcctggtgcttctctaccacggctaagcgcttacagagctggagtgaccgtcacattggcagtgttcgtctacagcttcagatggcgaaggaacttgtcttccggcctcatgttgcgcaggagagtcggtctctttcc

SEQ ID NO: 31871 - DNA, 9238 bp, Oryza sativa
tgacgttaaggatttcaggccgattagccttatccacagctttgggaagctgttctccaagatcttagcctcttgtctctcccctcgcctggacgagcttgtggcgcctaaccagagcgctttcatcaagggccgctctcttcatgacaacttccgctttgtccagcttgtggcaagggcgctccacgccaaacgcgttccccgacttcttctcaaggtggatattgcgaaggcctttgacacggtcagctggcctttcttgcttgaggtgctagcccagcttggcttcagtcaacgttggcgtgattggatctccctcattctcagtgcctcctcttcccgagtgctggttaatggggtgccaggtccacggttcccccatcggagaggtcttcgtcaaggagatcctctttcccccatgcttttcattctagtcatggatgtgctcaatgcattgctccgcaaagcctctgactcgggtggttttcttcccctcaattatcgtgctattcgacatcgtgcatccctctacgccgatgatctagttctcttcctttcccccgttcggcaggaccttgagttcatccaaggcatcctctctgtcttcggtgccgcttccgggcttcggaccaacttcaccaagtgctcgattactccgatccgctgatccgctgctcggttcttgacctggagctagttcaatcctcttttccttgctcgatctcggagtttccctacacctacctcggcattccactgtcagttcgcaagctgccaaaagcggccctgaaaccgcttgtggataaagtctcccatcggctcccccctggaagggccgtctcaccactctggcgggtcactcggttctagtccagttggttctctcttccattccggtctatgtttctgtggcgatcggcttgccaagctgggttatcaaagccattgacaagaagtgtcgcgccttcttgtggacgggtacggactcggccaatgggggacagtgccgggtgtcctggatgagggtttgccgtcctagggatctcggtggaccgggcattccggatctcaggatggctggctttgccttgagtgttcgctagctctggcttcagcgctcggggcatccctactggtctgatctgaaggcccctattaagcggagcgtctccgacatgtttgtagcatacaccttctctatcctgggagatggtcaatccaagctcttctggattgaccggtggatcgatggtcgctcgatagcttctatagctcctgacctcctccacgccgtgcctccacgcttccggggatcgcgcacggttgctactgggttagcgaactactcctgggttggtgacatacgtggcgccctcactgtcccggtcatctctcagttcctgttagtctgggacgcggtgcttcctacccagctctcgccgggtgttgaggatcacctcgtctggagttggacgggtgaccagtgctactcggtgtgatcggcgtatcgggcgttcttccttggccagcactcttttgcctgtgccgacctactctggcacgcgaagggctctgctaaatgcaagttcttcctttggtttgcatttcagcagcgctgctggactgccgatcttctccaaaagcgtggtatcgatagccactctgcttgccccttttgcactcaggagtttgagacggcgaaccacatcctcatcgattgcgtgttcgctcggcaggtctggctccgtgtgatgtcccctcctggctgggctgccctctctccccctcgtggcagctggctccaggattggtggtcatcctccagggcctgtttacctgagcacctccgcagcggcttcgactccttggtactcctagtctcctggcagctgtgcaaggaacgaaactccagggttttcgactctgcgctcgcttcggttgcagtcgttttggagtccatccactcggagggccagctgtggtctttagccgacattgctttttttggggatttcttggagtgtagcgtgcctctaccccctcccgctgtttggagttgtgtttttaaccgtcgtagtagtttctcgcttcaagttttctttttactttgttccccctctttaggcataagccagtctggctgattgctttgtgtaacaaaaactcttttcatgctaatatattgacgagcaattcttttgcgcgttcgctaaaaaatgcgctgtggctcgaactttcaccgcattgaggacactgctcagtatagtcactagctgattaatcaagcaacgcacaactaattaattagtggagtagtaattacctttgcttgtccagtgccgcgttgaagaacagcatgtagcagccacttctccaggcacgatctgccgtaaacatgtccacagggaatgcaactgaaagaggaaatgcatgcaattaacatatataaattaaggaggactactatagtactatatatataattgattagttatcaaattagtactaattaacaatcgatcgagtagctcatcaattgagacgtgtcatgcatgcaggaacgtatagtaccagatgcgatggtcgccgttgcaggtccagggttgcagacaaatgctgcaggtcggcgccggcgcctcctcctcctgctgcttatcaacttcttcgaccagctgcgtcgtagcttggccgatgagtcgccgccgcttgtgaccacgaccatgtccctctagctccatcgtcgtcgctactgatgccgtctcattatccttctgctccgccgccggcatcgacgaccatggccaagaaacgccctccccgccggatcccgccgcggcgcggtggccagcgtccttctcctcctcggccgccacatcgacgcgtgccccgctgctccctcccggccgcctccgcggcgtcgtccctacgtgcggcagtgcttgacgattgagggcgatttagtgcgggattaagtgggatttgttggggaaattgatgcccactacacaaggaaccgatttttgcaattaatttggaggagaaacgatagggcagggagatcaacgaaggcggcagtgcttgagtttcacgggagagatgaacagacgacggacagaggtagaagaagctcctagcgagcggggcccgcctgccagcgcacggacagcgaacggaagagaaagagagggggaggatgaggaggatgatttacgtcggcctcgtatgtcagtaggtcccacacatattttttggtgaatgacaaataggtcccacacatcccttctttctataaagttaatgccaaaagttcaaacctcatgcttccacatcatcatcagttgtgaatcattggatgaatgcattagatcgcttcttagccgttggatggaacgcggcatagagcccaacccatcaggtaccgggtgagtctcttcacctcctcagtgccaaaatgtagcccacatgaacacattggctcatcttcattcacatctacatgtatccggcccgtcaatccgtataaaaagagctttatggccgaacacccctttagttgacattacaatttgttaacttatgttagaccattttgcttctttatagcttacgctttgaatgtgctatctaaattatctacaaaatttggatagggctgctaaaaagaatttctccaagaaagtcatttattttgtccgtttcttcttgagattgtacctcctatctaacaaattgatgttaaccaagtcctgcagcaacgtgcggggcatcctctagtattttttatttctaataccacctaagcgccacgtcaacgccacgtggaaaggagaccgagtcaatactgccacgtaggcgcacgtcagtgaaaccgccctccaaaaccggttttgagagttgggggtcgagatatccggtttcgtggtttagggtcacggattagatttcgatcactttttcagggtcacaaagtgaacttattccaagataaaattaggtttgggcccaccatagtctggacgggtggggaaaccgctgcgagtgcgacccccgccgccgtcgccggagaagaatgggtgggcggggcggaggaatacaggcgattccctccataatctccggcaatagctacatggatttttctagcaggttagtgctaccgctcgttccctcactcttcagggatattccaaaggtaatttccagatttattaaggaaaccggtatcatgtttatattcttttcttatcctctttttgctaaagaaaagtaattttgctttgttgactccaagtctccaactcgggtcacccaagtcttcgcggtgcttaacttggccaaattgttaggtgcctgaagcatttcgcccggtttggagaacgagagtagctctgtttgcaaaagatccgatccctgttcccaatgcagtgatggggcttccaattttggattcttggtgttttaaagccggattttattgctgcttgattcctgcagttatggaggcttggcttctgatcaggtgcaatgccggcgatctgagctggtggagtataccaacgtaagggtgcgcagatggatgtgtagctggagatcgtgcgggtgctgtactgcagcaatcggggctacagaggattgatatatttgcctaaacttccatgaacatcggaagcgtgtcatgcaaggtcatgttggtgctagcttggtactgctatatgcttcttcttttttcaaatcatttgagaataaattgattaaaacaatctactccaaagggcacaatgaactggtggaagaagagaagcatccttttcaaattgccataatgggagcaatagacaaactgcatggtacttgttctatttttatgttaaatattagtgacacatgttacaagatcataagttaattaatttagtgaacctactagattttaccacaatatatattgatgtattttcattaggaacaatctgaatatattattcatctaatgtaaagatatagctatggttctacgcagttaatttctgatttttcccaaaatgttattttgtatggaaataaaaatgaggcttggtttcttctccgttgcaatgattcatttcttgccaacatggattccatgtgcattattgtactctgtttatttttcattttcaacttcaatggaaaactaaaatgaagcttgatttttatctaaaatggaaattgactttttttgtatgcatatatgtggggacacctaaattaggcctggtgccccgaaaatccactcgtgatcgtccaggatttcgattacgcacagattaatatacataacaacttttgattaattatacaaatttgatcatacaagctaattatacaactgttaaaggtttaaaagttccaaactaacacatccttatttgaaaatacaaggaagaatccaaactacccaactactaacctcctaaactactaatttacaactaataaactccataggcaaaagctcgagtgtagacaagcctagaaaaactcgttgttgctttagacctcactatcttctgatcttcttgttagcacaattcctctatatgttaaattatgcaagaatgagtacttatgtactcaacaaggcatattataaataattaaatgtagagagatatgaataaataaaacaatgagaaagtaaaagagtagtaataaaatcatatatcatttttgtgctcaaaattttagttttaaaactacttatacttcaggagtatgaatcacccttatgacacaactccaaaatcgggagtacagcgcattcgaatgatttaatttcacctctgtagatactatctagctttacccacacgatgcccacagctagctagaggctgagaataacagagccgttcgaaggtcccacttactactagttagtgcacagtggggttttggcccatcatagtagttgaactcttgctaggcctaagcaaggttactttatcatcatactttcatgggacccactgttgtgaagcatgcagcccaaactccttacgcacgttcaccccaaaacctgctcctagtgagccaaccaacagtctttcatatagtgggacaatatactaggctaagtccaattacttgatcgtgtggatggacacaaactatgtaatttccatggtataagggggtaattataatccggttaaaccaccaaaattatctcaacatccaaacttccataccaacaaacttcatcattcataaacattcaacattcacaatcctcaacattcacgacctcaactcataaatgcccattataaccggattcttatgtttttaaagatgtttgaaatagtaaaccacataaaatgataaccaatgcatctttctataacctcatgcaataatgcttgaaatcgtttaacatctacccatgagatgttaaaagagtaaggtattatgcatcaaattaaatatgaagattataattagttttctatatgatcaaaattttagttatgtcttgccttgtgccccgaggtttcctgcggcttcaacgtagctatctgagtccacgtcagctccttggatgtcgatagatcttgctgtacagtctaacgtatgaataccaaaaagatagcaaataaagcctataagaaaaatgctacaaagaaacgataaaccgagaaataaataaaattggagcaaggcgaaggaaaaaggaatggttcaaaatatattttaatttgaaaacaaaagagaggtgatggtttctataggttgggaatcaaataaaattgaagaaaaggtaatttggataggtggggtttatttggtggatttggtttctagtcggtgctagagtagggcagcacaacggctagatatttggagttggttagccgatgctaaggttggggagcatcacggctaaatattggctcgtctagttgatgctacagtcaaacaacacaacggctagagagttgggaagtttgtgccggtttgtggggcggaatagtgttactttacagctgtgagttgtagcaaagctgctaggttcgcacagagcccgaaagctagtgtgcggcgtgctatggaggttgatggagtagtgaggctccaaccactgtacgcgttaaggcgtggggtgcgaggagcaatactttgaccttgggattagcttatgccgggttttacgaccaacggtttgacatcggggtttgagaccacgtgaatgtctccatggaaagcgtaaagttctcacggcggctgtttagtggctatgggatggtataggtatggtttagaaataaaaagggtatttaaataaatcaaaggaatttgaattcaaaaaggtttttaattaaagaaatttgaatattcaaaaagggtaataaagaattttgaaatggtattttaaatcataaagatatttaaatgacgaaaatgtatttaaataaattataggaaaatttaatttaaaaggggtttttaaataaaacaagagatttaaatttaaaggtatttaagataaataaaataaattaaaaaggtatttgaataaaatataataatttaacaaggttatttaaaacaattttaaattcagaatgtaaataaataaaaggtatttaaataaataaagaaatttaaataaaatgtttaaaataggtaatttggtatcaaaataaagagtttggaattagatgaatttagatcaaagaatttctgggattgggtttgtggttgaagagatatgggtgtctaaagtttgaaattgaaataaaatcaaataaaagatactgtttatgtgggacccactatcagatgctccttcttcctcctctatttcttcttcttctcttcttctttcttgtgacacagataggggagggagaaaggcacggtagaggaggacggtggctccatgttgatgcgaaaaacacacactggcctaagagatttgcttgagtctagtgtaggtccgaatcttgcttttgggtcaaagggcgtgccagttggtttgatcctgcaactaacaagaaacaaacaaggaaacatagttaaatgcataaacgatagccgatcgaccacttgccgatgacgtatcgtttgtagactagccgatataacgtgaattagatcggcaatggtatataaaacataaagaaagttagatctagtcgatcggctgtagatattaacaatatataatctatacatcgaaatatgtttaaactaagtgattgggatagatcggacagcttgccgagacagtataaatcacttatgtataaaagtacttcaatataaagattatatatgttcatagcatagccgatgttgtagatataacatgtatcggctaataccctgatactactttatattaagatatcaatatagaccaaatatattaaataaggattaatcaagtgttaaggtagattaacgtattaataacaagtttaatatatttagttacagtgagatcttaacataaagggcagatttagcatattaagtaaacataaagtaaacaaaataatcaaatcaggtaagatcggttgaaaccccgatgaaaccctaatcggcaaccaataaacaggctagagattgatattttaatcacgacttataagatcaaaattaactgatgcagttataagtataaaaagaagaacaatacctagaaaatcaagtcattggatgtcacgaccggaattaacccaacgggcgttccttacgtgcgtgtattattccttgtcccaggaggcaaggtacaccaaaagttgatacatttcagagtttatcaagcggaagcgtaaatagttaatttattacatgggcggcgaaggcccagcacacacaaagacaaacgggaaacagcggaagactagggcgacgatcacaggcgcttgacggcatccacgagctagacaccaaagccttcatcttccaggaactccacttctgggtttgggaaaaattgagcaaaactgagtacaaccaccgtactcaacaagacacacccacaagtgcaggataaatacaagggagtacaagggggttataatataaagggttagggtttgcagtaaacagcattaaaagacacttagttgctcaaagctattttgtaaacacgattctagagctatacaatattattaatcaaggccgtgaacccacacgaacctgccttaacccaaggcgtacgatgattcagaccgaactggcaacc

SEQ ID NO: 31872 - DNA, 1748 bp, Oryza sativa
ccatgcaccccgagcccagcttaaaaccattttgagggttttaaaaaagggggacgtgtgaatccatttccacaataatccaactattcaatagtgtccaggtggtgagaatattcccaaagtctagagttataaaaccacctaatgttgcctaacgactctagcggatccccctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaagcggtaatgcaataatttaaatcaaaataattttataaactgggattcaatatgttcaaggatgatgtgacttgccttgctcgctttcccaaacgtcggcttcaacctccacgaagagcggatcttccgaagctgcagcgtctacatgaccaacggaaaagaaaaggcttttactctgataaactccatataacaagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaagggtttattgcgtcagccgaggggaggggcgcgcggaccgggtccacgggagtggggcccacgcggcagcctcacggtccacggtggaccgggtgcacccgggctcacaccggccggcgccgtgggtcccacgcgtcagccgcacccgagggcgcgggcggctgacggccgggccccacgcggcggccacacggcgcgcccgaaggcggccacgccggcgcagccggcgggagggcgcccgcgcccctatggtcgccggcggcggccataggcacgacggagcggcggccgagagaggggaagggaagggggaaaagaggcggccggtccacggctcaccctaggtcgacggcgacgacgaaaaggcagcccggagcggaggaaggcggcggcgcagctcgggtcgacggggtcgacggcgttccggtggtcggcgagcgaacggaggggtagatgaggtcggcgaggatgcggcgaagccgaaggaggcgacgccggggtgggagatggttcggggtgacgacggaggcggaccggagctcggcggtgacggcggagagagagagagacggcgcgagctcgattccggcgaggaggaagggcggcgagaggcggaaacggacggaggaggtgcggggagggtataaatagagttggaagggggagagggcggccggcggggaaggaaccggcgcgggaggtccggccgccatcaatggcgccggcgagatttgcgggggcaaatccgcccgtttgaacgcgagagagagagggaaaagtggggggaaagggagaggggatcaaggggagtgatttccccctattgattgcacgcggggacggtgggatgcggcggattcgcggcggcggcggcgctagggcgcgggcgagacggcggaagcggcgggaggaaggggatgacgggtgggccccacccatcagcgagggtggcgggcgggcccgcccgtcagcggcgcgcgcgcggggagaggccgagtgggccacggggagaggagagagagggggagggagatgggccgaccggcccaa

SEQ ID NO: 31873 - DNA, 1811 bp, Oryza sativa
gagggaaaggggccctatagggtttttctttatataaaaccattttaactttgtttattcttaataattattatttgtgctctgaaaattccactaaaatttatttacgcattttaggcttttaggaaatatacaaaaatcctccaagccttatttgacttttaactttgcacattttaatttttttggaggctttcacacggattttaattattctaggcataatttagaggatgtattttagagtcgttttgggacgtgacactatattagaaacccactcagcatatcggcatggctgaataaaaccagcatcatacaaacgtttaatttcggccttaatagcctcaaacatatcggccttacatcttctaggaggttgtttatacagccgatatcctggtttgattggtagccgatgttgaacaatcaatcggctaagtcctggcatctcgaaatattcccaagcaaagcaatctctatattctttcaatagctctattaacttggttctaaattcagatgacaaattcttactgataaatgtcggcctcggcttgtctcccggaccaatgtcaacttcttctaagtcatcggccgacatgaaaccttgtcctagtttgccatcgagatcatctacaatatccttggtgtagaagcttgaaccctccacaacgccctcaaaggagcaattggggctctccatctccaattggctatatgtcaaaatcggacacctttagaaaatctccttcccaaactttgccagacaagcaatcaattccatccatctcccaaatagtcaaatcggcattagcaacattgactgacttgtcggctggcacaacttcaaccttatcgccttgccattggatcaagctttggtgcatggtcgaagggatgcaacaattggcatgaatccaatccctaccaagcaacaagttgtaagaacccttcccatcgatgacaaagaaagttgtaggtacagtcttgctgccgattgtcaattccacgttaagaacacccttggtttccgaaggattaccaccaaaatctttaagaaccatgttggtcgtgatcagatcttctgcagtcttccccaacttcttgaaagtagcatatggcatcaaattaaccgcagctccaccatcaaccaacatcttggaaatcggcttaccattgacaaatcctttgacgtacaatggcctgaggtgccgattttctgctccatctggcttctcaaagatagcttgctcaggtgacagaaccaacttagccgaggattcctctaccacatcttcttcctccatatcggcatgatcaacaccgaacttggcaggcaacacaaaagccatgttaaccgacgaagaaacaacagattttcctttagctaacctctttgcttcatcggctaacacgtctcctcttattcagctgatggttgatttcttgctcacctcctcaaactgctccctattcctcactctgaactctcctcttctggttcttggtgaaagggcctgaaggacaccattgcttgttctcaacttgctcccgttcctgagccgattcatcctgaaagtagtcttcatgaatagggcccaatatctggtgaacaggaagtttcttctgaggtagccgattctccctgggacgtgatcggcttgagcttgcaacatgcccccttttatgattactacaactagggcaatcttcgatagatggtagcctcatcccctcattccagcaaaacctgaagaattcacaactccagtgggggtcaaagctatcatcatcttcataaaatttct

SEQ ID NO: 31874 - DNA, 2185 bp, Oryza sativa
cctctttgcttcatcggctaacacgtctcctcttattcagctgatggttgatttcttgctcacctcctcaaactgctccctattcctcactctgaactctcctcttctggttcttggtgaaagggcctgaaggacaccattgcttgttctcaacttgctcccgttcctgagccgattcatcctgaaagtagtcttcatgaatagggcccaatatctggtgaacaggaagtttcttctgaggtagccgattctccctgggacgtgatcggcttgagcttgcaacatgcccccttttatgattactacaactagggcaatcttcgatagatggtagcctcatcccctcattccagcaaaacctgaagaattcacaactccagtgggggtcaaagctatcatcatcttcataaaatttctcttcatgccgatcatgtctcttctgatatttgttgataatccttgcagaattgagttgcttggaccgataatccttcttatcggctgtcttcccagttgtatgaaccatgtttacttgaaaaggattacgctcaattttcatcagcctcttggagttatcaaacttgatcttaccatcttgtatagccaactagatctgttgtcagaacagcttgcactcattagtagtatgagatccagtattatgccatttgcagtatttccttttgcctagttcctcagccgatggaataacatgatttgcaggcaattgaatttgtttctcccgaagtagcatatcaaagattttatctgccttggtgatatcaaaatcatatttctcctccttggaagatggcttcacccacagacatgtagtaacctttttgtttctgatccattcggctgctgctacttcggactcatcttcataatcggaatcagaagcataattgtaagaataaacactattcatctttttgacaatcttcttagcttcctaaaaccgttgttcatgcactccaactttctgggccagatgagccaagctttcgaagtcctgagccgaaaaattttctctgatcggatgcaataaaccctggaaagccagatcggctaattgagaatctgaaaaggacaaactatagcatctgttcctcatatctctgaatctctgaatatagtcttgaatagattcatcatgcttctacttgactggaatcagatctgtcagcttcatctcatgaacgccactgtaaaagtagctatggaattgcttttccaaatcggctcaattactgatagaattgtatggaagattagagaaccaagtaaaggccgatctagacaaagacaaagggaacatcctaaatctaaaagcatcattagccgatgcctctcccagctgagctagaaatcggctgatatgttcataagtagaaaatttggaaaaatctagcaccttgtatcagtgtggtaatggaatcctatcaaactactcaagatatggtttccgatacaaattaccagaatctttaggcttgaaaccaaactactccctcataatataggctatcatatcggcccagggcttctgctgttgctgctcaggtgcaccctggaactgctgctgtgctagatcatactgattgaattgaggcacaaactacggctgtggtgaaggtgctagccgatactgtccttgaggtgagtatggttgaaacatgttacccccatcataaggtggtggagtctgatgcaccatgtggggttgttgaattggatcagtgtcacaccctgaaaatcgctaaattataaatcgttgtgaaaaaggaatttttagaaatcatttaataactaaagaaagtgtgtgaataaaatctatgaaaaatttgaacttaaacttgagctagataaaattttattaaatactttgtatgcccaagtattttctggatttttcccagaaattatttgagcattggaagtactttcttaataactgaaagatcatttcagcaattatttaaattaaaaagttaattaaatcctcttcctcagtctgggctgaatccggcccactcctctctctcccttctcccttccgcagcccgtgcctctcccttggccgaagtctgcattagcaccctcctgctcctttctctcttccgagccgggcccacctgtcggactcgccttcctcctccagccggccgctccttccgtgacg

SEQ ID NO: 31875 - DNA, 7915 bp, Oryza sativa
  unsure (1)..(7915): unsure at all n locations
accctaactaatccgtcgccaattccatccgttcctgagccgatctctccctcttccggctataaatagcagtcccaagacctcctcttccgtttccctctttttcccgagtttttccatagccctagccgcctccccacgttcggcttctctctcctttgccggccgccgctccagccgcgctgtgctgcctccccggtcgtccccgatctgcgccgtcgcttccctcggcttcgcagtgaagagatccacctcggccacccgttcctttgcgccaaatcccgccggaagccgctgtcaccgtgaaggccgagttcgctgcctcggtttgatcttcggcgaagctttgccgtcgactccgtggtcgccgaaccccgccgtctcctccgttggcattgcagcgacaacagcaagcccggcagccacctccgcgaagacgcaagccatcggagcaccgtcgtcactgtgaagccaatctgttccatcttcagccgcgccgttcgtcgccgtccatcgccgccttcgttcaccgtcgccaccctcgggatcgcaggagcgaggtgaagaccgtccgcccctcggttgctgcctctcgttgccggaaagccgttgccatcgtcaacccaaggtcgccgccttttggagttcgtcgcctgccatgtccctcgtcgtctgtcgttgcgtaagtggtggtaagggtcgccttgatctcctctctctcccggtgccctccgtttgcatcattgtaccgtggttcgctggtaactgccgttcccgtgcttgcggtcgtcgatcctgcgtggcagccatgtcatcgctggcatcagcgccatcttggccatccaaaattaatataaatttgtcatctcatttcaatgacatattattcctttttaatatatgtcatctaccaaatatgatctaatatttttccggaaaatgttttaatcttctgtctcagctataaatcatttgtaaattgtttaatcaatttggaatagtcttttctttaataggtttaattagaattaaatcttgtaaaattcatatctaattcatacgaactcagaatgaggtcgttcaagtctcatgattcatctaaattcaagctctacctatttatgaactttaattgtactattcatttgttttttattagtgttttactttgttttgcgttctaggtttagttttccgttgttttggaggatcgttcgttcgttggagaagttcctgaagacgaattgaagatgcttgtttgcaaggcaagtcacacaaatcccaaacacaattcctttgagcatgttgatcctacatttaaattctctatttatttcaattgtgcatttattttcgaatgtcaccgggtggtgagcctttcccatttaattatggccgaagatgactttatttacctatgggttagaatttgattagctagaagcttatatattggtttggttcagctagatgcttataatagattcttagccatgcttagaaaaaatagctcactaatgggataaatcatacttcactatcacttatggatatttaatggaagctcacgatggttaatcgtgattggttaattaattaatatgtcaactaaaacttgataaaggtgggttgtgagcacatggttttgatggtcgtgctcatgacaattaaggaccggttcacgagtttcggttgtgaaacattaaccgtgccaaccacaagccagcatgggcaacggctttaccttttgtatagcatggttcattgcggagcaccagactgagaagtggcagagataagcccacgggggtcgctggggagtccatgccttgtttataagggggtgattatgatccaggaacggtgcactgtggtggattgtgttgtgcgaggggtactgtcacagctcctttccgaggtaccgtggtgatatcgaggcgcatggtgacatgttgtggggctgtgtcttgtgggtacagtggtacacctctggccagagtaaaactattcgaatagccgtgcccgcggttatgggcgggtctaacaatgtctttcgtgattagtctcacacttctcaccataatgaaagatgatataactggtaataatttgattagctcctggtttggaatggtacattcctggtttggagatagatctgtacagacgggtatggttgttcaggatggttgggcctgtgcggcatgggtatgttgtatagtgttgattaatattgatgattaattgctctactgttttacaattctcaaatgtttgctaaatgctgcttttgcaaataagccctatattatgccattctttggtatccttgtgcacttgcatatttgctgtgtggcttgctgagtatgtcatatgctcaccttgcaataatcatcaaacctcagttgaagaaaaaggattcagaagaagaagacgtttggcttataccccagttgagctgcctgtgggagtggagctgaagctcgttaggttttatttttccgctgcagctttcttcatggtgaggactaagtgcctcttatgtaagtatttattcgctttagttattgatgaatctgtatattaaattgtcagtttgtgtacctcggctgattcctggacgaggattttatgcacaaatgagttcggaaattactagtgaatttctgggcgtgacaatcagacatgaactgagcaccgatcaactgagtttgctgaattggagtctaaggcctgatcggtatgttctaaatcggctgttgaacaggctgttgaatctgctgctgaattggctgagtgacatcgaacatagacgatatttgctcttgattaacttgaggaatgttgtgaccaacgtgctgaggttgtggtctcatcaggatacgaggtctgaactctggttgtttgtgagctgatgaaatcacagttgaattcggctgagccgatgctggcaccatcgggttaggttgagccgaatttgtccccgtcaagttaatctgaggttgatttggtcccaacgggttcagcagagccgaagtttcccctattggattaggttaagccgatgttgatgcaatcggctatcctgaagtaatcccagaaacaggcagtccatctgtaaccaaggtcctgtaattaggaaacttgtcaccagggaagaacgctggacctctggctcccctttcttcaaacttgcaatccatcatcttctccatcacattgctcatcacattagctaagattcctgactgattgatgagagcatgattaaccgcatagtcaacactgtcttggaaattcttgaactcgaggttggcatcttcttgtttaagtccttctttgccttcttccttgttgcgtccagaagtaccagaaccagaagcttcactgtttgaagggggtgggatttctaccttatgcttctggatcactgttccttgtcgagtcagagcaaaagaatcaaagtatgtgttctgtagcttgctcaaccatgcatcatattaacccctttgctctggtgtcagcatgtcgatggttatcggaatcttgtttgtggaatcaacttcagtcctcttgccatcatcatcagtaggcttgacgtccaccatgatgaaagattgtcacactcgtgtcccaccgggcgtgccaaaagcgtgttgatgcgaaaaacacacactggcctggaagatctgcttaacttcagtgcaggacctaaaatctctctttcgggttcagggcgtgccagttggtttgatcctgcaaccaacaagaaacaaacacagatacaaagttaaatccacaatagccgatcagccacatgccgatgacgtatcatttgtaggttacccaatataacgtgaaatatatcngcaattgataataaaagcaaatgaaagttagatctagtcgatcggctgtagatattagcaatatataatctatagatcgagatacatttaaaccaagtgactagtatggatcggaccaagtgctgagacaacatgaatcacttatgtctaaaagtactttaatataaagattatacgtgctcatagcatagccgatgttgtagacctaacacgtgtcggctaatactccaatacaactttatactaagatatcattatagaccaaatatattgaacaagaattaatcaagtgttaaagtagattaacagattaataataagcctaatatatttaataacagtgagatcttgatataaagggcagatttagcatgttaagtaaacatgaagtaaacaaaacaactaaatcagataagatcggctgaaacccccgatgaaaccctaatcggcaaccgaaagcaggctagagattaaaattctaatcacgacttataaggtcaaacttaactgatgcagctataagtatgaggagaatcacaatatctagaaagtcaagctgttggttgattcatagagtggtagataccctatataatctaagtcaaagttgatatttaacttgatcggctgccttccagtcatagatgttagccgattgaaggttaaataacaatattgccagaaactatataggatatatgataactcaacaaacaatattagagtgtcataaatatggaagcactaatcccgagaacacaagccgccataacaagttttacctcttgtcagagatcgaagccgatgcagcccaactcgaaagcaagaactcgtcgaaaatagaacaaaacgaaagggtggcgatgcgccgaatttgattgaactaagcgttaattgtttacaagggttcgggcttacttttatacctgagatacatgatatgtccctatcggacacgacttcgagccctattacaacttaggatacgaacaagtccctaaggcggactcttaccgactcaaatcataaggaaattacataaaatatcctaactaatagatacaattgcctttccaggactcaaatcgtgtgcagcaatccatatgaagcactttgattcaacccaatgatgtataccgagtcgtattgccaaaattcggctcaatcggctaaccttgttcgactcgaactctgccaatcttgaccgcagccgattcagacttcagccgattcttactctgttttcgaaacagtttatctcttagattctgcttcgattttatccttatctcagatacttggattaccaaatttggtcgttaacacatgccccccaagtccggaatatttggtaatgtttcggatttgccatatcatatctccaagaaaatcgcacattgccatttttccaaccgttaccacacggctttaaatactaaccgacctccccgagaaaattcacaccgttactttgccctcaaccgctcaagcgatttctgtcttctttctctccggcaatcccctcggcgcaaaaagacgatctcaaggcgactccctctccggtcaacttccacccgcggcaatgtcgtcttccgccggtccatccaccgctccatcggctgagtacgcagaggtaagcccttatcggctaaatcccttcttttatgcaatagatcgggttctcttggtctcagtttgccttctcttccctttgctcttcttttgtagcatcttgcaaatctgattgtgatccctagctgtcccgcgagcatcagtactttctcggtccgattggtaactctcaccgggcagagtttattagtgctgaaatcaataggatcccctacaggatagccaatcctagcctaggccactggaaaaacaccttcaagtcttggccttctctagagaaaagctggcccgcatggtacaagcgcatatcggctagcaagcagagccactgggatgagctgggaatcggccaggctttagccctaaccatagcaaattcggctaaagatgaacccttgatagcttctgcagcctatttctggtccaacacccttaatgcttttatgttcaaccaagggccgatgacccctactctgcttgacatcacaatgataactggcttggacattacctcatcggctaaccacatgaacctgaactccaagaacaaatttgatttcaagactaagagtataggaggatggtcagggttcatttctgctaatatgggccagggatctgttaacccccgagagcacacagcctatctgttagtgtggctagaaaagtatctcttttgtggatccagttgtggccctacttcgaattggcagcacatagccgaggcccttgaagaaaagaagcttgttattaatatattaaaagaaaatatattaagcttgttattaatctgttaatttactttaacacttgattaattcctatttaattatttaatctatattgatatcttagtataaagtggtatcggagtattagccgatatatgttagatctacgacatcggctatgctataagcacgtataatctttatattgaagtacttttagacataagtgatttatactgtctcggaaagctatacgatctattccaatcacttggtttaaacatatttcgatctatagattataaactgctaatatctacagccgatcgactagatttaccctttttcttgctttatatatcattgccgatctaattcacgttacatcggctagcttacaaatgatacgtcatcggcatgcggccgatcggctatcgtttatggatttaactttgtttctgtgtttgtttcttgttggttgcaggatcaaaccaactagcatgccctttcacccagaagcaagatttgttcctgcactagagctaaacagatctctcaagatttttgatggggaaaataaggggctctcaccggcttttataggcggcgaaggcggcggagggagagaagccgatgacagcacggcgcggctttgggagagaggcggcggcgcgtgtcgattttcaaatgggcggcaatggcggctcagtggtcggcgttggctcacagcggcgcgtggcatagctcagtggttggcgatggcttgaacaatgggtggcagcggcagagcaatgggcaacagcagcaatacagcagcggtggcggcatagccgcggcggccacaggatggccatggcggcggtggcggctgttggggtggcacggggtgcccctaggtttggcagtggcggcggcgcgtaacggcgtggcaacggctggtgaaaggagcggcgcggcagggcgatgtggtagcagttgggcggcgtgtggtttggggcgaggcgatggtggctgtcacgccctgaagtttccccctttttcttgctttaaaaatttgttgaataaattgcccaaagaaattgtttaaataaccatgagctaattccctaattaataaatgcattcaataattgtaaatggcatgctgggatttcgactctagaggatcccctgggttccacatgtcacaatacattaacagcatttttagtggaattttcaaagccctataaataattttaaccaattaaaatcatgaaagtgcaatattttaaatccaaggaaatcaatttcctctttttcctttttcttcttttctttttcctcctttctctctttttcttcccgcgccctctccctccttaccgggccggcccatttcctcttcccctctcgaagtcaacccggccaccctctcactctcaggcgctgacaggtggggtccacctgtcagtccttcccctacctccagccggttggagctgagctccaaccgccggcgcccccacctccccacgctgcctgccttctctgctccacctcgcgccccgactccgcgccgctcccacgtcgccgcccctcccccgctcctcccgcactcacgcgcacccgagaatgggcgggatttgatttcgaatcccaccccccattctctctctctccgcccccacgtcaccggtgatt

SEQ ID NO: 31876 - DNA, 4960 bp, Oryza sativa
ctctcccgtgcctcctaccaccgccgcgccgtgcacccgagctccgccgcccgccgcccaccttctgccgcgcgccgccgccgctagagccaccgccgcgccgcgccatcgccgccgtcgtgctcaccgagtccgcccgcacttcagccgccactcgattgccgcaaaaacccactggagtccccttctcctcgcacgctggtgagtttgtccctcccctccgcctccggtcgtcaatggcatccgctgtggtcattttccctactcgtagctcctctcctcccctcctttaggtatcgccgccgcccatccgcccctccgctcacagggtcatcgtcgccgcctttgccttccgttccggccgccgtgctcgccagtgaggagctcctctcctccctccttccctctgtcccgcacgtgccgccgctctctgcgctcgccatcgccttcggccgccgccgccagcctatgcgccatccgccgccgcttgccgtcgccggcggtcgcacgccgccgccgctccccatggccggccggccggctttatgccgagccgagccatgcctagccccgcccgcgccgtccgatcggccacccggccaatctggaccgtcggtcccgtggaccggcggtggaccacccgcgtggtcccggtccacggtagaccggccgccttgtgccgctgccaagtggggcccaccagccagcgcctccctctcccttgagtcgctgacccatggggcccacctgtcggtgcccccctgatgacgtcagccctgagaatatattgcacaataaataattaaggcatttctttttatagtaaaaacacagagaatcttctaaaaatcataactaattcatccgagctccgtttaagtccattcaagtctcagtaaatcaagaaaaatgcaatgaatccattaaaaatggttttgttttctgtttcagtagtcttatagcatgttttgcttgtgtgctttgtttgtcgcgtagatttcggccgtttcgtcgatctgcggttcctcgaagacgttgctgaggtctcatcagtgcaagagcaaggcaagtcatgcattacaattgatcatattgtacccaatttacaaatatcccgtatttctattaaatgttgcattcttttacaatgtcatgtgggatgggtcctattactcagccatttattgtttaccttatgccattgataacttgggtatcaaaatgactagatgttggtttaggaaaatgcttagccatgcctagttcaactagtacacaaatggggatcacattattacatagactttgactatgagcatagctttggattggtgccaccgcaatggtgttagttaattaaaatacactaaatggtgggctgtgggtgcatggttttgctggtcgcacccatggcaattaaggaccggttcacgggaaaccctgggagacttaccgtgcttgccacaagcgggagtgggtaactgcttgatctgaagtatagctcgaccctttcctaggcaccggtggcgagggtgggagtgatggagttgggtcggtcgaggtgtccggttgtccagctgccggattcaccgcggcgcacgaggggactacccactgccttttgaggggtgggggtgaaaccttagcgtggtgtggatggttaggggcgggttatgcgaagggtcttgtcacgatttcctcctttgcagtgctatggtggtactcggggcatggtgacatgtgtggaatcgtgtcttgtgggtacagttgtgcacctctggccagagtaaaactattcgaatagccgtgcccgtggttatgggtgatcaaccagattcaccgtgattagtctcacccctagtttagcttaatgaactggtgtagttcaggtggtgggttgggcctattgcaacgtggtgtagcgttggacagtgattgggtaatattgcttaatctactgcaattgttttactgttttcaactactgtttttaaatgctagctttatgcaaaagaacctttagcctcttttggttatatcctgcatcataccttctcttccggtatgacttgctgagtacagtgggtagtactcagtcttgctctcttttcccccacaccagagctgaagatcttcctagttggtgatgtcttattgaagttggtttcgtcgctgccgtcaaggattgcctgtggagtggagtcgccccgctgctgaagtcaagcttccaagtttagctcgctttttccttttccgctgcatttgtaatcttttatatttttgtaagacgtggatctgtatgtcagcaattgtcgtttgtgtaccctggctggtcctagacaggggtttaatgcactttcaacttggaaattctggttcgtgaatttctgggcgtgacagtggcgcccgcggtggcgtggtgatggcggcggcacgcccacagtgagagagagcggaggcggctcagttgggctggcttggctttggctaggccgacagcccgagggggagaaggaagtagaaggaaaaagaaaaaggaatgggccaaatgagagggttttatctcaaattgaataggaagtttaaataattttgtgtggagggttttgattggaattcaatgaagataaaaaactaaaggatggatggatgtggactttttaaactttgaacaaagaatttaagtataattttgaagggaatgaaaatgaagagtatttgtttggagactttttgaactttgacaacgaatttgaataggatttctaggaaatagaaactaagggagaagtttgaggacttttagaattttgacaaaaatttaaatatagaaatttttagaatacaaaaggagtttgaaatctttttaaaataaaactaaagatatttattttaaggtataaatttgaaaggataaaataaagatgctccaagtttatagaattcaataagaaccaaatataaaacttgtcacaaaagattttctctaatattttataatttaaaattgaaatagttcacaaatgatttaatttctgactttggatgaatttttgggatggtggcaaaaataaaaggaagggaataaattggactttagcccaagattatgtggtacggatttctgagtgaaacatttgtgggctaaaggaaattggactttctaaggaagcgattggaaatagtgttcttaacacaagagcaatcatttaatatttgtattaatattattcttctgccgaggagaatcaaaccttgggaatcaaattggcggtttgatttatataagaatttggatagtggaacatctagaggagtttgtggaaggtgttgtatgaaggagaaacataaggatttctaaagataggtatagatcaagggtttgatccacaataaattccagcaaaaaggaaattatactggtttagccctaaggataaaaagggttaatgggatataacagaaagttgggccgattagagaaacattggcccaaactaatttgtagacttggaaattttgaataggtaatttagatatggaggattccaaagggagagtatttgttggaggataaatttggatttggagataaatgtaggtggggaattataggaatttttataggaacggatttggtggtagtataataagctctaaaactatgttgactcagagggagattgaaagttgatattttatgtactctagagatatttgggtagagatcaaagggaaagtattaactctgaggaaattgaaaattattgttttatgtactctagggatggttggaaattattatttcatgtactttgaagatagttgagtgggaatcgaaagggtatttgtagatgtggagatgttcgggaatggattcgaaggaaatataatctagagccaaagttatagattaaaataaatggaagggttttgtaaaatttgaaataaacaaaataaggaataaaataaggattttataaaatttagaagagagcatttaactttgcaaataaaatttggatccaaattaaaagatattaaaagaaagcaaggttgctcaacgtaagaattgagaagagcatgacttaaaacatttcgcaaaaaattttcatgaaattttgagtatgttacaatatatattgagtgtgcaatgcaaaatgttgggctcaaccaagatataatgcagaaaagaattttgtggataaattttagtggttattctaaccttataactatcattctatattcgattggtaaactattttgatccctcaaggaatgtccccttgtttgattaaaaatcatctaaatggttatgaaaaattctaaaaaaattgtcaacactcatggaacatacttatacaactccacaaaatcttaagtccaaaatcaactcatatgtcgagatatgaaaaagacaaattcagcgtatgtgttcacttctaaatttgtatttttatctcaatgtgtaggtcaaatttgaacttgatttttggtggaccaatagatatcactatactctacattgttaaccttttcagaatttttcacaactatttatatcgaatttgaaagaaaaaaagtacgtgagaggacatccctggtgggattataatacactcccatattcgattgctaaaacatgtattgtaccaatgtctcttacatgttttattttgaataacaattgccaccgtagcgttagcacaggcatattaatagagactgttcttctctgaaaaaggcaagtacttatcttctgtcaatgtcttgagcgagtgaaacactggtggagaaaccatcttttgtcgatcggccgaattccacaatagtcccggttgcaacaaaaaccgggactaaagatgatctttagtcccggttaaaaagggtaacgggcatatttgatctttagtcctggttggtaacaccaacctctttagtcccggttcaaatgctg

SEQ ID NO: 31877 - DNA, 4803 bp, Oryza sativa
accaacagggactaaagatcccccctctttatatatgccttcttcctcctccagcccgagagcaagcttcaaaatttcttcaaaaaagaggggaggtcatgccaaaatttatagtgaatttactttggtgattatatacaaatcggaggtgcctaaaaggttagcaacttcatcctccaattttttttggtcatattacatttggagctatgttttgcacactttttttgtctccaaaattttgttgtaagttgatgagagagaaaatttgtgtgggaaaagaaagaatatatagaaattttgtttatttgctaaaaaaggttttataaaatagttgagtaggaaaatatagtgaaagttaatcctaaataaaagaaaacaaactaaattgaaaattaaaagaatttaaaacttaaaaaataataaataagaattatttggtggaatattttataatttttgtatgaataatgatatgtcattattgtatgactgttgaaagagtttgtgattattttatcattattgtatgactgtcattattgtacgaatgaatatttgtgtacgatttttttttcatttcatgtagatggatcggcaatggatgtacgctgaccggcggtccaaagagtttattgatggcgtgcattattttttgagagtggccgaagctaacaagcagaagggttttatttgttgtccatgcaataagtgtaagaatcagaaggagtattctgcatccaggactattcatttccacttgtttgagtcggggttcatgccaagctataattgttggacatcccacggagagcaaggggttgaaatggaagaagatgaagtggaagacgacaatattccagactttgctcagtacgctggatttgaaggaaatcaaacgggcgaggaggatagagatgctgattataacgacattgcggatgatcttggtcagatgttgcaggataccaaggaggactgcgaaagtgaaaagagggcccataaattggacaagatgttagaggaccacagaacatcgttgtactcaggttgcgagtaggggcacaaaaagttggataccactctggagttcttgcaatggaaggcaaaaaatggtgttagtgacaaggcatttggcgatttattgaaactcgtcaagaacattcttccggagggaaacaaattgcccgagacaacgtacgaggctaagaagatagtctgccctctaggactagaagttcagaagattcacgcatgtcctaatgattgtatcctatatcgcggtgaggagtacgagaacctagaagcatgccctgtttgcaagcactataatacaagattagacgagatgatctaggtgaggttgacgggcagctaacgaagaagagaattcctgctaaggtgatgtggtatttccctataataccacggctaaggcgtttgtttaggaacaaggggaatgctagaatgatgcgttggcacgctgaagaacgtcaataggacgggatgctgagacaccccgcagatggttcgtagtggcgaaacatcgacagaaaatttaaagacttggaaagcacgcacgaaacatatggtttggtttaagtacggatggcatgaatccttttggagagatgaccagtggccatagcacttggcccgttacgatgtgtatctacaacctccccctttggctatgcatgaagaggaagtacataatgatgccgattattattcaaggccccaagcaacctggtaacgacatcgatgtgttcctaagaccactggtcgaagatcttaaactgttgtggaagaaggaaggtgtccccgtgtgggacgaggacaaacaagaggggtttaacctatgagcgctgctgttcgtaaccatcaacgattggcctgcacttagcaacctatccgggcagtcaaacaagggttacaaggcttgcactgactgtatggatgaaacagaaagtacgtatcttaagcactgtaggaaggttgtgtacacgggtcatcgtcgatttcttgctgcaaaccacctagtacggaagaaaggcaagcactttgaacataaggcggaccaccgtacgaagcctaaacatcacagcgggaaaacagtgtttgctatggtgaaagatcttaaagtagtgtttggaaaggggcctggcagccagcctatagactgcgaagatggtcacgcggcgatgtggaaaaaaaactccatattttgggagttaccctattgggaattcttggacgtccgccacgcgatcgacgtgatgcacctcactaagaacctttgcgtaaaccttcttggcttcctaggtatatatggaaagtcgaaagatacactggaagcacgtaatgatctgaagcatatggaacagcgcagcgaccttcacccggaaccaaaggagaaaggcagccattacttaagtccagccagctacactcttagcaaggcagagaaggaaagtatgtttcaatgcttggagagcatcaaggtaccatctggatactccacgaatataaagcgaataataagcacgaaggagaagaagttcacaaacctaaagtctcatgactgtcacgtgttgatgacacagcttctaccaattataataaggggtatcctcccagacaatgtccgggcaacaataacaaagctatgttctttcatgaacgcaatttcgcagaaggtcatcgatccggataggttagaagcccttcagaatgatgtggtgcaatgtcttgtcagctatgagttgatatttccaccttcatttttcaatataatgatgcatctgctttgtcacctagtgaaagagatcggtattctcgggcctgtgttcctacacaacatgtttcctttcgagaggtacatgggcgttctgaagaagtatgttcgtaaccgtactcgtccagaggcaagcatcgccaaggggtatggaacagaggaggtcattgaattctgcgtagaatttattgaagaccttcgcccaatcagggtacctgaatcacaccatgaagggagactatggagaaaggggactctcggaaggaaagcaataatgacggtagacaacaatttattccgtaaagcccatttcactgttttacaacaatcttcattggtggctccttacatcgaggagcacttggctctagttcgcgccagaaacatcggtaagtccgatgcatggattacacgacatcacattgatactttccccgcatggctgcgacaacatctcatgggtaacgagacgattaaccagcaactggccttcctggcgaggggtccatctggctcgatcgcgacattccagggatatgagatcaatgggtacacattctacacacgagcccaagacataaagagcacgaaccagaacagtgatgttcgtatcgatgccatgggacacgatggtacaactggcacatattacggtgccatcgaggagatatgggaacttgactatggacctctcaaggtccctctgttccggtgccaatgggttaggttgactggtggaggcgtaacgattgatgacagtgggatgacaacggttgaccttaacaaggttggatactcggacgaaccttttgtccttgccaatgatgtaacgcaagttttttacgtgaaggacatgtctagcaaaggaaagaagggcaaagggcctgacgagccgaagcgccacgtggttctcccaggcaaaagaaaaattgtcggagtagaggacaagactgacgaggattacgatcagtttgatgggcaaccccctttcacggtgacgattgaccctagcatcctcctatcaaatgaagacaccccttactcacgtagcgatcacaaggaaggaacaatagtgaggagaaagtacgtgcggacaatcgtcaccgccgatgtattgccgtaattgttgtaaactattttggatgtattgaatatgctagttatatatgatgattaacaaatttaaatcatgcatatgctaggtatatataattattagaatttttaaaagttttaaatcatgcatgtgggatttacatatgttaattagaatttttaacaatttaatatcatgcatatgctaaataaatatgattattagaatttttaaaagttttaaatcatgcatgtgggatttacatatgttaattagaatttttaacaatttaatatcatgcatatgctaataatatatgcttattagaatttttattaattttaaatcatgcatgtggtatttacataggttaattagaatttttaacaatttaatatgcatatgctaattatatatgattattagaatttttaacaattttaaatcattcacgtgcttattatatattatccacttaatttactacagacaacaataatttttcgaaggttttgtcattaatttttcgactttaaataattttaatgcattatttactattttagaaacacatatgcaatgaaattcaatattcagtgctattatctttagtccggttcttaaccctaaccgggtttaaaaagaatttggaaatagcgggaaaatatctttactcccggttggtgagaacaaccgggagtaaagatatctttactcccggttcgtaacaacaactgggagtaaagatcatctttactcccggttgttgttaaagataagatctttactcccggttgttgttacgaaccgggagtaaagataactctcaccaaccgggagtaaagatctgggggtatatatattcccagtgcgccctcgtcttctctaccaacacttagacgtttttcct

SEQ ID NO: 31878 - DNA, 1996 bp, Oryza sativa
  unsure (1)..(1996): unsure at all n locations
nnnnnnnnnnnnnnnnnnnnnnnnnnnnnnnnnnnnnnnnnntaactcacacaggtggcaatttcatatgtatgttaattagagtttttaacatttaatttactagcattcatatgctaattataattgactagaggatttttaaaagttttaaatcacgcaagtggcaattttaaatgttaattagagttttttaacatttaatttactatcattcatatgctaattataattgactggagaatttttaaaagtattaaatttaatatatttttaaaactatcattcatatattagagtttttcacaatttaatttactatctttcatatgctacttatatatatgactattcgaatttttaaaaggtttaaatcatgcatgtagcatttacatatgttaattagagtttttatcatttaatataatataattcctacgctaagtatatatgatgattacaatttttattaattttaaatcatgcagtatgtacatacatatcttaattagagtttttaccaacataataatatcattcatatatatgctaagtatatatatatattggaatttttattaattataagtcatatatttgcttattacgatttatccacttaatttattacagacaaaaataatttttcgaagtaattgtcattaatctttgtactttaaataatgttaatgcattaacttctattttataaacacatatgtaagcgaaaatcatatgcagtgctataatccttagtcccggttgttctcaacaaccgagagtaaagatcttttctttactcccggttgttctaaacaaccgggactaaagatatctttagtcccggttgttgagaacaaccgggagtaaagatccggggtatatatattctcggtgcgccctcgtcttcttcaccagcacttagacgttttcggccgatcgatctctctcggcctctctccttcgccgccacgagacgctcaatttcatcatcaatatcacagcccaatcacagaaattcaaagaagctcatatacatctcaagttgttgaaatacatcacagaagtttcaatgttacaaattacaagcactcatggttcaattgacaagttaaaccaaatacaattcacaagaaaaattgaaccattcattacattcctttcaaataccacaatccatcggcaatccagtcccgaaattggttcatgacacgcgagtccaattcatttgttggttcgctagatggagaagaggttccacccaatggatcataattttcatcatggtcacaattgtcgaactctgtatcagccatttgactgtctctaatgaaattatgaagtgctatgcatgcatggataattctgctttgcttttcctgcgagtagcttggtaaactaaacaaaatcctccacttgttcttcaagaccccaaatgacctctcaatgacattccgacacgaagaatggcagtaattaaagtgctccctttttccccttggcaatgtgctttcgttgtactcttggaaatgatatgttatacccttgtatggtgctagataacccggcctatttgggtatcccgagtctacgagataaaactttcctggaggtggctttggaaacttggcactaaatctagtatgtgcatcattgaataccctcatgtcatgaaccgaaccaggccacccagcaagcacgaaagtaaatctcatatcgaagtcacagacacacataacattctgactcttctccttatgtctattcctatgttgaacagcagctgaatttggcaccacaacttggatgtgagtaccatctattgctccaatgcaattatccaaatatggtgtgtactgaggagaaagcaatttcttatggaatgttgtgaataagggatcttttggcctaatgatatcttgtgcaagtttcagtagagcggtcaaaactgctttgaacttactatgtactgttttaagagacctaacaaatctgt

SEQ ID NO: 31879 - DNA, 7911 bp, Oryza sativa
atatatatatatatatatatggtacttcgcatgtaatcctgaatacatctttttgtattctgccaaaaagacgtgttgtcggagtcgtcgtccaagccagagtggaagagctagccctagaaggaattggagcaggcaagtgacgtaataatataaatgattgttatatttgtaatgcaattaattaagattattagacctgtaattggacttatcatataagattgtgtagtgttctaatattatttgagttttaatataagattactttatttgtaattacacttagtatgtaattattgactacggaagtggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcaccttgacttagcttatatcacgatttgtaattagacttagcacgtaaggttgtgtagggttctaatgtacgacatttacacttagcatacatgacttagattgttaaaacataaatgtatcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaaggaaacgtggagagggatgcggaagggaaccagcaggggcacgtggaaagggatgtggaggggaaccaggaggaggacgctagtgatagtcatccctccgctggacagaagagggcacgcgggcaacaaggtgccgcgaagaagatagagggtcagcacatcataaactgaggtggacgcagacggccgacctagtgccccggcaaaagcagcgaagaattttgtacgccacatcggttgggttgtgagggataacgtgcctgtcagcaaggtgtactggcgcagaacaagggcacgcggggatcatgagagctttgtcccagattcagagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcttataagacaggtgaacaagggcaggcgatgatggaaagaaacaaagaaaatgccgccaagaagaagtaccatcaccacttggggtcaggaggctatagcgtcgcgatgccaaagtgggaggagatggaggctagcttgattgagaggggtatcgaaacggcaacagccaattggccggaacgatcgaagttctggtactatgctcacggtggaacgctcaacccagctgatggctcactggtcttcggcgatcagatacgagaggctgcacgacgactaacagatgcagtggaagcctcctctcagggcacgttccgaccagacagagatagggacgagctgacactcgccctacagactccagagcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtaagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttccagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaggcgcgtacaaggacctcgagctggattaccctggaggaaacggtgagacgcatctacgagacacaagccatgccattattctatggcgcaggcggtacatcatcctccctggtcgacaagcggcgtctcgtgcaccatctcctccggttccgccatctcctcctcatgatcctgcaccgtctcctcctcatgctccgccagcaccgtctccacctcaggctccagcatcgactcctctcaggatcctgcaccgactcctcctcgtgctcctacacctactcccccgcaagctcctcttccggcaccttcaaagtcaagggcccccccagctgcaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccaaaaaagaagattcctatagaccccattgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcacacatatctacgaactataccagctggacgccgtcgacgtctctattatgagttgctggattttgtaagtatatcgttcagttagatttcttactatacgtctcctttaattaattaggtccttgtatataagtagactatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattgtactgtcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcaattggtccgtggcaaatggagagaaagacttaggcggaagttcaaatttcctgttagtacacatgctctacatttatatttctccgattcaaatacatacaagtgtatattaattagatctctcgttgtttgtcatttatttgtagtgcgcaaagcaaaagcagggaaataacttgtgcggctattacgtgtgcgagtattgccactgccttgcaaaccaaatcatcaccacaagagagctcgatgtacgtacaaataaattcaaaatttcagtacgtagcgatttcttgtttaattactaatcaatttcatacattcatatagtttattcgcatgagggataacctgaccacacacaaggaatttatcacggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttggtcatatatatatctatatacatatgcatttgcataacatatatatgtataaatacatatatattatgcatgtatatacatataatataatataatatatatatatacatatatatatgtatgcatatatatgtattgaaacatatatatgcatggtttatatatatatatatatatatatatatatatatatatatatatatatatatatatatataaaccatgcagcaacagggccatgaaaaaaaaaaaggtcagctcgatctttagtcccggttggtgttaccaaccgggactaaagatcgatctttactcccggttatttcaaccgggactaaagatagcgatctttagtcccagattggtactcccggtttggaaaccgggactaaaggggggttacgaaccgggactacaaagggtttctccaccagtgcttatagcttcatagtggtagtgctagggatttaaaatttaaaatatgtagttttgtgacaacctcaatattaaatatgtagttttataatgtttggccttaaatatgtaattttaggatgaatttatcgctaatatatagttttgtgataaatttaccattaaatctgtagttttatactggtaattttataaaatttactcttaaaaaacagtgggatccacgtgatactgtgaccggcggcgagagacggctgccgctgcccagatagcccatcttcaatcataccattgcactagaaattcaaacaaagattgaaaactctgtcggcttctttttttttttgaaaaaaaagaagaaaatatgtcatttgtctttctgacacaggattgtataatgtatagagaaacatagttgccgtcacttgtgtatcgataatccctggtggaccatgaatacgaacaggacgacgcgtacagggtacagcaataatcatcgatcatcaacccaacaagacaacatggttgctgtatcttgagacaccaatctgaataatagacaggacatcgcgccagctcttcggaagttgcctttatttaatttgcactaatccatcgctacaatgatacaatctcatgttactgttcatcctacacagataaggatgtactcatgtaggttgagaactatattgagatagtgcttgctcacttttgtcaatatgatgcatacaatttgcaagaagtacgtgagcactcactttattatgctacagaaccaattttgcaatgtacttacacaacagtaccaagacaatgccctgtgaatatgcagttttttttaagctaatgaaagttttaattgaactcagttcgtcaagttgatacaactgtactgagaatactcccaaccatattatctctgaaacttcaaggtgaatatgcagctgtaatggtaattatctccgaatattcttgttcagtacattaattatcctctggctatattagcatggagttcttccagctagcactgaaagtagtggtctagctaatcctgttttgagcctcactcctcttaataatttccaatatgagagctcctcctctcatatccattgttatgagaatggcaacggggtcttccagctagcaccatgtcacaccctgaaaatcataaatatataaattgttgtttaattggaatttttagaaataattttaaaagccttgaagagaagatctagttttaattaataaattccaatataaaatggggccagataaaatttcattaaatactttgcttaattctataattcctagatttttctgggatttatttgagctaaggaagtatttttaataaatggaattgcatttcataaataatttaaattgaaaaaggttttaaaaaaagtctcttttggctttgggccgaaagtcggcccaaaacccttctctctctccccggcccaagtcggcccagtccgcgcccgagccgccgctctcctctctctctcgctgtcgctgacaggtggggcccgcctgtcagatcgtcgtctacctccggccgccgccgcccgaaaccctagtttcgcgccgccgccgttcccttccaaattcgatcgatcctttccgtttccggccgaattgatagaggggaaacaatcttcgggatctcctctaccttttctcttttggaaacatcggctaaatcggtttggaaatcgttggattcgaagtcgaatcggatcggcttttctctctccgagcccgacctttccttctcgtcgccggccgccgtgggccttcgccgccgcctcttagcccctttaaaaggacccccgagctcttctctaccagtcgcctccctcgccttcgcctctcgtcggcggaaacgctctagcgccgtgtagcctcgagccgccgtcgccgccgttgctccagccgagcgccgccgccattccagacgtcgccgttgctcgggaagaccgccgtcgtggtcgccaagccgtcgccgtccttgtccgccccttcgccgtcgccgaagatcgccggagcaccatcgccgccgtcgacccgaagaccgccgccgttttaacctcgtcgccgtcgccgtccgttggtcttccggcgctcttttggtcaccggtgagttcgccgcgtcgcgctctacccgttggtgtcctccgttcgtgccgaagcgtcgccgttcgccggcgagcgtgcgccgtccgagccgccgagccgccgccgccggtggtgacgtcatcgctgacgtcatcgtccccgtctcccgtgagccggtcgtggaccgatcgatctcggccgtccgttttggatcaagtctgacggagctcgtggctcctcaccgggagaccgcgcaggcccccctttgccggttcggccgggggcttagggtgagatctcaagctctcgctgtgtgtggaaagatcgcgtgccaggaagaaacacgagacacggacgatgtatacaggttcgggccgctgggaagcgtaataccctactcctgtgtttttgtggattggtgtatgaatgagctacaaagtgtcagccaacttctcccccgttctaagctctaaatctggaaaagaatccaccaaccctttctctatgggcaaggtcctccttttatacttcaaggggataccacatgcacccttccctttccaaactggactgttcttcttctctttaatgggcggagattggtatggttgtcgtccaaatgacacttcgatgggacagctcacacctacctccactcccggcggagacgggcgcaacgtgagatcgtggctgcccgttgctgatgcgaccagtgtcagaccggtcattcttgtccaccacgcgtcagtttaacaacgtgcatgtttgcccttctttgtgtaacaccttgcctgtaatgattaggatgaagcctggtataaatctaaccagggctaacgtgccatctctaagagataacacgctagctccggcttgagacgagttgccttga

SEQ ID NO: 31880 - DNA, 2176 bp, Oryza sativa
cccccctcaggggaaatcacgaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatttcctttcccaagggaagcggtcaagtgtgacgccacccctaaagcctggtgacaggtgggaccggtctccgtagttgggcaaaatgcccaacggtctcaatccatgcacattggtattgataactttgtttgtccataatgggcggtctattcaagactgccacaccacttgagcagcgcgcgaatctgggtgagcagatttgtctcgcctggagatacggtaacgccgcttcggacggcgagcgtaattaacgcgcgcacgatacaatccatttcgattgccacaaccgcatatccacttcatgcgccgtaagcgggcgaatgggattagtggaagcgtgggcacgggaaacgagggagcgagatagcgagatacgagggagcgaagtagtgggcgcgagaaacgaggagccaggcccagcgattgcaagggtataaaagcatcgagaaaaggatttgctcccttcctttcgccattgttcctcttgccttcgccgcctgagctctaactctttctctgctacgccctactttcgccacacacgctcgttcccaatcatctcttcctccaccgccatggcacggggctctgctctgctcgacggcagtgtactgccgccttcccgcatcgtgaacgagaggcacgccggactgccgcgccgcttcatgccggagtccgccaccggtcgggagatagtgatgctgggcgaggggcgcccggcaccagactacccgaggcggtccatcttcttcctccccttcgcaatggctgggctggtcccgccattttctcatttcttcatggatgtcctggagttctacgatctccagatgggcgcacctcacccccaatgcggtgatgacattggccatcttcgcacacctgtgcgagatgttcattggggtgcgcccctctcttcagctgttccggtggttcttcaccgtgcagtcggtgtcaccgccgtcggtggttggcggctgctacttccagccgcgggggccggtgttgaaccgctacctcccctgcgtcctccgcaagaagtgggacgactggaagagcgactggttctacacccccctcgccgacgaagcgcgcctccgacttccaagccagcccccggcgcaggtctccagctggcgggcgccggtagatctgggggaggagtacgacgccgtcctcgaccgcctggcgggcctgcgatcccaggggctcaccggggccatggtgttcggcgattacctccgtcgtcggattgcgccgctccaacggcgcgcccggagcgcctgggagtacactgggcctgaagactacatgcggacccaccagggagccagatgggattgggctcctgaggacttcaagatcgtagtccaaagggtgctgaatcttagctccgcggaggcgtctcgccttcctcaggagatcctccccctctgcatagatcccgaccgcgtctccattctaaccattatgttgggggtcggggcctcagaggagagagcccctaagggccacgacggcgcgggcgagcgacgccggagggaacaacctgccccaggagggggtcgtgcttctgggccccgcgtcgggggctcggggagcagccgccctgccgacgcccaggggaagaggaagctgggaggtacacctcccccatctcctccccgagggggcggggcggcgcgtgccagcagtcggcgcccggagggggccgcgccgacgtcgcagcccgagggggtgcgcaagaagaagcggctccgcaagacgggggagacggaaccgtgccggggaaacctgatttcccctccaaggtggtcattcaaccgaccccctcgcaggttcgtctcactctcattgcaaccatctttctccaaaaagaagttttttttcttgctcactttgttcgtcttctggctttttttttctgtttcagcgatgtcccgtcgcattcctcccgccaccccaagtccggccagtccgaggccgaagatccagcggccgcagaggag

SEQ ID NO: 31881 - DNA, 2125 bp, Oryza sativa
gatttttccatcggggaggccgaggccctccgcttggtgggcgagatggggcccgacatgctttgggactcggtctcccgcatggatcgcgccggtcggcaagcgggcctctggaaaggccagacgaggacgcgcccttgcaacctggaaggcctcgctccgcacctcaacaggatggcctgggtcctcgaacgactccccgaggagctcgagaagaccatcaagtcatcctcgagggacctcgcccggggggcggtcgaactcgtgctagcgagttaccaggcccgggaccccgatttctctccctggatggcgctggaggagttccctcccgggaccgaggacgacgcgcgcgcgcgggtcggggatgctgccgaccacatcgtcaacggcttcgaggggtcggcccctcggctcgcgttcgtctccagctccgacgaggagggcgacgccagcggtgaggatgacggtggcgacgaggccggctacccgggcgcatcggaatgagcccccgagcccccgccaatctttactttttttctttttctttcttctaaggccttcatgcctcttttttgtataaattaactcaatctgcaatcagaaacgaaatgatgaaaaaatttttgtgttagttttattttgctatacatatgcgatgaggatgatctgtgccatggtccttttgcgccttagcttgaaataagggctcgtgcccaagtcccagtcctcgaatggctcgggtcggggccagtgcctggggagatccacatgtcgagactggccaggccgggaacgtggtgaccgaggggtatgggtgacccgattgtgggtttttgccgattcccccccggagttcaccacgccccggggcacggctcggttctgggccccgtttggcgattttagctgaccgaaccgagcccccgagggtggggttgagcacgagtgacattatttcaagtcaagattcctcaaaaggaaaaaacggctcttacacaacctttagaaaattgaaactgcttctattgaaatgctgaaataaaggaaaaaggaatatatgtgcatgtgtggtagcccccggctaacccggcacacccgaggggggtgcggggttagcccgagccaaaacctgacacccgaccccccccttcaggggtagaagcgacgaaggtgttcaatgttccacgggtttggcagcttcgtgccgtcgcccgtggccagccgtaccgagccccgcccggggacaccgatcactcgatacggacccttccacattggtgagagtttgctcaatccagcacgcggttggacgcggcgtaagacgagggtcgtccaacgcagagtgatcgggcccggacgtggcgcttatgggaagcgcccgccaagctctgctggtagcgcgcaactcggagggccgcgcgccgccttcgctcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatgttgaaggtcttggttttgaggcctttaaggatttctgcattggcgcgctccacttggccattgcttctggggtgggcaggtgaggcgaagcagagcttgatgcccatgttttcgcagtagtcgccgaagagttcactagtgaattgggtgccattatccgtaataatacggttaggcactccaaaacgggccgtgatgcccttaataaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatgaatttgcttggcgtggaactgacacgctctgcatcgccggaccagatcgactgcgtcattgagagctg

SEQ ID NO: 31882 - DNA, 1537 bp, Oryza sativa
  unsure (1)..(1537): unsure at all n locations
nnnnnnnnnnnnnnnnnnnnnnnnnnnnnnnnagagtcgcctaacaccaggaggcggcggatccccagcccggctgccaccctgagcccggcaaggagtccctcgtactctgccatattattagtcgctcgaaagtcgagacggaccaagtatctgaggacgtctccgtttggagaggtcaacgtgacccctgcaccggcgccctgaagagacagagaaccgtcgaattgcatcacccagtgggcggcatgaggcagctgtgaggggttcgcgctggcctcgggcattgagacggtctctggagccggggtccactctgccacaaaatcggcgagggcctggctcttgatagcgtggcgtggttcaaagtgcagatcgaactcagaaagctcgattgcccattttaccactcgccctgtaccctctcgattatgcaagatttgaccgagggggtaagacgtaaccacagtgacccgatgcgcctggaaataatggcgcagtttcctcgaggccatcagaatagcataaagcatcttctgggcctgtgggtatcggggtcttggcgtcccggagggcctcactaacaaagtagacaggccgctgcacccttcggtgggcccgatcctctttgctaggggccgtacccccggggcgttcttcgtccaagtggccccttgggcgcactcgtcttttgtgccgatgacctcggggtcggaggacgacaggagcggccttcccccagtggcctggggtccgtcctgggggtcgggggctcctggcatcgtcggacaagcgggcaaagggccaactccggtggtcaggggcctgtggcctccgttcggctcgggggcctcttctccctgctctttcccgggtcggctcagcacagggttagcctcggggtcaaagggcgttaagtgtggccttcccgcagtggcctcggggccttcctgagggtcggggacacccagccccgtttgacaagcgggcagagggccgtctccggtcgtcaggggccttaggccaccgtttgactcgggggcctctcctccctgcctgctcccgggccaagtcggcacagagtgggggtgcgcagaatgaggattgtcctcatcgcgctccccaaccaacgctgcactaactacttggggggtcgctgctaagtaaagtagcagggactcatttggctccggggcgactagaaccggaggagagctgagatacgccttcaactgggcgagggcattttcagcttcctccgtccaagtgaacggccccgagcgcttgaggagcttaaacaagggtagcgccttctctcccagccttgatatgaaacgacttagggcggccatgcaaccggtgacgcattgcacatccctaagtttgctaggggggcgcatccgctcgatagctcgaatcttctcggggttggcctcaatgcctcgggcagagaccaagaacccgagnnnnnnnnnnnnnnnnnnnnnnnnnnnnnnnnnnnnnnnnnnnnnnnnnnnnnnnnnnnnnnnnnnnnnnn

SEQ ID NO: 31883 - DNA, 1785 bp, Oryza sativa
  unsure (1)..(1785): unsure at all n locations
nnnnnnnnnnnnnnnnnnnnnnnnnnnnnnnnnnnaaaccatattccgagcacatgttcgtcccaacttgactcacattagtaaggaactatccaaatccgacaaaccaacccgaaaccaaagcaaatctagaacctgccagtcagaccgcggcctggccggtctgaccaccgcatgacctgcggtctaaccggtggcattcagccggtctgaccgccaggggtcaaccgtgccattacttgacaaaatcaaacatctattaatcttcgaaatcgcatcataagaaaccaatatttcacacatgaaatgtcacaaaccaccaatattttcatcacacagaagctaaatcaactccttgattttacatatataatctaagttagcgttgatatctaaccctatcggctgccttctaacaataaacgtttgtcgattgaaggttagatagcaatattgctctagattatatagaatatatggataaatcagcagcttacatagacaatattagaatgtcataaagatggaagcactaatcccgaaaacacaagccgccataacaagttttacctcgttgtcagagatcgaactgatgcagcccaactcgaaagcaaaaacttatcgaaaggaaacgaaaacgaaacaagggcaatgcgcccagaatggtaatgaactgatcggtcattgattacacgggtttgggcttacttttatacccaaagtacatgatatgtccttgtcggacacaactcctaactctattacaacttaggatacgaacaagtcgctaaggcagactcttaatgacttcaaagtataaggaaattacataaaatatcctaattaatagatacaattgccttctcaggactcagtccgtgcgtggcaatccatatgaagcatatcaacccgatccgacaacgtttccaatgccatattgccggaatcggctccatcggttaccttgtctgactcgaactctgccgatttaggtcgcagccgattcagatttcagccgatgcgcactctgtttccgaaaccgctaatcccttttattccacttcggttttatctttatctccgatgtttgatttaccaaatttggttgttaacacatgccccccaagtccgaaatatttccgggtgttaacgtaatgttgcggattttccaaatcttatctctagaaaaatctaggcttgccttttttgaccgttaccacaccactttaaatattaatcgtcacccccgagaaaattcacaccgttacttccgttttctccgctcaagccacatctgtctcttctctctccggcgatcccctcgatgcgcttggcgattccataggcgatctcatcacagcgacaacctccgttccggcgatgtcgacctctgctggtccatcaagcgccccatcggctgagttccctgaggtaagtttcggtcgtctagatccctttcttttgcagtagattggttctttccttgctcaattcgccttccttttcttttcttctgtagcaatcctctcatcaaatcgcaatcccgagtttaacttaccccaatcagtacttcctcggtcccatcggcaatctagatccaacatagttcatcaatgccgaacccaagaaaatcccttttaggctagccagccccaatctaggaatctggaaaaacaccatcaagtcatggccatcaactgtgaaaagttggacggcttggtataagagggtatcggctagcaagcaaggccattgggaagaaattgggatagcacaagctttagc

SEQ ID NO: 31884 - DNA, 1946 bp, Oryza sativa
acatacttcatcaatgccgaaaccaatagaatcccttttaggctagccaaccccaatctaggaatctggaaaaacaccatcaagtcatggccatcaactgtgaaaagttggacggcttggtataaaagggtatcggctagcaagcaaggccactgggaagaaattgggatagcacaagctttagccttgactgctacagatatggctaaggacgaacccttgatgtcggctgccagctaattctggtccaataccttaaacaccttccttttcaaccaagagccgatgacccccacactcttggatatcactatgataactggccttgatataacctcatcggctaatccagtcagcttgaacaccaagaacaaattcgacttcaaaaccaagagcataggtggctggtctggatttgtctcaatgaacatgggtgatgggtctgtaagcctgacggatcacacagctttccttcttatgtggttagaaaaatttctattctgtggtgcaaggtgcggccctactgcaaactggcaacatctagccgaaaaactggttgagaaaaagcaattccccttagggaaatatctcctcggctatctttaccaaaccctaagcaatgcatcagctaagattgcttatgggacagtaatcggcacatgtggtccatggtggctacttcagatctggctcaacttgattaccaaggaagttgtcgatcgaccatctttaacagaagaagacttcccaaggtttgagctgatcacggatgaggatggtgaagaagtcacccaccgccgatgcatgtcctttggagaggcagcatcaaggaacaccggggccaagctatctgctgaactgctcaaggactgcttttgcaacttttatgatggtttcccgaagaacgctagagtctggttcgcatatgctgattcggctagctttcaacttccttcggattttagatttgatgagatcaactctgagaagtttgagaaatccagaaaagtctttactatagccatcaccccctgcatacttctagtcggcatccatcagggcaaaaacatccagatatcttatgagttttatcacccaatgagtgctgcaaagcaacttggattgggacaactgtcgattgggttgtactttgccgacaggatccaaagtaggggagaaattacattggctctgatgatggatcggctactaaacattgaaggaccttcacttggcagtatagagaacatcgaacaagccttgttcgggagcaaatcttttgaccaatggtgggtcgaatggaagaaacacctctttcatcagacaacttcgatgtatatgactgatctattctctgatctgatccctcaagtaagttcttttacctttgtcaattctgtttgatacctgcaagccgatttgtacgtaaccagttttttcttctgtttgcagaccacagagacttctccccctcatcaaagtgagagtggtcgggagatcgattatgcagcaagcctccttccaaacggtggtagattagcttcccctatcatcggcttccatgcccctaagacagcaagccttctccaagggcagatgagagagccaatcccagctgatgctggaaagaaaaggaaaaccaaagcatcggttgcggatccatcggctgcagaaaaagaagtccaggaagcaaaagataaagtgtcacgtcctgataaattcatcccgaaataaaaatcatcctctaaaaagaataatagaattaattaaaattcgaaaagaaattggcaaacactaaaatacgtgcaacaaaaatttgaaaatgggccggagaattttgggtaaaaactccttggtctaaaaagagcccctaaattttagtggaattatcagagcacaaataataattattaagaaataaacaaagctaaaatgattttataaaa

SEQ ID NO: 31885 - DNA, 1034 bp, Oryza sativa
aggatcccccatttttaaattaaaatttaaatgaagaaattcgcaaatattcatttaaagagcatataaacttcaaatggccataacttggccatttgaactcggaattggactgttcaagtctctaatttttccttaagaagtcaagaacccatttttgtgctttgttcctacttgttatatggagtttattagagtaaaagccttttcttttccgttggtcgtgtaaacgctgcagcttcggaagattcgctcttcgtggaagttgaagccgacgtttgggaaaatgagcaaggcaagtcacatcatccttgaacatattgaatcccagtttataaaattattttgatttaaattattgcattatcgctttatttaaattcccgcgttatccctgttttatctagccatgcctatttacctttgttatgaccttattattgctattgttattattatcttgttcaccctaggaaaataaaaccccaactagtgggtactctattcatggttccactagtatgaatttaggtagatgcttcgccgcttaattaggtaacattaggtggttttacaactctagactttgggatattcatatcacttggatactatggaatggttggcttttgttggaattggacacacacctccccctctattcaaaacccctaaaatggttttaggctgggctcgaggtgcgtggttgggttttgctagtcgtacctcgggtactataaggattaagctcgggcctctgttgcaaagcactaccgtacttccacatgtctagtgggtaaggcttagtttgtcgctcagtctggttataaacaaaagtacacggatggagatggacgaagtcgggggtcgatggacatctctaggacaaatgaaggctacacgagctgcggcccggtagtcgagatgtcatgccacagggccggtgtcctgctgctagggggctcaatcctgcctacctgtcccgggggttccggccataggtggggttgggtcggtactcttgtctatgctag

SEQ ID NO: 31886 - DNA, 8192 bp, Oryza sativa
  unsure (1)..(8192): unsure at all n locations
cggcgtcgcctccgtttcacgcggagaccaccggagacgcgtccccgctggcaaccagtggcattggtgccactgtactccctccagccggctgctgtccctcgtcggagcgtcggccgacgtcgccgtctccttcgtcggtgccgtggcatcgtctccttccccggccacacctcggtttcgccggaacaccgccgtgtcgccaccaaccctccacccggctcggcggagtcctccggccgcccgttcctcctcgcttgtttaccggtcagccacgggaccaccaccttcggcatcgcagcggcaaggtcgccctcggcctcgcctccccttcgaccaaacccctccgcggtccatcgtcgttgtctccgttcgttctcgtcgtcgacgtcccgtcagtcgccggctcgtcgtctcgcggcgccgcctccgtcgtcggcatcgcagcggcgtgttccacgccatcctcgcctccgtgcagccgctgccggctgccctcgtcgcctcctcgccggccccggtcgtcgtcgtcgtcgtcctctcgtcgctcccggtcgtcgtggcgttcgtccctccgtcgagccgttctcgtccgccgcccgcgtttccccaagtgtgcagcagccccgtcgaagtcttcgtcctcggctccgcgtcgtcaagcctcgtgccggccgcgtctcgccttcgtccaaggatcgcgacgaaagtcgtcccttcaccgttcgtctcagtagttcccgaccgcatcgacgcgcacgtatcatcgttgtcgttcccacgcctcatcgcgtggtggtaaggatccctctccctcgctgccccgtcctcatcctttcggtgtcgcccgtgctcgttgtgcggttgtcggccccggtacccgtgtaccggtgtcggtagtcgttcgcttgtgcgtgtggtgaccgtgtttgtgtgcccgctcggtagccgcgtggtttctacgtgtgcagcccgtgtggtgtctagtggagtccgtttgtcggccactcgcctcggttgacacacgggatctgcttccgtcgatccgtggaccgtctctgtgtactcggtctaccgcggtcctttaggttgacatgtggggtccgcatgtcaacggcgcagccttcttgtcttttccaggctagcgcttacacatgttttataattgcaaagcttaactataataatccgcaaatctccatataacagcattaaacttcggatgatcatatcttggtcatacgaactctgaatcgacccgttcaagtctcctaatgtttgttataacctaaagaaccgtgtgctttctttttatgtattgttattgcttctttataggcttgtagctttgcttgtgtgcttcgcgtagcttctgtcgttccggaggttcccgaagcgtggttcgcggtcgtcgccgaaggttcggaaggccgttctctctgagcaaggcaagtcacatcatccttgagcatattgaatcccagtttataaaattattttgagttaaattaatgcattaccgctttatttaaattcccgcgttatcactgttttatttagccatgcctatttatcattgttaagacattattattgttattgttattattaccttgttcaccctagaaaaatcaaaccccaactagtgggcactctattcatggtaccactagtatgattttaggtagatgcttcgctgattaattaggcaacattaggtggttttataactctagactttgggaatattctcaccacctggacactatggaatagttggattattgtggaattggattcacacgtccccctctattcaaaaccctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagttgggggtcgatggacatctctaggacaaatgaaggctacacgagctgcggcccggtagtcgagatgtcatggcacagggccggtgtcctgctgctaggggctcagtcctgcctacctgtcccgggggttccggccgtaggtggggttgggtcggtactcttgtctatggctaggatgggttggaaactatgtcacgtcttccgtccgtataccgtggtggtatgtggcacgtgattacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctctaggatcgtctttataaaatggctttgggcaactaagtgacttttaaatgctgctttctgcaaaacttaacccctatattattatccccttgtactcctttgcattaattgtgcatctccggtgtggcttgctgagtactgtggttgtactcattcttgctcaatctttcccccctccagtaagagaagcgttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacagagcgcctgtgaagatggagccgcaggcccgctagtccgctgctgtttatttttgattgtcaggccttaagtgcctttgtaataatgtaaatattatcgatataataaagatgtgtcttttatatcatatttgtgtgtggtgtaccccggcttttcctgggacggggattaatacactagcgttcgggaaaatgtatttttctcagtcgtgacataaagccagccgataatctgcctgctattgatccagacatggaagaagtcttggctgaggaagagattgaagaagctgtcgatgaagcagctgctgagttgagcgaggcacgagaacaaacaccaccagccgatatcccggctcctcaaagaacgcctccaacaccaattgccctagctcggcaaaccagggtaagcacttctgttcaaacttgatgcaagtaaaattttcatgtgctgatttctcttattaatacttgatttttgcagcaaaagaaatctgctggaaggaaaaagccagcaccagtaccatctccagctccatcggtaactttatttctctgaaatcttatgttaaactcagccgatgttaactagtaattgatcttcttaattggatcttctttcagccttctcctccttcacctcctgcccagccagcatctagtgaacatactccatcggctgcaagcagtcacaatgtagaagaagaagtccaagcccctcctactatcactgtaagtttctttcttcaagaagtctcatatcggctgtatacaaaattttcatgtacttaacatcttcatttgttcttttttaggtcttggccgcatatgttctcctttgatattcggcaatacttcgatgaagaagaggaagacaccactagcaaggctcttgcccctctaactgatgatgtgaaaaggaatctccaagatatatcaactcggttggaggcctctctagatgtattggtcgcctactgtggatcaataagaactaggttcaatgaaatccaagacttgatcccataagacttggttgctgcactgactccggctgctttccttgagcaacatcaatttaaattagagaaagcaaggcaaaggatagctgatcggcgagaaagaaaagacattgaagcaactatccaagccaatcggctgtccgtgaacaaggagaaggcaaggttagatcagctatccattgggccggtgcctattcaatccaatatagatcggctagaatctcgaaggattgaggtcttggctcagcttgaagagtgcaacaccgagttagccttaaagaggcaaaagttagccgatctgcccaaggttgttgaagaacagaagttgaagttgaaggctaccatcagaaatgttgccgatctaaccaagtccttgaagtttgttcctggaaccgacgcccaagatgaagtggagcaaattaggcagagggcaatatcggctattcaaagataccttgccgattgaactgatgatatgtaataggacttagaaatatttttgtaactggctttaaaactcttgtgcttccgtagtttgctctcatgaacttgatgccgattaatataacttttgtttttgatgtccatattttttgtatatgtatggccccttaattttaccatgttgacaaacattgataaaattaaaataccaactaaggacgatacaacaaacatcggccatcatacatcggcaaagcacaaccgattatgataagtgaaaaaacactaagggtgatataacacatatcggccatcatacatcggcaaaatacaaccgattatgataaaataagaagtctaagggcgatatgagtcatatcggccatctaaaggcaatgtaaacacctcggctgtcatgtatcgacacaatcgtagccgaatcatgaatggatccatacacttggataatatttcttcaaatactttccattaagagctctgccgaaaatttctccatcaagtccttgcaacatataagcccctttagaaatagacttataaatttgaaacggtccttcccaattcggcgaccacttgtcgaatttgttgtcacgtgtgccaatcggctagatcaactttcaaaccaactcttcttccgaaaatgatttcggcacaaccttcttgttataatctagagtcgttctctccttatctctcaccaccttctccaaagcacgcaatcttgattgcactaagtcctccaattcatctaccataagattatgataatcatcggctgtcaactcatcttgaaaatcaatcctcctcgatccaattttagtttcccacggtaaaattgcctaatatccataaaccaacttgtaaggaggaacttgaattgaaccatgacaagccatccgataagcccataataccttagccaatcggctatgccactaccttggaaaatcggcaatcttcctctcgatcagcttaatcaaactcttgttatatgcctatgccggcccattagcttgtgcataatatggnnnnnnnnnnnnnnnnnnnnnnnnnnnnnnnntcaacaacttaatccccaagcttttcgcaaactgaacaaattcatccgaaacaaaaattgatccctggtcggttgtaatagtctgaggaactccaaatcaattgataatatgttttttgacaaactgaattgcatccccagaatcaactttcttcaaaggaattacctcaacccacttcatgaaataatcggttgccaccaaaatatacttatgtcctttactcgaaggtggattaatctggccgatcatatcaatcccccaacctctaaacggccatggcttgataatcggattcataaccgatgctggtgctctttgaattgctccaaacttctaacaatcttggcatcccttgtaatatctaaaacaatcttccaacatcatcggccaaaaatatccaactctgcgaagcaaccacttcatcttttgagttgattggtgagtactacatatgccttcatgcacttctcccatctcaaccttagcttgattggtactcaaacacttgaacaacactccatcaatcgctcgataatacaactcataatccaacaaaaaaaatcgcaaggccttatattttaacttccttgcagccgattgagaaggatttttgagataattgtatacatcatacctccaatcatcagctgtaatggtagcaacttcaatttcaatatctttaaccatcggtttgtatcccgatgccccctgtgccaaatcatttgtctgcatattttgctctcgagaaacattcttcaaagtcaccagccgaaaactatccatcaactcacagcacttctcattgtatatcatcaatgtatccttcttgcattcatattccctagctaatcggctaatagctaacagagaatcacctatgatttcaatggcatcggcttcaacctccttcaaaagttgcaaacccttgagaactgcttcatactcggcttgattgttagtagcataaagcttgatagtacaagcaaactcaaaacttgctccccttggtgaaattatgactaaaccgataccacaccaggagtgcaaacagatccatcaaaaaataatgtccaaggcataatatcaaccgagccgattgagtcatcatgatgctcaacaataaaatcggctaaagcttgccccttgcctgccttgggtgactcatacctaagatcaaattcggtcaaggcaaaaatccacttttcaactctccctttcaacactggagccgatagcatatacttcaccacatcggtcttgcaaactatggtgcactcattggataacagataatgcctcaactttgtgcatgaaaaatacaggcataagcataatttctccacagctgaatacctggtctctggatcaagaagcctcctactgagataaaatattgctctttcctttccttcaaattcttggatcaagactgagccgattgacttctcatcggctgacaagtacaacttgaaagccactcccttctgtggaggaattaaaactggaggagaactcaaatattccttgatattgtccaaagccttctactattctgccccccataagaattcttggtcggccttcaatctgagtaaaggtgtaaaaggcgccatcttcccagataagttagaaataaatcttctgataaaattaatcttcccgaccaatgattgcaatttcttcttgtcctctggaggttcaatgttcttgattgcattaatgcttctctgtgtaacttcaatgcctctctcatgaataagaaatcccaagaattgtccacccaatacgccaaaagcacacttggtagggtttatctaaatgccatattttcttgttctctcaaataccttcctcaaatcggctatatgatcagcaatctccttggatttgacaactacatcatcgatatagatttcaaccagtaagccgattagatcatgaaagatgtaattcatagctaattgatatgtagctccagcgctcttcaatccaagtcattacaacacactcgtacaagccgattgcaccaggccaatgaaaagcagtgtcatgaatatcttcttcggccataaaaatttgattatatccagcattgccatccataaaacttataatcttatgtcctgaagcagcatctaccaattgatcagcaatcggcattgggtattcatccttaggggtagccttgtttaaaccttgaaaatcaatacaaaccctaagtttaccgtttttcttgattactagaactatattagagacccactcagcatatcggcatggccgaataaaaccaacatcataaaaacgtttaatttcagctttgatagcatcatacatatcggctttacatcttctaggtggttgtttatacggctgatatcctagtttgataggcagccgatgttcaacaatcgatcggctaattcctggcatctcaaaatactcccaagcaaagcaatccctgtattgagtaaagtccatcaccggtccctaaacttataccgctgtgtcttcccggtccctaaactcacaaatcgtatgttcaggtcctcaaacttgttcaactgtgtcatcccggtccctaaacttgcagatcactcgtttaggtcctccaacttgttcagttgtgtcaccccggtccctaaacaggatggtctaaaa

SEQ ID NO: 31887 - DNA, 1158 bp, Oryza sativa
actctagaggatcccctcgtaagctcataatctattatgaaccaaataacctagcgattgatggcgattaaaatcaagtgatcaaccaaagagacatttgtttggaccaagggtttcagatatgtcttctttggatcaaaggcatgcacccgttgtggagaaattggacacgttgctagcatgtgcctcaccctctgccctcattgtgaagaagaccatccaccaggggagtgtcccatccgcaaggtcacatgttttctgtgcgagggtacaaaccatgtgcccaaggattgccaacttagtgtgttgttgaccaagaccgcagaaatccaacgaacaaccctacgattgtctcgtcagctagtcagctccaacaacaacatcgatgatatcatccacagcaccaatgctcctcttgctccacctaactctgcaataaatcatggcaataatacctttagcactaaccattctctgcaccgacagcctcagcaaagaattgtcgtcgatggaagaagttgtgtctctccccgacctactccaggccaagcaaagggcaatcaacctccggagggcgataccaagcagaagaccgtcatccgcttcaaccagcaatcagaaggaagcttctcctgtgaatgatagcattatgcagtcctatcacatcatcacagaaccaatcaaggatgcagtcactagaacaatgccagctatatttctccagaatcaaaatgagcagccatgtttgtggttttcagttcgctacttatcatggtgtaatcgaaagtttgcagcaatcatgtaatacataaatatattcatgtttataaacagtgagcttgctatgcttatggatgattcatgttgaggatacaatgtaccgatgttaagcaccgtccctttttgtttgaggcagtgcctcgtattcatgtaatgagggagaaatgtgtaatacagacaagttccatgaggattcttttggaagatgcggatatgtgattatgtgtataattgcttactgataaagaagacctagggtctcatttcaaaggaactatgttctaaccttgagttaataaccaacctagtgatggaaaagaaaaccaattaaactgtgttgggttaaaaagccaatgagacagtagttggggataggag

SEQ ID NO: 31888 - DNA, 1261 bp, Oryza sativa
agatcgccagaagattgtttgcgccaacaacgtcttgcggacgcacaggcgaaacgtgggagcctgccccacacttcggccgagtcggactgggggtatagccgtgtgacccgtcatcctcgtcagacctggtgtaacatacccgaattctaggtcttaaaaatttcttgtcaaaatagttagaaactaacttttccaatgttgagagacaaaaattttccctttaacctaggtgaggtcaacttaacttgtacttagataaaatttgaggacaaactaaaaacttttcattttcagcctaggacaaaaatgcaaacaaaaatgtgtgcatgcatatgcatttagcattagtttgatttgagtcttttatgcgcgtttggattttggtttgcatatcatgttaggttcatgaacataaataaaaggataacttcactagacaaacccatggtcattattgtgaaataattataagtacatgaaagtgaagtcaaataataacaactcagttcaagtcaagtcctaatataagtctttacaaacatttagatgcatttatataatgagaacacttatataaataaacgtcttgcgaattattgaaaataattcgtgcaaggtaaaatcatggaaaaattcatgtagtctgtaatcaacacgtacaattcactgtaattttggtcaaattttaatacttaggatgatacctcaaataaatcagtcaaaccaattaaatgatagactaattataatccttaatcggctaaaacctactctcaccataatgtgcatgaaactgcatagaagtgtataggggaaacaatttattcaaatactaggttatttataatgaataaatatattttttcagaatttatatactctatttaaatctcctaaaaattcaaacaaagttctaacgagcccattttctccaattttctgagggcaaaccacataaaatttttgagagcaactacagaaaatggaaactaggtatcttcatctacgtccagaaaattccacatgaatttatcgtgcccacaaattaaactatagattaacaagagaggagagagatttaaatcctgaaaatcgtccaaaatcgataacacccaatctcctaccctcctctctcactccagacttgttcccttcgcccttgacccactttcagcctcacaagctcgctccccctgagtacatgatgccctatgttaggtactctaacgatttctccctcaaatttactggacaattg

SEQ ID NO: 31889 - DNA, 2965 bp, Oryza sativa
gtatcttcatctacgtccagaaaattccacatgaatttatcgtgcccacaaattaaactatagattaacaagagaggagagagatttaaatcctgaaaatcgtccaaaatcgataacacccaatctcctaccctcctctctcactccagacttgttcccttcgcccttgacccactttcagcctcacaagctcgctccacctgagtacatgatgccctatgttaggtactctaacgatttctccctcaaatttactggacaattgttcacgcatacaagtatcgatccacaggatcgttctgccgccgcctacgccaccacgtatccagttaatcaccttctaacatccacctatgttttttatatacagttaggacaacaccacacggctctccctctctcacatgacagcttggctacttggcccactgattgccgaagtagcgtgggttgggcctccgacgtcttgggccgatgcttggcgccgtttcctgtatcggcacgatcccctcctcgcctccagcatcttgttctgcttctccagcgccttgtccctcctcctggattccttccaccgtgccatcgtcttgttcatcagcggtttgatcggcagtcttcccgtccagttcatgatcgtcaggcttcctgtggttgtggcagtcttgagtcttcagaggaggcctgacaagcccccatgcttggaaatcggcttgcccccaagccggtgcatgagggaaccttgagtgaagatcttgcatatcctcccatgtggcgtcagtagctgctcccatgtggcgtcagtagctgcacttcctgtccaatgagttagtaactgaataatgggacagtttttggtgtgagatacgcgatagtgaagaaactgctggggaacttgaaatttggaaagagcagtaggaagttcagcttgcataggacaagaaaatccccgagcccccttcaattgagaaacatgaagcaccggatggatctgactagctgctggcagaagcaacttgtaagcaacagcgccaacccggtgcagtatctggtaagggccatagtagcgaaacgccaacttgtgattagccctgacagccactgaagactgaacatatggttgtagtttaagataaacccagtctccaacttggaattccctgaagcttctctttttgtcagccatgtgtttcatttgctgttgagctcggttcaaatgatgctgcaagagttgctgcataagcttcctctgttggaaccactgattcagatcaggaatggagcagtcattcagactaatgccaaaatgcccaggacagtacccatatagaacttcaaaaggagttttgttcaacgcagagtggtaggttgtattgtaccagaactctgctaagtaaagccaggatgaccacttggtgggagtagcatgaacaaagcaccccaaataaatttccagacattgtttaaccctctcggtctgacaatcagtttgtgggtgataggccgagctcatatgcaattttgtaccagatctcacaaagagttgctcctagaattggctagtaaaaatcttgtctcgatcagaaatgatgatatgaaacagaccataaagtttgtacacatgtttcataaattcaagtgctacattgctagcagtgaaagggtgagccaatgggaagaaatgagcatattttgaaaacttatcttctatccccaatatgcagttctaatgatttgatttaggtagcccctcaataaaatccaaagaaatagtttgccacgctccagcagttacaggtaagggttcaagcaaacctggatacttggctcgatctggtttggcttgcaaacaaatttgacagttttgcaccctggactgtaccttctttttcattcctgtccaagcaaataaactcttaacccgctggtaagttgctggaaatcctgaatggcctcccattggtgagtcatgaagagcatcaatcaacttatcctgcaattctgttagatcccccacccaaatacgtcccttatatttaatgactccttgttggagagtaaagtgaggtcgagctgtagggcagatagcaagctcaatgagtagctggatggcatgagcatccttgttataactctggatgatttcctgcatccaagttggtacacattcagatacagaatttagctcagctgagtcttctttcctagaaagtgcatctgctgctgagttagtgactcccttcctatagcagatttgatactgtaagcccagcaatttagaatatgctttctgctgccaaggcgtgtgcagcctctgttcattcaagtgtttgagactatagtggtcagttaatataatgaattccacctctgaaaaagcggattccaatccccgatccggaatttcacggccaaatcaagagaatggaaggaaatctgagtggaattgtggttctgataccaggtgttaggtactctaacgatttctccctcaaattaactggacaattgttcacgcatacaagtatcaatccacaggatcgttccgccgccgcctacgccaccgcgtatccagttaatcgccttctaacatccacctatgtttctttatatacagttaggacaacactacacggctctccctctctcacatgacagcttggctacctggcccactgattgctgaagtagcgtgggttgggcctccgacgtcttgggccgatgcttggcgccgtctcctatagctttgttcggcatgatcccctccttgcctccagcatcttgttttgcttctccagcgccttgtccctcctcctggattccttccgccgtgccatcgtcttgttcatcagcggtttgatcggcagtcttcccttccagttcatgatcgtcaggcttcctgtcgttgtggcagtcttgagtcttcagaggaggcctcacaccctactgctccagccatccgagaggg

SEQ ID NO: 31890 - DNA, 913 bp, Oryza sativa
  unsure (1)..(913): unsure at all n locations
nnnnnnnnnnnnnnnnnnnnnnnnnnnnnnnnnnnnnnnnnnnnnnnnnnnnnnnnnnnnnnnnnntgccattctgcggaatggcatcgtaaaataccttttttaaccgatgccaaaccgttgcttgggcatagtcgccatttcataagattctcaccttttttgcacttcaaccgaccaaaatacccctctctggtttctttctcttctccggtaaacatgtgggatgaggagaagaccacgacggcaggggtggcactaacctcaggctcggcgccgccaccgccggagctctcctcctcgtcgtccttatcttgctctacaaattcaagaacgcaatcttttagctcaaaccacacacaatccggagagctagcgagggcgagcgcgagggttccggctcacctcccgccgccttggtcgccagcgagggcttcggctcacctcccgccgccttggtcgccggctcgtcggtctccatccccgccgcagtcaccgtgccaaccaagcccgagacggcgacgcaggtctcgtcctgccatgagctcctcctggagctagccttcttgggccatggtggcgggcagcctgcgacgcgcggcggagacgacggcggaggagatggtggcgagcggcgcacggtggtcaacgggagaggagcagcgtggtgaccggcgggcgagacgatgcaggagattgtggctcatgacgcggtggccggcttagggtttccttctctttctccgatgtgctggcagcgggcttcgaccatgggggcgggacgtcgctggcggtgagcttgggcgtcggcggcgcgccggcggcacgaacgactcggttgtgacgaccggaggggtattttagtcagcctgggtggaaaaataggtggaaatggagagaattggcctaaagg

SEQ ID NO: 31891 - DNA, 692 bp, Oryza sativa
  unsure (1)..(692): unsure at all n locations
nnnnnnnnnnnnnnnnnnnnnnnnnnnnnnnnnnnnnnnnnnnnnnnnnnnnnnnnnttcatcttcttggggcaggaactcttgatgcacaacagaagatccggtgatctgaagtggctcagtgcgctgtctttggctaccacctggaaatactgggatgttgacaatccttctcttgcagttcgtcatccgattatgctcacttttgagttgcatggctttgtccacaagtttctcaaaatcttcataatcctctaggagtaattgcactgcaagctcatcttttaacccctggagaaacttctcttgtttgtcttcatccgtttccacatcttctggtgcatagtgagccaaacgatagaactcatgcaggtactctgtgacggtcaaatctccttgcttcaggtagcgaaactctcgttttcttagtgtgatcattcctgcgggaacatgtgatctcttgaatacagatgaaaactcgttccaggtgatggtatgtccttctggccgtgatgcttcgtagctatcccaccactctgaagccggtccaaccaactgatgagttgcgaagccaacccgctcctggtcggtgcactgaatcaaccctagcttcttctcgactgtgcgcaaccaatcactggcttccataggatcgacggccatggcaaaggttggaggcccagttttgagaa

SEQ ID NO: 31892 - DNA, 631 bp, Oryza sativa
acttgctttcgcgttgacaaaaaaatcttgaggaaaatttcctacctatgttctccaacgagtggcgaaaaggttggattattttttatactattatgaatagtaatgggccccgtgggccttttcaatcttgcattcggccttttactgttcggcctctgcccgatgggaatttactgtttcgtctacccttggacacgtggcgggttttgattggtctatagtcgaactgtcgcttggcgagtctatataaccctgccgcgggttaccaccttcccccccgctcttcactttttactaccgccgcgctttccttctctacctgtgctcttagcttttcaccatctctgcgctcctgcgcttgctctcttgactctttcccccccccctctcgtctttagacttctgcttttgccgcgggttcggtggctccttgcaagctcgcctaggccggtgtcacgcccggaaaaattaccttttctcgaacactagtgtattaatccccggtccacgataagccggggtacaccacataaacatgatacaaaggcacatctttattatatcgataatatttgcattaatacaaggcactttcagtttgacataaaaaataaacaacagcggacta

SEQ ID NO: 31893 - DNA, 422 bp, Oryza sativa
gcacccgcacgatctccagctacacatccatctgcgcacccttacgttggtatactccaccagctcagatcgccggcattgcacctgatcagaagccaagcctccataactgcaggaatcaagcagcaataaaatccggcttaaaacacaagaatccaaaatttgaagccccatcactgcataggaacagtgatcgatactctgcaaacagagctactctcgttctccaaaccgggcgaaatgcttcaggcacctaacaatttggccaagttaagcaccgcgaagacttgggtgacccgagttggagacttggagtcaacaaagcaaaattatcttttctttagcaaaaagaggataagaaaagaatataaacatgataccagtttccttaataaatctggaaattacctttggaatatccc

SEQ ID NO: 31894 - DNA, 1323 bp, Oryza sativa
agtttcgctacttgaagcaagaagatttgaccgtcacagagtacctgcatgagttctatcgtttggctcactatgcaccagaagatgtggaaacggatgaagacaaacaagagaagtttctccaggggttaaaagatgagcttgcagtgcaattactcctagaggattatgaagattttgagaaacttgtggacaaagccatgcaactcaaaagtgagcataatcggatgacgaactgcaagagaaggattgtcaacatcccagtatttccaggtggtagccaaagacagcgcactgagccacttcagatcaccggatcttctgttgtgcatcaagagttcctgccccaagaagatgaacgcaatgcagacaacaacactagcaatactaatgatgatgataccaccaacaaccatggttcatgccccattagtgaccactcgaataaagcgtgcaatgtcagtagcattcaccaagatgtcaacgatagtatcaatgttggaacccagaatgacaaccttagcaattttgacactgagaaagactccaatggtgatagcaactatggtaccactgatgccaatgttagcaaggatttccaaccaccgattccaactccaagtcagaatgatcgtcctcagacggatagctcagcaaagaagacgttgatttgctacaattgcaaagaaccagggcattactcgagggactgcctgcaaccaaggcaaaatcgacctccacattaccgccaatttacacgaagcagacatcccaatcgtattgtggtcactggagcaaatgcagtacctgttaagcctagcgctagtcagaagcaaccataatactcttatatcggtgttcaaatacttttgttttatagttgttacccgtcaatcatgtaataacagagaaacatgagataatgaaggagtttgataagtttatgaaggaaccatgttaagattgcaagtgctgtgagttgtgtacattttgttgctgattagggagacctagggtctcattttcgtaagctcataatctattatgaaccaaataacctagcgattgatggcgaagaaaatcaagtgatcaaccaaagagacatttgtttggaccaaggggttcagatatgtcttctttggatcaaaggcatgcacccgttgtggagaaattggacacgttgctagcatgtgcctcaccctctgccctcattgtgaagaagaccatccaccaggggagtgtcccattcgcaaggtcacatgttttctgtgcgaggtacaaaccaatgtgccaaggattgccaactagtgtgttgttgaccaa

SEQ ID NO: 31895 - DNA, 1714 bp, Oryza sativa
ggcgaattcgagctcggtacccttcccaaacatgcatatgagtgacatgagttcgtcattaatggaacaaagtttcacggatcagaatttactactcaggtacttttgcaattattaagagcagaaaataaattatattatctctatgcttttgatttcttccaagtaatacttagcaccttgcgttactcggtccatccaacgaggccccgggtgctaggaatcggcccaaaggcaaccatccattggcaaaccaaatggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaagggaaaaatatcatataaagaataaaataaatgatgacttagctttgtaatattccccttggtgatggcagaagtggccaatgtgggaacaaagtcgtccatcaataacaatgaagacaccagtcggcggcgacggaggcaggccggcggtgaagtcgtagacgcccaacagcggcggcataataggccagccgtgtaggcggaggcaccactcggcggcgacggaggcaagccggcggtgaagtcgtagacgcccaacagcggcggcataataggccagccgtgtaggcggaggcaccactcggcggcgacggaggcaagccggcggtgaagtcgtagacgcccaacagcagcggcataataggctagccgtgtaggcagaaacaccagtcggcggcggcgaaggccagccggtcggcgaagacctggacgcccatgaacggtggtgtgaccaacccaccgtataggcggggacaccagtcggcggcgacggaggcaggccggcggtgaagacgtagacgcccaacaacggcggcataataggccagccgtgtaggcggaggcaccactcggcggcgacagaggcaagcctgcggtgaagtcgtagacgcccaacagcggcggcataataggccagccgtgtaggcggaggcaccactcggcggcgacggaggcaagccagtggtgaagacgatgtcgctatcggcaacggcagcggcacacaccaaccgtggcagcgaggccgcaagcagtgaacgattgtttgatctcgactgccatccaatgcatgcgaacaaccatcgctccagcatacatgtagattaaatcgacgtaaacacgtgcttgctcctggtggccgagtatattcctgtgtcctgtgccaatctagcagcacgtccatctgcatggaaggaaagagaggagcactcggacacggcaagaggcacccgagtggccgagtaggcgacgatggcggccgtgtcgtgatctcaaccagcatgtgaaaaacaacaaaaattgccaggaaatcaaaacggccggcgattagggattaattaataatcaatctaataaaaattaaattggaacagccaacccaagttgtacggcgtggcttggatacgtcgtgcgcgtcgatcagcttgggtcgcaatgccgcaatcagcagtagccggcggaagccatcaacggccctgcgacctcggagagtcggcagcatgtagatgaccgaccggggcagctgtaaagcctaatgataacagctcggaggcgatcgactacggagacgggga

SEQ ID NO: 31896 - DNA, 422 bp, Oryza sativa
  unsure (1)..(422): unsure at all n locations
nnnnnnnnnnnnnnnnnnnnnnnnnnnnnnnnatgccgctgctgttgggtgtctacgacttcaccgccggcttgcctccgtcgccgccgagtggtgcctccgcctacacggctggcctattatgccaccgttgttgggcgtctacgacttcaccgccggcttgcctccatcgccgccgagtggtgccttctgcctacacggctagcctattatgccgctgctgttgggcgtctacgacttcaccgccggcttgcctccgtcgccgccgagtggtgcctccgcctacacggctggcctattatgccgccgctggtgggcgtctacgacttcaccgccggcttgcctccgacgccgccgagtggtgcctccgcctacacggctggcctattatgccgccgctgttgggcgtctacgacttcacc

SEQ ID NO: 31897 - DNA, 2299 bp, Oryza sativa
ctctagaggatcccctgcttttatcttcacaactgcgcgtcttcaccaccggtttgcttctgttaccgccgacttgtgttcacttcattacagcaatacaactttgtcatcatggtggagcgacttcatctttattatcttcggcaccggcaaactctattgttgctacttcgcaagttttactacttcaccaaccacgacgtctttgtgaacctcgacatctcggcatgcgatgccatgttattttactacaacaagaggctctccaacattcatgatttctacttggacatcttcaacacatatcttcaatcaagcaataactattcgacgacaagaggctacagttctcgactctatgttcagttgtttcccaactaatcaaagagtcgggggctacacaaatacaaggctcaaaatttgacaaattttatgtcaagctgaagaaatcaattaatcagccaacgagtcaactccaggagtcattatcttcatctttgcttcggagcagacattctacttcaacaacttcaaatatttcggtttagacgagttgggcaacaacatcaactctcctccaattgacctactatgcaaatgctgatgagcgtctttgtcattatcattggttgctacactgctattggctggatcaccgacatcgtcatcttcatcatgtcggttgcgtttgtcgtcgtcaactattttcttcatcttcatgattggtggatttcgccatcactgttgatgcgcgtctacatcttcatcgtcggtttgcttttgtcatcaccgactgtttcttcgcctccatggttatgcaacttcattacctttgattggtgtcactgttttttactaccactgacatcttccgttacttctgatgagcaatttcgtcttcatgttagtcatttcatctccatgccgactgcgtcagctattgccaatagacaattttgactatgacagaaggacaagctatatgctcaggggctcatcaactcaagcgtgaggattatatctccaattcggacttgttccggatacattccacatggattcatagtcatgagtctattttctatgctcaaagactggaccaattattattccccgtaaaggctatcaaccgaatacttgcgccagtcgggattcaattattatatttattttggagtatcccataagggataatcattcagatcagaagctattcatatgagctacacttggtctatattacccagaagatttgttactcgggagcatgtcacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaatacccttaaaatccttttataccgcagttacttaacttttttaggagtggaacaatgcatcttaaaaggtgtcaaacagtaaagctttatatagctgccccgctgacttttttatatataagtcaagagctgttttgggtttttaagcaattgatttgatacaatatcattgcttttcgccacgtaagtgtgcatttttattgaccaatattatggcttaggctgattatatattgtggtcattttctaggcggttggtaaatcctttatgagtttatttactcggattttacaccacatatgccatatatttccaggtgtggtgaaaccatgtgtcttctagggacttaagcacatctgttaaagcagtgtgcgcatggcgtatgcccaatactttggaaatttctttattcacaatatacaagcttctttatagctattttgctatatcactcatcatattttacaaagtagttggtatatcacttggatcatattattcagggattcacacatcatatgctattatcgaaaccactcggttggttagattatttattccttgactatatgtttggtttgttcaattaaccacatagtcgggggctacacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccatacggcatggttatccgactagtcataggggataacttatatctatgtaatatgtaacaga

SEQ ID NO: 31898 - DNA, 694 bp, Oryza sativa
  unsure (1)..(694): unsure at all n locations
gattaagcaatctagtaccaaactttgtttgacatgtgtggatattatgggtaccccatacccatacggcatggttatccgactagtcataggggataacttatatctatgtaatatgtaacagatcatgacttgggtgttacgtttccttgtatattacggaacggcctaaagtcctgatttaggaaaccgataccgtattggttaaggtttctatcttgtaatcctgccccccatcctatataaggtgggcaggaggccctctagggggcagagatatatgatgagacaacctgatcgtcagatcaatacacactcggcggattcaaatccccaaacaggagtagggtattacctctcattgagagggcctgaacctgtctaaatcctttgtctccacatccatccacttttaggtctcgtgcgctaccccgttttattattgccgaaatcatgtttcgacaacatgtgttgctaatgagatgaaactaaaatatgctttgggtcgtgttaagcacatggaggaaattgttaacaagatgaagtgatgtcttgctcaacgtgtagaaaataaaagagtgttttggatgcttgcaaaaattgtgctactctttctcaagaggttttttacttaaaaaagttctttgcaaagatttnnnnnnnnnnnnnnnnnnnnnnnnnnnnnnnnnnnnnn

SEQ ID NO: 31899 - DNA, 885 bp, Oryza sativa
  unsure (1)..(885): unsure at all n locations
nnnnnnnnnnnnnnnnnnnnnnnnnnnnnnnnnnnnnnnnnnnnnnnnnnnatttcataatgtccgcagccaatgttatagtttgaacctaagtgatgagcaactagcagatcttgcattccaaggattgtcagcaccaatcagagatagattcttttgccacgggtttgacagtctagctcatctaatgcaaacagtatcagctcacgaaagccgattgcaagacgcaaatgaagatcagttttggagttatcaagaccagacagaagataattttgaagcatgagtactcatactctaaactggggggcatgtgttaacgacgaaatttggtaagcccaaagtcatcatcggctgaaagtcaatatcggttttagagttctagaaacagccgatgggagtcgtcaagtcgccatgctatcgtgttcttggtggagtcggatcaatcgaaggaagcttatttagaagagtccaagttcaaggaggatgccgtatgacagtttatctattaattaggaatagtttgttagtttccttttatctttaggaaagtatgtttagtgtccgataaggacttgtatcaactcatgggtataaatatgtacacccggggtctatgtaatatatcaatctatcgatcaatacaactactctcggtgcatcgccaccctctttaccgaggtttttacttgtcttccggcggaaattggcacctgacacggggctgcatcggctttcgatctccggcgaaggggtaagtcctacattccattgggccctggtgaatctgtcatctacgtcggcgtcgttcacggctgcatcgctacgacttcttggatctctctggtttggttgattgatttgcctacctgatatctcaattct

SEQ ID NO: 31900 - DNA, 3271 bp, Oryza sativa
  unsure (1)..(3271): unsure at all n locations
nnnnnnnnnnnnnnnnnnnnnnnnnnnnnnnnnnnnnnnnnnnnnnnnnnnnnctcatcgagtattagattattatatacaatctcgtgctgcattggttaggttcgacctactagattgttgtttataatataagtcttgctaagccaataggttcatgctaatgttttatcggggtgctagccgatacgttatctggacattgcatcggcttataaggattacatacaagttgggtttagccgattgcaacaaaggtttcactgtttaaattaatcttttggattttatgacatcggacctccagccgatgtatgctttaaccttcggatcaatgcttattctatcatattgtattgctagccgattggtttatactagattatattgttattttattacatcatcatcagccgattgcctttctatcattatctatattggacatatagccgattgcttaaatcctatcgctatcggctagtatcggcatcggctattattggcatcggctggaactactccatcgccttgtcagccgatcggctatttaatctacggtttacatatcttgttagttgcaggatcaaactaactggcacgcccgcatctcatcaaactttggacctgcactggagatgaacagatctctcaggccagtttgtctttttcgcatccacacaagggtatcgtatttattttatcccgtgggaagatcatgtagagagaactggactaataatttatacattgcttgtgataatcatattctaagcaggggttaagataattctagggtagagtgacacacaagcattaactattcaatctcataatatattatctaagctaggtgggaagaaaagagaaagataatctattcctacacttctaatatatatagtatacatacatcctagttaaccgatatactaggtaataccctctttctgatgccctcctggtacttcgagaagccacccctgattgccgagttccttacgacagcccgtcatgaccatacaactggggctaaatacggaggaataccctccccaaggaattaacctaggattatatataggcaaggacgaatacccgtactgagctatcaccatcagcggcccacctctcatccgcaatatataaccccaaataatgatatcccgtagtctagacaccacgtctaaactaccaaatactactctaatatcatcgtcatgacatagagtaattgcataagcaaacattatacccgcacgaaagcatctcccagataagctagccatatattcagtatagcaaaaatattcatgtaaagtaggtactcatatactcggaaagtatttcgactccataaatgtatttagaagagtattctaataatagtacaaagcttacaaaagagaagagaaaagctactagagccatacccgaactcttccgaaggctttcagactccgatttctactctatttctattccaccagctagatactacaaaactaaacttgagagaaataagagagctaattgcttgaggtgtgtgtgtgaagtgaggaggtgaagtccttatataggcaggtaatgacggttgtgatggttggaatggtcggtaatagcctccaaccgtcattggggcttcatctcaaccgtccagccaaaacctagatccaacggaggcgagggtggtttggccgaacctggggccaccccaatctagcccaatttcagctggcggcctcctccgttgttcttctccgtagacttgtgaattttggcccagtttgtcatgtcagttctgagttcttgacccatttattcataagtctggttcctgacatcgtccgattgatttatcatttgcgttgatgtcgattctcctccactttattttcattctctacaaaaaggttagtatacctaatactagtggaatattattactctaacacatttatgcattgtaagcatcactagctctctcctattttggtagtattgacggtcgaaactgatcgataacgaccgtcaacaaaaccccccaagcttgaaccattgctcgtcccgagtaaaggacgaaaggaaacaaagacttggttgttgatcaggagttgctactatgctgcatatctcaaagatataggtgcaaggtacatgtactctctctcagattaaataatctttggcacggtggcttatccttacccctgattcccacaagacactacttctccttgccttgggtagttgaaagacagaacaacaattagagcaccattcacccaatattcatccaactcttattccgaaagttttcaaatgattttgaaaaagataaccaagtttgttaaatgattcactcagtctctccaagtgtatcaaaaatgaattcctcaccaattattgcctttttgattccttctctaaggctttgatatgtggagttcggtagggatcaaacatgatatacttgcattcacatttattactaagtcaaaaacttagactaaagcagataactgaacatactcaagatcaagatcgtgcaaagtgtgtgatatatagtggaaatggtgtatgaagaaaaataaagaaaatgcttctcctttgtgcttactttcttctcccaaaaatccttcttttattgattaggagagggcatgattacatttttttttcaacatcatgctcatgtttgatggagcataacccccttttttttaaccatgcctttccatcctcttcttttccctttttttcaaaaggatttttctttttaggagaagaaagcacatgaaagcatggagaatttattttggtggtaatatggaaatggaatggaacattgcttagctcccagtgttggagtttagcacgtgcacatatgtgggtgtatgatcttgatcatagagcatgagaagtatctacacaagtcacaagagtttgacaaagttcagtggaatggcaaataaccaaaatgtaaatggtttcatcaagatagcacatttttggctctggtaggaatttttatcaaatgaggaactttcagttttatcattttgaaaaacaaaacatccggaattcaagtcaaactagtatcaggatcgtagcaactcatatttactatctcatatctcgcaacatcttagacttagatcagcaagtgcagctcatttaccttaggttcccggataattgttggctacttatatttaatctttgagagagtatttacgaagaacccatatgtaagagatgggtaccgagc

SEQ ID NO: 31901 - DNA, 751 bp, Oryza sativa
cggaagatccgctctttgtggaagtagaagccgacgtttgggaaagcgagcaaggcaagtcacatcatccttgagcatattgaatcccagtttacaaaattatttttaatttaaattaatgcattatcgctttatttaaattcccgcgttatcactgttttatttagccatgcctatttacctttgttatgaccttattattaattatttccttgttcaccctagagtaaacaaaaccccaactagtggacactctactcatggcaccactagtttaattttaggtagatgcttcgcaatttaattaggtaacattaggtggttttacaactctagactttgggaacattcatatcacctggacactatggaatggtttggttattgtggaattggcttcacaccgctccttctattcaaaatccccaaattggttttaggctgggctcgaggtgcgtggttgggttttgctagtcgtacctcgggtactataaggattaagctcgggcctctgttgcaaagcactactgtactttcacatgtctagtgggtaaggcttagtttgtggctcagtctggttataaacaaaagtacacggattggagatggatgaagtcgggggtcgatggacattcttcaaggcaaatgaaggctacacgagctgcggcccggtagtcgagatgtcatggcagagggttggtgccctgctgctaggggctcaatcttgcctgcctgtcccgggggttcccgg

SEQ ID NO: 31902 - DNA, 2622 bp, Oryza sativa
ctatggaagacaacaagagtatgcttatgatgatatgatgttaattatgatgaacttacaaatttgttttgttaattgaatcattaactcctttgcaaaagatttgtgaaccaagtcggtgtgcttgtggttgggtagtcaagcttctgctgttctctgttatctatctatatttggccggtcggcatatgtaactataaagtagttgtaaatttgaatcgctttcatcttatttgtatttgctatgcataacaatgcttaagatgaaaatgtgaatctagtgcacatcttgggaactagattcacatgaatatgagttaaggatatttgatatatcatagatctttagccattttgtcaagtcacctgaatatgtaacacatctggtcgctgccttcgtgtggtttgacgggcacatctcaggctgaagttgactggcaggctaaaggcccggcaatgtctctagtatccttctctcgaggcgtcggatgtttcattatgtttgtttgatgacttgaattattcacttcatacctcaaatataatgagaggggtcctctagagtcgacctgcaggcatgcctatcgtcatcatcatcatcctcatcagcatcggtttcggccgcgtcctacgcagcacgacgagttcgcacctggccgctcttcgcgacggctcgcttgtgcttcctcgacatcccaacgtcgtcgtcgccagccttggaagggatcgatcggttggccaattcgccgccatgaacccggttcacctgaccgtcagcctggcgctgaagcaggcgggcgaattctgcagtagtacgaactaaaaaaaacaacgaattaggccgaagcgcatctccgtaaaggaaatagatgtcaaaaagcgaaagcaaaactcacgttcggtcccggcggggagaacaaggcgaggaagcccaagcaccacctcgcccttgttgatggaaaccccccagtcgcaagcaaggggggaaatccgaagaaggcaaaactcctcgcaaaggttgtgggtacttaatcgccgcagaaccttgcgaaggaggatgagccgggactcgagggtgccatcgatctccactttcggcttcacgacaatggagaccgcaagacgccaaaaacggagccagttcgccttgtcatcctcggcggggtaaggattgttgatgtaaaaccacttctgcatccagttccactcccacttcaccatagacgcaggcaccggccaggcgtccgaacgctccggccgaagcatgaagttgacgcagccgaaaactgtcttcctcggcccggctggcatgttcacgtctttggttgtggcgcacgccgtaaacaagatggcgaacaattcggtggtaggatcgaaaccacacgttcggcacatccatgcgaagacggccaacttcgggaatgctgacgggctaagctcaggaagcctgacctcatatatcgccagcacagacatctagaaattgtcgcatgggaggcgaagtccagcaacaaggaaggcagcaaaaatgactgttcgcctgtcgcctggcgaagggacggtggcttcgcccgcacagttcacttggccctctgcaagagcaccggagaggacgaactcagccaagtcaggctccttgacaagggacttgccaaggtagcacgaccacccttcgccagggttttcgccggttgacccggctgtcacgccatgataaattcatcccgaaataaaaatcattctctaaaaggaataatagaattaattaaaattcgaaaagaaattggcaaaccttaaaatgcgtacaagaaaaattcgaatgtggcctagagaatttttgttaaattccccttgctctaaaaggagccctcaaattttactataaattttagaacaccagaaataattattaagcaacaacaacctttagcaaagtttattaaaaaaaaacttaaaaataatcctccttcttcctttgggccaagtcttgcccaaagcctccctctctctccctcggcccgcggccgaagtccttctatgctccctctctttttccttccctctctccctcgggccgcccctcctatccctccttccctctcggcccagccgctcggcccaagccgagctgcagccctcccacgcgctcacatgtgctgactgcgccagaccacgtgggtcccaccctcggtcatcgtcctcctcccgcacggcctcctctctctctcccgtgaaccctagctcctttcctcccttaaatccatacgaatcaattcccttcatttcaaattgaggctttgttcgctagctgtgggaattaatccgggtaaagcctcccacgtggggtttgggttgtccccacaccccacacccaatccctacctggcttcctgcgaatcccccacctctcatccctctcacgttagactgttcggacagaggtgggattagaagggatcactaccattcactacactttaaaatcagaaaatgagtaaaacatgttggaaaattcggataaaataaaaaaaatgggagaaaggtcacgaacgtcaaaatattttagaaatgataaggaaaaaattgatctatgaaaacaaaacaaaaattaaacgtggaaaa

SEQ ID NO: 31903 - DNA, 1471 bp, Oryza sativa
cttcagctttaatttttccaaccccacacgcctgtgcctagcctgaaatttaattcagcacaacagattatatttttgtcattcaatagccatttaaatagctttgtatgatatgacctctagtaaaatatctgaacacccagtttcctgaaactagttgtgaacatagtagcagttcagaatagataaatatgctaaattgattgctaagagtaaaataggtattcgaacaaaagatggacagctacatttctcaagttttaacaagggcattttgctaaacaaaaagccatggaaaaaaataccaaaactagaatgtatactacagtgtccacctgaccacctgatagcatgactttaaaattttttgcatcttcttgctcattcaattggcatatagtattggtcgttcaatctgaagctcaaatgaccttggccaaaagcaaagtgatgcattctagacagcaacaacagagtgcactagtttttatttttcaggtgtgctcccactgcatctacaataattcctggagaatcaacaaaccaggtttctccctcacaaaaaaagaaaagaaagaagagagcccatgttcagaaatataggatctgccaattgaaatatatatttccttgattacagagcaactgataggcaagatttgcacacacacatagagagatgtgcatggaattttctgtggtttcaggttctactactacaaaccacatcacccctccttctaagcagaacatgactgatacttcaatccatacagccactcaattcatcaactagcaacaaattcatccactagataagtcacaaaatcttttctgagtgggaaaagaggagatcaagaatcagacctgcttcttagtgtccgggctgttgccctcgacctcgccctctcccgcaactggtgaatcccaaccgaggaaggagagatggcgagcgccggcaactgggcgggatggagagcgggaaggagagcggcggcggctgaaacgggatggagaccgtcggcggctgaggacgggatggacaccggcggcggctgaagcgggatgaagaccagcggcaaccgacggcgggatggagagcggcggcggctggagatatgctgctctcggatctccaccctagagccgcctcttggacctcgcgccgcctccaaaccctagcgcagcgaggagtcgaggaggccgagcgctgcggctggcttggaaaagaaaaatcgtctccgaggcgatttttctctccccgtggaattggtgtggattgggtggagaattgctccgaccccagcccaggcgaacgcatacatgggccacggaagaaaattcgacccggccgggatggcacacggggattttggcccattccccccccccctcaaacccagccgaaaagaacaaggcctgaggggggaattaatcccctttccctcctctctctttcccccttaattct

SEQ ID NO: 31904 - DNA, 989 bp, Oryza sativa
ggtcatacgaattccgaatcgacccattcaagtctcctaatgtttgttataacctaaagaaccctatgcaatctttttatgtactgttattgcttctttataggcttgtagctttgattgtgtgctttgcgtagctttcgtcattctggaggttcccgaagcgtggtccgctatcgtcgccgaaggttcggaaggtcgttctctcttagcaaggcaagtcacatcacccttgagcatattgaatcccagtttataaaattattttattttaaattattgcattaccgctttatttaaattcccgcgttatcactgtttttatttagcacttcctattaatccttgttatagccttatcattgctattgtttattatcaccttgttcaccctaggaaaataaaaccccaactagtgggtaatccattcatggttccactagtatgaatttaggtagatgcttcgctgattaattaggcaacactaggtggttttataactttagactttgggagttctcatatcatttggacattatggaatggttggcttgtgatggaattgaacacacacctcccccttctctacaaaactcccaaaatggttttaggctgggcttaaggtgcatggttttgttagagaaccttggccaccataagtgtcacatcctgattttcgtttcaggatttataaattatttaataaattattaatagaatttatattaagtgttctttaatttacaagtgaagttaaatgtgggaaataaaatttcttaaatttaaagcatggatggatttaatttttgttaaattctccatggttaattatactctctgaaattttctcggatttttcagagctcaattcttaaataatacaaagaacagttcagtaattatttgatcattaatgatctaattataattgttaagagcttttcttgtttaaaaatccttaaattataaattgttgtttaaaaaggaattat

SEQ ID NO: 31905 - DNA, 2407 bp, Oryza sativa
ccttctccagtgaaatcttttgaggggaaataatcttctcgatctcctcttccttttctcttatagaaactccggtcaatttcctttggaaataggcggattcgagattgcttcggattcgttttcccccgatctttccttctcgtcgccggcagccgtgggccttcgccgccgcctccttgcccctttaaaaggatccccgagctctcctctacccgccgccaccctcgccttcgtctctagtcgtctgtagcgccctagcgccgtgccgcctcgcgccgccgtcgtcgccaccgctccagccgtgcgccgccgtcgctccagtcgtcgccgtcgttcgggaagaccgccgtcgtggtcgccaagtcgccgccgtcctcgtccgccccttcgccgccgccgaagaccgccggagctccgtcgccgccgccaacccgatctccgccgccgcttctttctcgccgccggcgccgtccgttgcccttccgccgttgttttggtcaccggtgagttcgctgcgtcgccctctacccgttggtgccctccgttcgcatcgtcgagccgtcgttcgccggcgagcatgcgcgcccgagccgccgagtcgccgccggtgctgacgtcatcgctgacgtcatcgggatcgtccgccgtgagccggtcgtggaccgtttgatctcggccgtccgttttggatagggttgatctcggccgttcgtttccgtgaaccgctgccgtgcacccggtccaccgcaaaccctagccgctgacgcaataatccttcttttccttttcaaaaataattcattattgcgtcataattcaattaaaatcaatataagtgttttaatccgatttaatctttaaaaattcataactaattcatttgaactcagtttaatgtggttcaagttgcaaaagttgtgtaaaataaagatctacatattaaaattgtccataaattgaattaaatttattgaattctttttaaatgggctttaaatagatttaatcttgtaaaattcataataaattcatttgaagtcagaatgaggccgttcaagtctcacaattcatctaaaattatgatctacatgtttgtttactttttatgtactgtttatttggtttttattagtctttttcttcgttttgcgtgttagcttgtcgtttccgtcgttgcgaaggttcgcgagtgcgccgtaagtattcaagaagattaattgaagaccgattattgcaaggcaagtcacacagatcctaaacacaatcctttgagcatgttgatcctatatttaaattctctatttatttcaactgtgcatttattttcaaatgtcactgggtggtgtgaacctattcctttgttatggcctgtttgcattgattactttattccttgataccttgggtgattataacttgactagttgagctatatatatattggttcagctagatattagatatgattgcttagccatgcttagaaacattagcacacaattgggataactaatgtttcactatcacttatggttatatttaatggtagctcacgatggtcaatcgtgattggttaattaattacttgccaactaaaacttgataatggtgggttgtgagcacatggttttgagagtcgtgctcatgacaattaaggaccggttcacgagctactattgtgaaacattaaccgtgccaaccacaagccagcgtgggcaacggctttaccttttgtatagcatgattcattgcggagcactagactgagaagtggcggagataagcccacgggggtcgctggggagtccatgccttgttttataagggggtgattatgatccaggaatggtgcactgtggtgagttgtgttatgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtcccacacctctcacaataattatggatgttataactggtaataatttgtttagctcctggtttggaatggtatattcctggtttggagattagatctgtacaaccgggtatggttgttcagaatggttgggcctgtgcagcatgggtgtgctgttcagtgttgattaaaatttctgattaattactccactattttacttctcttaaatgttttgctaaatgctgcttttgcaaatgagcctatattatgccatcctttggtatccttgtgcacttgcatatttgctgtgtggcttgctgagtatgtcatatgctcaccttgcaataatcaattaacctcagttgaagaaaaagg

SEQ ID NO: 31906 - DNA, 1303 bp, Oryza sativa
caaatgaaggctacacgagctgcggcccggtagtcgagatgtcatggcacagggccggtgtcctgctgctaggggctcagtcctgcctacctgtcccgggggttccgcccgtaggtggggttgggtcggtactcttgtctatggctaggatgggttggaaactatgtcacgtctcccgtccgtataccgtggtggtatgtggcacgtgattacacgtgagaaagatgtgtcttgtgggtaaagatgtacacctctgatcagagtataatctattcgaatagccgcgccctcggttatgggcaagcctagcaatgtacccaagttagtggtttaattcttaaaacttgcttaacaactaaaatgtggaatggttgcttgggttggcttgggacgagctgggacctaggtcgggttgctagttcggtctgaatcatcgtaggccttgggttaaggcaggttcgtgtgggttcgcggccttgattaataatattatgtagccctaggatcgtgcttgtaaaatggctttgagcgactaagtgtcttttaaatgctgtttactgcaaaatctaacccctattattatccccttgtacccccttgcattaatcatgcatctcccggtgtggcttgctgagtactgtcgttgtactcattcttgctctatcttccccccctcagtaagagaagctttggagaagaagtcctaggtggagtcctggcttataccccagttgagctcctgtgaagatggagccgtaggcccgctagtccgctgttgtttattttttattgtcagacctgaagtgcctttgtaataatgcaaatattatcgatataataaagatgtgtcctttatatcatgtttatgtggtgtaccccggcttatcgtgggacggggattaatacactagtgttcgagaaaaggtaatttttccgggcgtgacacacaaccatgagtgcaaaccgatcgagtcatcacgatgttcaacaataaaatcggctatagcctgccccttgactgccttgggtgactcatatctaagatcatatattattaaagcataaatccacttcccaactctccctttcaaaactggagccgatagcatgtacttgatcacgtcggctttatatactatagtgcactcattggacagcaaataatgccttaactttataaacataagcacaacttctccactggagaataccttgtttctgcatccaaaagtctgtagcttaaataaaaaataatcctctcttttcctgccacttcttggattaaaactgaaccgattgattt

SEQ ID NO: 31907 - DNA, 1545 bp, Oryza sativa
  unsure (1)..(1545): unsure at all n locations
nnnnnnnnnnnnnnnnnnnnnnnnnnnnnnnnnnnnnnacatatatacatatatatacatatatacatatatatatatatatatatatttatagacacggtcgcgctacacggcacgacacataggcgctgtgcgccaggaaaactccatggtgcgacacacagcgacaaaccccccaccaccgaggcatccaaaccacccgtgtagttaaaatataacttagatagagttgagtggtggggggcgatgacatcgttgaggagttaatattatgcattaattcagttggtttgagttaaaatttaacttaaacacagttgggtggtgcgatacgatgacatggttttggagttaaaaatttagttgttgttgaattttgaacgatatgtgattgaacctggtcactgctgagttaaaaattaactcgtgacaccccatgaccgagacaaccaacccgtctcgcggagttaaaatttaaccgagatacagttgtgtggtagggtgcgatgatatcgttgtagagttgacatttttctttaattcagaggattgttcgcattgttttgtaatttgttgttatcaaaaaatacatcccaacacgtataagttttcacgtattcattacaaaaccgtattttacacgggatgcagctgaataaggttaaaaacattggagggcgggctaagtaaaaaattaacttggtatccttactaagtaaaaaattaacttggtatgacaataaaagttttactcaacatatacatcctcacaatttatgagcaaaagttaaaattttgtttacacttgctccggacatcgacggcggcgtgtcgtggaggtggcaccactggtcttgcctatccatcggagtccgagctcgccaccacggaggtcgccgccgtgcgcatggaggcggcgtggaggccggatccatcaccgcgctcgcctcccgccccagtcgcccgtcacagccgcgccggctatgccccaccgcggctggatccgcgcgcgtggggtgtggagcagcggccagatgcgccgcatcctcgcctcccgctcgccgtcgcccatcacagcctcgcccgcagccatgccgcgccggatctgctgacaccgcgccagccgcagctcggtggtggaggtggagccgccgcgtctccccgtgcaggatcagtgccggatccgccgtcgcacagcatcctcgcctcccgctcatcgttgcccgtcaccgcctcgcccgcagccgtgccgtgccggatccgccgacgctacgctagcctcccagtgccagatcagcggcggattcgcccgaccgcggccggatccacatgcgtggggcacggagcggtggccggatacgccgcctcctcacctccctcacgccatcgcccgtcgccgccacgcctgtagccgtgccatgccatgctggatccgccgatgccgtgcccgccgtcgctcggcagtggaggtggagccgccgcgtctccctcccggcgacgtcgcgccatcagtcgcctctctcatgtctggaaaaataggatcag

SEQ ID NO: 31908 - DNA, 1838 bp, Oryza sativa
  unsure (1)..(1838): unsure at all n locations
ggttaggtttcaatccctcggtcatgtccgccgctgttgctctaaccctagcgcagccgctgccgcgtcacttgccggctgccctgtgcaccgtcactaccggttgtgccgttgttgcttgttgccgccgttgtgctagccgcctagccaaaccaagtcgccctagtgccgccatgtcgcagctgtgtgccgctttaacctagccgccgctttagccgttgctcggtagccaagttgtctagccgtaggtgtatccctaaattcctaccggtctatcgtttgtcgtaccggggctttaccgtgaatcgtttctagccgaccggtttagttgcagccgttgttgaatcgttcgctcgttcgttcgaataaggtgttccccgtgcttcgttcgttcgtccgtgttgagtcgtcctttagttcagagccgccggttccgttcgccggtttcggttgatcatttgggtgatcccgtgtcacgtagaattgactcgttgagttggtatcccgtgaggcctgcttgccagatcaatctaagccatccgatcttggtcgactcggtcaagattaatctcagccatataaatcctttcctctctttccaatggcatattggttctttttatcatatgtcatctaccaatataatctaatcttttccggaggttgctttaatcttttctctcaattataaatcatttgtaaattgtttaattaatttggaatagtcttttctttaataggtttaattggaatttaatcttgtaaaatttgtaattaattcatatgaaatcggaatgaggtcgttcaagtctctaaattcatctaaaatcatgatctacatgtttgtttactttatatgtactgtttatttggagtttcttagtctttttcctcgttttgcatgttagcttgtcgtttccgtcgtttcgaaggttcgtgagtgcgtcggaagtattcaagaagattaattgaagaccctttattgcaaggcaagtcacagatcccaaacataattcctttgagcatgttgatcctacatttaaattctctatttattttaattgtgcatttattttcgaatgtcaccgggtggtgagcctttcccatttaattatggccgaagatgactttatttacctatgggttataatttgattagctagaaccttatatattggtttggttcagctagatgcttataatagatgcttagccgtgcttagaaacaatagctcactaatgggataaatcatgcttcactatcacttatggatatttaatggaagctcacgatggttaatcgtgattggttaattaattaatatgccaactaaaacttgataaaggtgggttatgagcacatggttttgatggtcgtgctcatgacaattaaggaccggttcacgagtttcggttgtgaaacattaaccgtgccaaccacaagccaccatgggcaacggctttaccttttgtatagcatggttcattgcggagcaccagactgagaagtggcggagataagcccacgggggtcgctggggagtccatgccttgtttataagggggtgattatgatccaggaacggtgcgttgtggtggattgtgttgtgcgaggggtactgtcacagctcctttccgaggtaccgtggtggtattgaggcacatggtgacatgtcgtggggctgtgtcttgtgggtacagtggtacacctttggccagagtaaaactattcgaatagccgtgcccgcggttatgggcgggtcaaacaatgtctttnnnnnnnnnnnnnnnnnnnnnnnnnnnnnnnnnnnnnnnnnnnnnnnnnnnnnnnnnnnnnn

SEQ ID NO: 31909 - DNA, 1692 bp, Oryza sativa
  unsure (1)..(1692): unsure at all n locations
nnnnnnnnnnnnnnnnnnnnnnnnnnnnnnnnnnnttccaccttcgggattggtgcgcctccaaccaattgagccatggttagaccggtgtccgaaatgaaatccgttatgccaaagtgttcgccggtcaccaacggctcgaacacttggtgtggttgttctccaagctgaggaactggtttggacttcttgtaataggctttcctaagtgttcggtcataatccgatagctttaaggcctccttgtttgtggtggacattcccttgaagaaattcttcacactcgggtcaatagctatcttcttttcaggactccgaggcttgagttgcctcttcacttctcctgccacataagcgtcaagctcctcttgactgcaaccgtatggcggctccttgtttttggtggtgtcaactttggccttcttcgttgcccttgtgctggcaggaggtggagcttggcgagaccttgtcttgggaggtgcaggcggacacggtggaggtggaggaggcagaggagccggaggagatggtgcaggaggaggtggcggaggagccggaggagatggtgcaggaggacgtggcggaggaaccggaggagatggtgcaggaggagacggcagagccggaggagatggtgcacgagacgccgcttgtcgcctagggaggatgatgtaccgcttgcgccatagtataatggcgtggcttgtgtctcgtagatgcgtctcaccgtctcctcctgggtagtccaactcgaggtcctcgtacacggcttccaccagctcaacttcgaccatcgagtatcctgctggaatcggcctacagtggtaagtccctgaaatgtctgttgggatggccattcctgacaccaccttcacatgacgagaggttatctattagtaatcaacctaagcagcaacttgcggaacgtacgagtcaaaaatcatatattacatcgagcataccttgattgataagttcttgaagggaatatgcagctcacatggtgtccgttgcgtgatctcatcaacggggcaggtggtttcgtcctgggtttgcatggcgtccatgctatgtgatcctacctgccctgttgaggcgcagctgctacgattgcctgatgggctgaccattggaggaggtatgtacggctggggatcgtgtgaccgatgtgctgccatgcgttcatccaccttccgggccacctcctcttgcatgctgagctcttagctcgataccctgtactcaagatctgcaatcttcgcctcggtatctctcttgctcctcatccgactcctgtacgtgtggatgtcctccttgaatcccatcttccagggaatcacgcctttccctcgtgttcgtcttggatgctcgggagtctgtagggcgagtgacagctcgtccttctctctgtcgggtcggaatgtgccctgagaagaggcttccactgcgtccgttagtcgattcgcagcctcgcgtatctgatcgctaaagaccaaggagccatcaattgggttgagcgttccaccatgagcatagtaccagaacttcgatcgatcaggccatttagcggtggccggtttgatacccctcttaagcaagcttgcctccatcttcttccacttcggcatcgcgacgctatagccgcctgacctcaagtggtgatggtacttcttcttggcggtattttctttg

SEQ ID NO: 31910 - DNA, 559 bp, Oryza sativa
  unsure (1)..(559): unsure at all n locations
cagataactaatcaactaactaaccggtggcacacaagattactgctaacaaaactctccctaagcttgatgtgccgattatacaggaaacataccaatttgttcccgcagctcctgaaacttgattcgagaaagcggcttcgtcaggatatctgcaagttgcccttctgtgccgatgtaactcggtgtgatttccccattctccacggcttcacgaatgaaatgtaattttgtttgaatgtgcttacttcgatcgtgaaaaacagggttcttcatcagggccagagcggattggttgtccaccctgagatcgacgacttcagttgctgcattcctgaggtcaccgaggagccgggcaagccaaatgccctggcatgcagctgttgcagctgcaatatactcagattcacaggaggagagtgctacaactctctgtttttgagactgccagctaacaggatttttgccgagaaagaaaattactcctgtgatgctcttgcgagtgtcaatgtctccagccatatnnnnnnnnnnnnnnnnnnnnnnnnnnnnnnnnnnn

SEQ ID NO: 31911 - DNA, 993 bp, Oryza sativa
agactaatacatttttttgcatgttgcagagaagacgtcgtcgtcgtcgtccctcaagccgaagtggtagctagccctcaaaggaattcacgcagacaagtgatgtaaagatgtgattgttaaatatataatataagattgttagatttctaatataagattattagattattagagttagcatatgtgagtattagagattattagattattagacttagaatatttgagtgttagagatagttagagatttaatataagattattagaggtttaatatacaaaacttaattagacttagcatatgtgagtgttagagatttaatataagattattagagatgtaatattcgaaacatatttgattgttagaaatttgatataagattattagagatgtacaaatacacgacacttagacatagcatatatgattatttgagttttaatacaagattagtagagtgttaatattacgcttagcaaatatttcttctatgaacagatagctgatcgcgatgaggaacagatactgtacgaaacaatcgtagagggaagcagccagtactggaacgaaaaaaaggggaacgaggatccaaactagtacttgaatgaggaggagaacatggagagggatgaagaggggaacgaggaggggaacgtggagagggatgcggaggggaacgacgaggacgctagtggaagtcatccctccgctggacagaagagggcacgcggacaacaaggtgccgcgaagaagatagagggtcagcacatcataactgaggtggacgcaaacggccgacctagtgccccggcaaaagcagcgaagaattttgtacgccacatcggttgggttgtgaggggtaacgtgcctgtcagcaaggtgttctggcgcagaacaaggccacgcggggataatgacagctttgtccccggaatcagagaaagagatgctatggaccacaatgctcgagacgttcacgctccctg

SEQ ID NO: 31912 - DNA, 2502 bp, Oryza sativa
  unsure (1)..(2502): unsure at all n locations
gatttcatttcggacaccggtctaaccatggctcagttggttggaggcgcaccaatcccgaaggtggaagtggcatacaagtttgaactcggtaaaccgcttgtcaggcctaagcagctgcagtatatacatatatgtgtgtacatatatatgtgtatatatatatatatatatgtatatatatatacatatatatatatatatacacatatgtatatatatatatatgtatgtattctatatacatgcataatatatatattacaatgcatatatatgtattttgtgtgtgtgtgtgtgtgtgtatatatatatatatatatataatcaaccatgcagcaaacagggccatgcaaataaaaaaatggtacatagatctttagttcaggttggtaacaccaaccgggactaaagatggatcagccggccacgtggctgatcgatctttaatcccggttatttcacccgggactaaagatcgctatctttagtcccggattcgtagtttcggttggacaaccgggactaaagggggttacgaaccgggactacaaacgatttctccaccagtgaaagaggaggtcagtaccttgtcccgtgccttccatctagctatagtattttaacttgttaacatcacgattatttcagtagattaatcatgtgcatgcttgaatgtaacattttcctctagagtgcttcatagagatgcacttgatagtgcagtggcaagagatgtgtggttttaaccgtaaggttctgtgttcaatccctaacacactcacaatttcttcttaaaaactatttggaggtacgtctcttcctctatacagtggcgccaggaagcaaatagcgcgactctgagcattcatctctaaacaatgagtaaagaaattacttctatctctgccctaatttgtaaagggagtaaaaaaatcactctcgagtaaaatatttttcacatcacttttgatcagttaatggtcaaatatttttcacatcacatatagttaaaaattaactaacttgttcaatgtcagtcgaaaaaagaacatttgatttacaaaaaaattaaaaaatcatagacatttaatttttcaaaaacataatgaaacagaagaaaaataataataacaagaaaatactaaacgtttatcatagtaaataactcaatatgctaggtcacgtttattatagttgatgaatcacacatagttaaaatttaactgactaaacatgaatatatatggtgcgctatatagtagtaaaaatttaactcgtgaatcaaagtgggtggagtcgggaggggagtggggtggtgtcacgcccagaaattcactagtaatttctgaactaatttgtgcataaaaccctcgtccaggaatcagccgaggtacacaaactgacaatttaatatacaaatccatcaaaataataacgttacatacttacaaaagaaaagaaaactgtagcggaattacggtctagcgaagctccggctccactcccacaggcagctcaactggggtataagccaaatatcttctccttcgcaacttgtcttcaactgaggtttgattgattattgcaaggtgagcatatgacatactcagcaagccacacagcaaatatgcaagtgcacaaggatactaaagaatggcatagtatagggcttatttgcaaaagcagcatttagcaaacatttgagaattgtaaaacagtagagcaattaatcatcaatattaatcaacactgtacaacatacccatgctgcacaggcccaaccatcctgaacaaccatacccggctgcacagatctatctccaaaccaagaatataccattccaaaccaggagctaaattaattagcatcaattaccacattattattaatgaatagtgtgggactaatcacgaaagacattgtttgacccgcccataaccgcgggcacggctattcgaatagttttactctggccaaaggtgtaccactgtacccacaagacacagccccacgacatgtcaccatgtgcctcaataccaccacggtacctcggaaaggagctgtgacagtacccctcgcacaacacaatccaccacaacgcaccgttcctggatcataatcacccccttataaacaaggcatggactccccagcgacccccgtgggcttatctccgccacttctcagtctggtgctccgcaatgaaccatgctatacaaaaggtaaagccgttgcccatggtggcttgtggttggcacggttaatgtttcacaaccgaaactcgtgaaccggtccttaattgtcatgagcacgaccatcaaaaccatgtgctcataacccacctttatcaagttttagttggcatattaattaattaaccaatcacgattaaccatcgtgagcttccattaaatatccataagtgatagtgaagcatgatttatcccattagtgagctattgtttctnnnnnnnnnnnnnnnnnnnnnnnnnnnnnnn

SEQ ID NO: 31913 - DNA, 1611 bp, Oryza sativa
acggcgacgatggagctccggtggattttggtggcgacgaaggggcggacggggtgcagctccttcttgcgaacctgacggaggcaacggcgagcagcagcggcgaccacagcgacggcgcggggcggctggagacacggcggcgacggcggcgctccggttcacgacgacgggctacctccgattggatttggcgcaaaacaacagcggccggggtagggctcgacgttgcggagccgagggaggaggcggcgctgaccggcgacggccggggcgacggcgaatggcggctggagtggcggccggaggtggagagagagggagctcgcggggagagcgtttccggcgacggcggcggacgggacttgaggggatgaggagaggacgactagggggtcctttatataggcacgggagctcgggtccgggcccaaatcgacgagaaaaaaaatcgggaaagtctagggttttcgccggtaaaaggaaggatttgatctgcgaaattggaaagaatttccatagaaaattttggggatttcttggggaaaaggaagaggagattgaggggattccattcccgcaactaatttggaaagaggagcaacggggaggtcggattggtgggaggaggcggcggcactgtgcacgagcacggctggctcggctctgtctagaggtagaagaaggagcactgtagccacagggaggaaaaacagacttctatgtgggctgagaggaagggagagagaaggggaggcaatgggctggattcggcccaagctgatgaggaggacttttatttacttttccaaataaattaaccaatgagatgatctttcaattgttaaaaatacttccaatgctcaaataattccaagaaaaatcttgaacatacttggacactcaaagtatttaatataataatatccagatcatttaatgataaatttattatttaaataattgctaaactgttctttgtattattaaaattaggaattgagctctgaaaaatctgagaaaattccagagagtataactaatcatggagaatttaataaaaattaaatccatccatgctttatatttaggaaattttatttcccacatttaacttcacttgtaaattaatgaacatttaatataaattctattaataatttattaaatgatttataaatccttaaacgaaaatcaggctgccacaggtggtgggcagtgggtgggtctggtcactatgtcaggtgccgtttaatacgtagacgtttaaattttgcaaaaacattatgaaacagaataataataataataataataataatattaataataataataataataataataataataataataataataataataataataataataataataataataacaaaaaaaaattaaggcatgagcaaaaaaaagtttcctttagttaataaataactcaatatgctaagtcatgttcattatagttgctgaatcacacagttaaaatttaactgactcaacgtgaatatatatggtgggctatgtagtagtaaaaatttaactcgcaaatcaaagtgggtggagttaggaggggagtggggtggtgggcagtgg

SEQ ID NO: 31914 - DNA, 7664 bp, Oryza sativa
ggcgaattcgagctcggtacccatggggtgtcacgagttaatttttaactcagcagtgaccaggttcaatcacatatcgttcaaaattcaacaacaactaaatttttaactccaaaaccatgtctcgtatcgcaccacccaactgtgtttaagttaaattttaactcaaaccaactgaattaatgcataatattaactcctcaacgatgtcatcgccccccaccactcaactctatctaagttatattttaactacacgggtggtttggatgcctcggtggtggggggtttgtcgctgtgtgtcgcaccatggagttttcctggcgcacagcgcctatgtgtcgtgccgtgtagcgcgaccgtgtctataaatatatatatatatatatatatatatatatatatatatatatatatatatatatatatatatatatatatatatatatatatatatgtatatatgtatatatatgtatatatgtatatatatatatatatcagggttatggataccacatatctaatagtagttgattgaatcttgacaggacccaccacttgatgaaaccatgagcacttgagcaggagcatgaagtcacatggaatttcttctttaaaaatgcatggagggacacctctccctccaaatctccttttttttcctagagtgcttcatatatgctatatatatacatcacttgatgaaatgatgagcacttgagcgggagcttgaagtcacatggtttgtctttttttttccgcacttgtgacagcatgaacctaagcttaatctatgtttttttaatgtactgatgtacaagcacaaaagattacagatgggaggcttgtgggtcagctgctgaacctgaacaatggccccaagctcctgaaccaactgaaactcaacagatgcagcccattgggatctattcctcaacaaagcgagctgttcactgatcttcgttcgctcgtgatttggtgttgcagctgggactccttaccagataacatggagcgtctcaagtcactcgagaaactagagctatttctttgccctcaaatcttgctgcttccagtgctacccctgtctcttaagacgtttcgactttatcgctgcagcgacgtgctcacgagttcgtgccaaacaattggttatgaaaactggcaaaagatcaagcacattccaaacaagcatttataagcatccatacatgttcaatgtaaagtccatgtgtgctcctccatttcttttttttttatttgaaaagttatgctctacggtgattatactgttactcatgttgattctgttttgttgatcaggaagtaattaagcctgtcaaatatactaaatgctgggggcggatcatggtgtgcacatgcacgccaatgcacggcatttggaacacagccagagaagaggacgttaagcatggtggctgagatcagtaagccaaaataaaactggcatggccagattgtgaatttgtgatctttggattatttcttgctaatttcagtataataccgtacattctgtgtttattcattcatttacctgtttcatgtttctcttattattccttgtgttggtcaagcgcatggccgggcttgtcggtgcagcgccctttgtgtttgtggtgttcctcatgcgtgggatgcatggcccgcgtcgcggaggatcatgttgcatttccacagatttcctgttcttgcttgctgttaaataagagaagaaaaactaagaaaagctgcacagttctggtagcacaaaacattttgttcaagtgtttgtctaagtgcttgcttaagtacaggagcgtctcccgtcagattgataattactacctccatattttaatatataacaccgttgactttttatccaacgtttgaccattcgtcttattcaaaaaatttatgtaattatcatttattttattgtgatttgattcatcatcaaatgttctttaagcatgacataaatattttcatgtttgcaaaaaaaattgaataaaatgaatgatcaaacgttggttaaaaagataacggcgtaatatattaaaatacggagggagtatattttctctttacatgtgacttaaaaatatgtgcagtaaaaacgcgtacgaaacgtacaatattttcacattaccaagaacacatgcgtgttttctccctaacatatttaattacatgaaattattggaagcacaccggatgcgttcaaatggtcgatagatatttcttcattcattcatgagggcgtcgggccgtcgcctcgcggagccatgcggagactccggacaaaagacttgtggagtcattggtcaacggcacgtcctgttgatctgttgatcgtgccgttgaccaatatgttttgtgatcgttatttttgacgcatcattttttgtcgctgttgatgatatatagaggactatatacaaaatatatataaagactcgaatatcctcgacgcatcgctgttgatgataaagaaaatctcaaatatagacgacaaagacttgactacttgagtacgtaggtactcagtcatcggcacaatcgagatgcatggataaaaatttaaaagcgcgagtcaaaacttgttctgagtctctcactccctgcagtatgatatatttttcaatgtcttcacgcgggcccttggtacaattttatcgttggtattagatcttcgatagaggaccgtaaaatcgatcataactgaagcgtgtggagttgtgggtgcgtaagtattccataacacacgcgtacatattccctgaattcccgtatgttcgtttctaacccatgctcacatagacggttcatgtttgccgtcatcaccataatttttgaaagcatgtccatgtgtgtctaatatttatgcacactaaaaaaatagcccgcgcattcgtggtggacatgcgtattagtttgtttcgaaaatagttctaacaaaacaaattatttaaggtaaggtatttttgatttttttaattgagtgttcattatatcttttttccttgaataaatctcgacaaacttttattgtttttgttggtaagaaatgtattttttaccaccctactaattatatctttaattgcttcacatatatgcaaattcgttatgcatgtgaaccaataaagatagaaaagttctttaaaaaatatttattgtattttgaatttagtgattgagtgattctaatttcgaatttatattcaaatcaaattattgttttattctaaattgtatttttaggaatttgaaattgtacttaatctcgtaacgtgttgtatttggactcttctaattttaatacttattttattattccaaatttaagatatttataacttatacttttatatagactcttgatattttatattctacatagtatcttgttatgttttttagttttaatttttattttatttttaatgcgtttttaatcaaattgcttgttttaatttttttctgaatttaattacaaactccttgtagtaatccagctgtcaccatcggcctcgcggatcatcttgtcggccttctcattagtgagcctctcttgatgtattggacatgatgtggcaaggctcggcggtagagatggaaccattttctagtctttgtcaaagacgtggaacgtctccctctgcctctcctctcagtccttgcccttcacctaatcatctagtacgctgttagacctaggaactcgtggaagtcattgatgtcactgtcgtcggtgtccatctctccatcagtttcaagcccaaggcatgcatcatggttccaagctccttggtggtgattgaacatggattttagactcacatatttcatcgctttcgaagtgctattatgctcaaatatttgttgtcagaatgaccgcactatctaacttctatatagcaaaatatgggtaatatggatcttggattatgtatttacttataaataacacaacaaatcaaataattgagaaaagtacatttaacttgagagtcatgattatttagctattcttttatatattatgtgttagctaatagtatcctagaggtgagtaggagagtggagggagtacgtacgtacgtgcgtgcatgctcacataggtatttgctcagacttttaaaaaacacacacacatatacaatatctactcagggtgcggtataattaaaacacatctaatgttagtaatcattttattgagagtggaatcatcataaatcttcatattaaatctaacagttttactatcaaatatttaagaacatataacgtgtagtaaaacatttcttttcttttggactaagcatttcataaattattagaatactggaaatttaaaagttaggccaatgttatccaatatactataaacaacttcaagggtcgtttatatttttttcattgcaatggaaaacctatatgcacatatacatgtgcgtaattttacacacttcttggagcatttacttttaaatcaacaataatatagatataatgtttaaccccctaactatattttggttgtcattttttttggcctgtcagccttgagtaaacaggcacgtaatatgttagaatcaaatgagctagacccaatttaatcctaataaattttatagacctacaattaatgttaacaagattaataccatcttgaaaaccaacgagaaagaacctcaacttaaatatgctgctatatgagagcacttgttgagcgattgaggtggtggtgagacttccacacacgcgctgggctagtccatgagcgagggtgaggcgtgaccagcgggcgtatggggacttgcctgcctccctaatgctaccttttgttttgatgaacaaaggcataaccgacgggtgacattacttgaagtattggacgataacttaatgcgcacacaacgttatctccgacgggtgacattacttcaagtattggacgagacctcaatgcgcacgcaacgttatctcccctactagcatgtacaaaaacctctcttgattctaagcactttgagcacacgagtgttcaggacaaggttatcttccccattgggaaagacataaacctctctcggttctaagcacttgcgcgcacaagtatttgggacgagcaggcttccagaactccattcgcttgagtacgtacacaggttagacgagcgatcaagtttttgaggagcacgttcttcacacggctgctctcggcactgcatctccttccactacatcaacatgtcgcccgtaacctgaatggcagcaacggaggtggaggcgagaatgacaatgacaacggcaatgaaggcaacaacaccaaccatgcctcatccagtaccagaacatacactctctgggtatatcactctattcaccttagtattaaacatgttgctagatgatgctattactgttattagcacgttcatgtttacatacaactgaatcatcctattatatacatgttttgcttattatgtttttttgattaaaatataccgaatcgtaactatatttccaatgtatagtaacatactggtatatatttcacactaccaaacaatgaaacacgcatgggtgttttctctgaacataaccaattaatcattgaaacaccggatgcgctaagaaaaccagccgcccacagctaagccaaaatgctggagatgtcattgttccaaattgacaattttgcctactaagcacgtgggccctgcaaagactctggacagaagactttagatcaagtcaatcaacggtgatggattcatgtctccggtctccctagagggatttactcaagtagtctaaaaagttataaaaattaaaaaaaaaagtagtaatagaaaattagtaagatcacgacgagactacggatcatgcaccctattctttttttttctaaaaaaccgggcgcccatctctagctagtaaacctgcacttcactccctgtcaactgtccacttgtacgcattccattccctgggatggctgagcactactttttttttatctgacacgcatgcaaaccgtatactcccttcgtcctatagagaaccaatctattattggatttaatattttctactacaatgaatttggacaggagctaaacaaatctggacttgttcctgtccagattcgttgcactagaaaatatctcatctaatattaggctggtttttttgaactgaggaagcatatgtgtctttttagtcgcatgcaataacattcaaaatgattgttattttaaactattcatccaatctaaagatctaattcaaccattgtatttatcgcaagtaaatttttataacaatatctcgcatgactattttctgataaaaatattattttatatttttagcaaaggttctgttttttatgttgcacatcatattctttatatatttcgatacgtacttcctgatgtttcactaggacgtttgcagttgttgcatgtgatgttctaggtgttttatagtaagcattttgtgatatttcctacaattaaattttccaataaatttaagtatttgaatacatataatatgttccttatgaattctttttaagtttcattagttgggattcaatgttaatttcctgcggtgctttttgtggttgttgcagtatgacgtcatgaggcatttttcacccttctctgttggttgtaggagcgagaggctttggcaaccggccgcaatatgcctatttcaccgggtgccaatcccatctatgtcttggatgagatcacctaagatttcataattggaagtaaaacaggccaagagcatgcggtaggcgccggtagggggtttggtggcgatccaacacatgtacttttttttactagaaaaaatgtccgtgcatatttaacaacaggtgaagattattttatttgtattgttgttatacggtctagttaagatgaaattcacttagatatatatttttttagaaaatcataagctgcaattagaagtccgatcgtcttagcatgcaagtctttttaaaaagaattcttatatgactctttctatattttcaaaagcgaacgaacttaaaaaccgacttaaatacggatatgtatttctaaaaacgatcgaacttaaaaaccgactcatacacgaatgacttattaaagtaccggcaaaaatatttttaatttttataacagtagagatagaaatagagatggagatagagatagagacacgtaacagtacgtaaaaattagagattaggtgggatatgatttggcttttttaatctaatccaattagaggatttgccggttatacctttttttgacatgcaatacgtacatatgcgaattacgtacttacgtgttagagataggagggtgtgattagccgggatgaccatgaggagtgattagtaggattttttaaattctaatccaatggtcatctattgatttactgaaaaatccagggatatgtactttttttgtcaaaatttttagaatttctaggctttgtatttttagaaaagatagatctaatggtctaatacatatttaagtgaaaatcgatgaacaaataattttattaaaaattacgtgaaaaaaaaggtaggtcaatatttgtacattcgttcctacttaaca

SEQ ID NO: 31915 - DNA, 1288 bp, Oryza sativa
gtgccaagtgatggcttgagattgttttgagaaagtttgatagactttataatagatagactaagatgcatgggtgttaccgcactctacacacacagtattgccccgtttttaaatatacgcactagttgagtctatgtacttttaaccattcatcctaattaaaatttataatacaaatataaaaaagtagaagttgtgcttaaagaacctttaaagataaaataagtcataataaaatatattgtatttatactaaatttctgaataacatgattgatcaaacgtatgtctaaaagttagctgtattactctctccgtttcaaaatgtttgacaccgttaatttttcagtacgtgtttgaccattcgtcttattaaaaaaattaagtaattatttattcttttcatattatttgattcattgttaaatatacttttatgtacacatatagttttacatatttaacaaattttttttaaataagacgaacggtcaaacatgtgctaaaaagtcaacggtgtgaaatattttgaaacggagggagtaaaagttacaagcactttaacacatacatagaagatacactgcactttaacacaatagagaactatagagcataaagcttggcaccggatgtacgtagtaaaggctattggtgctcatacgttttgagctggaccagtgggtcgctccaagatgccaccatgtgcaagcaaagcccagagatgtgtgatgaactctcctccccttggcagggtttccaggtgcgctttggcatcattcgaaggtgcaatgtacagcatcatctctgcccagaaatcacacagcaccttccatctgtcccccgggtgttcgatctcgatgagattgtttgcgagccgaccgcccacaacgaggagacggttgtcgccatggtcctggcttcttagcgcttccttccgctgctgcattgttttcttacccttcagcaattcgcgggcttcctcgaccagggcgtcaaatatggattcggagacgaagctatgatccggtaacaattccggagcaaaggctactaggtaggcacagtaccttgacaagctacaagctacgtgctgattagtagtagtagtagtactgtctattccatgttgatcttcgtcttccacctcgcaaagagtagtgccgatgtgccaagccattatgatatgtgttgtagttgggagtgtggtgcatgaccatgaaagttggtagtatacctcgttagcgtgcagagatatgacacagtttcccagttggccaaggcc

SEQ ID NO: 31916 - DNA, 5013 bp, Oryza sativa
ggttagcattgacgaggaatttgagctcatcttcatcgggtacccggaggaaatgctggaacagcttgtaggcaagccaaccgcaggtcgggaccatggcaaaagacaacgtgacgaacagatggtgactgctatagataagaaagtacttggtgtagaagtagtcgtgcacaaaggctaattctacctcgatgaccctgaaggttcgttcgacgcacctgtcgccatggagcaggccaccgaagaggaagtcgcgggtcttgtggagatttgattcggcgagcacctgaaagccggcaaacctgcggttcagcatcttggacaaggccatggagaggcacacgtccttgagcctgccgccattgccaccggagagcagactcccattgcagttccagatatcttgaacggtaacgagctttgcccggtcatcgtcgttgtacctaagatggtactcgggaggctccaccctaggattcggctcgtcctctcctgcaaccacatagtggtacccttgcatgtcgacggcgtctgtcgttggaccccgtcgccggcaggtcgcaggtgctcgtagctcatgtagtctgccacccatttggtactcttggagagcatggagcttctactggctagcttgaacgacgcgacccgtgtgccggatttcaatatggctatgcagtatatgacccatagaatgtactggaaatccgagccaccagaggaaaccaccagccaacccacccagaaagactcgatgagctgcttcaagtagaacctcttccagtcgtcgttgtctagtaggctataagcagagaaagaatcggcgctgccgaggaagatgaagaggatgatggcccagacggagaagaggctgttcttgtaaggggacgactgcatcagccccagggtgtagctcaccatggggatggaagcagcgtacgccacccagatggtcattttgacagcttcacagctggaccgccggcggtaggagccgaggatgaggagcacaaacagcccgacgacgcccaggaacacgagaacctcgatgcggatcaatcgcaactttgggctgttgagcccgtgaaccatatcgacgagtgccatatatacgtaaatatgctatctaggcctaggtgttggtgtactggttaatatataggcagcagttgcacgaaggatgatagccctaccagctgctgctaggtagctagctaggtcatcgataattatacactttatccaaccatcccccctgccttgtccagaccatctgacggtcggacccacttacacataacaactccacttacaatttcatttttattttcattctcgtttcgtacaaaagggttaatatagttgaagggacaagctcttataagttgattccacttttactaaactagcaatgtggtatgaaacatacatacacagcttacatgcatgtaccacacatttctaattcaaattgggccgtgatgtcacactgtcctaatcgatctcttaacttttgcccgatgttataattaggaactgaagacttgacgaagtcacgcgaggatcatttccgaccttgcacactgaccctcgtttgtacctcagttctattaattaaggggcaaaacgtacagtatagtgctagggtataagtttcgcctcgttctttttaatcactagctctattagatttttatggacacgcttccattttctgaacacggtacgtaccgttgaatccaacttcttaactagttaattaaaaaatttgcaactttccgttcgtcacatcaattattttttatttgtaagtgcgaccgagcgatggcctccattcccacacacgtaagtaacacatcgcgtaaagcggatacaacacaaattcaatagatacaaaatctaattggacaattcatatgatatttcacactattgataatatattataaaaaataatgatcaaattataaagtttgtttaaaacttagacaaagtataatattggagactatgcagacacatattgtcacgccccgaactagccccgagcggaactagcccgtgacgctccaaattaacctgttaatcgataccagtcccaggaaacagtgctggtatcacaggaagacagaatatcacagcaacagatgtctctttattatagagtaggagtatagtcatgttgggctgcggacagatcccgagctcacaactgcattacaaaagggaagcagaagccaagacttggaccaaacatcacaggcgcgacttgggaactaggccgaaaccctaaaactcatcgtagccgacttgctcctagaagaactcctcgtcagcgggatccgcttcatcttcttcagcaactagggaggattatttatatagagcaagggtgagtacgggagtactcagcaagccatggggattaagtgtttaatgcaggcttcaaggaaaggctgttgtttttgcaattgattttatttaaactcttttctgaaacaactaagtgagtgcttctcaaacgacacggatgagacagtgcgtctcgtccggtcggagtatgtgcaaggtatcagttttttatgaattgatcaaggttggcatccggccaacagctttcaaacggccacccgggcctggctgatcccattagccgcaaattttccaaacatcgaacccaaaccacctcagcaaatttcacaaagcagtagtcaaacaaaactacactaggaatcacctcacattcgcccatgaccatgggcacggctattcgaacagtttaataacctctgcagagggggtacactttacccacacgacattactaacctggatcatccagcccgtgcagaacggccacgactagagaccttaaggctttcatgacaaggcatttcgaaagccgacacaggttcaccatatgccaacaagaggggtcccagaccaacaccagattaggtcccagaccatactgtgccaggaaacccgggggttctccccgacaccaccccgttgaatccacatgtctcttggcatcatggctcccccgattagctagttactcagccaggggtgtcccattccaaccatgtggtcgcacttgtcttatgttcggatgaaattccaaggaaacggtccttaagtgcaagagcgggaaaccgtacacccggtacgttccccggtccccgattttttggaaattcatttagttcgcaagcaccgacccaggtgtcgggttttccaagtcttttgtaaaacccaagttttacccatggttggatattttatattttgagggggggtgttccgatgcgcgtacccgaaggcccgttaacaaggaggtttaagtgttcaataattcaaggagggtaattgcagcaattaggattggggccggcaggccgtctcgcaagccgcggccgaattacttgtgtaaatcctattcatgcaatatttgcagaaaagaaatacttagatttaaattataggtgcaagatgatcaaaggtgacttgccttgctcgagatcttgaacttgatcttcgaaatcctcgcactgcgggtcttcgggctccgaaactacacgcgaaatgggacaactcaacaaacggcgaaaataaagccatattattgacctctaggcgtgtcattagatagatctcgagatttgaggagttttggaagttgaacggagtcaaacggacttacggttgggaagattttgaatttctaagtttattcgatttttggtctaaaggaaaaggatttatttaaatcctttttgagagaagaaaagaaaagaaaagaaagagggaggggaaatagacttccctcgggcggctagggcgcggcccgagagaaaggggcggcttggccaagcttaatgggctggccggtccaagaaggcggcccaaggcgcgcgcgcgggcggggaggagagagagagagccggtgggccgggtccaccttgcgtggtcccgggtaggacccgcttgtcagcggctcggcttaccatgtggagggagtacgcggcgcggcgctagggtgtggagcggggcgcggtgcatgcgcgtggctcgcgggggtgcggatgcagcgggcccacgcgcagcctcacggctcgcggtggaccgcgcgcgcgagcggggcggagggaagcggcggaccggggtcagcttgacccggtcgcggccgaggtggcgccgacgtggcgcctacgtggctgccacgcgggccggcgggaggtagatgacgacgtcggccggaacggacggcggacggcggcagcgagcggcggagcgaaccacggcgatacaggcaaaagcgagcacaccgggaggttgcacgggacgaggggagacgagccaatgactcggattcgccgggggttgctcgactgcggtggattgcggcggcggcaaccggcggcgagagaaggggggaaacggcgacggcgcgacgggagaccaattcgggcaagctagagcatctacgcgactccgggaatccgttgctagcgtcggattgggcggagctacgccgagcgaggccggcgacgagcggcgctacggagcataggcggcgacggcggcgagcacacagcgagcggcggcgagcacacagcgagtctaaggggaggagatggaacgaggagggaaaacagagggaggcgagcacacaacggtcggggcggcgccagctagctacggggaggctactcgtgctactacccgagtctaaggggaggagatggaacgaggagggagaacggagggaggcactaccgtgcggggtgatggggagcagtgacgaggggccgatggcacgggagtgatctctccggcctcgggccggggaagaggaagaagacgagcacccggagtccccttccgcgtcctagcgcgcaccggctcctccggcacacgcgacggcggcggtcggcgagagagacagagggacggcaatggcgcgggcgaaaaacggggaagattgggagggaaaaagggaagggaggg

SEQ ID NO: 31917 - DNA, 6154 bp, Oryza sativa
aacagacttttgcggagggatttgatttgggacggatcgagattcgggatttgaatttgacgatagaacggggatttgagatccggactgactgcaagcgaagaaacaattttcgcaattagggtttttagaatttaattttcccgcaatgcgccacgacggaatgggcgctacacatatataatatgccaatatatttttcaaagtgaggttgtatcctctcttactataaagttataactcactaacttttaaagcttaacatgcaaaaaatactacatcatcatacactaacaagatgctatatcattatcatccactaacaaccattaaatttaaacatcatgcaaacatgctatattatctataaacttatatttaacatgtgatcatcatttcatataattcacataatatttcaatgtagattttcattatttttttataatatgctatgtacctgttgacagagtagatcacaactaggttatttgcagaatatggagatcgttgttgctacgatatacgcgagattgggggtaaagatacagagacaaggatgtttatacaggtttgggccccttaactgacaggtaatagacctactcatattggtcgaagccagtattgctcttcttcatcagaatcaaacaagtacaatatttgggataacatatctagtcatcattgacttgacggcatggaacaccacacgtagtcgacgacggaatagtcttcctgctcgaatacaaactcgatgacataagagatggcatttgagtctgtctaggcttgtctccgatgtctatgtctggtgatgtgtattggtatctattctcactgagcgtgtttattatggttaggcttggcttgatctcccccctctcctcctagggggcttgtatttataccacagatgtcccttgtccaaatagaaataggaagacaaaaatggatacgatccgagtagtccttgtagtttccatgtagaactctgcttctccttctgtataaggaatattttccatatatgaggcatgattccatataaaacttggtatatggtgggccccgctaagctcaacctaaggctattgggtttgccttatccataacactggcagtacctacatagttcatcctcacgtagttaatatttttttctcttgtttcattaagccatatcacatcaattgtttttagtgcttaaatgattaatctatggtccaaattatctctctcattttcttctctcattagtccatattacctcaattatctttaccctttagatgattaatctatggtccaaactatctcaatacttttcttctttcataaagtcatatcaccttacttttacatttgaatcatcattctatttactatttaaatttaatttatcataaacctcattaacttacgtaattgttaacggaattttgcatctgattcggagaaggaagaagatcgatcggcgaagaagatggcgaagccggcgtgcacgctgatggcgagggaggccgagaacggcatccatgatccaatgaaaggtaggcatcgtaccttctgttgtttttctgttcgcttttcctttagatcaaaagcgatgggtttccttctttcacttcgcgatgtacttcgcgagagcgaaagtgctcataacgtgttgaaagtggataagattgattgagcgagagaaagaattgaatacaatagagcgaaaaacaatcgttaattaatttatattaattaagttagatgaccagataaaaaaagaaaagtgtgtgcatgcatagagggtatcgaactttggagttcgatagcgtgtcaaacaaccgtagagttcgattgggttgtttattagataaaataattcgaagtgcatacatgcatttgcatgcaggtcctatcgaccaatgtctgtcgataggtcctgcacacccacatgcaacaacaggccatttactggtctatgcgcatgcattgtacttttaatattttttcaccataccaatccctatcgaacatacatattgaacagtgtttgtttgatatgtacctaatagaacatcagtagcaaaagtgggaccagcggaggggcctgtcaggtgatgaaagggagccattgtaggtggggccgatggagaagtaaagaaagagagataagaggaagagagagaatgacatgtgggcctcacaggatgactcagcgggatagaataggtcaaagcgttacgtaagtgaaatcgtgttttacatggctactgtgtgtaattctttttcttgcaaaagattcgcctatgcaggtgtccaatcggatgttacatgtatataacgtgattttttttctaaaaagaaaaagaaagagtccttatctacttcaaattctcatattttttattttattttatttcaattaatatgagaatttatagaccttgagagctacagtggagacttttttttctattactttattaagttaattaattaataggtttatgcatctcataggaagacatgagccatcgagcccattagccttctgttttccgcaacgattgatacttctcgcaagtttcttcttgaagatgacgtcatgacggcgaatatattccagcgataatcagctgcggttaatttgttctggcaggtcggcaccttggccttcagtagttcagtgtccgagggagattccaaaaccaagttgatcacggtggaattacgggacgatgatgagctactagctcttgattgttttctgctttgtattagtggatacttttgctgatatactacgcgaaagctgtcaactttgacgccggatttctcaagtagcttagcatggaactggacaacgttttgtctcaaggtgctgagatactaaacatctggacagaaaaataaatgactactagtgacatgaacatttaaaaattgcaacttcccattcacaaggcaacatgccaattgtaaattgatgtttgacaattggtttgctaaagaattcgagttggcgatggcacttcaagttgggacaactctgtccttataaaactgatcatcgagactgtaccgttatatgaacaagtatgttttttcccccattgactacaactcatttgagtctgcaagtcaaatactgctgtgagcaatcaagaatctgcattctaccctcctgttatgaacttttttagattgtaaagactctttcctgcccaaaaacgattccattagttgagatgctcttacactcatatattaaattccttacccttccataactaattttgaactattcaacaatatcctcttcatacattggtgctccccagccattcattgccccttcacagtacactgatggtccctcgagtcatcaatctgaatgtaagtatcctcctcctcacggccaccgaagagctccgccataaaaatcgacgatcgtgcggcgagcacgtccgctggcgaggaggtcgcggagatgccggtgcaagtccggtggtggcaccaccacggacgacgatgacgccgcctcgcgacggcggtggagggcactcagtaaccacggcgatgtcacacctgataccatagccctaacgttatttgtagccatggacaattaaaggagaaaggtcaccggcgacgatgggggaattttcatgcggaccatgtggccgctcccgtcgggtatactgaacacgtattctgcggtgacgacgtcggcggcgtcagccggtcgaggtagaggaagacagatacccagtcggcgaactcccggcgatcgccgtcgggtagtaggcgacgtatatatataccaggtgtccaggtgtcacccctccgtcgtggaacttacaggagttgatgctcttgccgacgccgatccctttggttctactgtagccggcgacctggatggtgactgacccggtttccattgctctcttgctgtcgatggccgacgacgacgtggttttgccgccgtcgccggtggcagacttggaagttgtgagacccattagattttcaatcaactttgctatacgtccgacgcatgtgtccgacgcttgtacgactgaaacagtggaaaaacgagcaatgacggcgtcagatatgactacgggtcgctgggcctcgttgttgtttgcttgcgtactgggctttctgtacactggggccagtctggctgagaacatgtatcagcttaggttgctattaaaatgattcactccagatgttagattagtttagacctttaggatgtgaaaccaatatattctcacagccataacatgcaagtcctctaaaaaaagccataacatacaagtaaaaaatgattgaccagacctgtgaaaagcaacgcaccacggcttcaatttccatattcatggccaaaatcagttcattaaacagaatacaggtagagtgacattcaaaatacaggtagagtgacatccaaaatcacaagcatactgtctaacattgaataataataaactagcaaatgttgtttagttcgtcgattgagatcacaagtaatgcaagcaaaaaatcattctctctttcatccattcatatgctgggatagaagctccgtcaaatcaccatttccctgcaaaagtaaaaggaacagagcaacaagttaggggaaagtactatgcactgatatatactagaaggcaacaatgaaaattagcacctgaagaagatccatgtaagaactaatgtgagatggtggtgccgggtgatttgattggagtccctgtacaacaatattgtcaaatcaattacagcaatgcaaaattatgtatggcaaatcagtcacacaaattacctgaaactcatttgcagcaaactctgcactgcctgcctcatatgctccaccatagcaatgatcaaaatttacctaataatgaagtgcatatattcagaaacgatagagagatgaaatatttcaagtacttaatactactgaatagaatatgctgtacacattttaataaatatattacctccatttgtctagagttctgaatattgataagctgtttatcttttgatataacatttttggtccttgtctttctccttcttcgactttgtacttcaattgtagattcttgttgcttcttcattctcaatctccttaccacttgatccaattttgattgttttctcagtgaaggaggacgacctcttctacgaactgatattgggcttagcaccatttttccttgtttcagcaccatatctttattcttcccattttgctgatattcctgaatttccttgctgccatggtgtgcatcaatctttatttgcaattcatttaggccatccatcactaaattgcacaatgcatctgaaactgaaccattctctgccacttcattaaaacgcttgcacaacgtatcaaaacgcctaacaattggcgtgtcaagctgatcatcataggagcatttaataaatgtgtgcttgcgcttgaaatcctttctccatcgttgtagtatatatttggaagggactttttctatatcaacaagagggagtattgaaaggatatgtctacacaagatccctcggaattcgaaatgccgacattcacaatgcaagtcacaatcctcttggttgaacaaaacaagtaactctgaaacaaccctttgctctccaatttttcggtcctctctgacactgaaagtatgaaccaacccttctgtcttccgaagagttgcatagtagtagattttgcctcttagctcatcctgaaactctttaaacttcttgttggtatatgccacctgaaattgcctctcaaattcatagtgagtaatgcaaggaattgcctcttggaatgatttacaatcagacttgttttctttctctactttgtctcttagtgcattgtcatattgctccacaaattgcttaagtgtggttctagcattaacataaccatcaaagaaggcattcacactctcactcctttgcgacgaagacattccagcccaaaatgtgtctttcacataagccggcacccataattccctgttatcatataacccagcaagccattcattatcctgtaagctaaattcatcaatcattttcatccatcccttatcaaaatcatctctgtttaatgaatgggtac

SEQ ID NO: 31918 - DNA, 602 bp, Oryza sativa
cgagctcggtacccatgtttttgacctaatgtggttttatatatcctacactttgaccattgtattttatattatattgctcatgatcttgaaattgacatcattggaaaatgtttcgaatatgaatctaatcataccataatgatttttattaaggacaaagaattttgctttcagacttttgttaaattatttgaatgcaattcaggtttggagcgcgcggttgtgacttttttttaaaaaagtaacaagaaaagataaaaaaaattaaaaaaaggctaggcatggcattagaaatgcatgatgaagatgaatactgcgtacctggtaccaaaagggagactgatggcattagatcctacaagaaaccactggagaaagatgcagacaagaaccgggacaatcaggccaagaacataaccggtgtgcctgctgtccctgcagctcccggcggcgtaggcgccgccgagtcccaagatcgccgtgacggtgagcccgtacagcgggaacttgatgcgcttgaggtcaagcttctcttattacacgttgaacgtgatggcgagcagggacgcgatgaaagagatggcgttggagaaaaagaa

SEQ ID NO: 31919 - DNA, 550 bp, Oryza sativa
  unsure (1)..(550): unsure at all n locations
nnnnnnnnnnnnnnnnnnnnnnnnnnnnnnnnnnnntatgctttaaccttcggatcaatgcttattctatcatattgtattgctagccgattggtttatactacattatattgttattttattacatcatcattagccgattgcatttctatcattatctatattggacatatagccgattgcttaaaccctatcgctattggctggtatcggcatcggctattatttgcatcggctggaactactccatcggcttgtcaaccgatcggctatttgatctacggtttacatatcttgtcagttgcaggatcaaactgactggcatgcccgcacctcatcaacctttggacctgcactggagctaagcagatgtcccaggccagtgtgtgtttttcgcatcaacacatttttggcacgcctggtgggaccacggattttatatccacatgtctgaagaagaagtcaatgccaagatcatggtcacggtggagaatttagcggacgaacagaggcaacagatggagcagtttttaactgattttcaaatgcg

SEQ ID NO: 31920 - DNA, 749 bp, Oryza sativa
  unsure (1)..(749): unsure at all n locations
ctataatcacaatactgttctaaatagatttgtcatatccatcacattagacagatctatcggctcatcgagtattagattatcatatacaatctcgtgctgcattggttaggttcgacctactagattgttgtttataatataagtcttgctaagccaataggttcatgctaatgttttatcggggtgctagccgatacgttatctggacattgcatcggcttataaggattacatacaagttgggtttagccgattgcaacaaaggtttcactgtttaaattaatcttttggattttatgacatcggacctccagccgatgtatgctttaaccttcggatcaatgcttattctatcatattgtattgctagccgattggtttatactagattatattgttattttattacatcatcatcagccgattgcctttctatcattatctatattggacatatagccgattgcttaaatcctatcgctatcggctagtatcggcatcggctattattggcatcggctggaactactccatcgccttgtcagccgatcggctatttaatctacggtttacatatcttgttagttgcaggatcaaactaactggcacgcccgcatctcatcaaactttggacctgcactggagatgaacagatctctcaggccagtttgtctttttcgcatnnnnnnnnnnnnnnnnnnnnnnnnnnnnnnnnnnnnnnnnnnnnnnnnnnnnnnnnnnnnnnn

SEQ ID NO: 31921 - DNA, 646 bp, Oryza sativa
tatagggcgaattcgagctcggtacccgaacaatttgatacaactaatactactattttcaaaattaattcccctcatgtgcattgctgtatgcattccatcttgtcaaatctgtaattaaattgaccatttatcacacaacagttccattccccacgttaattaaatttgagaacaatttgagatacaaccaataccactattttcaaattaatttccctcatgtgaattactgtatgcattccattccattccatttcattttatttccccaaccacttttgagatttgctagcagcatagtgtggtgccaccccctccctcttgtttgttggagtagttttttttttcgcagtagtccttttcttttcgcaattggttgttgcagtgattttttttttactctcttccagcatacgtatgtctagccgattgcgttgtgtatcaaaacctctatttcttactaatatattgacgtacaatccttttacgtattcgcaaaaaatctgtatttaatttgacaagttaattattaattactcactcacacaacacaggaggtgtacctggtgacacgtgaggagaaagcgaggtggtcggcgctgccgcgcgacaagtacccgaagccgatggtgttccacgacgg

SEQ ID NO: 31922 - DNA, 557 bp, Oryza sativa
  unsure (1)..(557): unsure at all n locations
nnnnnnnnnnnnnnnnnnnnnnnnnnnnnnnnnnnnnnnnnnnnnnnnnnnnnnnctccccatcaccccgcacggtagtgcctccctccgatctccctcctcgttccatctgctccccttagactgggtagtagcacgagtagcctccccgtagctagctggcgccgccccgaccgttgtgtgctcgcctccctctgttgtccctcctcggtccatctcctccccttagactcgctgcgtgctcgccgccgctcgctgtgaactcgccgccgtcgccgcctatgctccgtagcgccgctcgacgccgggctcgctcggcgtatctccgcccaatccgacgctagcaacggattcccggagtcgcgtagatgctctagcttgcccgaattgggctcccgtcgcgccgtcgccgtttccccccttctctcgccgccggttgccgccgccgcaatccaccgcagtcgagcagcccccggcgaatacgagtcattggctcgtctcccctagtcccgtgcaacctcccggggtgctcgcttatgcctgtatcgccgtggatc

SEQ ID NO: 31923 - DNA, 794 bp, Oryza sativa
caccaatccatcccgaatttggtggttaaactctactgcggtgacgatactgtaggggaggtcctgcggcaaaatagctcgatgccagaatgataaaaagcttaacacctcttatttgactttttcactattttgaaatacgaaaaagatccaaatccaaaatgcaaaggtcgtcttattcaaaacctcaatcatcacatcccctctctcccacttcacacctcggaacgcactgttcttatagagagaaaggggctttcccatcttcttaacccgaaatgaaatggctgaggagagggaggttccttttggggggtacccccgggaagagatccagtggagacggggtgggcctgtagctcagaggattagagcacgtggctacgaaccacggtgtcgggggttcgaatccctcctcgcccacagccttccaaaggggaagggcctttactttccccctgagggtaggaaaaccatgatcgggatagcggacgtaaagctattgaacttgggtatgctctttccttttgtcgaagtggaatcgtagaacagaatgtgatacgatgagataaaatgcaatagaaacaaggatagcgaacgggttacctactcctaagggtcaaagcaagccctttaattcaattctttattcttacattaaagaatgaatcaaatctccccaagtaggattcgaacctacgaccagtcagttaacagccgaccgctctaccactgagctactgaggaacaagggggattcgacctcctaaagttcaacttccgctctcaaccca

SEQ ID NO: 31924 - DNA, 917 bp, Oryza sativa
aaacatacctttttcatagatatttcgaatatgttccctatggtaactgggttcatgagttatggtcaacaaacaatacgcgcagcaaggtacattggtcaaagtttcataattaccttatcccacacaaatcgtttacctataacgattcactacccctatgaaaaatcaattacatcggagcgtttccgggggcgaatccactttgaatttgataaatgtattgcttgtgaagtatgtgttcgcgtatgccctatagatctacctcttgtggattggagatttgaaaaggatattaaaaggaaacaattgcttaattatagtattgatttcggagtttgtatattttgtggtaattgtgttgagtactgtccgacaaactgtttatcaatgactgaagaatatgaactttctacttatgatcgtcatgaattgaattacaatcaaattgctttgagtcggttaccaatctccataatgggagattacacaattcaaacaattaggaattcaactcaaagtaaaatagacgaagaaaaatcttggaattcaagaacgattactgattactagaatttttttgttagaatccaaaagttctttactaactagaaagaaaaacgaatacctactgcttattgcaaattattcctgattttaaaccagagtagattttcgtgatgtgatttctaactatagaaagaacttatatacaatatacaaaaaaatttcctaatcccttttttcttccttgaatcttttagttttagtcagttcatgaaaaatttatactattaatttcttcttatccataatggatttacctgggccaatacatgaaattcttgtgctatttgggggatttgttcttctactagggggtctaggggtggtattacttaccaacccaacttttt

SEQ ID NO: 31925 - DNA, 578 bp, Oryza sativa
  unsure (1)..(578): unsure at all n locations
ttcagtggcatgtttcagtcctcttccccattacttagaaaaagtgagccaccggttcaggtacaagatactaccattaccgcctggacaattagacagccaacccgtaatcgcaacgacccaattgcaagagcggannnnnnnnnnnnnnnnnnnnnncccccgagccaagtggagtatgcatgaaagagtcagatgcttcttctattcttttccctggcgcagctgggccatcctggacttgaaccagagacctcgcccgtgaagtaaatcatcgcccctacgatccaaccaattgggagagaatcaatagactccttttcgggagcgattcatccttcccgaacgcagcatacaactctccgttgtactgcgctcttcaagtgtgcttcttccccttctcccccttaccatggcaagtccttgggaaataactccgatgggcagaaaaaggaaggcgttaagagaccctcctggcccaaccctagacactctaagatcctttttcaaacctgctctgctcccatttcgagtcaagagatagataaatagccacatcccattgcactgatcgaggg

SEQ ID NO: 31926 - DNA, 606 bp, Oryza sativa
  unsure (1)..(606): unsure at all n locations
ttgctgattcacacgggattccacgtgccccatgctactcgggtcagagcgtaagctagtgatgctttcggctactggactttagccatctagggtgcggcactcaaccgcttcgcctagcagcacaacgcttgtattgctctcccacaaccccgttttcacggtttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtctcttgcctgctcatggattcagcaggcagttcaaaaggttgacctatttgggaatctccggatctatgcttattttcaactccccgaagcatttcgtcgcttgctacgcccttcctcgtctctgggtacctaggtatccaccgcaagcctttcctcttttgaacctcgccattaacgttaaggctatgccatcctaaggtgctactaaatggaaggatcttatcaacgtccatgaatgcgaaatcatagatcgaactgccgaattggcaaaattcggtgctatcatagtatccgctaagttcac

SEQ ID NO: 31927 - DNA, 866 bp, Oryza sativa
aaacccataatagagtccgaccgcaacgaccgaattaattatcctcatcgagaaacttagactactaagtagaaaagatttgaaaatcatggcatgggtctcctttttttctttctttagagttttctatatgcacaatttctcgatgtttcgatgagaatttcttgactttccatatatagaaagagatagactataaatgacatctcttatgtcaataagaccaaagggatggatattaaatgataggaagtgctaggaagtgaaatagaatgaaatagagccactctgggcttacctatgaaatgaggcatggaacggagccactacgaagaaattccgggagttacgaaagaagcttcggactcatattgttcatgggttgagagcgggagttgaactctaggaggtcgaatcccccttgttcctcagtagctcagtggtagagcggtcggctgttaactgactggtcgtaggttcgaatcctacttggggagatttgattcattctttaatgtaagaataaagaattgaattaaagggcttgctttgacccttaggagtaggtaacccgttcgctatccttgtttctattgcattttatctcatcgtatcacattctgttctacgattccacttcgacaaaaggaaagagcatacccaagttcaatagctttacgtccgctatcccgatcatggttttcctaccctcagggggaaagtaaaggcccttcccctttgaaggctgtgggcgaggagggattctaacccccgacaccgtggttcgtagccacgtgctctaatcctctgagctacaggcccaccccgtctccaatggatctcttcccggggtacccccccaaaag

SEQ ID NO: 31928 - DNA, 171 bp, Oryza sativa
ccgtggacgaaccttgcggaggaaaccttgggttttcggggcattggattctcaccaatgttttcgttactcaagccgacattctcgcttccgcttcgtcgacccccgctttcgcggttgcttccctctaaggcggaacgctcccctaccgatgcattttgacatcccaca

SEQ ID NO: 31929 - DNA, 3028 bp, Oryza sativa
  unsure (1)..(3028): unsure at all n locations
ttcagggagagctaatgcttatgcttattgggtattttggtttgacactgcttcacgcccaaaaagaaggcagctacgtctgagctaaacttggatatggaagtcttctttcgtttagggtgaagtaagaccaagctcatgagcttattatcctaggtcggaacaaattagttgatagtgataggatcccctttttgacgtccccatgcccccccccgtgtggtgtggcggcatggggatgtcaaaaggaaagggatggagtttttctcgcttttggcgtagcaggcctcccaaagggaggcccgcgcgacgggctattagctcagtggtagagcgcgcccctgataattgcgtcgttgtgcctgggctgtgagggctctcagccacatggatagttcaatgtgctcatcagcgcctgacccgaagatgtggatcatccaaggcacattagcatggcgtactcctcctgtttgaatcggagtttgaaaccaaacaaacttctcctcaggaggatagatggggcgattcaggtgagatcccatgtagatctaactttctattcactcgtgggatccgggcggtccggggggggcactacggctcctctcttctcgagaatccatacatcccttatcagtgtatggagagctatctctcgagcacaggttgaggttcgtcctcaatgggaaaatggagcacctaacaacgcatcttcacagaccaagaactacgagatcaccctttcattctggggtgacggagggatcgtaccattcgagcctttttttcatgcttttcccggcggtctggagaaagcagcaatcaataggacttccctaatcctcccttcctgaaaggaagaacgtgaaattctttttcctttccgcagggaccaggaggttggatctagccataagaggaatgcttggtataaataagccacttcttggtcttcgactccctaagtcactacgagcgccctcgatcagtgcaatgggatgtggctatttatctatctcttgactcgaaatgggagcagagcaggtttgaaaaaggatcttagagtgtctagggttgggccaggagggtctcttaacgccttcctttttctgcccatcggagttatttcccaaggacttgccatggtaagggggagaaggggaagaagcacacttgaagagcgcagtacaacggagagttgtatgctgcgttcgggaaggatgaatcgctcccgaaaaggagtctattgattctctcccaattggttggatcgtaggggcgatgatttacttcacgggcgaggtctctggttcaagtccaggatggcccagctgcgccagggaaaagaatagaagaagcatctgactctttcatgcatactccacttggctcggggggatatagctcagttggtagagctccgctcttgcaattgggtcgttgcgattacgggttggctgtctaattgtccaggcggtaatggtagtatcttgtacctgaaccggtggctcactttttctaagtaatggggaagaggactgaaacatgccactgaaagactctactgagacaaaaagatgggctgtcaaaaaggtagaggaggtaggatgggcagttggtcagatctagtatggatcgtacatggacgatagttggagtcggcggctctcctaggcttccctcatctgggatccctggggaagaggatcaagttggcccttgcgaatagcttgatgcactatctcccttcaaccctttgagcgaaatgtggcaaaaggaaggaaaatccatggaccgaccccattatctccaccccgtaggaactacgagatcaccccaaggacgccttcggcgtccaggggtcacggaccgaccatagaccctgttcaataagtggaacacattagccgtccgctctccggttgggcagtaagggtcggagaagggcaatcactcgttcttaaaaccagcattcttaagtttaagatcaaagagtcgggcggaaaaaggggagagctccccgttcctggttctcctgtagctggattccccggaaccacaagaatccttagaatgggattccaactcagcaccttttgttttgagattttgagaagagttgctctttggagagcacagtacgatgaaagttgtaagctgtgttcgggggggagttattgtctatcgttggcctctatggtagaacccgtcggggaggcctgagaggcggtggtttaccctgtggcggatgtcagcggttcgagtccgcttatctccagcccgtgaacttagcggatactatgatagcaccgaattttgccaattcggcagttcgatctatgatttcgcattcatggacgttgataagatccttccatttagtagcaccttaggatggcatagccttaacgttaatggcgaggttcaaaagaggaaaggcttgcggtggatacctaggtacccagagacgaggaagggcgtagcaagcgacgaaatgcttcggggagttgaaaataagcatagatccggagattcccaaataggtcaaccttttgaactgcctgctgaatccatgagcaggcaagagacaacctggaaaaaagccagaagaaaagaaaggcaaaacaatttccgtagaacggnnnnnnnnnnnnnnnncgagcgaaatggaagcacctaaaccgtgaaaacggggttgtgggagagcaatacaagcgttgtgctgctaggcgaagcggttgagtgccgcaccctagatggctaaagtccagtagccgaaagcatcactagcttacgctctgacccgagtagcatggggcacgtggaatcccgtgtgaatcagcaaggaccaccttgcaaggnnnnnnnnnnnnnnnnnnnnnnnnnnnnnnnnnnnnnnnnnnnnnnnnnnnnnnnnnnnnnnnnnnnnnnnnnnnnnntaaaccgtgaaaacggggttgtgggagagcaatacaagcgttgtgctgctaggcgaagcggttgagtgccgcaccctagatggctaaag

SEQ ID NO: 31930 - DNA, 11118 bp, Oryza sativa
aaacgttgggtagccaagtgcggagaggataactgctgaaagcatataagtagtaagcccaccccaagatgagtgctctctcctccgacttccctagagcctccggtagcacagccgagacagcgacgggttctccacccatacggggatggagcgacagaagcatggaaataggataaggtagcggcgagacgagccgtttaaataggtgtcaagtggaagtgcagtgatgtatgcagctgaggcatcctaacgaacgaacgatttgaaccttgttcctacacgacctgatcaaatcgatcaggcacttgccatctatcttcattgttcaactctttgatgaaaagatgaaaaaaccaaaaaaaagctctgcccttccatctcttggatagatagagagggagggcagaggcctttggtgtcccttccagtcaagaattggggcttcacaattactagccaatatttctctcatgcctttcctcgttcatggttcgatattctggtgtcctaggcgtagaggaaccacaccaatccatcccgaatttggtggttaaactctactgcggtgacgatactgtaggggaggtcctgcggcaaaatagctcgatgccagaatgataaaaagcttaacacctcttatttgactttttcactattttgaaatacgaaaaagatccaaatccaaaatgcaaaggtcgtcttattcaaaacctcaatcatcacatcccctctctcccacttcacacctcggaacgcactgttcttatagagagaaaggggctttcccatcttcttaacccgaaatgaaatggctgaggagagggaggttccttttggggggtacccccgggaagagatccagtggagacggggtgggcctgtagctcagaggattagagcacgtggctacgaaccacggtgtcgggggttcgaatccctcctcgcccacagccttccaaaggggaagggcctttactttccccctgagggtaggaaaaccatgatcgggatagcggacgtaaagctattgaacttgggtatgctctttccttttgtcgaagtggaatcgtagaacagaatgtgatacgatgagataaaatgcaatagaaacaaggatagcgaacgggttacctactcctaagggtcaaagcaagccctttaattcaattctttattcttacattaaagaatgaatcaaatctccccaagtagtattcgaacctacgaccagtcagttacaagccgaccgctctaccattgagttactgaggaacaagggggattcgacctcctagagttcaactcccgctctcaacccatgaacaatatgagtccgaagcttctttcgtaactcccggaatttcttcgtagtggctccgttccatgcctcatttcataggtaagcccagagtggctctatttcattctatttcacttcctagcacttcctatcatttaatatccatccctttggtcttattgacataagagatgtcatttatagtctatctctttctatatatggaaagtcaagaaattctcatcgaaacatcgagaaattgtgcatatagaaaactctaaagaaagaaaaaaaggagacccatgccatgattttcaaatcttttctacttagtagtctaagtttctcgatgaggataattaattcggtcgttgcggtcggactctattatgggtttctgaccacattctccatgggtccctcttagatcttctttctccaatcttggattagggaagaaggagatattcgcgactcctggtggtttcattatggggcagctcatgatcttcatatcgatctattatccacctctgcatctattctttcttagctaaacgggtggaagatccatccaatttggttatatcatggactcaaaaaacggatctgaatgtgactgaaatgcacgatcttcacaggtatcacttttcacgatacctaaaaggtggaatagcgattttcgaaccatttcctataagagaaaggtttccattactttgagaaatggattctatatcaaactatagctattgcattaaagaagaaaagaaactaatagaagtcgaagacgcggaatggtagtgaatagagagaaagattcttctggttttcttgttcctgaaaatattctatctatctcctagacgccgtagagaattgagaattttcatgtctttcaattctcgtactcgtaattggaaagttacggaaggagatccatcattttgcaatgaaaactacataaaaaactctggacaatttcgaaatcaggccaagcgtcttaatacatatgcaaaaaaattcattattggcccaccattgattagaagatttaacttgtatgaatcgctattggtttgatacgaataatggcagttgtttcagtatgttaaggatacagatgtatccacaattcatttagagttacttaatagcctatttcttataccatatctctatcccgtgaaattctcgagccgaaagatggatgcatatgctatgtttcattttgctaaatgatatcaattaaacggtgtatcaattccataaattggatatagcaataaataaatcagcaaaattcttttattttagatagaagaaacttttcttctatctaaaataaaagaatgtacccttctatccaaatccaatttgcatcgataaaataaatccaaattccagtagtagatgaataattgcaaatttttgtgtgtacgagattagaataacttcaaaataactgacataattttttatttttcctgatcagaaaaatacatgaaaaagaaaggaggtagaaaaatttttggatttatggttaaagaagaaaaagaagaaaactggggttctgttgaatttcaagtattcagtttcaccaataagatacggagacttgcttcacatttggaattacacaaaaaagatttttcatcggaaagaggtctccgaagacttttgggaaaacgtcaacgtttgctggcttatttggcaaagaaaaatagagtacgttataagaaattaatcagtcagttggatattagggagcggtaatttcatcgttcgaattttttttcttattttattagtagtcttatagtagtcttagattttgcattttgatgagcctcgttttgaggaattcatggaataatccattttcatggaataatgaattaaggaagaaaggatatgagtctaccgcttacaagaaaagatctcatgatagtcaatatgggccctcagcacccatcaatgcatggtgttcttcgactgatcgttactctcgatggtgaagatgttattgattgtgaacccatattaggctatttacacagaggaatggaaaaaatcggcaaataggaaagctacttaggcaggagataggggaattccttaagaaagaaaaaagaataagaacacagatacataacataaaaaaaagaataaataagacgaaattcgacctccccctacatatttaatttcttctcctatacaaaaactagcaagacctactccattggtaattccatcaatgacacccttgtcgaaaaactgcgttagttcggttaatcctcttatacccaaggtaaaggtcctagtatagaaaatatctatataaccgcgattatatgaccaactatatatctttttttttagttgatggaaaaaatactttttcggacccccttttacaaaggaatttattaaatccaaattctgaaaaaaagagtaagcagatccataaaacatatatgctatgaatagaccaaaaatagctagacttacagaagaaattgcattagtgataaattcatatgaatttatggaagaattagaactttcttggaaaaagttgattgagggagttagccactttgataatatggttaattcccctatttcattatcaaaatggattcctatagatccaataaacaaagtacaaagcagtaatataagaagaggaaatagcatagtatttcccggttcatgaggatagacaaaagtgtttttagtccccaatgaagtactaaaggaccctatcctatttcctgtattaacatgaattttggatagattttgtgaaaaaaaagaaactccactcttcgctgttgataaaacgaaatctctattgactcctttagatatcctttttccccataacgatattgaatacaacgaatcctctttagtactactgtaattttgaaaatgaacacgcaaatacccatcaaaagtaagtaaatatatccgaaacatataaaacgcagttaatcctgcagtaaaagaagctattattccaaaaaagggtgaatataaccaactattactaaggatttcatctttggaccagaagcaagcaagaggtggaataccacaaagagaaagggtaccccataaaaaacaagttcttgtaattggaatgtattttcttaaaccacccataagaaccatattctgacttttatctggtgaatatccaacaagaggttccattgaatgaataacagatccggatcccaagaataataaagctttcgaataagcatgagtgatcaaatggaataaagcagcttgataagaacctatacctagagctaacatcatataacccaattgagacattgtagaataggctaagcttcttttaatatctctctgagcaagagctaaagtggctcctaagaaaagtgttagtgtacctattaaagaaatgaaactcattatcaaaggtagggatatgaaaagaggaagaagtcgagctataagaaaaatccccgcagcaaccatagttgctgcgtgtataagagctgaaatgggggtgggtccttccatagcatcgggtaaccatacgtgaagagggaattgtgccgatttcgcaaccgcaccaaggaataataaaaaagcacacaaaatagtaagcaaggagttaatctcattattaggaatccagttattagctattttaaacaaatcccgaaactctaaactacctgttatccaaaaaaaacctagaattcctaataacagaccaaaatcccctacacgattagttacaaaagctttttgacaagcactcgctgcaattggccgtgtaaaccaaaagcctatcaataaataggaacacattcccacaagctcccaaaaaaaataaatttgtatcaaattggaactagtaaccaatcccaacatggaagtattgaaaaaacttatataaacaaaaaatctcaaatatccctcatcgtgagacatataatcatcactataaataagaaccaggattcctacagtagtaattagtattaacataatagaagtaagcgggtcgattaagtatccaaattctaaggaaaaatcattattgacggtccaagaccatagatattgatagatagaacttccatttatttgttgaatagacaggtgaactgagaataccatagctatacttaaaagtaaaacactaggaaaagcccatatgcgacgaagattttttgttgctgttggaacaagaaaaagtccaaaccccattgacataataactggaagtgggagaagagggattacccatgcatattgatatgtatgttccataagaaaagaaattgcaatttttacttgaaaattttacttcaatttttctataaaattgaaaaaagtttccgattcaccaaactaattcttatctatttctgaaggaataaaaaaatactagaattcttaatttttcaaaaattttctcattgaaacaatcaaaaaataagaataggttttgttggttaaagtcaaaaagttaatgaaataacttcgttacctagttattacctaaagaaggacttttattaaaatacaaaaaaaagattgaatcattttactttaatatttttttgtattaaaatgaagcagctcccttgtttcgtaactcaaattgattggaattcaattctggaatactttaattaactatttgattgaattttcccttccttttatcctcccgtcttatatgggggataggcccccataccttatatctgtatatggagagtatacttgaaatataaattgatttaaatagaaaacctttgtatatattctatattattaaaacaaagtctaaaaaaaatatataatatgttaaaaaactcttgtcttatccgcattagacaaaatgaagtaaaaaagaattcagaatttcaatatcttttagtatctaagtataaatactaagaaaaagaagaaagatggattgatttgcggcaatagatgtctttcacatacaactagaaaaaagtaatttcctttttgaatggcagttccaaaaaaacgtacttcgatgtcaaaaaagcgtattcgtaaaaatctttggaagaaaaagacttatttttccatagtacaatcttattctttagcaaaatcaagatcattttctggcgtcagcgagcatccaaaaccaaagggtttttctcggcaacaaacaaataatagggttttgggataatatgaattgacctatcccccaaaaattccaattatttaatatgaataattaggaataattaggattaattaatgagtttacttttatgtgtcgaattcctcggtacaatattcttagaacaaacctctctgatatataaaaaaagggtttttggtatactgtgacctaaatattcttttcctatcaatgaacttttcgtaatagaatccgtataataaataaaaaaaggggattctattatgaaaagtagagtattcctgcaataagacttacaacttctacctatcttatcctaaattaacaaaaaaattagttctatattgcaactgagaaaaaattgttccaactctttcaaagtttctattgggcaaagcaagaatttttttgttaaaaaattcgcaacgatactaccaaacgaagtctattttaatgaagattctaatgtcctaaattctatggaatcttccaatctcgacgattcgcgagaaaataacttaatattcttttaataaacctgttatttcaacttagccgccatggtgaaattggtagacacgctgctcttaggaagcagtgctcaagcatctcggttcgagtccgagtggcggcagtctcgaaaaagaatacaatagattataaaataaaatggattcaattcgaaatttccaattttgtaatgggaccttctccttatgctatttgcaactttagaacatatactaactcatatttctttctcaacaatttcaattgtgattacgattcatttaataaccttattagttcgtgaacttgggggattgcgtgattcgtcagaaaaaggaatgatagccacttttttctgtataacaggattcttagtttctcgttgggcttcttcgggacattttccattaagtaatttatatgagtcattgatcttcctttcatgggctctgtatattcttcatatgattcctaagatacagaactctaaaaatgatttaagcacaataactacgccgagtactattttaacgcaaggctttgccacgtcgggtcttttaactgaaatgcatcaatccacaatactagtacctgctctacaatctcagtggttaatgatgcatgtcagtacgatgttactaagctatgcgactctttcgtgcggatccttattatccgccgctcttctaatgattagatttcgaaaggatttaaatttccttttgaaaaagaagaaaaatgtttttagcaaaacatttttctttaatgagattgaatatttctaagcaaaaagaagtgctttaaaaagccccttttttcctttattttccaattattacaaatatcaattaattgagcgtttggattcttggagttatcgtgtcattagtctagggtttacccttttaaccataggtattctttgtggagcagtatgggctaatgaggcgtggggatcctactggaattgggatcctaaagaaacttgggcatttattacttggaccatatttgcaatttatttacatagtagaacaaatccaaattggaagggtacgaagtcagcatttgtagcttccataggatttcttataatttggatctgttattttggtatcaatctattaggaataggtttacatagttatggttcatttacattacccatctaaatgattacataacataaaaccttaatgaaatggaaaaaacttccatttttgtgtttgatttgagaaccccttgaacgccttctcaaagggttctcaaaaattcgagatagatctaattagactcttttacttttttctgaatttttgagtatttccactatggaatatagagcggactagtagaagaaaaaaaatcctatttaggataataattggataacagagcctctaccctgtcaacggatagcgagagaacaaaatctggataaataccgattcctattactggtaaaaagatacagattaaaagaaagagttctcgcgggccggaatcctcaaaattttcgtttggaacatgaaatagcttgtatccatagaacatctgtcgtaacatagataataaataaataggagttaatatcattccaattgccattacaaaagtaattagcatttttggcattaacagaaattttggactagtaattagtccaaaaaatactactaattccgcaacaaaaccactcattcctggtaaggcaagagaagccattgaaaagctactaaacatggtaaaaatttttggcattgggatagaaacccctcccagttcttcgagataaacaaggcgcattctatcacaagccgttcccgctaagaaaaaaagtgtagccccaataaatccatgggataatatttgtaaaatagctccattgagtccaatgttggttatggaaccaattcctataataatgaaacccatgtgagagacggaggagtaggctattctttttttgaaattgcgttggccaagagaagttgaagctgcatagattatttgcatcgctcctattattactaaccaaggggaaaatagataatgagcatgaggtaacaattccatattgatccgaatcaatccgtatgctcccatctttaataggattcccgctaaaagcatacatgtactgtaatgcgcttccccatgggtatctggtaaccacgtatgtaggggtataatcggcaatttgacagcataagcaataaggaagccaaaataaaatagtatttccaatgttgcagggtatgattgattaattaatctttccaaatctaatcttggttcgttggaaccgtataagcccatacctagaactccgattaagaaaaaaatggaaccacctgcagtatacaaaataaactttgtagctgaatagagacgcctcttccccccccacatggataaaagtaagtaaacaggaattaattctaactcccacatgataaaaaaaagtaaaaggtctcgcgaagaaaataatcctatttgaccgctatacattgctagcatcaggaaatagaataatcgggaattccgggtaaccggccaagctgctaaagtagctaaagtagtcataaatcctgtcaataaaatagatcctaatgaaagtccatcgattcccaatctccagtggaaattgaagacatctatccatttagaatcctcttttaattggattaagggatcctccaattggaaatgataacagaatgcataagtcattagaaggaattctaataaacaaatagacatagtataccacctaacgattttgtttcccctatgaggtaaaaagaaaattaatgaacccgcaaatatcggcaaaacaacaagtattgttaaccaaggaaaagaactcatgataaagtgataaagacaagatacgttttgaccagaaaagcccgtgctcgattattttgagcacaggcttcttcggtaaagaggaatcagacgattcaagtggaattttttgtaacgtatcaataagatagagccatgctgcgggttgtctcaggtcctaaataaacgcggacacttaaaaaatctgttgggcaggcggattcgcatctcttacaacccacacaatcttcggttcttggcgcggaagcaatttgcttggctttacatccatcccaaggtatcatttctaatacatctgttggacaagctcgtacacattgagtgcatcctatacatgtatcataaatttttacggaatgtgacattgggtctataaattttccttttcaacataaaaattttcgatctggtcaaaatgaaattagtactatatcaatcaaatgtattgtagacaccagacgaagcaatggtttatccaaacttcaacaaataatgcaatatatttcttaatccgtttgtgagaaagcatgaaaagagccaagagactttaattttgggcttcaacaatcataattatacgaattgtatatacgaattcgaattagccaataaattggctatcgtcttttcaatataaattattgcaatattcaaattgcaatatcaatgaattgcaaaaattcaactaagtaaaaaagaatactatggaataacctactcaaaaaatagatattctcaaataataaatagtattcatgttactatttcatattattattatatgtgtccctttgtttagaagattctatgtctaattattcaaaaaattagattgattgatacgagttgatttcctattacgatggatggaagaaagaatggataatccaatagctgcttcagcagccgcaagggctataacaaaaattgcgaaaatgtctccttttaattggcggctatcaaatagatcagaaaatgttacgagatttagattaattgaattcagtataagttcaaggcatattagagctctaaccatgtttcggcttgtgatcaatccatagataccaatcgaaaataaatagacactcaaaaaaagtacatgctcaaacatcattaactaactccttatcaatctcgattcatttcaatatggggacaagaattgaaccgattgaattaattagaatagaacaattacacaacaaaagagaaaagaaggtatttg

SEQ ID NO: 31931 - DNA, 3110 bp, Oryza sativa
tggtaaatgaaagggtaatctttcacattccgccaaagaagaaattagaaaaaccagaaaacctataggctgacgccaaagattccatccaaaaaaaccatattttgactgtgcttcaactatatcaactgtacttgaactgttggataatcatagtcgacgataacatcacagttcccaccgctattccaaaaccgtacatgaaaccttagtttcatacggctcctctatgatcagaaaaaaggaaagtactgtttcatttcgttattatcttcttgggcgtagttagaattatctaagataaaatcgatttcaacgtcctaaattagaccaaaggaattctgtctgctagaataataaaaaacgcttcggaattcatctcatcctttataatataatggtactttttctttgttcagcaataacttaatcttggaataaaacactcgttataacaattaataaacgaaaagagttgggtattagttcatgaagaattctgtatgaatatggataaacgacggaaagaataaataaagatctttttttttgtattgcattccatatcttttgtcctattcttctttccccgaggggtatttaaaaagaaaaaaggaataaagggttaattcgttcttgatagccatttccttaacaagtgaatgggaacatactctggatcggaatccgaagaaagtactacttgctcatttccaccaatttcaagtccttattatgattccttttatgaggaaaaatatctaatgctttagattccctcattactaatcctttatgtactttagtgtttctaatccctcactaacttttgatggattcccttatgattacaactttctgtatcgggaatcccttattattgcccgcttcaagatatgatgactaatcaaaaaatctcaaccttggggtaaagaatttacaccgcttatgtttacttccattttttcttgtacataggaaatgagattttttctttttactacaaattaataagcagttttgtttcactcatatagctatctagtttaacttactaacctgaatatagaataagaaaaggaggataaatattcaatgaatttcagaggaaaaagatcctattttaacgaatcgcacgtagagatattgctagtacacaaaaagttaatgggatttcataactaatagattgagcggcagctcgtagaccacctgaaaaagaatatttattatttgagctatatcctgccataagaagaccaataggagcaatacttgaaatggcaatccataaaaaaacaccaatactaagatccgctaaaacaaagcgatatcccaaaggaataactaaaaaacttaataaaattgatatgactgctatagacggtccaatgctaaataagggaatatcccctcgggatggcaagatatcctctttaaaaagtagcttagttccatctgctatagcttgaagcagtcccagggggccagcatattcaggaccaatacgttgttgtatcgatgcggatatttctctttctaaccacacaattacgagtacttctattgtgattcccagtaagagggtcaaaatgggtagaatccatatcagtccatagacttcttttaataattccaagttcgaaaaagaattgatagcttctacctgtaccctgtctattatcatttcaacgatcaacttctcccataatgatatctatactacctaatatcgtcatgatatcagccaatttcatttttttgactagctgaggaagaatttgcaaattaataaaaccgggtggacgaattttccatctccaggggaaaagactatcatctcctaccagataaattcctaattcaccttttggggcttccactcttgcataaagctcttgttttgacaattcaaaattgggtgaaggttttttaccaagaaatcgatattcaaaatcattccattcggaattctttgctttcttaaagcgtcggacttctaaattctcataagggcccccaggaattttttctacagcctgttgaataattttgatggattccctcatttcaccgattcgtactaaatagcgtgctaatgaatccccttctttttgccattggactttccaatcgaattgattgtaagactcgtaaagatcaactttacgaagatcccattgtattccagaagctcgtaacatggggcccgataagccccaatttacagcttcttctccgctaataaaaccaactccctcaactcgttccaaaaaaatgggattctgtgtaataagttgttgatattcaataactcctcgtaaaaaataatcacagaaatctaaacatttatcgatccatccataaggcagatcggcagcaactcctccgatgcgaaagtaattatgcatcattcgcatacctgtagcagcttcaaatagatcatatattaattctctctctctaaaaatataaaaaaaaggagtctgcgcaccgagatctgccataaaaggtccaagccataacaagtgagaagctatacggctcaattctaacataattaccctaatatagctggctctttggggtatttgaatattctccaagaattctggtgcatttaccgttattgcttctgtaaacatagtagctaaataatcccaacgtgttacataaggtaagtattgtataatagttcggttttccgcgattttttccattcctctgtgtaaatagcctaatatgggttcacaatcaataacatcttcaccatcgagagtaacgatcagtcgaagaacaccatgcattgatgggtgctgagggcccatattgactatcatgagatcttttcttgtaagcggtagactcatatcctttcttccttaattcattattccatgaaaatggattattccatgaattcctcaaaacgaggctcatcaaaatgcaaaatctaagactactataagactactaataaaataagaaaaaaaattcgaacgatgaaattaccgctccctaatatccaactgactgattaatttcttataacgtactctatttttctttgccaaataagccagcaaacgttgacggttttccaaaagtct

SEQ ID NO: 31932 - DNA, 48874 bp, Oryza sativa
  unsure (1)..(48874): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtaagaaggggtttcgttctagtgcccggaaataatattccaaagcctttgtatgctctccattgcttgtgtgtataaggcctatgttatagagtatataacttcgatcatagggatcaatttctagtcgcgtagcttcataataattttgcaaagcttccgcataatttccttcggattgagccaacatccgttacggtcgttcgttctattcaaaaaatctccgttccaaaaccgtacatgaggttttcacctcatacggctcctcccttctgtacatagtactaagcgaaaaaatctagagaataaaaatagaattagttccatctcattatggaccgaaaggggctggtatttttccaagaaatctctagccaaccttcccacaagaggtttttcttaacaccaatgaattctattaatgctagaggaaaacgatagctccaagaatttctttgttctcaacgcctcctatttagaggaattagccacttcaacgatctttgatggttataggggtatccaaagtacaaacttgatggttgtttgttatcccaaccattcttcccagccctgataccaatcaggaaagggttaatttctaacaaagtttttctcttgttgattcctatttctaggtgtagtgcttttatcccctatgctacctattagtactagtagagtaggattagcctgtaatacagaacctatcctgtaggtgtaacctttcgctcaatactaaaatctacaattgaagcatccgaggccgcgtcagtcgaggatacacgacagaaggagttgttagttcacctcaccttccctaagcgtgggtttcccttactaatttggttttctctccgcgaacccccactctttctcgtaaaaccggggtgtaggtagggctaaaaaaacaaaaaaaagagtcaaatcgcaccatctctataataagtaaatgcccttttttccccggaggttgtcggaattattcgcaataaaatattggctacaattgagaaggtcttatcaatgaaatttccatttatacgggatctaggcataattcccaacccattctatcattctatatagaattcttttcattccttcacaaaataacataaaaaaaaaacaaatccattcaattcttataaatcgatccctatgctccaaatggataagagaggtatttctgctcagcccaaattctctctttttccttctgtttgaacaagaagagatagaaaatatttgactaagattggatttcattccactttcctatttcttttctcaacaacaacttctctcatcaactatttcgcattttcaaagtcattaatcgtcccataccctattttctatttgattgtatggggtaggataccttatgcaaacagaattctagggttccttttttatcgaataagaagaattcttccattctctttttctttggtttggggaaaacccaaactaaaacttttcgagggagcggaattcctagtaaaaaaatcctggacccgtccacttagatgaaaaggaatttttctatctaatagaacaatggaactctcgcgcggttgtggttgtacctgtactgcaggaataggaaaactcgctattcactcagttttttttccataataagattatggaggagagatggccgagcggttcaaggcgtagcattggaactgctatgtagacttttgtttaccgagggttcgaatccctctctttccgtttttcttaattcagcaacgttaatgattacaatgtatcaaatcaaatgacaatttattccagcaataatacaatacctttatttaatagaaattctctataccaaattactatggtatgtaaaatacacatagaggaaagaacaaaaaacaaaaaggaatcctagggttaatccatttctgttaggtgaatgggaaaatacgaattaagagccttaggtcgatttagttcggggaaaggggaaggggaagaaaattctatgaacctttccgtttttccttaagttcaagtttgacgagagtaatattctacaactaacaactcatttattttgagaccgacccacttcctatccaggattttttttactagtcctttatattgcaatgtgtcaatcgtcaaatgctttggcaatttccccgggtcggatgaagcaatagaattttgaaccagacgttttgatctttggttatccttcgtagtaataatatctcggggtttgcaacgaaaacttggtatatcgactatacgaccattaactaaaatatgtctatggttaactaattgccgggcctcgggaatggttgaagccatacctaatcgaaaaaggatattatccaaacgcatttcaagtaattgtagtaaaacctgacctgttgaactttttgcttttccagcgatatgtacatatctaagtaattgtcgttctgtcagaccataatgaaaacgcaatttctgtttttcttgaagacgaatacgatattgttcttttttcccagaatggaatttctttttcagattacttccggatttaggtgtttttctagtgagtcctggtaaagctcccagacggcgtatttttttaaaacgaggtcctcgataacgggacatgaagactcctttttttattgaaatttcattttacacaattaatttcattgtatttacattacagaatacatcgaaattaaaactgaattaaagtaaaggataaacagagtaaaatctactaaaagtaccacaaaaaaatggaatttcatcaacatctgaatttttgtatatatattatttattttattgttttgtatctagcaaaattgtagggtagaacgacataatagatcctggcttctccatttaattcggagaaaaagaggtatttttgttcatggaacattgatagagaaaaaagccgactatcggatttgaaccgatgaccctcgcattacaaatgcgatgctctaacctctgagctaagtgggcttacataacagaaatagtgtaacaaatagaaatatgtatagtataggaaatccgtaaaatgtcagatcttaattattaatcttagctattaactagttcgaaattggaagttctacttagaaaaaaatactagaacttcataaaataaagttagatagatttttttgaactttcttttttctctaattcgcaaatctatttttctaatagaatctattccaatttctatattgaatttgattttagatatttttaatttgatatggctcggacgaataatctaatacatggaaaagaataaataatatatattatatacgaaaacataataaagagaacatgcgaatttcttgtattttcagtccatcattatagacattttttgagatattttgtttttttttgttatttgctaataatttaatgattaatatttcactaaggagaacatagaatcatagcaaatgaaattgctaattctgattagcaaaaaaaaagaatgaatatcaagcgttatagtatgattttgaatactctaaaaaaggaacgcggtaggtgggggagagaaaaaccttgggatatattgattcgcattgaattgcaaatacatcaacgatagaatcaattcaatgctgaattgcaataagcggagtctctcaactagagacgaaccgctagactacatagagtaatgaattcaacgattcaaaaaaaactaacagatggaggaaattgcacaaggaatcctggtctcaaagaaaaagaaaatggggatatggcgaaatcggtagacgctacggacttgattgtattgagccttggtatggaaacctgctaagtggcaacttccaaattcagagaaaccctggaattaaaaaaggggcaatcctgagccaaatccatgttttgagaaaacaagcggttctcgaactagaacccaaaggaaaaggataggtgcagagactcaatggaagctgttctaacgaatcgagttaattacgttgtgttgctagcggaactcccttctaaattagggaaagaagggctttcgaaatctaatacacacgtatagatactggcatagcaaacgattaatcacagaactcatatcataatataggttctttaattcttttttaaaatgaaaataggaatgattatgaaatagaaaattcataatttttttagaattgttgtgaatccattccaatcgaatattgagtaatcaaatccttcaattcatagttttcgaaatctttttaaaagcggattaatcggacgaggataaagagagagtcccattctacatgtcaatactgacaacaatgaaatttctagtaaaaggaaaatccgtcgactttctaagtcgtgagggttcaagtccctctatccccaaaccctcttttattccctaactctagtatttatcctgtttttttattaataggtttaagattcaatggaatacatttcttttttattatagtatcggcaaggaatgtcgattattaactcgatatttaaatattattaaataggctttctttgtacaatgcataggactgccccctccccatttccaaattttggatattgacatagatacaaatactctactaggatgatgcacaagaaaaggtcannnnnnnnnnnnnnnnnnnnnnnnnnnnnnnnnnnnnnnnnnnnaccagttcaaatctggttcctggcacagaaaaaagggatcttccgaataggtattgatacaaatacctcgagatgggttgggatacatattcgttaataatatagatagagtatgattttttcatctaagtagataaatctctaaatagaggcacttctttttctgcatttttgcatttcttaattttctattccgctattccgacaaatatttttttattcttgcttatcttatcttactttactagttgttctaagtaatgcacgcggtacaaagttcgtggtagggaacttctttgagtcatcatatttttctgttcatacgaaggaaatgaatatgtgattttccaacgaaatgaagcccttttttgcttagtctatctgaaccttttgtataattggaattaattagaatgtaataggtattctgtttcatctaggaacagagcgtaaaaatattccttgacttgcataaaatctggagttgtgttgtataagtgagcatgaatttcttatcattcaatgagcatcttgtatttcatagaaattgggggttatatagtccttacgtaagggccagcctatccaactttcaggcattaggatacgtttaaggcgtggatgattatcataagagattcccaccatatcaaaagattcgcgttcttgaaaatcggaacttctccaaatccagaagacagatgggattctaggattatccttttgggcaaagacttttatgcatacttcttctgggttatctataccatactgtattctcgtaagatgatacacgctagctaaagatccaccgggtgcaacgtcataagcacattgggaacgtaaataattgtaaccatatacatataaaatgacagcaatggaatcccaatcctctgcttttatttgcaaagtctctattcctcgatgatcgaagcccaaagatctatgaaccacctcatgtttgactagccaattagataaccaaccctgctgcattatcttgatctctcctcctttgtataaatatttcgcagttcgaatgcaagtttgaaatattgccctgctctttcttttcggcacaaagagctcctcctaattcactaatttgtaggaagatactggacttttggatttgaaaaaagtttcagaagatatgtctaaagtagatggtgattgatagagcaattcttgctcataagttccagtattagtactgcgccgaacataaagcttgtggctggtagtaaaacatcgatttttcttttgagatagagttcgatcctcaactatttctcgcgatatcttcttacgaagttttgttagggcatctataacagcctctggtttaggtgggcaacccggcaagtagacgtccacaggaattaacttatcaactccccgaacagtactataggaatccgtactgaacattccaccagtaatagtacaagctcccatagcaatgacgtattttggttcaggcatttgctcatataatctcactaaagagggagccattttcattgttactgtaccggctgttaaaattaggtccgcttgcctaggacttgatcttggtaccaatccataacgatcaaagtcgaatcgtgagcctattaatgaagcaaattcaatgaaacaacaactggtaccatatagaaggggccataaactagagagtcttgaccaattcgaaagatcttttagtgtagttgaaataacggaattggaacttgtttggtcaagtaggggaaactcaatcaaactcataactgtcttaatggaatcttttccttcttttttttttttgtctgaatattcagttaagaccattccaaggctccttttcgccatgcataaactaaaccaacaactaggataagcacgaaaatgaaagcttcgataaaaacggatatacccaatacgtcgaaactcattgcccaagggtagagaaagaccgtttccacatcaaaaacaacaaaaactagcgcaaacatgtaatagcgtattcggaattgtaaccaagccccccccatgggttctatacccgattcataactagaaagcttctctggtccttcacgaaccggagctaaaagtgctgaaatccaaaatgctaaaataggaataaggcttgctattattagaaatgcccaaaaaatatcatattcgtgaagcagaaacataaatgtactcccattaatgtggaataggcggaactgaattagtcaattcaagtcagcattgtcaatttatacagaatttctctcttttcctcggtgaaacaaggatcggtttttctcaaaccaaagggcttagtttagcctttgtttcctctttgccacgtcttctttaaagattcatccaatggaatcccgaccccctttctttttgatttcctttctatttaggtatggtggagacataattcttatagaaacaaaactctctcgcttcactttgtctcattttctctagaatctctagaaaaaggaataaaaacgaaaatactacgaattagagcctaattaagataggatgactaatgtatgcagcctaatgaggagtaattctataaaaataaagaactctatttcagaacgtagattgatttagatttaggtaatctatagatatagataagcaaagtaatatacttcaaacaaagtaggaatttgcaagatggagaacatcttgcagttgatttgatagaaattcatttttcttttcctgtctctataattttcgatgaatgagcctctggtaatccttttatctctattttatggcgcaggcgcctgtccagtctataaacaagtactaatagggaaatgaaaactatactaaaggaaacgtaggatatctctcctaaaatctaaaaaaggacatattagggctatacggattcgaaccgtagaccttctcggtaaaacagatcaaacggattattatcgaaatgattcgaactgtttcaaagacccaacatgcatttttttgcattgggctcttttatcaactgatagaaagatcagttagtccaccatagtttttctttacggaaagataatgagatggctccctgcgctctgattgattatttgtattatgatctatctaagagcaataccaaagtgtttcaaaggaggattaccttgacttaggtctgcctccggcctaaattaaatcaacctaagtgaaatagagtctctatcgttccgctacaagagttgactatgagacttcatacaccttaaagttcatagaacgaaaagaatttttttggaggcccttatcctcattaagcctagcatttagtgggctggatatttaccttatcaactagcaaatcaataaaggttctatttgtttaggcacctggattggtacctgaatcggactgaaccaactatttgtcaggcgactgttctcctattctctcgaatccatgaagtaagacattgattttgcaagaagatccactatgttcattgcataataagctcccttgaaaagcattggcgcacgtgtaaacgagttgctctaccgaactgagctatagcccttgtcagagatatcttaatatatagagaatttcttgtcaagatgaatattctctaatagtagaggatatcctttgatctgtttactataataacataccaataacgaagcggtatttgcttataaaaaggattcgatctataatcgatcgaagtaaagggtcttcctttgtggtgataaattgcctacttaactcagtggttagagtattgctttcatacggcgggagtcattggttcaaatccaatagtaggtaggtaggtagaaaaattactagatagcattggccctacttcgcttcgctatctaataattttttctacccctcttccctttttctttgtatcaactaaaccgttgggttgtcttcaattagatgggggaatccaattaacagcctcgactcgtatcctagctcgtctgagagctaccttcgcttcaaccaattctttcgtaccctcagctctactcacgttagcttcggctatttcaagtgcctgttgagcttcttccggatcaatgtcactacccagttccgcatcatttcctaaaatgatgatctcattattaactattctggcaaaaccgctccacagaaccgccgttaaccattgatcgttgaggaggcgtattctcaagggacccatatctacagctgtgttaatgggggcgtggtttggtaatacgccaatttggccactattagtagataaaatgatttctttcacttcacaatcccaaataattcgcttaggagtcagtacataaagatttaatttcatttcttcaatttgttctcctcttctaagtttatagctttcgtgctagcttcatcgatgttacccaccaaataaaaagcctgttcgggtaggccgtctaattctccggaaaggattagttgaaatcccctaatagtttctgcaagaccaacatacttttcccgnagaaccggtaaaaacttctgccacaaaaaaacggttgtgataagaagctcaatttttcgtgctcttgctacagttaaacgatcctcctccgataattcatccaacccaagaattgcgataatgtcctgaagttctttgtaacgttgtaaagtttgcttaactctttgcgcagtttcataatgttcgttgccaacgatccgaggttgtaacatagttgaggttgaatctaaaggatctactgcaggataaatcccttggaagctaatcctctggaaagtacggtagtagcatccaaatgtgcaaatgttgtagcaggagcagggtcggtcaaatcgtccgcaggtacataaaccgcttggatcgaagttatagatccctttttagtagaagtaattctttcttgcaaagaacccatttctgtactaagagtaggttgataacccactgcagagggcattctccctaataaggcagatacctccgatcctgcttgaacaaaacgaaagatattatcgatgaatagaagcacgtcttgcttattaacatctcggaaatattctgccatagttagggcagtcaaaccaactctcatacgagctcctggcggttcattcatttggccatagactagagctacctttgattcctcaagatttttttcattaattactccagattccttcatttccatataaagatcatttccttcacgagtccgttcccctactccgccaaatacggatacgcccccgtgagctttagcaatattgttgattaattccatgatgagtactgttttacctactccagctcccccaaatagtccgatttttcctccacgccgataaggagctaaaagatcgaccaccttaataccagtttcaaagatggataatttcgtatctaactcgataaaggcgggcgcggatctatgaatagggaatgttgcactagtatctacaggacccaaattgtcaacaggctccccaagaacgttgaaaattcgtccaagagtagctccaccgacaggaacactgagaggagctcccgtgtcaatcacttccattcctctcatcaacccatctgtagcactcatagctacagctctaactcgattatttcctaataattgttgtacctcacaagttacattaatttgcttaccgtcagtgtctcgactcttgactaccaaagcattataaatataaggtaacttgcccgggggaaaagtgacatccagcacgggtccaataatttgatcgatacgccctgtacttttttcttcaattgtagaaaccccgggacgagaagtagtaggattggttctcataattatcacataattttcaaaaaaaaggaatttatcgaaattttgatttttttcttgttgaataatgccaaatcaacaccaaaaaaatatccaaaaatccaaaagtcaaaaggaaatgaattagttaattcaataagagagaaaaggggaccagcacttgatttcgttgcccaaacgaatcccattcaatcgtttactcatggaatgagcccgtcggaaagttcaatcaatctttttttcatatacattttgccttttgtaaacgatttgtgcctactctactttcttatctaggacttcgatatacaaaatatatactactgtgaagcatagattgctgtcaacagagaattttcgtagtatttaggtatttccactcaaaataagaaaagggggtctattaagaacttaataaggattagaagttgatttggggttgcgctatatctattaaagagtatacaataaagatggatttggtgaatcaaatccatggtttaataacgaagcatgttaacttaccataacaacaactcaattcttatcgaattcctatagtagaattcctatagcatagaatgtacacagggtgtacccattatatatgaatgaaacatattatatgaatgaaacatattcattaacttaagcatgccccccattttctttaatgagttgatattaattgaatatcttttttttaagatttttgcaaaggtttcatttacgcctaatccatatcgagtagaccctgtcgttgtgagaattcttaattcatgagttgtagggagggacgtatgtcaccacaaacagaaactaaagcaagtgttggatttaaagctggtgttaaggattataaattgacttactacaccccggagtacgaaaccaaggacactgatatcttggcagcattccgagtaactcctcagccgggggttccgcccgaagaagcaggggctgcagtagctgccgaatcttctactggtacatggacaactgtttggactgatggacttaccagtcttgatcgttacaaaggccgatgctatcacatcgagcccgttgttggggaggataatcaatatatcgcttatgtagcttatccattagacctatttgaagagggttctgttactaacatgtttacttccattgtgggtaacgtatttggtttcaaagccctacgcgctctacgtctggaggatctgcgaattccccctacttattcaaaaactttccaaggtccgcctcatggtatccaagttgaaagggataagttgaacaaatacggtcgtcctttattgggatgtactattaaaccaaaattgggattatctgcaaaaaattatggtagagcatgttatgagtgtctacgcggtggacttgattttaccaaagatgatgaaaacgtaaactcacaaccatttatgcgttggagggaccgttttgtcttttgtgccgaagctatttataaatcacaggccgaaaccggtgaaattaaggggcattacttgaatgcgactgcaggtacatgcgaagaaatgattaaaagagctgtatttgcgagggaattaggggttcctattgtaatgcatgactacttaaccggggggttcaccgcaaatactagtttggctcattattgccgcgacaacggcctacttcttcacattcaccgagcaatgcatgcagttattgatagacagaaaaatcatggtatgcatttccgtgtattagctaaagcattgcgtatgtctgggggagatcatatccacgctggtacagtagtaggtaagttagaaggggaacgcgaaatgactttaggttttgttgatttattgcgcgatgattttattgaaaaagatcgtgctcgcggtatctttttcactcaggactgggtatccatgccaggtgttataccggtggcttcagggggtattcatgtttggcatatgccagctctgaccgaaatctttggagatgattctgtattgcaatttggtggaggaactttaggacatccttggggtaatgcacctggtgcagcagctaatcgggtggctttagaagcctgtgtacaagctcgtaacgaagggcgcgatcttgctcgtgaaggtaatgaaattatccgatcagcttgcaaatggagtcctgaactagccgcagcttgtgaaatatggaaagcgatcaaattcgagttcgagccggtagataaactagatagctagactaagtggataaaattagatagaaaaaaggtctaaataaaaaagaagagaaatagaaagatcaaaaatcagttacgaaaatgcagtaattcttcttttttcttctaattgattgcaattaaactcggctcaatctgaaaaaagattgagccgagtttaaatagattttgatacgatcatgagacttgacaaatcgggattcctctattctatatatttagaagatataaaggtataatacaataaataaatacaaatagagtattatcatatgataatggaatcaaatacgcagtatttacagaaaaagttttcatttattgggaaagaatcaatgacatacaatgcattacagacgtatgatcattaccctttaaccgggttattctattccacttctagatagagaaaaaaactaaaggagaatgaatgaaaaaagacagagtttggaagttagacccctttctaagactctctttcaaaaaagaggacattttgaaacttttaacaggcacaatcgtgagtcaacaagtgactcgaaatgctcgtaagaaaagagaattgattttcaaaatggtagaactagatgacgaagttttctataaccttgatgaagaggtagttttagtttacgactccgatcaagagcgagaagtctttcatttcagattggactgctatagaatctggacccatcgtagagacgttcaaaaggctcctgatgataagaatcatactttcgcggaactccatggggctatgggcttcaacgcggtagacgttttgttccgaatttttctggagcaaacctccgacccaacgatacaatgaattttttctattcacaaagaaaaaagattcggaatcgcaatgctactatacgcacccggaggaatattcggaattatattcttatataatccatttttgcgcggggtcttactaacaggacttcgctgcacgagacgaggattcgtcgaaaagctaaggtcatccggtattttcataccctttgggggtggtatatggccttacaaagtctaaggggtagtatgagatctgtagtaggtaaaagaatttgtcccttgattgagtatgctattttccctcctttaccgcgcattattgtatatgcttctagaagagcacgtatgcagagaggaaattacagtttaataaaaaagcctaaaaaagtttcaactttacggcaatatcaatcaactaaaagtcctatgtatcaatccttacagcggatttgtggggtccgagagtggttgaataagtattgcatgtggaaggaagtagacgaaaaagattttggattcgaaataggcgcattcgactaagtcgtactttgaatccaatttcaagttcgattagaaggatagaaaggccgcgaggatcggaaaagaaaaatcaaatctttttaattgcttctccttttttgctattttcttattatttatataatccattcgattctttttttttagaatactttttttttagaatactaaagtattctaaaaaaaaagtattctataaaaaatctttttttgcaaactcaaaaatacaatagtcaatattcgttataatagatatacttaattatatcataagaatcttaagatattttttgaatagatcaaatcgaatagatagaaatagtaaatttgaatggagacacctattctatgatggattttaacttaccctctattttcgtgcctttagtaggcttagtatttccggcaattgcaatggcttctttatttctttatgtgcagaaaaataagattgtctagaaccgacgggaccgaattttctcaatgtatttccacacaggatcataatacggatcttttgtagtgtaagtaatataatatggtatgttatgtggctctttctacacacaaatgcaaacccgctatggatggggattatggatgcggatataggctacgagcataaatgcatgcatatgcggaaccgggtatagcgagtttttttaagtggatcaacaaatactttttgaatagaaagtcaatgtatctaaccaattattttacaggagtatctagttggcgaaggcgatttcagaatcaaaaaaagtaaagtcaaaatcatttagcttattctctcaatttcaatcgaccgctgttagtatatctaatatgaattggcgatcagaacacatatggatagaacttctaaaaggttctcgaaaaagaggtaattttttctgggcctgtattctttttctaggttcactaggattcttagcggttggggcttccagttatcttggtaagaatattatatctgtacttccatctcaacaaattcttttttttccacagggggtcgtgatgtctttctacggaatcgcaggcctattcattagcgcttacttgtggtgcactattttgtggaatgtaggcagtggttatgaccgattcgatagaaaagagggagtagtgtgcatttttcgttggggattccctggaataaaacgtcgcgtcttccttcgattccttatgcgggatatccaatcaattagaattcaggttaaagaaggtctttttcctcgtcgtatcctttatatggaaatccggggccagggggccattcccttgactcgtactgatgagaagttttttactccacgagaaattgaacaaaaagctgccgaattggcttatttcttgcgcataccaatggaagtattttgagtaccaattgaattttttgaaatgaattgaatgaagaagaattggaagaagaaaagttttctcaacacgagggaaaaggtcccttcgaaattgcattattgtaaggggattttgagtatttatctaaaggaaggaacaaatgaggataagagaaaattgcttctaatttgtccaagtgggatatatggcgtaatattcttccattttcatccgaaaggacttttttctatttctctattccactccatctagatctaagaaagaactcaatgcaatgaaattctactagtatagaaaaaagaggaatagatacaaggtctcaaaccttgttatagaatttttccttcaaagaaaaagaaatatcatatagagtcagcgaataaagcggattcattaacaactcaatttacagatcaaaaatgaaaaaaaagaaagcattgccttctttcctatatcttgtatttatcgtacttttgccttggggagtctctttctcttttaacaaatgtctggaactttggattaagaattggtggaataccaggcaatcccaaactctcttaactgctattcaagagaaaagagttctagaaagattcatggaattagaagacctttttatcttggacgaaatgataaaagagaaaccgaatacacatgtacaaaacccccctataggaatacgcaaggaaataatacaattggccaaaatagataatgagggtcatctccatatcattttgcatttctcgacaaatataatctgtttggctattctaagtggttctttttttctgggtaaagaggaacttgttattttgaattcttgggttcaggaattcttctataacttaaatgactcagtaaaagctttttttattcttttagttactgatttttttgttggatttcactccacccgcggttgggaactactaattcgttgggtctataacgatcttggatgggttcctaacgagctaattttcactatttttgtttgtagttttcctgtgattctagatacatgtttgaaattttgggtctttttttgtttaaaccgcctatctccttcgcttgtagtcatttatcattcaattagtgaagcataaactcatttgatctcctgatattaatcaaaattagcatcctttttcctttagaaagaaagcctttttccattttagcaaaattctttttttctatttctacctgctcaaggtattcatcattccagtacaactgttgcagtagaatgacaacagattcgtgtatagggaactagattagcttagctacctatctaatttattgtagaaattccgggatctgtgattggacatggaaaatagaaatactttttcttgggtaaaggaacagatgactcgatcgatttctgtatcgatcatgatatacgtaataactcggacatctatttcaaatgcatatcccatttttgcgcagcaaggttatgaaaacccacgagaagcaactggacgaattgtatgtgccaattgccatttagcgaataagcctgtggatattgaagttccccaagcagtgcttcccgatactgtatttgaagcagttcttcgaattccttatgatatgcaactgaaacaagttcttgctaatgggaaaaagggagggttgaatgtgggtgctgttcttattttgcccgagggattcgaattagcgccgcccgaccgtatttctcctgagttgaaagaaaagataggaaatctctcttttcagagttatcgtcccaataaaaaaaatattcttgtgataggccctgttcccggtaagaaatatagtgaaatcgtctttcccattctttcccccgaccctgctatgaagaaagacgttcatttcttaaaatatcccatatatgtggggggaaaccgaggaaggggacagatctatcctgatggtagcaagagtaacaatacggtctataatgcaacgtcaacaggtgtagtaagaaaaatactgcgtaaagaaaaggggggatatgaaatatccatagtcgatgcatcggatggacgccaagtgattgatcttatacctcccggtccagaacttcttgtttcagagggggaatcgatcaagcttgatcaaccattaacaagtaatcctaatgtgggagggtttggtcagggggatgcagaaatagtgcttcaggatccattacgcgttcaaggccttttgttcttcttcgcatccgttattttggcacaagtttttttggttctcaaaaagaaacagtttgaaaaggttcaattgtacgaaatgaatttctaggtcccgggatttcttaccatcaagttggtaaaaagccgcgatttattggcgattgctagaattctctatgatccattttggaaatcttttttttgtttagactattttttgtttgcgagatgtcttgtctgcaattccttatttctatcatctcatgcaaaacgaggagaatgcaaggcaagggcgagaacaataaaaggaacaaatccttttaggagggattgctggtcttcttaatcctctattgggcacaagaaaaaggcttttttgcctttttcttgtgtcgattcttcttgtatcgaaatatgaatcttttttcttcctattcggcaaagattactatttcttctttatttgggtctgtctcttgaacctcttttgcttaggttcaggcgatgtagtggacaaaaagagggaaagaaaatatggcgtgggacaaattttttgtgaccaaatagaattgcttgacttgttcaattaagttcaatttagaacttacagaaattttgcaaaaaaaacggatactcttccattgaaggctgttttttatttttaggctagttgagtagttttaattaaggttttattagtttattactctaaattaaatcaatgatttacaagagacttcctccggggaataaaatattggatcctcgattgatcctttctttctcctcgcttcataaaagtgaattaatttcattggcgagggggttataaatcaactgatggattacttcactaacattattaacaaacaaaattaacaaacaaaacgaataaatagagggattctgaccatcagagcaaaggctttctctttgttatttttacaaatcaaaataggaaacccgtttgtaggttatggaatagattaaaaaagtcgggttataagagtaagaattccgcgggtcctttccgctctaatcagataaaagggggtaaggacccgctaagttcctattttttcatgtttacaacctggtccctccaattactatagagatgaacccaatccagaatatgaaccgtaaaagaaaacacctattaaaccaatcacagcaataccggttacagtacctatcagccaaagaggaattcttccagtagtatcggccatttcccctactttcctccacattttatcaagtggtcatgctagagacaaaaacagtcatggatagttataaggatggtatccttccaaatggggataagagaattcttactactctctttctttctctcaattgaagaagtaattggaaaataaaacagcaagtacaaaaatgagtaataaaccccagtatagactggtacgattcaattcaacattttgttcattcgggtttgattgtgtcatagttctatagttggaatttggtttatcgttggatgaactgcattgctgatattgatcccaagaaaaaaacagtaggtacagctagtccgtgaacagccagccatcgcactgtaaaaataggataggttcgatctatggtcattgagggcctcctaaaaggatctactaaattcatcgagttgttctaaagaatcaaaacggtcggttattaacggaattccttgtcggctttctgtgaaatactcgtttggccgaggacttccaaacacgtcataagctaaacccgtactgacaaataaccaacccgcaatgaatagggaaggtatagtaatgctatgaataacccagtatcgaatactggtaataatatcagcaaaagaacgttctcccgtgcttccagacatgctgagctccccaaatttttgtacattcaaaaaaggaattgattccgtaaaagatgggatcaaccagtaaatagaaaattactgatatttcatccttgtgagattgtcaattttgtaccaaaggtgtattttgagtataccaaattagtatagctatccttcctatggcacagcaatcctgtttcgcttggtctcgaaacagaattctttttttctcttctttgttccttgtctatagggtaagctatatggtattcaaggcatcaatagaaaacctcaattttgagggtcctacttaattttcaccggcttcggaatagtagaataattcggaatagggctcaagatcttgggaaaatctaagttaatgatcaacaggtttggataaagaatttaggaaagatattcttatactgacacaatacaaagagaagtagatgcgaaagctatcccttcgaatccaacctttccccttaaagaatttaattggttagcataatataatatctaataaatagaaaatcaaatagtagataatctgttatgaaagagagaaaacattctttgaagaatcaagattcgtaatcaacccttgccttgtttactaactttcttgaccaaactgcaagcgtggaactttgccagttcttaggtttccgaaatagtgtaatggaaaaagaagtgcttcgaatcgactttgattggggttcgaaaaaggaattaaaaaaaagtaaattcaggaaagatttcctttttttaggagaccctcgaggggtcgtggaatgcttttcttctcctcttattccatatggaatacaatcaattaaaataagaaggaataggggaatattcgactgttcgctccaaaaagaaggttaaatcatcctattgaaaaagaccaaaatagaaagaactttttcaaattcaattctttatttttcactggggttagctgatctagttcttaatatttttactttactcaattgacagattacacagcaaatctcttgattcggaattagggactcatgccccatctgatgaatccattttcttttacacttctgtatctcactctatcttgttttttagtattatctaaaataaccgatgaattatgaattttccataacttaggtaagtgctttaccaacatatgtagtgtagtaaaaaaaatggaatttaaccctttcatgcttactataactagttatttcggttttctattggctgctttaactctaaccctagctctatttattggcttgaacaagatacgtcttatttgaaatgaattgaatgaataaggcagaaaagaaaaaatctctcttttggattcctggtattctacgcactaattaccaattctttttttcttggtcattgagattcgtggataatttagactactatttagggataaatcgtacctcttttttttatcccctcgaacaaatcgaaatgattgaagtttttctatttggaatcgtcttaggcctaattcctattactttagcgggattattcgtgactgcgtatttgcaatacagacgtggggatcagttggatctttgattgagtaatatttcttttttgattgccctcctctctggtctggaggaggtcaaattggaattgcaatttgttttgttaagttattttgccctgcttcgacataagatagatggaatcacgctctgtaggatttgaacctacgacatcgggttttggagacccgcgttctaccgaactgaactaagagcgctttcaaaaatcaaatccttttctactcctaatgtgtctcacgtacgtatagtatccacaaattcaagttatacccgctttaatcgacctcctcactactgcctataaagaagaaagaagtaataggtagggatgacaggatttgaacctgtgacattttgtacccaaaacaaacgcgctaccaagctgcgctacatcccttttccaaattgttgtacaatgtcattgtacacaattcctatcttgttttccacatcctaattttcttgtctttttctatctatagagaatcctcgtgtcatttcttctttttggtctcatataatcaaggaatggtatatatctaaatccaatctaatttcacctataaaagaaagattactattccttggtaatctataggaagggattgtctttttcgtttttagttcggaatttcgcctaaacaaaagaaatacaaatgatcttgggcaataatatctgatcatatacgtattccaataaggaaggaggattttcaatgcgggatataaaaacatatctctctgtagcacccgtgctaagtactctatggtttggggctttagcaggtttattgatagaaattaatcgtttatttccagatgctttgtcattcccctttttttcattctagttgttgctatgtgaggaatagagttcttcgtgacatgataaaaaattcccacttttcaatccctttttagtataggaaagaaaaagaaagaaaagatagattgggttggaccttagagtcatgaaaaatttggtaaatctcatttttgaaaaaagaaattcaattaaaagcagtatccaagctaagtcaggcctcagaaatcagagcatagaaagaggctgggttggctactaaaatgaaaggattttgcttcaaaatccttgctaatttgacaaggattgtattccttaattatttctctattttttattacttaattgaaaaatttccaaaaatttttattctaatggattttcttcttcctcttcggtttcaaaatagaggaataaaagaataagtagaagaattaagttaagtcaatccaaaaaggaaaggaggttcatggccaaggggaaagatgttagaatcagagttattttgcaatgtgtgagttgtgttcgaaaaggggccaatgaggagtcggcagggatttctagatatagtactcaaaagaatcgccacaatacacccggacaattagaattaagaaaattttgtcgttattgtcgtaagcatacgattcatgccgaaataaagaaataggagcatcttgtgttcgatctttccaaagatcaaaaagaataagaacttcctatttaatatatagagcatagatagaatacaaaatacaaatcaacttgtctgatttccattagatattatttcatatgtatcgagggtattcatctaatatatggaccaaagagagactatttcttctggatccaaaattaataaaataaacaaatcaatttttttttcaattttaaaataaggaataaatcatgtatacatctaaacaaccctttcataaatccaaacaaacttttcataaatccaagcaaacttttcgtaaatccaagcaaacttttcgtaaattcaaacaaccttttcgcaaacccaaacaaccttttcgtaggcgtcctcggattggcccgggggatcgaattgattatagaaacatgagtttaattaatcgatttattagtgaacaaggaaaaatattatcgagacgaataaatagattaaccttgaaacaacaacgattaattactcttgctataaaacaggctcgtattttatctttcttaccatttcgtaactatgagaatgagaaacaatttcaagcccagtcaatttcaataattacaggtcctagacccagaaaaaatagacatattcctccattaacacaaaagttcaattccaatcgaaacttaagaaactccaaccagactttaagaaacaacaatcggaacttaagttccgattgttgatgttttattcgaaagggccagactatatataaagaaagtaatccaatttagattcttgggtttgttataagaaagaacaatggggaagaaaaaatagtttttttatttattgcaacatgctcgttgattcctaccacttaatcttaatttattgtatcttcccggagttacctctccgggaattcttttttaattattcctgtatattacttttttatccctttaattgataatctttattttattggaaatcgtgtaaagattatttgaatttaatacagctacttgtgcaaggattttacgattaagaatcaattctttcttgtaaagattgtgtattaatttactataattatcgaatactttatgtatccgcgttgctgcgtttatccgactgatccacaaacgccgaaaatccctcttttgcctgactctatctcgatgagaggaaacaaacgctcttcttacctgttgagtaatcattcgattaagtcttaaatgagcccctctaaagtttgaggcaaatgaacgcatttttgcccgtcgtctccgagctatatatcctcgcggaactctggtcattgaatcaaattaaccttaatgaataactaatgatttctcttcttttagccatcctttttcccattaataacaaaacgaattattcccatatataaaatattagttccaatggcttttgctactataaccttcccaaccacaattttctcttctactcccttcagttatttcgcacgatactaaaaaatagtgggttccatcgtttctatggttcccttttaaacggcgaggccctctctatacaccggagccctttctttcatttcatcaaagggtattgtgaacttgtatagttcacattctttggctctacctatccattatagagtaaatagctcttttcacaataagagttatccatacagtgacggcatttaattatgaaagttggctaagtagctgaccctcttagtccgtttttttaagataaaggagcataagcctttatctttttattactatttcctccgcttaatgaatagccgtttgctaccaatgggggaattgcttcttatttccaatctagatgattggatttgcaccaaaggaaaccagaaattccatataccgtagaaatctaggatagagaagctctatcctattcattggtaccgatcatggatacttcaaaaattgtcttatttgtttgaacccatgatccgaacgagtcgcacatacaccctagcacatgttcctcgacgctgaggacatcccttaagcgcggccgattttctagcatttcgtattggctgtcttgcgtttctaataagttgtttaaccgttggcatgtcgtatgtatatagaaaaaatggattggtttagatcgatcttaacctgaatgattgatcattatgaagtatttccattaaattgcataaaacccgaatttagggttgaaataaatttacaagaaatctggccactaccaatccttaaacatttctggaaaccacactggatcagtatcgcagtgctcgtcaagcatttcatcccctacaatatcgacaagtccataagctttggcttcgtctgctgacataaaaacatccctttccatgtcttcggatacaacccaaaaaggcttgcctgttcttagtgcataaacccttgtgatcatttcgcgaactttgtgtaactcttccacttctagtaaaaattctggtgttcttgcccgataataagcactagcaggttggtgaagcataatcctcgcgtgggggaatgctatacgcttggtgggttctcctccaagcagaatgaaggacgccatggacgcggctattccgaggcatattgtatatatatctggtgtcaccgtttgcatcgtatcaaaaatcgccattcctgagattaaccacccgccgggggagtttataaacaaaaaaatatcgctaattccatcttctatactgagatataccatgagacctgtaatatgattcgtgacctcgcaacgaatctcttgacctaaaaaaagtgtcctttctcgatacataacattgtataagtcaacccaagtcgcttcttcatctccgggaatccggtaaggtacttttggaacaccaatgggcatattagattaatattattaaatttaagtaagaaaactacactttaatatggaaacgtaagaatggaagagaaagaaagaatccgcagtttattgttttcactttttttcttattctatatgaatactatagattctattaatacgtagattgaaataatacatagattgaaagattatacatataagtaggataagacagattgaataaagaaaaaagaatgggtgattcgaatactaaacaaaaagagatagggatctattcttcgttttttccaaataagccaagctgcccattgcatattggcacttatcgagtatagaatagatctgcttctctttcttcttacgaacagaattggcttcttatttttaatggaatgaaataaatattcacgctttctgacacagaatcccctagaagggttaggtacataggatatggatagtctttgccaatgcgataaaataaagtgacatcgtgtctatttttctttgctaaaggggtatttccatgggtttgccttggtatcgtgttcatactgtcgtattgaatgatccgggtcgattgctttcggtgcatataatgcacacagctctagtttctggttgggctggctcgatggctttatacgaattagcggtttttgatccctctgatcctgttctggatccaatgtggagacaaggtatgttcgtcattcctttcatgactcgtttaggaataaccaattcgtggggtggttggagtatttcaggaggaactgtaacgaatccgggtatttggagttatgaaggcgtggcaggggcgcatattgtgttttctggcttgtgtttcttggcagctatctggcattgggtatattgggacctcgaaatattctgtgatgagcggacgggaaaaccttctttggatttgcccaagatctttggaattcatttatttcttgcaggggtggcttgctttggctttggcgcatttcatgtaacgggtttgtatggtcctgggatatgggtgtctgatccttatggactaactggaaaagtacaagctgtaaatccggcgtggggtgcagaaggttttgatccttttgttccggggggaatagcttctcatcatattgctgcgggtacattgggcatattagcgggcctattccatcttagtgtccgtccacctcaacgtctatacaaaggattacgtatgggcaatattgaaactgtactttccagtagtatcgctgctgttttttttgcagctttcgtagttgccggaactatgtggtatgggtcagcaactaccccaattgaattgtttgggcctactcgttatcagtgggatcagggatactttcagcaagaaatatatcgaagagttagtgatgggttagccgaaaatctcagtttatcagaagcttggtctaaaattcccgaaaaattagccttttatgattatattggtaataatccggcaaaggggggattattcagagcaggctcaatggacaatggggatggaatagctgttggatggttaggacatcctatctttagagataaagaagggcgcgaactttttgtacgccgtatgcctactttttttgaaacatttccggttgttttggtagatgaagagggaattgtgagagcggacgttccttttagaagagcagaatccaaatatagtgttgaacaagtaggcgtaacggtggagttctatggtggcgaacttaatggagtaagttattctgatcctgctactgtaaaaaaatatgcgaggcgttcccaattaggggaaatttttgaattagatcgggctactttgaaatcagatggtgtttttcgcagcagtccaaggggttggttcacttttggtcatgctacctttgctttgctcttctttttcggacacatttggcatggggctagaaccttgttccgagatgtttttgctggtattgatccagacttggatgctcaagtggaatttggaacattccaaaaagtcggagatccaactacgaggagacagccagtctgaggccgcattgctttggtatctttcacctctcttttttgatttgacatgggaaacatctcccatcccttctttgactctttttccttttttatacgggaaatgatcccaaatgacaaatgaataggtgtggaagttataattgtaaataaaccacgatcgaatctatggaagcattggtttatacgttccttttagtttcgactttagggataatttttttcgctatcttcttccgagaaccacctaaggttccgactaaaaaagtgaaataatttaattgaagtaagaagtctccccatnagggaaacttcttacttcaattagtccccgtgttcttcgaatggatctcttaattgttgagagggttgcccaaacgcggtatataaggcatacccagtaaagcttacaagtaaaccagatatggagatggcgactaaagttgctgtttccatttttatagaatttcaagattacaatggatctacgaaaagatcgtgtatttacaactacaacggaatagtatacaaagtcaacacaaatcattaaatggaatttatggctacacaaaccgttgaagatagttctagacctggaccaagacaaactcgcgtaggtaatttattgaaacccttgaattcggaatatgggaaagtagctccgggttgggggactactccttttatgggggtcgcaatggctttattcgcggtattcctatctattattttagaaatttataattcttccgttttactggacggaattttaatgaattaggtttctactaacgaaaactacgaagtcatagtttttccatccaaaagagcctttctactttaagctctacatttctagacattctggtagttcgaccgtggaattttttggtttcggtatctctggaatatgagtgtgtgacttgttagaatttgctcctattgataatacatagaaagcacctgttatctctatcaagatgattctaattcgtcggatattatttattctagtatctggaacacgaaatagatagagtggatcaagaaaaaaaaatgaaactatgattcatattaactattcagacctcgcaaccagactgaaaaaaattcaagtagttcttaataaaaataaaaaaagaaaatttcttccttccaattttgtttgcccaaaaaacaactttttttctctcgattttgtcgagtcattacaccgattcaataaatgatcatcaagcggttcttattcgaagaacccttgccttttgtttagcttgagactcaatcatcgtggctctagtatgaatctaaggttttaattgaactgattcataggatcgcaacaagataatttctaccagaaaactactccaatttttgctttatttatttatctagtaaaacaagagtaaatctgcattacgcacaaaaaaaagaaatccaaaatagggaagagaaaaatcaagaggcctctaatgatcaacatttgggaaagaaagatagacgagccaacttgagattttttggcattatcatcacaaagaagaaattctggatttttcttatttcatatcttcaaggcaaatcgacccaacccagtggctgatgaagttttgaaccttttttctaatatccgttgaaaatttgtgtgtttctgtttgagccgtacgagatgaaattctcatatacggttctcggaggggggttcgggttagttacctatctcaataaagtatatgattggtttgaggaacgtcttgagattcaggcaattgcagatgatataactagtaaatatgttcctcctcatgtcaacatattttattgtttagggggaattacacttacttgttttctagtacaagttgctaccggttttgctatgactttttactatcgcccaaccgttacagaggctttttcctcggttcaatacataatgaccgaggccaactttggttggttaatccgatcagttcatcgatggtcagcaagtatgatggttctaatgatgatcctgcacgtatttcgtgtgtatctcacaggtgggtttaaaaaaccccgcgaattaacttgggtcactggtgtggttttagctgtattaactgcatcgtttggtgtaactggttattctttaccttgggatcaaattggttattgggcagtcaaaattgtgacaggtgtgcctgacgcgattccggtaataggatcacctttagtggagttattacgtggaagtgctagtgtgggtcaatccactttgactcgtttttatagtttacatacctttgtacttcctctgcttactgccgtatttatgttaatgcactttctaatgatacgtaagcaaggtatttcgggccctttataaggaaggcatctcatagagagttctaattctcatatatcatatcgggtaggttgtggtatttcattgctacaaacatgggttattctaaaataagacatgtcatttagatacttctcttcaactccgaactattgtgatacaaataatacaaatagttgaagttaattttacgaaagaaaagaaggcggattatgggagtgtgcgacttgaattattgatttggccatgcagatagagagttggatctgccacattagaattcacgaccaaaggtgtctccatatccaatcaacacgtaagtcccctgtctagtaaggataggctggttcacttgaggagaatattttctatgatcatacctcaaccatgtcatccatgaagaggctccgtaagatcccatagagtagaaatggaataagtcatgtgacatgatccaattctctatttattacacttactttttattatagtatggaaatgcattcattttctttgcatcgattgcgatctgcaatactatcggagtaaaagaagggatctaaggaagaacgtaggctaaactttttgattttttattagtaacaagtaaatactttgtttggacgtaagaaacttgcaatattgggggggataaataccaactaatcaagagacgcgagacaatccacaaagcaattgatcatgatcaaatttgtaagcccacttggatattgagcatttacccataagagtaggattcttttcaatgaatagttgtaggtgcaacttcggaaaatagaatctgataaagcttttcttacttagagccattgagccattatataccttattctattatggatcttctacggttttatttctttcattcttgctcgagccggatgatgaaaaattctcatgtccggttcctttgggggctggatcttaaagaattcacctatcccaataacaaagaaacctgacttaaacgatcctgtattaagagcaaaattagctaaagggatgggacataattattacggggaacccgcgtggcccaacgatcttttatatatttttccagtagtaattctaggtactattgcatgtaatgtaggtttagcggttctcgagccgtcaatgattggtgaaccggcggatccgtttgcaactcctctggaaatattacccgagtggtacttctttcccgtgtttcaaatactccgtacagtacctaataagttattgggcgttctcttaatggtttctgtgccgacgggcttattgacagtaccttttctagagaatgtcaataaattccaaaatccatttcgtcgcccagtagctacaaccgtttttttaatcggtactgcagtagctctttggttaggtattggagcaacattacccattgaaaaatccttaactttaggtcttttttagggatttttcagtttgattcattcaatcgtgaagtaccgtgcataggtatctaggaaatagttacttccaagtgaatcttccctagatacctataatctattttattatgatccatttcgcgaaaatatagattgtcccaaagatgcaaaattgttttattttttctttttattctaactcgaaaaagaagaagaggaaaaaattgcaatggatttaaaactagaacttattcttaggtaaatccattgggagatgcttctctagagtgtcccatatctgttttccatcttgcatacgaaaactgtcaattctcatcagatcttcttccgtcttactcaaaaggtccaatagtgtatggatattggcccttttgagacaattatacgttctagaaggcagttctaattgatcaataaaaatacaattcaatggaattctttttttgtttttctttagattagttaatcttttttgaaagcttaaaaggggggaagtaaacctgtttttattttcttggaaacgagtaccctcttcctccgtgtgaagaaaaggaagaaataaatcaatcaaattacgagaagcctcataaagcgcttccttaggggttaaacttccattggtccatatttctagaaaaagtatctcatattttgcatttccattcccacaagcaaaaatactataattcacatttcgaacaggcatggatacagcatctataggataacttccatcttgagtgttctttctgacttccgtgtgatatccgcgatctctcttgatccgtaactcaatacggaaatccgtgggttctgtcaagttagctataggttgtgccgtatcaacgatttctacggaaggcggtaagataatatcttgggcagttatgtatctaggacctttgacgcaaattgatgcggttctaactccatagagattacttctcaatacaatttctttcaaatttagtaaaatttcttgtaccgattcttcaatacctgctattgtagaatattcgtgcggcacgctcccaaattttgcatgtgtgatacatgttccttctgtttctccaagtaaagctcttcgcaaggcaataccaacggtatccgcttgaccttttctaagcggggacagaatgaaacgaccataataaagacgcttactatctactcttgattcaacacacttccactgtagtgtttgagtggatcctgctacctcctctcgaaccatatagactagtattattatttgatcattgaatcgtttatttctcttgaaaggggtttaattcttttacagacgtctttttttaggaggtcgacacccattatgcggcataggtgttacatcgcgtatacaacttaatcgtacaccacttttagcaatggctcgtaatgcggcatctcttccactaccagcaccctttaccataacttctgctcgttgcaaacccactgtacgaatagcatctacagctgttctttgaccagcatagggtgatgcttttcttgagcttttgaatccacaagtacccgcggaggaccagaaaaccacccgaccttgcggatctgtaacagttataatagtattgttgaaactagcttgaacatgaataactccttttgttattctacgtgcactcttccgtaaactaaaacgcgcattcctacgcaaaccaatacgtactttcctacgtgaaccaatttttggtatagcttttgtcatattttattatctcataaatatgagttagaaataacaaaaagaaaaaaagatacaaagatatccgtttcagggtaaaatatatcctttacttgaatttttttatttggaatttggacattttcgcgggtacttttttttttactttttagaaagtcaagttcttttttcgaaagattacccctgtctttgtttatgcttcggattggaacaaatgactctaattcgtccacgcctacgaatcagtcgacattttgtacaaattttacgaacagaagctcttattttcatatttccgtattcctttcttaaactatgaatttactcttttggaaaaaataagtctctttgtttgaattttagaactttgaattttttaccctagaaaaaaaaaagaaaaacctaaccctttgaatctttggtatccttcaaatcttcggtatccttcgagtcttcggtacgcttcgaatccttatggggaagtctataaattatacgccccttgcttgaatcataacgacttacttcaattttgaccctatcccccatcagtattcgtatagaactagaccggatctttcctgaaatatagcccaggatgatggtgtcattctctaggcgaacgcggaacattccgttgggtagggcttccataactaaaccctcgaaagtaatttttgcttctctcgggttttttttttctctcctatttttcttttctgtcatatttttttttctcctatttttctttttttattttcaaataaaaaaacgttgtatttttgtttgaaaaataggaagttcaagatagaatttgggtactataactataggtggggcgattaccgctataggcggggcgattaccatatataacataagacttctcccccaattctgtttagtcgagcttctcgatctgtcattatacctcgagaagtagaaagaatagcaattcccattccgcccaaaaccttaggaattccttgatagttggcataaattcgtaagccaggtcggctgatacgctttaaaaaggttctagttctatatattccctttctagtctttctcttttgatgtcgcaaagttgaaaccaagaaatatctgttactttcctgatgtttccgaacactttcaataaaaccctctcgtagaagtattttaacaatgttttcggtaatatttgtagatactacccgaacagttccttttttattcatgtccgcgtttcttatagaggttagtaaatcagcaatagtgtccttgcccataagactctaattctaggttcctcctaatttttctataatcaacatgttctcttttttcttttcgttttggattctaaagcatatacgtgaaacacaatctactaattttttatttgatctatatcttgtctactagtatttataatacttcaggagctaatgaaactattttagtaaaattcaattctctcaattcctcggcgatcgcgccaaaaacgcgagttccttttggatttcctttttgatcaatgataaccgctgcattgtcgtcatagcgtattattataccgtcttcgcatttgaactctttacatgtacgtacaattacagctcgaattacttcggatctttctagaggcatttggggcactgcgtctttgattacagcaacaataacatcaccaatacgagcatatcgctgattactagcagctcctatgactcgaatacacatcaattttcgagctccactgttatctgctacatttaaaagggtctgaggttgaatcatattattttgatttcaatttgttatttcaatgcaaaaggatgaaagaaatattgtctttccagaaagaagaacctggttttttattttcaatactactttttttggggggttatatttctaaccgaagaaattgacttcgtatgggcattttgctggcagctatggaaatagctgctctagctacagtttcggatactccgcccatttcataaagtattcgacctggtttaacaacggctacccaatattcgggggatccctttcccgaacccatacgtgtttcggtcggtcttattgtaaccggtttgtcgggaaatatacgtacccagatttttccaccacgacgtgcatatcgtgtcattgctcttcgtcctgcttctatctgcctcgccgtaatccaagtgggttcaagtgcttgaagagcatatctaccaaaacaaatacaattgcctcggtaggattttcccttcattcttcctctatgttgtttacgaaatctggttcttttggggttatagtcgatggttctctcttagttccatctctactgcaaaactggacatgagagtttcttctcatccagctcctcgcgaatcaaatgagaaagtgtgcaaatttctctaattccacaatattctaaaatattacggatagatacacattaataggaaaggttagggtttttaatattgaatttattaaaatactaaaatatatagtcaagaaagaggatctagaatatatctagatgtgtatgtttatttatctatattctatatttaatgtaattctttttttttttttttttaatctcctttttttattttactcttattgaatcgcggtaaagtattctaattcaataaaaatttcgcgggcgaatatttactctttcctgtcttatttgttaattcataaccttatcaaataagacaatttttttggtttgttccgccatcccacccaatgaagtattgggattcttttcaagaaaatcctatccagtcataggttctgtcgttcccactgcttctcctttaatggttaggtttgaatctcgcaatggagcttccaaaaaatttctttccgagtcaatttctcagttttattaactcgggacgctctttgttattccttgaaatttgtatttcttgtttcaatcaaattacgatttcgaattctctgttatttttattatattgatgctttatcacattgctttttatgatgtaattcatagaccatacatattggaatcctatatctttcttatttctcttccttctttctatcatccttccttttatctacatcccctttagttttgcttcacaacttagaatcctatttttttttaaagaaaaaattgcagttgctacacgtatatgatagatttactcatttatgatagatgtatttattcatatagtgactgtttcttagttaggatctcgacaatacgaagcaataggttggttattagttcattttctataattacatagtagggttcattctatttttttttaatcccctttttgaaccctaaaaaaaaactaacgagtcacacactaagcatagcaattttattaaaagatttctcaattttcattaaatcttatagaaagaggtagaatttcttctttttttcagggattttagggaaaataaggctcttgtcattttttattctattactgaacagaatgggaagacagggttggttattcttcgtctacgaatatccaaattttaactcctaatactccatagatagttcgaattggatagcagcaataatcaattttagcgcgaattgtttggaggggaagtctaccttttttgatgcactcggcacgcgcaatttcttttcccgcgagacggcctgcaatttttacttttactccctttatatctgtttttttagttaattcaatggcttttttcattgcctttcggaatgaaactctattttttaattggaaagctatatattctgcaagaatgttaggttgtctataaggttctttcactttttcgatcccaatattaagtctctggtttacagaattaacttctttttgtagatctttctctaattcttcgattgctccttttttctttaataaattggggaatccaatatggattatgacgtggattgtatcgatttctttttgaatttctatatgtgtaattacttcggaacttgagcctgagtccatttttttattatgtgtaattacttcgaaacttgagtctgcttctatttttctattcgagccctttttcctattcttttgtatatagttcttgatacaattccgtatttttttatcttcctgtagaccttcagaataattttttggttgtgcgaaccaaaaggaatggtgattttgggttgtaccaagtctgaaaccaagtggatttattttttgtcccatatttttctattctattttttttaccgggaatcaaatcttagatggatctaaagattatttcgatttctttactatatttagtacaattgttatatgacacatggttttttttatgggagaactacgtcctcgagcccgaggtctgaatttattcataatagtactcctactgacttcggctttagtgatgaataaatttgctttgtcgaaatccctataatgagtagcatttgctgctgccgaataaaccaactttaagatgggataagatgctcgataaggcatgaggttcaatatcataacagtttcttcgtagtaacgccaacgaatctcatccagaactctttgtactttgaaaacggacatgtggatgcgtttttgtgctttgaaaacccgttcgaacttaagtagacgatcggttggtacttttcttgcgagtttccttagcccactcttcttcttctttatcctaggggtatactttaccagtttgaaacttgtcataaataaggttattccccgcttacctatttcttttttttttattttgaatctttctattctgaattcagttaacgacgagatttagtatcctttcttgcactttcataactcgtgaaatgccgagttggtacgaattcccccaatttgcgacctaccataggatttgttatgtaaataggtatatgttcctttccattatgaatcgcgattgtatggccaaccattgcgggtagaatgctagatgcccgggaccacgttactattgtttctttctcctccttcatattgaccttttctatttttgccaataaatgatgagctacaaaaggattcgttttttttcgtgtcacagctgattactcctttttttccattttaaagagtggcattcgatgtccaatatctcgatcgaagtatggaggtcagaataaatagaataatgatgaatggaaaaaagagaaaatcctttagctggataaggggcggatgtagccaagtggatcaaggcagtggattgtgaatccaccatgcgcgggttcaattcccgtcgttcgcccatcccattattgcaaattccaaaaatgcaattttccatattcctagttacgtatttacttacggcgacgaagaataaaactatcactatattttttccttttcctagttcttcttccaagcgcaggataaccccaaggggttgtgggtttttttctaccaatgggggctttcccttcaccgcccccatgggggtggtccacagggttcataactacccctcttactacggggcgtttacctagccaacacttagacccggctctacccaaacttttttggttcaccccaacattacccacttgtccgactgttgctaagcagttttgggataccaaacggacctccccagatggtaatcttaaagtggccgatttaccttcttttgcaatcagtttcgctacagcacctgctgctctagctaattgcccaccccttccacgtgtgatttctatgttatgtatggccgtgcctaagggcatatcggttgaagtagattcttcttttctctcaaaaaaccccttcccaaactgtacaagcttcttccaaagcatacggctttctagatgtatatgacgatctctagacagatggatcttatatgaatcgtatgatgaagtaccacatgagtggatatataggaaaggaatccaaatctgccgaatcgctcatgttatgatcttctacatcctaggtctccgcgttccgtcatctggcttatgttcttcatgtagcattcagatcgaatgactctatgaaattacgtcgatacttctacatattatgggtaacgtaggagacatccctattttcccccgggggtcttaattaccactgcttagctttcaattcgcctctgaccatcaaattaaatgtgaataacccgtcctcctctctttgaaacaaggggcgcttccggttctgtgcgtgcttcaaacaattttgtcttctccatattaccatatctctagagtcaataattttctatgaggaactactgaactcaatcacttgctgccgttactcaacagttttctgttgaggtctatcccgtagaggtagtcaaattggatcagtgatcgatttctaggtttcgtcgtaaacctaattggttacttccaattacgtaaatcaatagttcaaaccgcactcaaaggtagggcatttcccattgatataggaacttttgtaccagaaacaatagtatctccaattatagcccctctgggatgtaaaatatatcccttctcaccatccccatagtgtatgagacaaatgtacgcatttcgattagggtcgtattctatggttacgattctaccagatatgtctttttgattccgtcgaaaatcgattttacggtataggcgcttatgacctccccctctatgccttgcggtaatgattcctctggaattacgacctttaccacaacggtgccgtccatggatcaaattatttcgtggattggatttcacttgcctatctatggttcccttgcgtgtgctcgggataggtgttttgtataaatgtttcgccgtattattaagtattctcctttagtttttttctctatctagaagtggaatagaataacccggttgaagggtaatgatcatacgtctgtaatgcattgtatgtcctagaatagggcccattcttctaccctttccgggtagtcgatggctattcacagctactaccttaacaccaaagaagagttcgacccaatgctttatttctgtcttagtgaatcccgattcgacattaaaagtatattgattctttcccaataaacgaagacttttttctgtaaatactgcgtatttgattccatccataaatcgactttccctcctatgctctgagttccagtatcgataagaattcgagttcttattgttcttatgttatggtatgaatataccataccaattcgttatgtatggatgatggatgagattccatggatagagagccagttccaatagacttatggaacgttccggttcgcgtgcatccagcaggaattgaacccgcaaatttaccaattatgagttgggcgctttaaccattcagccatggatgcttaacagggatcatcgtacatcgtaaataaccaattttcatatagaaagacatatcatagaaaaatgaaatcgaaaatattcggagatggcaaatattcggagatgactatgaaaacacctctctggatcctcgaattgaaagagagattgagagggatccagaatcctaattctcgctatttggaatggatccaattctattgagtctgactcatagtgatcatttctctttagcaaagaatgaccttggttatcaaaggattgaacaaccgggatccgtttacttatgatacctagttgacattgataacaaggatctaatgaattatgagtttaatagatcctctttagcagaaagacgtatattccttgctcatcacttattcccaaacctcgtatggggctaatcgttttcatttaccatctcagggaaaatccttttcgttccgcttagccctatcgggtattttagtgataggttctataggaactggacgatcctatttggtcaaatacctaatgaaaaattcctattttcctttcattaaggtacgagggcttcttattccacaagaaaagaacgaaagcaccttttcattctttcatatactgggggtttttacttggaaaagacaatgttccatactaaaggattcgggtccataaccacgagttccagtgcactagatcttgtagcacttagcaacgaggccctatgaatagacatatagaatttttggtcgggaaattcgaatgaatcattgagtgaaaaaggagcaaagaatgacaaaagacgagactctactagtcttcactcttgtggtttcctcggtttctgttttcttattcgggatcttgcttttcatggttctcatctctgcaactcgcgattttcgcgagagaaccaaatccaagttggtgaagatcatgatttgggctggcatagtagtgattacctttgcaattgcggttcgaatctatccgatctttatctttttgctcaaagaacgaataaaaccccttgtcgaagccctttatgataagcttccctggatctgggaagtttctctttcacggtattgggatcgtttgatcgatttccttgatcgctacttatgggcgtgcgctcaaaggatacaaacagggattcgcaaacaaaaaggggaattcgtagtcactttttcctgtcgcgtaaaaaaaaggctttacgcgagagcaatagaggttgggatacatctatctcttctgagcaacctcttttggattcttaagaccacccttgcagtaggataccgtctgctttgggttctttattatattatctccttcgagggatttttaggatcgttcaggctatatttagtctattttggcttttactgtctccttttctcagggaagtggttaaggacctcagaagatagaggagagcgccaggcgcagatttccggaatacttctacggggaatgctcattgaatgcgcattctccgtattatgccttgaagaggactcgaacctccacgctctttagcacgagattttgagtctcgcgtgtctaccatttcaccatcaaggcatcttgaaagtgaatcatattccatgaatatgatatctatctaatgtgatatcttgaaagtgaatcgtattccatgaatatgatatctatctaatgtgatatatggaatatatgacaaaggtggagtcttggagtatttcgatcgatcggtcatataggcctgagtcagacatcaaatagcttcgatttgcattatccgtaggacaccttatatgtatcaaaatcaaaaagatgtacaatccaatttctcgattcaatagaagcccaaagaggtgcatatggtacccaaataaggataggatagatatgtcaaaagcaggtctgattacacctattcctaatcctaaatagaatgtaaggacgtggggatttctatgtaaacagagtatcctatttccataggctcgaatgaccccttctcataataagaatgtgcacggtctggtccggtatggaatgaacttataatctgatgatcgagtcgattccatgattataagttcattaccctagcgcccattcccattttgggcggaacagatctactaattcttttattccagttagtaagagggatcttgaactaagaaatagacctagcagctaaaagagggtatcctgagcaattgcaagaatggggttcattgatattcctggtatagtagatgctatcacacatacagtcatactcaattcgatggaattgtttgatcttaaaggggatcttctataatttcgcacataaggggttatttcttggtttcgtccagtcattaataacttgactatttttagataatagtagatagaaagaacgctcgtaaggagtcctattgaaaccaagaaatataggcctgcttgccatccacaccagaatagatagagttttccgaagaaacctgctagtggaggaaggcctcctagggataagagacatagggctaaagagagagccaaaaaaggatctttcgtgtataatcctgcataatctcgaatgttatcagttccggtacgtagaccaaataatacaatgcaagcaaaagttcctagattcatggagatatagaaaagcatataagttatcatgcttgcatatccatcatttgagtctccaacaattattccaataattacatatccgatttgccctatggacgaatatgcaagcatacgtttcatgcttgtttgagtaatagcaaggagattccccaatatcatgctaagaatagctaggatttccagaagaagatgccattcgtttgatgagaaataaaaaggaatatcgagaattcgcgtggctgaagctgaagcagcaactttcgaagtaacagaaagaaaagcaacgactggagtgggggagtcagagtcgaaaagaggattcctcgcttctttctctcatgcaaaaccgtgcatgagactttcatctcgcacggctcctaagtgataaaagaaagaagaacttgtcttctttcttttttgattaccttcctcgcgtatgtataagaccgaatccattctttttcgaaatcgatttcgaaaaagaactactaatccttaacttttcgaggaatccttcatcagtggttgtgaatgactgactttttcaatcctttcgaccttggttccgtaggagcaagtcagaaaggttgagaaatagaaccatctgatttgattcgttcccaatagccatgagatgatcatcttagggtgatccttttgtcaacggatgctcctattacactcgtagtctctgaaggatgagaacccactatgtagcatctacgtcgataattcaagcattgtatacgtcattagtccgattctttgtaggaactacccgtaataacgagcttgcaaaatggatctgtttatcataaagagattcgttgttcctgaccctgcttcaccttaattgttatttgaacaaaaagatcacaataaacttttggtaaaagttctgtcttggtcggagtggggatagcatttctcttctgcatatctatggagttttgcaaaacccaaacacctcagagatagatatagaggtaggaatttgtcgaacgaaccacactccttcgtagacgtcaggagtccattgatgaaaaggggctggggaaagcttgaacccaagtcctacagtgatggatataagcgcaattgaaattcctggggagttatacatttgtgtattgataagaccgttcacaatttcttgaagctcgatctcccccccagatgaaccatatagccaagagaaaccatgaaccagaatagaagagcttgccccacccatgagtaaatatttcatagtagcctcattagaccgtagatctctcttggtatatccagacaataggtaggaacataaactgaaacattctggagctacaaagatagttattaaatcgttagcaccacataaaaacattccccctagagtagctgttaatacgaataacagaaactctgttatagccatttctgtacattcaatgtactctacggatagaggaatacataaagttgaacataataaaataagaaattgaaagatttcgttgaaattgttcgtttggaaatttcccgaaaagctaattataggttcttctctccatcggaacaatagggccgttatgcttattactaaacttgttgaagagatgaaatagaaccaaggtctatctttttgatcagaggttaaatcgatcatcagaagaagaattaggccaaaaattaggatacattctgggaaaatgaaacttccctggaagagaagcaaatgaaacgctttcataaaaattctcgtagaatcgagaatgaagttttcattctgtacatgccagatcatgaattagtaactgcatccaatctccgaaaagtcccgattgtttcgatttttggaatgggatatttacggaatccccatgaataggatcaaaccttattccatgctatttccataagattcctctttcttattcttaagcaagcccccgagagggcttagttgatcatgatttctgttttctctttcttttcctttttgtttgtttcgagaaagatatcgtccgattctccttctattgattcttttccgatcgagatgtatggatccatgtgtctacatacctagattctgttcatggattaacgaaaatgtgcaagagctctatttgcctctgccattctatgagtcgcttcctttttgcgtatggcacccccaccccctttggcagcatctactaattcggaacttaatttgaaagccatatttcgacccggacgcttttgggatgcttctaataaccaacgaatggcaagtgctcttccttgtttagatcctatttcaatcggaactttccgcgtcgatccttttttattacgtcttgtttttactcctatattgggagttactctacgtattgcttgacgtaaaaccaatagtggatttgtttctgtcttttgttgaatctttttcacggctcgatagagaatttgataagccaatgatttttttccgtctttcataatacggttaaccaccatgttaactaatcgattacgaaaaattggatcggattttgcagttcttttttctgcagtacctcgacgtgacatgagcgtgaaagaggttcaagaatccgttttctttttataagggctaaaaacgaatcacttatttttttggctttttgaccccatattgtagggtggatctcgaaagataggaaagatctccctccaagccgtacatacaactttcatcgaatacggctttccacagaattctatagggatctatgagatcgagtatggaattcagtttactcacttaaaattgagtatccgtttccctccttttcccgctaggatcggaaatcctgtattttccatatccataccatcaagtccttaggtttccgaaatagtgtaatggaaaaagaagtgcttcgaatcattgctatttgactcggacctgttctgaaaaagtcgaggtatttcgaattgtttgttgacacggacaaagtaagggaaaacccctgaaagaatttccatattgaccttggacatataagagttccgaatcgaatctctttagaaagaagatcttttgtctcatggtagcctgctccagtccccttacgaaactttcgttattgggttagccatacacttcacatgtttctagcgattcacatggcatcatcaaatgatacaagtcttggataagaatctacaacgcactagaacgcccttgttgacgattctttactgcgacagcatctagggctcctcgaataatgcgatatctcacaccgggtaaatccttaacccttcctcctcttactaatactacagaatgttcttgtaaattatggccaataccaggtatataagcagtgatttcaaatccagaggttaatcgtactctggcaactttacgtaaggcagagttgggttttttggggttgatagtggaaaagtcgacagataagtcacccttcctgtccctctacagaaccgtacatgagattttcacctcatacggctcctcgttcaattctttcgaagggatccttttcctcgttcgagagtctccgcccttcttccactccgtcccgaagactaactaagaccaattgagtcacgttttcatgttctaattgaacactttccatttatgattaaaggagaagattgttcttttaccaaacatatgcggatcaaatcacgtcttataataagaagaaatctttctcggtatcaatccccttgcccctcattctttgagaatcagaaggatccttttcgagtttccatttcttcatttggaatctgggctcttctatcttcgacttattttttttttgctttattctttatttatttcatttcgatttttccctcttcctctatccctatcctctaggtacagcgtttgcatcaatagagaaccttttcctctgtatgaatctatattattccattccaatttcttcccgaaacttcccaagaaaaatcccgaattggatccaaaattgacgggttaatgtgagcttatccatgcggttaggcactcttcaaataggaatccattttctaactggctttcgtgctttggtgagtcgtccgagatcctttcgatgacctatgttgtgttgaagggatatctatatgatccgatcgattgcataagacccgcggtagcaatagaacggggaaagtatacagaaaagacagttcttttcaatttcgattatctatatattagttcgtttctatttctagatatctatttctatatattagtattagttagtagtactattctattagttagcgatcccggctctgtgagttctttcttccgtgatgaactgtcggcaccagtcctccattttttctctgtggaccgaggagaaagggggctcagcaggaagaggattgtaccatgagagaagcacagaggtcaaccctcttcaaatatggaacatggattctggcaatgcaacgtagttgggtcctcatatcgatccgaatgaatcagtctttctacagaggtcaatctttgcctattaggcaagaggatagcaagttcgaaattctgtctcggtaggacatggatttctattactatgaaattcataaatgaaaatgaagtagttaatgggagggctaccattatcctttttcttgtatgtgttcctaagagaaggaatttgtccatttcatgtttcgaggtctcaaaaaagggcgtggaaacagatagaaactcttgaatggaaattgaaaagaaatgtagccccagttccttcggaaatggtaagatctttggcgcaagaagaaggggcgacccatatcatcttgacttggttctgcttcccctctttttttaagaataccgagtcgggttcttctcctaccagtatcgaatagaacatgctgaacaagatcttcttcatggaaacctgctcgatttagatcgggaaaatcgtacagattttatgaaaccatgtgctatggctcgaatccatagtcaatcctattttcgataggaccggttgacaattgaatccaatttttcccattatttgactatccataatagtgtggaaagaaagcccggaggaagggtggccttgagtttctcgcccctttgccttaggattcgttaattctctttctcgaggggacggggaagggatataactcagcggtagagtgtcaccttgacgtggtggaagtcatcagttcgagcctgattatccctaaacccaatgtgagttttttctattttgacttactccccccgccacgatcgaacgggaatggataagaggcttgtgggattgacgtgatagggtagggttggctatactgctggtggcgaactccaggctaataatctgaagcgcatggatacaagttatccttggaaggaaagacaattccgaatccgctttgtctacgaataaggaagctataagtaatgcaactatgaatctcatgg

SEQ ID NO: 31933 - DNA, 771 bp, Oryza sativa
  unsure (1)..(771): unsure at all n locations
tggcccagctgcgccagggaaaagaatagaagaagcatctgactctttcatgcatactccacttggctcgggggnnnnnnnnnnnnnnnnnnnnnntccgctcttgcaattgggtcgttgcgattacgggttggctgtctaattgtccaggcggtaatggtagtatcttgtacctgaaccggtggctcactttttctaagtaatggggaagaggactgaaacatgccactgaaagactctactgagacaaaaagatgggctgtcaaaaaggtagaggaggtaggatgggcagttggtcagatctagtatggatcgtacatggacgatagttggagtcggcggctctcctaggcttccctcatctgggatccctggggaagaggatcaagttggcccttgcgaatagcttgatgcactatctcccttcaaccctttgagcgaaatgtggcaaaaggaaggaaaatccatggaccgaccccattatctccaccccgtaggaactacgagatcaccccaaggacgccttcggcgtccaggggtcacggaccgaccatagaccctgttcaataagtggaacacattagccgtccgctctccggttgggcagtaagggtcggagaagggcaatcactcgttcttaaaaccagcattcttaagtttaagatcaaagagtcgggcggaaaaaggggagagctccccgttcctggttctcctgtagctggattccccggaaccacaagaatccttagaatgggattccaactcagcacc

SEQ ID NO: 31934 - DNA, 174 bp, Oryza sativa
ctgagctcccaagcagtgggaggggaaagtgatctctgaccgcgtgcctgttgaagaatgagccggcgactcataggcagtggcttggttaagggaacggaacccaccggagccgtagcgaaagcgagtcttcatagggcgattgtcactgcttatggacccgaacctgggtga

SEQ ID NO: 31935 - DNA, 484 bp, Oryza sativa
ccctctctcccacttcacacctcggaacgcactgttcttatagagagaaaggggcttttccatcttcttaacccgaattgaaatggctgaggagagggaggttccttttggggggtacccccgggaagagatccagtggagacggggtgggcctgtagctcagaggattagagcacgtggctacgaaccacggtgtcgggggttcgaatccctcctcgcccacagccttccaaaggggaagggcctttactttccccctgagggtaggaaaaccatgatcgggatagcggacgtaaagctattgaacttgggtatgctctttccttttgtcgaagtggaatcgtagaacagaatgtgatacgatgagataaaatgcaatagaaacaaggatagcgaacgggttacctactcctaagggtcaaagcaagccctttaattcaattctttattcttacattaaagaatgaatcaaatctccccaagt

SEQ ID NO: 31936 - DNA, 842 bp, Oryza sativa
  unsure (1)..(842): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgataaaaacggatatacccaatacgtcgaaactcattgcccaagggtagagaaagaccgtttccacatcaaaaacaacaaaaactagcgcaaacatgtaatagcgtattcggaattgtaaccaagccccccccatgggttctatacccgattcataactagaaagcttctctggtccttcacgaaccggagctaaaagtgctgaaatccaaaatgctaaaataggaataaggcttgctattattagaaatgcccaaaaaatatcatattcgtgaagcagaaacataaatgtactcccattaatgtggaataggcggaactgaattagtcaattcaagtcagcattgtcaatttatacagaatttctctcttttcctcggtgaaacaaggatcggtttttctcaaaccaaagggcttagtttagcctttgtttcctctttgccacgtcttctttaaagattcatccaatggaatcccgaccccctttctttttgatttcctttctatttaggtatggtggagacataattcttatagaaacaaaactctctcgcttcactttgtctcattttctctagaatctctagaaaaagg

SEQ ID NO: 31937 - DNA, 724 bp, Oryza sativa
  unsure (1)..(724): unsure at all n locations
attcctgcagcccaataagaccaaagggatggatattaaatgataggaagtgctaggaagtgaaatagaatgaaatagagccactctgggcttacctatgaaatgaggcatggaacggagccactacgaagaaattccgggagttacgaaagaagcttcggactcatattgttcatgggttgagagcgggagttgaactctaggaggtcgaatcccccttgttcctcagnnnnnnnnnnnnnnnnnnnnnnnnnnnnnnnnnnnnnnnnnnnnnnnnnnnnnnnacttggggagatttgattcattctttaatgtaagaataaagaattgaattaaagggcttgctttgacccttaggagtaggtaacccgttcgctatccttgtttctatgcattttatctcatcgtatcacattctgttctacgattccacttcgacaaaaggaaagagcatacccaagttcaatagctttacgtccgctatcccgatcatggttttcctaccctcagggggaaagtaaaggcccttcccctttggaaggctgtgggcgaggagggattcgaacccccgacaccgtggttcgtagccacgtgctctaatcctctgagctacaggcccaccccgtctccactggatctcttcccgggggtaccccccaaaaggaacctccctctcctcagccatttcatttcgggttaagaagatgggaaagcccctttctct

SEQ ID NO: 31938 - DNA, 495 bp, Oryza sativa
ttttggtttgagattttgaaaaaaattggttttttgaaaaccccattccaataaaggttgtaagctgtgttcgggggggagttattgtctatcgttggcctctatggtagaacccgtcggggaggcctgagaggcggtggtttaccctgtggcggatgtcagcggttcgagtccgcttatctccagcccgtgaacttagcggatactatgatagcaccgaattttgccaattcggcagttcgatctatgatttcgcattcatggacgttgataagatccttccatttagtagcaccttaggatggcatagccttaacgttaatggcgaggttcaaaagaggaaaggcttgcggtggatacctaggtacccagagacgaggaagggcgtagcaagcgacgaaatgcttcggggagttgaaaataagcatagatccggagattcccaaataggtcaaccttttgaactgctgctgaatccatgagcaggcaagagac

SEQ ID NO: 31939 - DNA, 401 bp, Oryza sativa
actcggtgaaataaacatgtctgtgaagatgcggactacctgcacctggacagaaagaccctatgaagctttactgttccctgggattggctttgggcctttcctgcgcagcttaggtggaaggcgaagaaggcccccttccgggggggcccgagccatcagtgagataccactctggaagagctcggattctaaccttgtgtcagacccgcgggccaagggacagtctcaggtagacagtttctatggggcgtaggcctcccaaaaggtaacggaggcgtgcaaaggtttcctcgggccagacggacattggtcctcgagtgcaaaggcagaagggagcttgactgcaagactcacccgtcgagcagagacgaaagtcggccttagtgatccgacggtgc

SEQ ID NO: 31940 - DNA, 588 bp, Oryza sativa
  unsure (1)..(588): unsure at all n locations
gatcgagcgcccttgcgctgaagatgaacggggctaagcgatctgccgaagctgtgggatgtcaaaatgcatcggtaggggagcgttccgccttagagggaagcaaccgcgaaagcgggggtcgacgaagcggaagcgagaatgtcggcttgagtaacgaaaaccatggtgagaatcccatgccccgaaaacccaaggtttcctccgcaaggttcgtccacggaggtggagnnnnnnnnnnnnnnntcagggcttagaatcaggccgaagggcgtatccaatggacaccaggtcaatattcctgtactaccccttgttggtacggagggacggaggaggctaggttagccgaaagatggttataggtttaaggacacaaggtgaccctgctttttcagggtaagaaggggtagagaaaatgcctcgagccgaggtccgagtaccaagcgctgcagcgctgaagtatgagccccgtggactagccattgcttctccacgaggctcataccaggcgctacggcgctgaagtatgtaacccatgccatactcccaggaaaagctcgaacgaccttcaacaaaggggtacct

SEQ ID NO: 31941 - DNA, 58 bp, Oryza sativa
aaaaataacaggggtcaaggtcggccagtgagacgatgggggataagcttcatcgtcg

SEQ ID NO: 31942 - DNA, 548 bp, Oryza sativa
gttttaagaacgagtgattgcccttctccgacccttactgcccaaccggagagcggacggctaatgtgttccatttattgaacagggtctatggtcggtccgtgacccatggacgccgaaggcgtccttggggtgatctcgtagttcctacggggtggagataatggggtcggtccatggattttccttccttttgccacatttcgctcaaagggttgaagggagatagtgcatcaagctattcgcaagggccaacttgatcctcttccccagggatcccagatgagggaagcctaggagagccgccgactccaactatcgtccatgtacgatccatactagatctgaccaactgcccatcctacctcctctacctttttgacagcccatctttttgtctcagtagagtctttcagtggcatgtttcagtcctcttccccattacttagaaaaagtgagccaccggttcaggtacaagatactaccattaccgcctggacaattagacagccaacccgtaatcgcaacgacccaattgcaagagcgga

SEQ ID NO: 31943 - DNA, 446 bp, Oryza sativa
agtactcctttggcttttatcacccagtgttgagtcttttacctcccacacttgaaacattgtggggcatcaccatctttcttctcaagaacaaggcatagaggagttcattccatgcatcagggacaccaggcaggcaccagtggctgcaatcctgcctgtgatgagatgcaggccctgaaggactcaggtacaccgagaggtgcccgtctttacgcagagctgtcatctgagtcacattcagtatatccagcccgacaagcttggttgtgatgctgttccccagtacatgatttatgggttcaagcaggtcagcccacggttccagcgatttaattggagttacatctggtagagtttccaagtggcaggtccctccagtcttccagtcaccacctctgtaagaaatatctaatttagttaaagaaatagtttgactgaatatt

SEQ ID NO: 31944 - DNA, 1244 bp, Oryza sativa
acttaaaggaatctgcttcctgttactgaaaataagtctggtagatcaccttgctaagccttgatctgcctatcttactcctgtagccctgttctctgtgttggtaagccttttaacctcatgtactgttttcacggttgtgattttggaacagaaacagttaccaatctcttgtgcgattaaaatatgcctttttgcctgccatggtaagcttatgggcttttccaacatgcaggtgaaggaaatttttgaaccaatttttaatgatcatgctagaaagactgcaaaggtcctactggtaaccgccagtgatcattaagcccagcctttgttatcatccttgaaattgcaaaattggaccgtgaccaatgacttgcatggccacttttttaccatatgcaagcaggtatggaaaatatttacagtatgtagtttattgccgaacatcctatttatggggaccaacccagaactgtgccatgcacctaaccttcccttaactttttccagttgaaaactggtccctaagacttggggtttacttgaaaaggaatttgtagtccccccatattcttttgattgagattggctgcttttcttttactttgacaacttacatttctctggattttcttcagtgttgggctgattaatgtccttgtgaaagactgggagaacataacaacggcaaattttgaggacttcgacactgtgttggttgcagacttgcctccttcagttgacgaatacattgaaatcctcgctggtgcaagctgtcatgtgctgtgggggaagtgcattgcatcttttctagcgctgatgctatgcttgcaaaacccttgtctgaagttcttacaagctgtggtcaggtagtgcctgaatttctcaggaaactggcatcctcatagcaggatcggttttctcatggcaatcatcatatagtatacgctaccatatgcatggttcttccagtcactaaacatttttgtcagtttactgttccttatcatgtaattctcacagcataacgaggatcttcagccttgttgtatctctgcaactttgtattttttgaatgcgatcaagtcctagtctgtgagaaccaattgcttttgcattcattaacattacatggtcaatagtcaagtgcaaactactaagttactggttttattattgtgaaggttgaatcagcttatgattgtcaggcaccgacctgctctcctcttttcaaggggagcaaa

SEQ ID NO: 31945 - DNA, 652 bp, Oryza sativa
aggattacattagctcggtaggcagtagtgagcagggtttacgattccgacaggcccttctgttcaggtactggcggaatacggaatttcgcaaaatccggtgaaaaaccagtaaattctgaacaaatttcataaaccaaaatttgaatacaaattccctaagtttgccgacaagttctcgaaaaccggtcggttttggcgaaattctgatcgaaatcatcgaaatcagtaaatgttttcctttttttatttccggtcggtttttgcccatgtaagtgttttccttttcttgattatttattcttttctttcctgatgtaagtttcagtaaatacatacaatacatcatttttttcgaaaatttatatcccaataggttctatgaatatcatagtatttataaaattttatttgatttttcttttttatcaattcaaattttaatttggatgaaacttctcgaaatctcagacgatttctactttcgagcctcgtcgaaacgtcgaaatttcacgaaatccggtcggttttcgtcggaaccctggtagtgagtacatgcccaaccaaatgctactattcagcccctttgtagtgagtgcagtttaaactacgtcaagtgaaaaatactacactctccttaactatgagagga

SEQ ID NO: 31946 - DNA, 528 bp, Oryza sativa
tcataagcatttaaggcatcggacaaattttgagtaaggtgctccaaaaggaaaaatatataacattttacttaattccataaaggacaaattttgagtaaggtgctccaaaaggaaaaatatacaacattttacttaattccataaaggaaggcctcaaattcaaatacataaggagatacatatcactattctgaaatgagttccttacctccttgtcctcatcagatagggtaggtaagtcgatgtgaatctgcgagcaatgcaatgtgaaaagcgacccagccagagttgctgtgttttttatcacacagaccacatcatttcctttaatttgagaaacctaaaccagacaaattagagttttggtatcggaaaatgtgggcacaaagcaaatcctactgacattgacataagaaaaaaaaatgcagaacgctaagcgcagtatgccgaatatttttacctctaacccaactgaagtagtctcactgcctgtgaacaagtattgcccaacaaatattgtgtcac

SEQ ID NO: 31947 - DNA, 551 bp, Oryza sativa
ttttggtagacaaaaactagaaataaaaaagacagaaaaagactatccttgaagtttttggagatatttgacttggcagatgtggagtatggatcaattgatagccctctttgcttgatataagtactcacaaggagccaaaactcgccgcccaaagtttaatagtagtaatactaatagggtgattaccgataaggctttcatgattaaattaggcatgatggtggtattttatcctaacacaaggaaggggggaattctgatctcaaacttttttgcaagcctattgtagatttaaaagaaaacaggacgagaggaagcagctagcacacctctgttgtttacaacttttaatatgctaaagaagtgaaaacaatacgggaaccaaaattataaagctgccagataatatttaaggtgaaaacaaccagagaattcagacctagagtaccatcatatgatgctttttctaacctttcacatgaccttcaagcacccttccaagccaacaagctcccccacttggctgaggtctggggacaatacaaaaa

SEQ ID NO: 31948 - DNA, 310 bp, Oryza sativa
aataaatgcacagttgaaataaatagagaatttaaatataggatcaacatgctcaaagcattgtgtttaggatctgtgtgacttgcctgcaataatcagtctttgaataaatcttctgaacacttccgatgcactcacgaaccttcgcaacgacggaaacggcaagctaacacgcaaaacaaagaaaaagaataataaaaaccaaataatcagtacatataaagtaaacaaacatgtagatcatgattttagatgaatttagcaactggaaccactcaattccgagttacgatgaattagttatgaattt

SEQ ID NO: 31949 - DNA, 503 bp, Oryza sativa
aaatagtctcgactgggtataaaccacgcagagtctcagcaccaaggagaatggcatcactccctaaacaatagaagtatgttaaactatcagaaggcaattgaaaatttaacattaccaatagctcaaacaactcaccgtcaagcactgcatttgccacatccgtagcctctgcacaagtaggcctgaggttgtcagtcatactgtctacaacacgagtaacaacagcaggctttccagccatgttgcacttgtgcaaagcaaacttttgaaataaaaacacctacagtatgaccagcaaaggtcaaagagcaaaataaataaggtttacctaacccaaagacaagtattgcaccataatttgaaaaaactacaattcttgttaataaggtactaagtgtagcggatgtacaattaagcagggccttctgatgggctcgacgtaagctaaaaatactaaccttttcaggtggaagatcaattccaaggtttcctcttgacag

SEQ ID NO: 31950 - DNA, 724 bp, Oryza sativa
tctcgtgtcttctgtgattgatctcttgttatttatcgtttatttgcctatcgcttcctaacaacctgaaaatataagttctaactgaaattggtctcaacatattctggaactgcagatgctgcacaagacgcatgcccatccaaaatacccttctttcttttcaggattcaaaatgcatcatgtacaaacatactaactagtgcaagtctattttcactgtttcagttctgttccggtgaccttattaaacctgatacgtcttcactaatgaattacatggtaaatttacattaaaatgatcagctgccctacacttatacactaaaatgcaggagcatcaattacagaataaatgcgtgtcataatgccaattgtagggattgaaggaccaaatcagcaaagggaatctgatgctacctctgcttacatatcccaggctcatccaattcagttgcatcttatcgacattccatcctataactactataataatctgtgaattcatcgcgttttccaccacctgacaccaattttttagcttttgcataaagctctcttccagctttccacaggtagttcaacccaacaagcagctcaactatggcagcctcgctctttttctggtcagcaaaatgcaacgtctgcaggagcagcacacctgtaccgctcgacgcaacatttttctgctcgaaattcctctccgattgccatcgcagcatgt

SEQ ID NO: 31951 - DNA, 134 bp, Oryza sativa
tactcacaattagaaaattttgaaaaatttgagtgattgtgtgcatttgaaaccatggtgcccgggcaccatggtgccccatatgagtgtcctatatatatatatatatatatatatatatatatatatatata

SEQ ID NO: 31952 - DNA, 699 bp, Oryza sativa
  unsure (1)..(699): unsure at all n locations
atattttttttcttttatcaagatgtaaacatactaaggtaaaatgaaattttaccacttgatcatgagcgtcacatgcatgaatcttctgaattttgttaccagatatgttccacgaccatgcttctagtgacccagatgctcttccaattgccagattaactgagtcttgatgctgagctggtgcagataatgagattgacgagactggtgctaatgaatcagtagtgacctgacagtacaacgtttggagcagtatatttaataacagaaaggcattagctggaactagaaagtgcaagatgggcatttcaatctattatattattaagatagctttgaaaggaggcatcacgttcgctgtgggggctagaaattcccacattaatcggagaaaaagagaaaaatattaaccgttgtattgtgatatgactagattttaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 31953 - DNA, 8242 bp, Oryza sativa
  unsure (1)..(8242): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccttccaaataggaccagcagctgtgtgtgtatgctaacctggtggtgattttgcagcctgacatcaccgcgccaggagtcagcgtcatcgcggcttacagcgaggcggtttcgccgacggaactctctttcgacgaccgccgtgtcccctacaacataatgtccggcacctccatgtcgtgccctcacgtgtcgggcatcgtcggcctgatcaagaccaagtaccccgactggacccccgcgatgatcaagtcggcgatcatgaccacaggtgagcgagaaatgcagatcgcgatcaatcgagccagcgcaaacatcacataaactctgatcgatctcacgtccttaatatgcctgtgcattgcagcgatcaccggggacaacgacagcggcaagatccgggacgagaccggcgcggccgcgacgccgttcgcctacgggtcggggcacgtgaggtccgtgcaggcgctggacccgggcctcgtgtacgacaccacgtcggccgactacgccgacttcctctgcgccctgaggcccacccagaaccctctcccgctcccggtgttcggcgacgacggcaagccgcgcgcgtgcagccagggcgcgcagtacggccgccccgaggacctcaactacccgtccatcgccgtgccgtgcctgtccggctccgcgacggtgcggcgccgggtgaagaacgtcggcgcggcgccgtgccggtacgcggtcagcgtcaccgaggcgctggcgggggtgaaggtcacggtgtatccgcccgagctcagcttcgagtcctacggggaggagagggagttcacggtgaggctggaggtgcaagacgccgcggcggccgccaactacgtgttcggaagcatcgagtggtcggaggagtcggagtcggacccggaccggaagcatcgcgtgcggagccccatcgttgccaagacgacctgcgggtagcacggacggggtcgattcttttcgagtcagaactggaaactgaataactgttggtgttgtcacgccaaggtccacaagtcgttagggctaactgcctaaatcctaatggcaggagacttggttagagaggagaggatcgatttcgttttatctggcagatagatgtgagctatcgaatccagatatttgttctgattccgacggtcaagttgtttttgtgctactcgaatagtgtaatgcatcaatcttcatcttgttacgataattatatacttctcgtcgggccggcgaagcgccggccgaaatatataattacgataattatatacttgttcgttcttttctgccagagatgtgtcgctacatttctccatggaaatcagtcaaactttgaactgtataatttatactgtgttttatgctgtagtgttgcttggtttctcttttttgcctcttcacggaggagtgtaatttattttcctaccataaactgtgacgaacacatgcaacccctgaagctagtgatacatgctgacgtcttatttgatatgccataaatattaaagtgtaaatgagaaatttaaaggtgtaagatttgaataatttaaaatcgactgctttttagtacaaatgggctgtttggttaggtgccacatattgccacacaacatgttaggcatgccacagattgttagcttagcgtttggttacttgcttcagttgtggcaagccacactttcttgttccatggatatacatgtcatatacttattttctagccaaacattgtcacacttgtggctaacaaattgttggccacactatatttgccgtgccatacctatgataaattaagttgtggcaatgttaggcaacaaccaaacagacccaaaaattgtagcgctatgatatagtactcccatactttcttctagtttcggctgggactatttggtgggattcgtggcccaatctcgcgcgatggaaggattgtttttttttttttttgaacttgatggaaggattgttaggagttaagaagaaatggaaactatggaacgattggaaaaggaaacgatggaacgattggcccagactcccattcgaaagctggcaactgggccggcctaaatcacggaaaaccaattgggcctccgaacatacaacaatgggcggaaggcggcttgagggctgaggcgacatagggcggaggaggacagcacgcgctccgctcgcccgccgccccacgccccccgcacgccgcggcccttcgctcggctgccggttgctgccgcgcccctccgctcgtccgctccactccgcgtcgcagcaccggggtgggagccggcgcggcgagtccggccggcctcggggaagcgctgccgcgctcttcccgactccggcgactgcaacggctgctccacctccgcctaacgtttcccatcgtcagcctcctccctcttatactcctgcagttttagctctccgccactattcattcctttcctttcctagggcttagctgaaatttctccgtagcgaagaggaattgggtggtgggggattaaacccgatccatctgcagtgaggattttcccccatgtgtcaaacaagcatgctgtggacttacatataggatgatagaacttagacgaggtgcaggtgcagtcagtggctcaactgaacccccttgtcccgcgttaatttccgcctggttttgttgtgagtgccatggcttcgcattaccaggctgccaccttgatcgcgtcgccgtcgtacccaaatgcaatcgcttggtcgactgagaacctggtggctgttgcctctggtcaccttatcactatcctggtatgtgtggtttcattgcattagtgtattcgaaccatgttgtcctcctcaggagttatgactgttcatcttgtgtttttgattctagaacccatctgcactggaggggcctcgggaactggttgttcttcgtcctagcgacccatttcccataggagtggttaacagagaaggtacggtttccagtgaaacacatgaatttgtgctgcattccttttgcttttcacgtgttatcagtttagacggataatatgattgccgaagtggagtggaagagatgctcggtgttaagtttctttatgttagcactgcatagtaagaaaaaatgattgggacagcttgagtttagcagttactttagagttctgtcaacaacttaaatgttatgggtggctgttgtgcttgagatcacggtggacaactccaaatgatgataaatatcatcaatatgtacactttgctttctttaaaaattattaagcaatgccttaggctaattgcatgtgaagatgcaattcaacaatatgcatccagaagttacgctttcttaaacatcaattcagcagtgtggatttgagttcctacaaaaataaaattgtaattttaatatgtaattatcttgattacatgaaatttttggcagtcaacttctcttgtgacaaactgaaaagtaacactggacatcgatagaaggtgcgcaccaggaatcagtttttattgcttattttgcagatctctttgaaccatgtataatgcccacttccttagcacgtgaaactgaattatgcgctcgatctatttcatggtctcaacaagggttttctcctaactccgggtatgtctttttttaagtcgtttcatcacatcatttttgtctctctctagatttattcttcagcactactaggttcatttgcttatctggcctctgtacttttttttccctatatggattcagttgtctgttggctgtttgtactgttgatggtcatgtaaagctttatcggtcaccattttgtgaattctgtgatgaatgggttgaggtaagcatgttcacctaatgtattattaatttagtttattgactaacttaatttgtataaacattgatagctgggcagcttgattggcctgccaaattcctgttatgcaacagtaatttgttccatgtaggtccaatttgccatgtcccatgcaaccatgcagccccctacattattttttcactatctaagaatttgaaaacatattggacaggcaatgcagttaaaataagcttaacaatcactgcaccacctagtagacattcaaccgtttgttcagtactacttctgacttcgattacagacaaaagaagatattctttttggcagttttgtttgtatttctctgtgtttttcttgctgtttgtcatgtcccttccttttccttttgccattagataaaatatttattttcattcaccacttgtaatcatttgaacctatcagttacatatgcttaggatatctcagggtgtatgtgttctttagttttctcatattctgcctgtcaacttaaatctattggtctaggttgcagatatatctcgattgctgtttaagttttacaaaggtatagaatttggggaaaatgatggtcctagttcacttcctcaggtattctcccatccatccactctatcaccagtgtctccctttcattggttgcctcagaaaattttttttttgtgaggcagaaatatatgttattgagttaacttacagaaagtttgtcttctgtgtcaggaaaaagaaaatactgaacaaaaccagcaagtcatgtgtattggtaaactgcaagagcctcttctgagcatgggtacagaacggagaaaaaggaaaccagcaaggtgagtcacactcttctgtttgctggccatcaaagtttaagataacaagatggtccaaaggggttagttcaagaaataagatgatgggttctatgcttacaatttgatgtatgataatgagtgcctagagtcgttcaaaaaaagataatgagtgcctagaagtataaaatgtatttaccagagaaagatctatgcttaacactggcagactggcctagtgcacttacttggtttctctggtggtacattgtcaatgggtaaatattctgcatgtgctatttgaatcaggtttaattttagccagggaaaattgaagataatctccaacaaactgaaaatggcaatgatagcaactcagtttcccctttcctgacagtctttgacttagacgagcagacaaatgtgtcaaggattgcaaaaaggccattttattttctatcattaggtggcgagaggctgcttataatgtggttgtataaagtaattcttttttcgtttggcacgacacacttgccatgtgtggttttggaataagattgataatttagaggctcttgtttgctaatttttacagttgaagtactgaattactgacgattactggtagaaaaactgtagtaagtatttgctatgggttgttgctaagcttattataggatgccaattgttcatatgtcaacctatccgccactgattaatgccttccttttcgcactaactttattttgcaagaagctatttttggcctataatcgtatgttaggtctgaattattttgtttcattttttagatttgaaggttttgtttatcatgaggataatggtggcgtagatgctccaatggatgcggactttttattggatccaatctctaatttaaagaaaaaaacattgaagaagcgcagtgtagatgctccaaaggatgtggactttatatcggatccatctaatttaaagaaaaaaacatcggagaaggacgatgtagatgatccaaaggatgcagacttttcattggatccaatctctaatttaaagaaaaatacactgaagaaggtaggatttacatgttcacatttaggttaaagtccccagtgtatgcccattagttgttaacattaaaagctaaaccttgtttcataactaaggagagaactatttgtgctgttaaatcacactcgcacatagcctattttatatgatttttttttctttggcatcctgtatcttttacctggttgtgattgtaggtcacgagacctggacttgacgatgctgtcagaaatggtcagggcaacactcaaaatattcagacaccatcatactgcaatggagaagacaaatctctcccacttattacggcaaaacagtattcatgtcgtgaagcacttttgtcttctctcgtagttgcatggtctccagttctaccatcacctgacagaagttcttatttcacgggacattggtgcattcttgctgttggttgcaagtctgggagtgtttccttttggaaaatacacaaacctgaatactacacaatagacatcggcatggttactagagatccaatgctgatcggggttgttcaagctcatttatcatgggtcactgccataagttgggaacttttttcctcaggctcttcaaaacctttgttgcttttggcaactggatgctcagatggaaggtcagtacaacttccgtcaccactgtaaaggattttacatttttgtcatactatgtgacagctaactcttgaatttgctcttccatggttccatctctctctctttctctctctctctcgacaatttaagcataaaccactaaaattgtgatgcttccttaatcctcccaaatacctgttttactcaaaacctttcaaattcgttttctggggttttttcagctcaaagatatggctgggtgatattgaagggttaaatcaatgtacatgcgcaaaagaagtgcccttgacattagtggctgaggtacataattaccattaccctgtgttgtctattgatatacatatttgattcgatatatgactaatatccaatattctattaataaaactagctgggtaacccgcgcaattgcgcaggtatctagttgtcttaagattttgaaaaccaaaccttattgtccccttgtttctatattatttttatagttttttaaaatcacaccagttgccacccttacttgtgtcatccccttctttatttgcttgctcgatctaccactatttctattcattctctcagaacctttaaaaattaagccttataatttctagagtttattgtctcattggttccatttttataattttagaagtcccgttaaatgctgccattatactattctgcggcccgtccgttgcctccgcttttattgtcattgggatttttaaaaatcaaacataattattggttggggttattttttttactttatagaagtccagccaaaccgccagcgggtatgtcacagtactcctttacgg

SEQ ID NO: 31954 - DNA, 1450 bp, Oryza sativa
tttatttttataatttttaaagtcccgtcaaatactgacactatactcctccgcagcctgtccgctgctttctctctttattgtcacattgggatattaaaaatagaacataattatcatttggattcttttacattctagaaattctgtcaaaccataagtgactttgccactataatactttcctttacggctcgcctacagcctcccctctttattgtcgttaagattttaaaatcaaacatggttatcattgggtttattttttaccttttagaagtcccgccaacagtcgtgatcatgttgtttaacggtatgtccgtcatctctccttttaatattcagtaggattctatttggggttttattaatagtttttagatgtcccattaaccgtcaccactctacttctttacaaacatgttacttctcccatatttattgacatttgtcatctgtgttctagattttatttttttaaaaaaattccatatttttcattccgatattttttatttacaacattatactcctatttgaactcttataattatttttctattttcagaatttattttatttgttatttggaattttaattaatcttgtcatgtgttctagatgtctcttcttccaatagtatttattttttattacgaattttagttatttataaattgtatttctagttgaattcttatttttcgttttgtcatttcagaaattattttttattttgaattttaatttaatcttgcattgtgatatatatggactattctccgattgatatggaaatttctaatccccacaacgtttgtctgtgttaattaaaccgacggaccatgataaaaaacgaaatccttgcgtatttttttattaggtatagatataggttttagaacggaacaacatgtgtccaaagtgaggactaatagtagtactcggattgtttgctttgctgtatgcatatactatcgtttatgtttttctctgcagcatgcaaactctctctgttggtatgtgtttctgacacccagtgtggaaagtgctacttctaaatagagttatgccagagtttagttggcttaagaataaacactaataagagtctgattattagaggtgactgcttatttttctttgatatttagctgggaattaggcagtcatccatgggaatcggacacaaattcgtacttatgtagctaaagctagttttctatttttgtgtttgtttccaacacttacatatggtaatatgcaaattatatcagattccaaataacaaaacaaatcaagtcaaacttacatatggactgtcattaaatctctaccattaaaatctagtcatatcacaatacaacggttaatatttttctctttttctccgattaatgtgggaatttctagcccccacagcgaacgtgatgcctcctttcaaagctat

SEQ ID NO: 31955 - DNA, 11447 bp, Oryza sativa
ttcaacgaaaaacatctagaagaaattcctctgcacacagatggtccggagctgaaagagtccgtagatgtaaaacatatactcaataaccctttatcctgaacatgcaagttttttcttctggttgacatctgaaatgtgcatgcagctcacagaagtatccgatcgatgttatggccttgcactagcacctggagaactaatgattgctgtggtatgctttaggctatctcttatatctgacgcatattgcttaactgtgcaacatttgtacttgagctttcatatataataagctaaaacaatttatgaatgttatctccttcaggtgcgcagcttggactcaaacttgttaaatcagatgtatcaggccaggtaattttgtttgggagttcggtatgggaagtagtgaggtctgcttggatctaattaatgatttcttttatctaacatttagaaaatccactgtcatcacaataattttgtgaataaaaacaacaggacacaaaaggcagtggttgagttcatttggattggtggtcagttccttggtattccattggacaatagcgttatcctcagtcttcagtctgccgccttatctgagactaatttcttgtggtggggatccaacattttttggtcactgaagaaatatgagaattgtgaaacagtgcttgtcttatgggatctcattgctgcactacaagggtttaagaaatctgcacctacctttcttgagacattgatgcataaatgggtgtcaggtttgttttcagatgatccacattgtgcttctatcgacatcccatcacattcaattcacaacatgtccaaagtcagctcgcggaagttgcacttgctgaatatcgtatgtaggaaagtaatgcttagtgatcaaccgcagtattctcctggtgcagaaaaaggtaatgatgtaatggctgatttgtggaacaatcttctggtaagaagtgaaagggagctgcaagagaggcttgtggctttcacttttgctgctgtcctcaaccgaacagcatatttgctcaagggtgcccctgctgaaaacagctggtttcctgttggagttgcccagatggactcttgggcatccatgaacgatggagaagtgagggatgagctcaaatttcttagaacgaggatcaatgatctaggagacaggtaaaccatttttctaacatcatttcacttgtgaaacggcatagagcatatgccacatgatagttcagtagaattgccttgaaatggcttcactgaaagtaaaattggatgttgaacctgttcagtaactgttttgcgccatgcaggatcaactcagtgtgcgagtactcagttgaagaatactgcacctactgcaatgcaccagtccccttcgagtccgcagatgttgccatgtgcagtggtagcaatcctgctactcccccagctgaagctcacaaattgtcaagatgcacagcgtcgatgcggctgtgccctgttcttcaaccaacatggcactgcgcgtgttgcgggaggacggtcgacaagctgctgccggaaatattcttcaccatgcccacatcattttgggatgtcactcatggtaacgaatcgcttgatttatcagcgccggccgtcccattttgccccttctgcggcatactgctgcagaggataaagccggagttccttctctctgtctcaccggtatagaagctagtgacactaggcagcttccagctgtaagttgtaatactgaatacgtcactaatgcactttgaatttgttgttggtggggggctgcttctaaaaacatgtgcttaaaataagcatggctggtttgcgctaggtgtggtggtgccatcataatgtaacaacccgtgtaacatgtgacatctgtaactcttggcaataaagcgggcaatatatactacttgatgtgagaatatgagatacagggtgtagagcataatgtggcaggccagatgttgtttgctgcatgtacacatgacccacaccagggaggctggaaagagcaaacagacagacaccgatgcttcccttgcaggttgcagccaacgggagcagcctcgaaagcgaagcacttgcgagagattgtggaggacgaggcagtgggtggggtccgacccaggaacctttcccggatttgaccacatgatcgatcgcatcaactgactcccatcatctccgggctcaactcctccctcctggccaggtcagatgatgaccactctcctcggcatttccgattcttgactggcttgttctctctctctcccagtaaccgatcttctcgtcgggctccgacgatcagttgcagcacgatccaggaagaggcggcgtaagccatggtggtggacagcgcgtactacgacgtcttgggggtcagcacagacgcctccgcggcagagatcaagaaggcgtattacctcaaggtgcgtggttcttggcccgagatcgagaacgctggcatatttgtttttcttgtgtttttttttctttcgtgcaatgtttgttgttgggttcatggtttcagctgttcttgcaatgtttgggtttctgtaggccaagttggtgcaccctgacaagaatcccaataaccctgatgcggagcggaggttcaaggtagattttcgcttctgttttgcgctgtgtgcgtcacagttcgatgttctaggaaaggaaacagtataggtaatggctttagacgataagacgactgaaccaaagagatggtggtagctctggtcacttctgttctcttgtgaacttttctgttctaccttttttttttcgagggaaacctccgaaaagggcaggcatgagctcatgcgattcactattagaagagagttatccagtttataaacaaaaattggacacaaaaatcttacaacggttaattagggaaaccggtgaaaactcttaatgccttatgttggtgcattcttaatgtcagtaggtagggatgcaaaccggccaacccgtgaacctactaatatgttaaataaaaggtaatccgtgggtattcatgtcatggctcggcttgccgcgtcgtaaagatataagtggatcaatccataaagctatttataggtcaaattagtaggtaacccgcgggttactcactaacagtggcggaggcagtgtgggggctggggttctttagaccccccctaaaatttaaatccatatatctattgcaagggggctaaaataaactttgtctgagattgttataaggctcaaaagactaaggagcccccactatattttatcctggctccgccactgctcactaattttgcctataagcgggttcatgggtcggcccgcttgcatccctatcagtaggccttattaattcacccactacctttataggaggattactaactaaaattggttacttctgcaaggaactgggtgaggcctatcaaatactcagtgatcctgtaagaaaggattcttatgacaagcatggaaaagaaggccttccacagtaagtcttgaatatttctgtcactattctatcaacctagatagaaattaagctccaaattctttgtttctatagaattggatcggccaaattgtaaaacaaaattcaattgcacaagcgatttgaagttttagctgcatgctgcatgtacattgtattagttattatcaacataaagctattgaacttttaaaatggcttttttagggataacatgattgatccaactgctgtctttggaatgctttttgggagcgactattttgaagattatgttggtcagtttgcactggcatctgtagcttcagtagagattgaggaagaatcagataatacagaggcaagggcaaggattcaagataagataaaagtatgatgctccagtaatgctctgtaaattgcacaacagatgttatctagtagtgctcccagccttctagtatccatctcctcaaggttggcagttcataattcatgcttaggccttaataatatctctggattacaggagttgcaaaccgaaagagagcaaaagcttgttcaaagccttaaggatcgacttcaaccatatgttgatggaatgcaggatgaatttggtgattgggcaggtgctgaagctcagcgtctttctcaagcgggtattgccctccatcttcatactcatttgcactgttgtattttttgataagcatggacatttcattcaacttttgctgctgtatgtacagtatatacactcataccactgaattttctattatgccttatactgaattgctgattgcatttgttttaattccttggtgtctgttatgaattgatttttcagctttcggtgaggctatgctccacactattggctacatttatgctcgtcaagcagcaagagagcttggaaaaagcaaaatgtatatgggtgtgccgttcatagctgaatgggtaagagataagggccaccacgtaaagtcacaggttaatgcggccgcaggtacatcataggatgctgtactaccttttcctacatcacctataatacttcttaatgagtctgaccctcggtgttctacatccctcttttgttaaagatgagtctgatcttttactgtaggtgcaatttctctgatacagctacaagaaggtataaaaaagattgagggcgacgacaaggaaggccagcttatgaagagtattgaggagaaaaaagacgcaatgttgaattctctgtggaaaatcaatgtagtcgatattgaatcaacgctttctcgtgtttgccaagcagtaagcattgtccacctcagtttttacctcatgttttgcagtactgtaccgatatgcttgaattttgagatatcttagaaataacatacaaatatggatgatcgtggcaaccattttgacttcaggttttgagggagaatactgtttccaaagatgttctgaaggtgcgagctagaggactgaaaaagctggggacaatattccaagtaagttttgcttcatctttctatcttctccagctactatggtaggtcaaaggaggattgctctaatcaccaggacttgataccgatcattctggcaaatcttgtttgcaaaccgtaaaacattgaagtttgtgttgaaactaatttggaacaaatatgtttccgtggcctgtttctgtggagaaattttgtaaagccgttgtaaatcgtcacagaggtggcaatttatataggaaactagttcagagaactactcggagtttttgtttggagggtgagagatgatgattggcatatgtaacatgtcggaggttacgaactatatgaatggtttcatacgcgtcttctctcttttcttgatgtccttttctattttgcttacctttcagactcagtgcgcgttctgctttcatgtagtcttttgtatcttcatgtcaagcactcaagctaattgctaatgctatattgccatgttgatttgaaaaacatcctcgtatttttccattggttaaccaggttgcaaaatcataatgagatttggatcccgttttccatgtgaaaccagggtgcaaaatcgcattgccggcgcgagaacagcctgcgtgttgaggctcgcgatgcagaagcaacaccgtcggattgatcaggactcaggagcagcacggcagcatcgctacaagggacaccactccgccgaggcttcattttgtgattctttttgcttttctgtaggagcatttgatattcgttgcgtccagcattccagcaaagatgttacgatgtggatagtgtgttgcaagaccgatgtttggtccatgtagccacgcaatattcttcgatattttcgagcctttgatgctttagaggtaatttggatagttataatcaggtcttgagatcttcgatggctatctgcccgggcaaagtgtacccttttactgttcacccggaaccttccagagatcaggccgcaacgtggcgcgcccggcgcttacgtgcccttctccggtcacgcgcgccgtccttacgagggcacacgtggcttgcctgcagggctgcagataccgcctgtcgcctcctgtttcctcgtacaaatacgagtccgcttccgcttcatcatcatccaatttcccatcagctcgatcgctcgtatcactcatggctcaaagagggtaaccgagttagaaactgaggaggaagcaactcgacgacaccaaccaatggcggagcacgccacgggagtgtacgggcacccgtacccgcgcgtcgaccagtacgggaaccctgtgccgccggtcgaccagtacggcaaccccgtcccggacgagccggcgccgcgcgacacggccgcggggtacgtggcgccgccggaccccgcggtgtcgactggcgactacggcctcgccggcgcggaggcgccgcacccgcacgagagcgcggtgatgagcggcgcagccgccgctgccgtcgcaccaggaggcgaggcgtacacgcgcgacggcggcggcgtagttcccccggccggcgagaagacgttcgcctacgagggcacggtcagcgccgccggcgtcacgggcgcctccgggcagctccagcccaccaccagggaggaggggcacacgacgctcggcgagacgttgcgccgctccggcaaatccagctccagctccagctcggtaacttctctttctagtcgttgtgttcttgattaattttgtcgatgggctgactgacttgatgagcgcgtgcccagtcgtcggaggatgacgggcaaggtgggcggaggaagaagaagagcatcaaggagaagataaaggagaagcttcccggcagccacaagcaggaggagcagaagcaagctggccacacggctccggcggccgggacggggacggggacggggacgcatgcagcggggaagcacgagaagaagggcatcgtggagaagatcaaggagaagctccccggccacggccaccactgagcgagagctcgcgcgcacgcactttcatcggttgacgttcgtgcaactgtccatgcatgtatgtataataccagtcgtgtttcagttcgttaattttacggtcgatgtgtggtctcggtaaaactaggtggtgtacagtgcgtctatgcatgtacggtgtatccaataatccagagtcagatctcttttaattatcctttataacgagtcacgagtgctttacgtttcgcaccaaaaaattgtcacctggcgaatcgaattcctctgagacaaccgtgcgcataactgatgatggtgtgagacaaaacgaatgtactatatgatacgtttaggcaggaccgccgattgatcggttttggtcgatcccgacgcttcacaccatggacggtcactgcgtcaagtggtcaagccgaaacaggagccgcggcggtggcgcggtgcgacggacgggaggcgaatcaaaacaactactggccgcagccgcagcccgcaagtcggagtcaagacgaactggtgggccgtaaactgaacaaccaaacaaaccgccaggaacgaaacacagagtgcgccaaccacattgcgcgcgcaacaagagactgagcggccccggcccaggagaatttgacacggcattcactcacaacttcacgccttccgctgtttcccagcgttggctttcggtagacaagtagtggctttccgtgatccgcgtcgtccatggcgacctctgtccggtggacggcaacatcgttctcggtcacagggtaagctcatgcagaccactcatggacaggttaatacccggcgtcaggcgtgcaaggaccaaggagtaatggagtatacagcgatgcactgaccgcagtatgcaatgccacaagtgtgtacggtcaaatgtttgtcacggaacgttgtcatgtttttgtgttggtactcactcccgtaaggagtacatgagccggccatgagtgtaggtgggaacacctaatttgcctcgtcttataccgtatttgttttgactgacgtgcgttaggtcgcgagaatctatccctggaaatccgttgtgtggaatttattttagagaagtatctcattctcaatatttgcttggtttacgtagagcatggaggacgcgagtggagcacacggaattaatgtgctgtaaagtatgtgaatcagaagcagcatacagttgagttacacttgatagtaatccctccgtgctcgtactcgtaaaggaagttgttttgaacagcgatacggtctccaaaacatactttgacttcttatttctataaaaatatttatttaaaagtgatatatgtatatttttatgaaaggattttcacgacaaatctattcatataatatttatattttccaacttaacaactccagagttattcataatttatattcccaaggtttaacttaaacattgtcctataaatataaatataagaccccctataaagggattgatcgaatcacaattcataaccagagccacattgagagataatccaaagaaaaccaaagcctagttgtcgtattctactcatctagacgtactcgatggattctatttggcatgttagagtagcctacagatcaccggttgtaacatgtgcgatatctttcccagtaatacatataaactagagtagggttattactcatctcaatgacccgaaccagtataaatcattgtcccttgttctcttaatatgatatcgtgtatattctagtaccaacgacccctatactctagtacggataccattgttgtatagcccctcgagataacaaaaaatagtacaaaaatttccacctttcaaccaggagaacatgccactagtttgtcttcgatccgtagcggctatggtgcagacggctaccggaactatggccgatgcaacggcgtgccccggcagccagctacgatcaagccgatagccagggcgcgcggtgcggttgcgcgcgacgtgacgatcaggattgcgaccgacgttgtggccaacgcggtgacacaacagtcaactttacggtccacttggtacccacaacgcgtggtccgattacacttagcatgttggctaggacggcagccggcgctacggccagcgcgtgcagtgcaactactcaacaacgacgggacggttcagcggcagtgcggcaacacagcgactgtcttggcttttggtgtcccggtagcttgtggcctatagcctcatcggccaccacctccataggccgcacccccccccctcccccaccgtcactgtcacctcagccagccgttgcacccaccccactcgtgcctccgccctttgggattgagctgagccaaatagccaagaaacccactttcatgtttggttagaataaaggacaaatttctaccatctaacaatatagattatacgtttctttaggggaaaatacttttttttcataggaatttaacgatcaagtaatgaaaagggtatggaagagattcgaattaaatttaaatttaaggatatatatggaaataagaaaaaacagggatatatggaaaaggaattaggtaaatatacacgcgtatggattttgtagtcgaataccaatccaacgcaaagattcgcgagcgcgcacgtgtttgcctcgtggcggcggaggcaaggatccaatccaagggccaccagcccagagcccagcgccccagatacgtcgccctgctacatagccgccgctgttccggttcaatccccaacagcatcacaccaatcagatcgacaatcgccgccccaccccccggccaccccacagcacggagcccttgccagtgccacctccagtgcagcttctgttcaaggaccatccccgaccacgtcgcggcaacgacaacgccgtacgcgcggcggcctctatcgtccctcccgctgctgcgcgccagggctgcgcttcaatgcgccacaggggcagcatgcatatccgtcggccgccgcgacgccatctttattcccccgttctctcgtcgcgcgcgcgcacttgttcactgtgatacgtcgcaccgtgctgttcactgttcagtcgtcgtgatcaatcaatcgatcggtcgaccccagcaagtggacgctacggtgcacgtagcgcatgcaggcgcgtatacgttatgcgagatctcgccgaactgtgcccccatttatgagtcaggtccactcgctgtctggtccttttttttctgactgctgatcagccggtgcaagacgccaagacggatcagacgtgatcagatcgatcggatgtttgcagggttcgaagctgggccaccagaaaggggggaaaaaatcgaggccgccaacgtgctgcgcacaagaaacggcggataagttttgtaagttttgcctgagccgcatgcaggtaggtgtgcaaaagcttgatcgaaggttcaaatcggatcgaactcattcatagtcataacgagctaaaccatgttagaattatagttcgtgaaattaacgagtcagatcgtgtctagctcacttgtaataaaaaaaacgtaaaatacgtaggtgatactacatacaacttataagatacacgaaatttagtcagtcatctcgtaaaattctcaaacaagttttagtcaaaaaaaaattctcaaacaaatcactcatcttgttttttttttcaaatcacataagcacagtggtggagtcaggataaaattatagcggggctaaactaaagtggaaaataaaaattgaaatatgtctcatataaattggctatatttctaatacaaaatataaatatatggattagaattttataaggtattatgggggctctaatggtacattagggtagagagtctaaagaccccagcccccaagttgtcactgccgctgcataagtacatgtgtcaagttcgctattaaattggatacatgttgatttatttttgtaagcatgaccacactcaatgaaaaaacaagccaacttcaatatgattgatactaaaatccaatttaagatgattttgttattgcttgctaagtttattgaaagcatacaagtagcaactaacataaatgaaaatacgggtgctaatatttaattttattgcttgcctataaacatgtcaacttgtcctgcccatatcactactagaaaaagtatttttactaacgtgagggccttatttttgcaggctgatatgacccttagagccaaatgaccgtctacaaaaatataaatcggggtaaaatttgatgcccgcttgcgaaaatagattttcgcagacggaccacttaagtggcgccgcttaagtggtccgcctacgaaaatagacttgaatataaatagacttgcgggccctattttttttttaagtcctcacacctctcagtcctcccctcgctccacacctctcctcccttcctcaccggcctctcccctcccctcccctctc

SEQ ID NO: 31956 - DNA, 5748 bp, Oryza sativa
cacagatttggccggaggagggatgggggaggccggcgggggcggcgacggcgacgaaggcgcggggcggcggtgaagacgacgacgacggcagcggctcccctcccctctcagatccggccggggagggcggcggcggcgagccgcgtgcggcgatttttttgttcgttttttttttttgcattttcgcaggcgggccgttgccccgactgctaaaatcgatgattttcacagtcgttgtgatgcaggcggacctccctcccgcctacgaagattagttttggccacctgcgaaaattagttttctagtagtgtatgcctcacacatgtatttatgttaggcttgtatggcttctaattgagaaacaaacaatacatgtgatgtattttacatgattttcaccatcggaacaagatggcgactcatttaaacaatttgtaagataagtgactaaattgcacttatatcacaagttgtgataccacagaatacattttactcaaagaaaaatcagtgtctttatatgcataatacttcctaactattctatctatcctaaaattaactactagtcatttaggattaactacctagttatagttatattcaaatttgtaatactagataacgatattttaagatgaagagagtatacatattttcttaaattagtctaagctatttatatctgttgagttctttactactacttccacccaacatttcaaacatttcaatttgaagattgtccaagaatataagcattcatacactactgcttactctcagttaaatttatctcatcgtactcccaaccaccttttcaccctaactctctctcgttaaatgtgggccgggcactaaaatcttttttcttcaatcttaatctttgctaaataatctagaaatgttcgatgaagggagtagttagtttttgttgttatgttaacgttgataaaatagtaaattaaaaattaaaaagatgatactccctccgccacaagccgtatgttgtctcgttacggtcaaaatttgactaacgattatcctattttgatatactttttatgacgtaaaattgatgttgttatattcatatttaaaagtaatttgtatcatattgatatattagtaaagtgattgttttaaccttgtcttagattggcatgttagaattgaggagatggctatgtttttaaataatttgtggcaaaagtacaattttacccctacacgtctatatttttatggataatcatacctcttcatatttctactattgttaaataaggttatagtataaaaagatctgaactctcaaataaaattagatttgtggttcagatcgattaacttctactactagtagggagtaccatggtaggactcaaataaaatacgttatatttatatgaagtagtgtaaatgagaaaaaacttgttctaacgagcttagctcaaccaaatccgtcttctatcagtcaatctagaaggcctgggtgccacccaagtgcaaattcttctcttggctagtcacgcaaaatagagtttggacggcagataggctggagaaaagaggatggtaaaaccaaaatatttgcccactttgctgcactgttgacgaatcgtccttacacctcctggccaaatgcagactcacaaagaggatatgagcagaaatccagagatggactgggacttacctccaaatggacgattgggaaaactgccactcagtcgatcagtggtggaccctcgtaacggaatccccaaacaccccgcacaaacccctaaggaccctggtgattttaatctcgtgggaaatctggtgcgaacgaaacacaagaatatttcgcagcaatgcatctgcgccgtcctcaattttagcaaagatcaaggagaaaggaagagcatggatcaaagcaggggctgtaaccctgcaggagtttggaactttgggagatatcacttaatatccgccttttgtcttccttttgcgggttattgcttttttctggctaaccctgtatatatcttgttataatttttttctactctattaatatatacaagacaaagctttttccttctttaaaaaaaaacgagcttagctcagctcacgaactgagcaaagttaactagccttaatcaatcgagctgtagcctcgttatccacctcaggtgtggctgctggcttggcttgtgggcttgtggcagcgtcggtgtgggggcgatgattttgcactcgatgctgtgaccttacttggaagatgctatgctgctattcactggcccgttcgtttttgacagccttttgtggcgtcaaggcttgatttgatacacgatgttcacgatgatgtctccagccatcgtgccttggcgccttgcttctgtcgctagcagcggtcagggtcttggcgtcgaacatgccatcatggctcgccccgacaaaattgacggactcacgtcgcatgatgcttactattaaccattcaatggaagattggaagaactagtgtactattatggtctgtgaatttccaactaaattaaaaataactaaacaaactcctcgcctgtttggtttctatttgaagagaaaggtaaaccagagtggttagcgtctttctttaatcccactggccttttgtttctcttcaagcaccgctagatttattctactacatcatgggagtgatacatgtagcttttggcaaaagcgaccttaggagaaaatttggattggaagctaacagcagcattaacaatgccacgaaattgttgtccaaacattactacggctcctaaacaataattggaattgactatcatggatggtgctcctaaacagtatctatctttctcattgctttcgtgggacacaaatcaagaaaagctaaaaaaacaggatagcgacttgggcaagcaattagtgagaaccttgattgttccttcttcaggagaggaatacacgttacacagtcctcccagtggcagcaacttacagagtacaagtgtaagaaacttaattattcttacaaaatctcatagtagtaattaactacacagtgttcacatttctataccctttatttatatttttacccatgcagaaatcataaaaaggtgttaattaaggagtatggactagtgaaaattaacagagtacagtctctactctcccggttggtcatgccctctgtgtaaaatgccttggaagaatattgtatatacgataatggcttaattcacaagaacctcatcggaagtactcgaagttgaagtcgccgaccaccatgctccggctgacgtcgaagtcgaaatgtgtcatgccctgctcttgctgcccatggcagggcagcccgaacttgtgctccatggcgtccccctcgccgtagcccacgaaaggctcgaccttgctctcggtggcccaatgcagcggctcgctctcgagcgcattgttcacctccggcgcgcccacgccgcagttccagttgctgctgttgctggagctctcgctgtagcacaggttctccgacacgtcaagcacgctgctgtagtccacgaacccggccgcgtcattgccgcagaggtggccgtacaatggcatgcccgtggcgtcgaacccgctgccgaagctgtcgatcaccgggaacgggtcgaacacctgctgctgctgcttcagggcgaagccgtcggcggtggccggcggcttctggtcctgcgtcgacgtgtccaatgccgccgccgcagcagcagcagccgtggagatgggctggtgggtgctggggtcgatgccgcgctgcctcagcttcttcttgaggcagctgttccagaagttcttgatctcgttgtccgtcctccccggcaagtgagacgcgattgcgacacttgcttcggatccccttgctgatcaggcaccttttcgttaacaatatcccttccacacacacatattgggacaaaatagtactggtacgcattattgccggagcggcagtacgtacgaacctgttgcctaggatctcatgcaggcggacgatggcgtcctcctcctgctgcgagaagctgccccgcttcaggtcggggcgcaggtagttgatccaccgcagcctgcagctcttgccgcacctctggagccctggagcacagaagaagatcgttgcacggcacgggtcagcgatgagacactgagacacatgcatgcaaagagcggatcgagcagagcaggagcagcttacgacctgcgagcttgggaacggagctccagcaaccgacgccgtagcggtagatgtgattgtagagcttctcgtcttcctcgggagaccagagccccttgcgcagcttctgctggacaccggcggcagagcacgcgtgccgtcccattcccgcccgacacgcgagcagctacctgccgctgggttcgttgcccttgccggcgtgtatctgtctatcgatctctctgtcgatcgaggcggccggctgggcgcccgatccagggggtatatatggggaagcgtgccgagaactactgcacacacacacgtacggtgcgcgcgcgcgagggaggcagcagatcgagcagcgatcaagtggcctttaagcaatcaaccaacgagccacggagccaagcgtctctctacctagtactcctcttctctgtgtgtactacctggtgcgtgcggcttgatatcgtgcttccgctacaatggattggagcttaagatatctccggttcgtgagagaaattaggagaggagaggagcgcagacactgggccagcgagcgaaagcgagcggcaagctagggccccgcgggaacaggacggaaaggacggaggaaaaaaaaagcagggttagttggagattatgactaagatttttccatcaacacttggttagggaagaacacggtacagccatatcactattaatctcactattaatccctccaggaaacttgcaagttgcagctacacgaccgaagctataagcgaggcagcgaaaaaacacacgcctcgtgcagcgctcgtacactgggagggactaatgggcgggcgatcgccgctcccctatactctatacactcctccctcccttcccctctccctcctctctttcttctcttcctactatagtacaccacacaaatttttttaaaaaaacaaaaagttagaaaaatttatgtataaaaatactatatataaaaaatttgaattcaaattcaaatttgaatcgggtatgtaaactttagacttataaattttaggtgtatagaaatactatatatagaaaatatttgaattcaaattcaaatttgaattcaaatttaaaattgaatcggctatgtaaacttttgacttataaactttaggtctataaactttaggtgtataaactttagatgcataaaaatactatatatagaaaatatttgaattcaaattcaaatttgaatcgggtatgtaaacttttgacttataaactttgggtttataaactttaggtgtataaactttaaatgtatagaaatactatatataaaaaaattgaattcaaattcaaatttgaattagatataaaaacttttgacttataaacttttggtctttagatgtataaacttaaggtgtataaactttaaatgtgtaacttaaggtgtataaattttatgtgtataaatttactaaagtagaaaagtaatacggtgccaaaaaaggaaacaggtggagagagggagggaaggggg

SEQ ID NO: 31957 - DNA, 4768 bp, Oryza sativa
cccccccccccccgcgtcccaggtgatcaatcgccgtttaggatttccgtactcggttgctatacctatatagcccgtggggccaaatcaacagggtaagatcgtacggcggccatagctctgccgctaattaaacacggcttaattagtctgctgtgctacgcaatgcagatggcggtctttggccacgtcttcaattgattgtgcccggctcggtcgacactggccgtaccgaccgcgtgtgtgcctgtgtccacgcatggcaataggcgaactactaccgctgctgccgactgtcgcgttccatctatccgtgttgatttgcaggtgccagccccgtgcgccggtgcgcgggtggcgcggtggccaactgtgcgcggcgagacagccgaaggtaaagctgccatccaagttgcggccggtcgggggacgtcacattcgtgcgtgtaaatacggcattgtttttcatagatcgggttaaactgatcactgtccacgagatcctgaagaggatagcagccgacagttggaattgcagcgttggccccacgtctttccacgtaagagtccttttgtggggtactggtactactacttgtagtaggaaattttttacacggccgaatcgatacagtacctagaacattctttcagaatttctactttgttatgttctaaagaaggcataaacacttaaccaggttgcttatcgcacagtgtcagtttcatgcatgagaacatgtacaggatacctgtcgtaggatctactgacatgtgggtccgatatgcgtccgtagacggaagaagaagttgatgattttttttttcttccaagtagagagtggatattctgtaacagttaaaatgtcgaagcataaaactatctttaatttaggtgcgggggtaaaaaccttgctcgttctagaaagacatgcaaaggtgaaagttacacgctgaaaggtgaaaataacgcacacgctttggtctcatcagctgcaagaaagcagaaatgagagagcaaaatgaccacagggagaggggtacctgattaaccgccgagcctagccaaagttactgcagaacaaaacgggaacaaacaaaccaagcaaagcagcacagcagtaggccctggccatcgtaccactaggaaggaaaaggtgagatgcagatgttcagttcaacgtaccagacggctcgatcgatcagtcgactccatcctaaattcgagtactacgtacttgcagtgcgtggctcgatcaaccgtgcaatcattcagctttcagtacactaaaagcgagggtccctaaagcctcgggccatagcaattgcatgcaggacagggcagcccccgcttaacccccagcacttagcctcccacgcttgtgcgctaaagcatacgcatgatcgagttgtacacgtcaacctttttattttcttttccatctatctggaggccctaggcactaattaagagcacgatactaaaacgatcaaacttgccataatgccatgcacgcgttgcaacgaatttctcaataacggcacacatcatccgtggtgttcatgctgttcttgcatgccaacgcagcttgtagcgcgaaaacgatctgaaaaccacttaatttaagtgctctggcctgtaccgattaattagctagtgccgtgaccctcgttagagtggcttgaaggctcgtgccaaatgatggcagctagttctcagcagtatgactgtgcagggagatagagataagaggccaagagcagtgctcgatcgaggctggctacaaccgcaaggataatgatgtagcgaggggtgtgtccgttccgtccaggaggggagggggggcaaagctagcgtgctccggagaaagcatgcagggttagcgtagcgcggagaccaccagcaccacccgtccaccgcgcgcgcacggcctcggcaacaagtttggtggccaatcagggtcaggcttagcttccagcctgctccatgtacatgtcgagttcggtttagttgggaaccctagtatccctaacggccgcgcacttaattttttttaacttgctcttggcgttgttttgtgcgcgctgcaactgcaaatgcatgcagacacaccaagttgcaccaatgtgctcatgaattgtaatgcattgatcttgtgccttcacagatcgattggaataacgggaaaattgtgtttgcagtgaatgatcagatctgtgaatgctactgagcatttgtctgattctcccctcttttgacttgagagactgctactctgctaggcaatatcagtgatcaatcacttgcctaacggtgtctacaaaagctaattgcttggaaataacaacacatgtgtgagtggctaagtggtgatagcagtgcggagtcactataatgctggaggcacaattttgcatgtcaccggtaaaaaaaggcatatttttcgccagataaacctgcatgagtgaaactcaagaaatgtgcgtcaacgtagtagtgttaaccttctgataaaatgggatgatctacatgttccataggcgacaatgcttcttctccaattcttctgacgaagttacccgcgtaccaggaccagggtaggcagcttttccctttcgaccgagcttgcagcagttgctaaaagacaagctggcctctttttcacccacaagaaaaaagaggctcacttgaagaaagttggacaataacacaaaaaatatatttgttgacaacttggtactgttatcatcctctccttcctttttgtactctgttttttttctttcttcaagggaactccaattgtagtaccaagggggccgggggcaactgcagtgtattcttgcagttgacgttgattatttcagagttcagacaagtggacggctaaaagaaggaagaattaggactaccgactaccgagctacgtagccactataaggcaagttgttaccgctgcaacttccgcagcactaactaagacgacgactacgtggtagtatgcgggatgcatgggcgacatgtaaaagaatcgcccggcaaagtagtcactaatcgatcaattgggaattacctcaagtgcatgtctctattgtggccaaaaggatcctccaggattctcctacctgaggcttgatcttgacatgcctcctctataaaggaaagtactactagtaagtaaaaccccaaaggtgagagagcgagagaagaaagaaaaaaaaaacaaactaaagaggtggtgcatcatggtagctcctctttgaagttatgcaagcccaaagctagcagctaagtggctgcattacacatcacatacacatgttactactagtttactcatcgccgagcgacgacgtcaccggccgatatctctgggctcccgaggttggtgcgcccggccggcgctgccgctacgtagtagtagtaatactagtagtacgagttagaggccgttgctgtcacaaaaagatggcgtgatgtgcacttgccttgcatgactaacctgcatgattgaacttgctgctggctagctgcaatggaaagcgcctgctcaagccatgcagaactgaactgtgcactaattaattctcccctcacctaattcagctcgcctctctctgttttttttttcattaggaggccggacttgctgcatgcatgcctggctgtctggatagtgcgtactgttcctttcctacccctctttctcgctctcacggcacactgacaagatatgggctaaggtacgtagctaatagcctaatatctagtagtagtagcaactaagctagagccatggaggttacgcaacggaagccaagcaacataactaatcagtggtactctccagtactgtccaactgtcctgatgcttggagcttggaaagtttggatgctagctgcatttcagagtaaggagcgtccgtacacgcagtttactgaattttccgttcttcagttcagaggattgtttcttcccgtcgtcctctgcttcgtttcaatattggtgccgtccgatctaggagtagaaatggaatccgtttctagtgcattccgagctacctgactaatcattccagcgtgattgctttcaaacggaatcctaccgggcttgaaatcgcgggcgcaatgcagttatcttcgtagtgcgtaccaagctagacaatagtattgcgcgtacgtcatttctacgtatcagcctaatagcctattagtgatcaatgcatgcatcagatgcatcttagaaaaaacttacgggcaaagcaagaattaatcatctggccgtgcgggtgtaatccgtatctagccacgaggaaggccgtacacatgtttcattgcttaatataacaaacttgcagtactgcacccacggcgaacgttgaaatgcaacgtgaatcgttctgccattatttgatcatccgtagctcgagtttctgaatattattgggtactccagtctccaaatgaagtttttgcaaaacaataaagtgtagcttcaggggcagaaaacaacgaacttccagtcgttaagtggaggtggccttcagctccacaaagctgcacattttctgtgtctgccctccgggctgcggcttcagaatgttctgccggccgacatgcacgtcagaaccagcatggactagtcgtgtgtgtgtttttagagaagggtattttttacccggcctctacatccaaccggatatatacggccattgaaatagggaacttagccctgcaaacaacccaatctgaaattcgctccatagg

SEQ ID NO: 31958 - DNA, 22402 bp, Oryza sativa
ggttaaaaaaattacctttatctaaaaaaaataaaaaaaaaactagtcgtgtgttaggtcacgctaaaattgaaagtttggttgaaattgaaacgatgtgacggaaaagttggaagtttgtgtgtagaaaaattttgatgtgatgaaaaaattaaaagtttggaaaaaaaaagtttagaactaaacaaaggtgcagttttgctccgttgtcatgtttagctggagatgtgtcccgttctcttacattttgattttgcagcccagatatcatcggtgtctggccatcccttttgatatccctcgtttttcaaacgatatgacattttctttttgtgtgtgtgagatcatctcaactgtagtaggcattattacctcagtgaaaatgatacggctgcactgcacctttaataatcctatgacaactttccaatatacgtagcacaccggagattgcacaatattgtaaggacccctttgaatcgtaggaatgtaaaagcataggaatagaaaaaacgcaggattctgacaggaatgtaggtgtaaaacagatgattgaaaaatacaggaaaaacacaggaatgatcgtttgattggaccacagaaaaaacacaagaatcggatgagagaaatagactcaaaaggatttttccaagaggttggacctcttgctaactttcctccaaaatttctatagaattacctattccataggaattttaaaggatagtataggattcaatcctttgtttcaaagggtttcataggaaatttttctataaaattaaaatcctttaaattttctacattttttctacaaattgaagggacctaaaggtggacgtaaaatcttgcatgccacctgcttcccagggaagatttgttcatgaccctcttctgatgttaacttctctgccaggaaccttcctgacatgtccacaaaagcatattctgcctttttctttttctttttgagtgtgtgtgagcgtgttttttgccacactgtagtacccttctgtatcaatagaaaacaaatcgtagaactgtggccaaaataggggtcaaaatgtttggaaattgctcaaaccatttctcgactatggcccttggtttaaattctaacttttttctttaaactttcaattttaccgtcacagcaaatttttctacacacaaacttccaacttttttgtcacatcgttccaaattcttcaaacttctaattttgacggggaactaaacacaacctatacttttttcttgaaaaaacggataaaatggtatagtaagaaaacgatatagaatatatcgaaaacatggcaccatagtgtcaactgtcaagcaaatgaagccataaatactttacaaattacttggtgaagtcgtgaagattcaaagcacaactaataaatactactgaggatgccatagcattcaacacactagtaacacataagggtcaggggttgattagggtttgatttaataaaggattgtttgtgctgggttgccagtacaatatagtagtttttgccaaaaaaaacttatgaaaacggtacaccggcgaaactattacggcttgtttggcaacttgaagcaggggattgagagtttacatgaggaaattgatgtgagattgattaagatgagaatttaatttttaatcctaatagtttgtttggtagagctgatggaaattgataaggagtttagttggagattaggttattaatgaaaacggataattgagatttgtttaagaaaagtaaaggaggaatttcctcccgattaccactccctacctagatattgaaaatgagggagtttcttaattctccgtctccatcccaccaaaattcttatgtctcccaaccaaaataaaacagttaatattcccatccctctaaactctcaatccttcgtaaaaactcctcctaaccaaacggccgttaaaaaagcctcaccagatcacatttatgcttccgtcaattccaattccaagtaaatggtcagtacaaaagggggaaaatgttcaggatagccgggggaattccatactattttcaccttttagaccaaaatatatctgatctcaagtgaagcaggacttgcccaagcactggtgcgttacatctgaaacaaacaaaggaactgtgtaccaaaatcttgacaaccaaacatctaactttgtcaatattttgtcttggcttaccttttcttttagtataaggtttaggctaccttttcttttggtataaggtttagggactatctatacatttgtcaataaattttttcttaaaaaattaccaaatatagatatagtatgatcgtagtataactacattataacttactcctacatatgttatacaacgtaatttgtcgacaaatgtgtagtaaaatcatttaagttttagacttgacacgagtgcacacattcacgagtaatagtttttttagtgatattagatatatccatcggcaatcagatacctgtgataactttgttaatcgtaagatatattggcccagtttttaaagtggctcatagtggtagggtgtacatacatgtatatgagcatctaaattcgtgtgtactgtgtattagaaaaaagcgcgaaaaatctgtcacaagtgaaattgcaatttgcaaatccgaaaagaaatcgtaaacaaaacctgtgaggctgctatactgagttactgaccaatccactggatggacatacgcggcccggcccagcggccggtacgtggtctctccgcatcagggtttcaggattcaggtcttcaggggagctgcttgcttttgatcgtgtgccacaatcctgccgtcatcacactagcactactgccgcagtgccgctactatacgtacgtaccgaactacggatcgatccatggcgcggttgctttcgcacgctgctgtgcgatattccacacctaggaaacaaagatagctataggggcgggggagagcgtggaacgccaatcggccaatgcccaatatgtcgacggtggtgcaggccccgcatggcgcactcacaaggatcggcggcgttcgccgcccggccgcgggagtgtcggcacgatcgaggtcgcggaaggccgtaagctagatagcgagccgccctatcactcgagccatacattcgtgtcgcctgcagtgcggtgcatgcacagctcacccgcacgtacaccaggcgaaatcaacggtgttggcgtttgccgcgcgcacgaacgtcgatcgggtcggactgatcagccgagacgtcgagcgagcgagccgagatgcgctagcaggagatcgtgtgacaaaggctcaccttaacgacgacgtgtcacgtgcatgcctcgttccatccatcgatcgtcgcatccgtccaactccatatctccattcaccgactgaaaataccgtcaggtcacacagcaagtcggcaactaattaagcaagcaagcgagaagagttttagcacgatccaacgtaccactaaacctacgtgacgttgaacaaccacgcacatctagtcatcaacaatgcacacaagcgatgccatgcaccatctgtaagaaattaatttgctgtgtgtatagcgacagccatgtagtactacgatcgactcggatagacggatggacggcaggacgggatatctgaatcgaaaaaaagtgactaatatatgtatcaggacctaattaatcgctcggtaatcgcattggtttagcgatcgtaatcgatcgccgtggggatcattgacttcaatgtcacgttaagtgcgattgggaaataacccgtcgatcgattggtgatgggggctgggtgacaccactgtgcccaaacatggagttaactatatgtacacaaggtggattaagattttggacccctcttatgttagtgtcgaattgtcgatccgtctcgtcgtggtctccatcagccaatcagcgaggaaagccgagggtgtgtgtggtgcttctagaattccttctcttgcggcacagcttgattacagcggggattaaaacttgatagctgaccttttcttatcatgcctctttttcgtttgtagtagtagtagtagtaatacgcatggtactgcaacggtatatgtccaaatctacctattgtacagtgactggacgtgtacagaccaacctgccaataggccattattgatcctcattccagatgtccaatcttcgtatcgtttttgttttttatttggatattttaacttaacatattttggggggggggggaggggggtgtttgagagagattgttgcggatgcacggtcacaacaaacgaaaaaaaataattgctcgtcctatagctatctatccgagtttatatatagaatcgtgcggttatcgtgtttatcatgtgcgataaccttaccagattctgaaattacgatataccttgcggtaaccaccaaaccatggggtggcaataatcccaccttaaacggtttggtaaaccctaatagttatcgcccaaccacaattgcaactagctgtaaagtaacacggtcaaacaagttcaaaggttgttataaagtactcctagtagtacaccacggtgagattttcttttcgatactttagttgttttattttcatttttctatgtgggtatctacactccatggatgggtttctttacagggctgccatctaatgtgggtgacttacatgtgggcacgattttgtaagtaggttggacagatcgtggctggcttgcttgagtcgactcgtttcatttttgtgaagagctgagctcatgttttaattagttcgttagagataacaaaccagctcaagctagctcgcgagctactcatgagccaaacaaggtgaaggtctagagcacttgccgcagccgctggtggtttggaggctcgtgcttgttgccccgcccctcactgtactctattggccttgacctggttgtactacatgcgcatgctgccgcgtgcgctctcgccgccacttggatttggcagctctctgctctacttcccatcacgttgtggcgcctgcgctgcatgtatcgtcatccgttgactgttgtccttcttcttcccgtccaagacgacgagatgcggaggatgacgagtccctgtttcgacagaagactggtgagcttttgcgcgtcgtggagcctgttgcttcggtgaggtcggctggtgctgccaaccatgacgttctccttcttgtttcgctcgccatccatttgcgctgcccactagcccctcctactcgtgcgcgctcgtggagaagatagggcatggtgctctgcctagtagagctcgcgagctagcttgagccgagtcgagctaactcattatcctaacgagccgagtccaagcccgagccagcttgatatccaccctttgatgtgtaaggctcaaatatcaatcacttaaaattaaaggataatattacagaggattggtttccatactccatatgaatagctttcgacgagaaaaaataaaatgaagcatggatgcacgctccttgtctaaaactgtgtacaaatgaagaggagcctatctgtgcatatgcatctaggatcataaaatactttccactagccgagaaccccttttatttgcgactaaaaaagatgacaatctttcttcttttctgcaaaaaggtatgctaatatatctggcggtcgttttcctgggcttagagtatgttccctgtcaagcagtgatcgaatccataaagttttgggtaattagttttcagttctgcctttacacttattgttcccatctcctttacgtacttttctcgcctccttaattttccttgcctccttgagcgatcaacatcgatgagatcatctttagcttgccatttcaaggagaagagatttgcggctcggccataccatctctctttcagggctagcttccctggctgcacagtttttctgacgagacagaaacgttgcacaagataaattagttacttccaggtaaagtaattattaccaggccgacaactgaaccggtaaaaaccaaaacgagggaaaactccaaaaccagcgcctctatcgatcagtttggtgatgatttttttttcctttttgaaaaaaaaatcattcacaggtctagctttagaggcaaagtaagtgtactcaagtaaactaaaatatataaaatgcatcagatcagatgcatcgatgaaccagtgtcggcgactcggcctgcaatcgtacatcgacgaacgacgtataattccgtttgcggtaattggagggtgcgggatttttgggccctggctcacatgttttgggagaactggacttccacgcagcctgcagctagcaggccatcatccatcgcgcccgcaccaaacggtgtccacctctgttccggccgcacacacgggccacacactgaaagcccccaaagtcccaccgcgcgccgaggtgttagcgcgggcctttcgctgattgattcgctttcgaagaaaggaataagttcacttttggttcctctatttgtcgtccagtctgattttcatccctgaaccgcaaaaccgggtacaacccgtccctcagcttacgaaaaccgggcaaacgaggtccctcggcggttttgatagcggttttggttgacgtggcgcctacgttgctcatttaactcggtctttatctgacatggcactgatgtggtacttacgtggcaatttgatccggaaaaataacaaacccgtgggacccacatgtcagttgcacatacaaaataataaaaataatggtgggacccacgtggaccccacctgtcaccctatttctcccctcttatcagttatctatatcctctctctcagtccccggtgggagaggaccacgtgaggtccgccgtgccaaggctcgggaaggctgaaggctgacggcgctcaggaggcggacctcgccgtcgacgctgccgcatgctccgtgcactgccacgcctacgccggggatggtcgccgccggcagcaaggagctcctccgcaacgaggatgggttcaccacggaggacgtcgtggccatggactcccccaacatcgtcgccctcgctgagacgccgacggcaaggacatcgccgccgccgccgctgccgaccacctcaaggccatctgagcgagctagctgctctcctcaaggccatccgtgcagcgccggcgagccgcccggagatccttggcgtcgaggcggccgcggcggagacagcttcccgctccccctgccgccgcggctccttgtggtgctcggtggcgtacgcttgcgggtgaaggtggcagagcagcatcccggacgtgtccgcctccaccctggccgacagctgcctcaaccgcgactccacccagccctgtgagctttggcccagagaaacaacaaaacacacgcgaggtcacacacgcacgaaggaatacacaagtgatgcaaatacttcagtggacaaacacgagcttgcggcgaactagctacacttccactcttatttctcagactcagtgatttgttagtcaagctgcaacacatacagttaccgatcattaagaccaagcagtacttaactaatcaccacccacatggcgtcggccttgacgatctcctggcagacgtcgtcgccgacggcgagctgctcggtgatgacgcgcagggtggcgtctgaggccgagctcgccgtcgtcgtgctcgatggcgcgcagcatcaccgggctgggccacttccaccgcgcaaagccgcggaagaagcgcgggagcagcatgctggggatgtgttggggtagagctggcacatgcgcgccacgaggatagcccagccgatgccgccgaggaagcccgcgacgttggagtagacgccccgcgccttagcccagtgcttcacgcaccgcagcatggtgcggaacacggcggtctccgggacaagccgcaggatctcgtcggccacgcggatgccgttgaggctgcgcgccgtggcaaggtcgtcaaggccgcggagcaccgaccggtcgcactgaggtccactccaggttgtcgggcaccacgggaggcacacgccggcgtacacgagatccacctgcacgccgcggaacctcatctggatcaccggcaagggatgtggcggtggcgggagcggcggcggagtccgtggtggtggcgctgctgtagagagaagagatagaggaaaggggatagagatgaagatgccgagagaagaggaggaaatgaggagtgacgatgacaggtgggacccacgtgggtcccaccatttttatattattttatgtgtgcaacttacatgtgggtcccacgggttttattatttttccggatcgaattgccacgtcagtgccacgtcatatgaagacaagtcaaattagccacgtatgcgccacgtcagccaaaaccactgtcaaaaccgccaagggatctcgtttgcctggtttcgtaagttgggggacgggtcgtgcccggttttgcggttcagggacgaaaatcagactggacgacaaatagagggacctaaagtgaacttattcctcgaagaaacggggacgctccggcctcgtggcctcctcgtcgcaacgccccggaaatgtcaatgtggaccagaaattttcgcaaccaggatcctgctggaatttaaaatttggaacaagttcactcttgctccctcatcttgacgttgagtttgagtttgaattacatcaccgaactgtaatgtcagaatgttgaacccctgtctttcaaaaccaggttaaataaaatcataagacagtatgaatggctgttttgattggcgtggcatcctaatcagaaagaaaaaccatgtgtggctcacatgtaagtggactaaagaaacaagctctcgcgtcgtcttcccctgggggcggcacgggaggcggcaacccggccgcccctcaccctcccctcttccccctccgcctcgccaccgcccgagcggccgccggcaaagccggccggccgcaagggcggcggcggggcctctcacgtcctctctttcgggcgggcagggggctgtcctaggcgaagcagcggtgaccgccagatccggcccgctccggccggatttggcggggcggcaactggcggcggcgagggtggcggcaacgacggcggggatggagttggccgagggcgcggaggcggcggcggtgcctcccagatccgcgcctctcggccggatctggagggtggaggcagttggccgacggcagttggcgacgacgacgacgacggccggcggcagtaggcgatggtctcggccggatctggatgccggcggcagtgggcgacgacggcggcagtgtggtgacggcagcggcggcggccgtgggccggcggcaacgtggtggctgccgtgtcatctggcgacggcggtggaagcaatggcgtcgggctgctacctactcggtggtggagggcgatggcgcaacggcggttttgcggaggcggtggttggtgtcggtggcagcggcgacggtggctgtgactctagaggcggtgatgacgttggtggcggggaaggagtcgggtgcgaggtggggatgatgacggcgaggtggttaggtgttcggcagtagcggctgtggtggtggtgaccgtgttcacggtcaccggaggcatggcagcctcggttgactagccgaaggcgtgggagacgtccgcatctggccggcgtggcaccgttcgatggaggggtcggagaccggcttggtgcagagaaacgcaaccgatggcagcggaggtcggctcggcgcgagaggcgtgggcggcggagatggaggccggcttggcgcgagaggtgcgacggttagagggaggccagattggcgcgagaggcgcgtccggtagaggaggccggtttggcgtagtgaggcactgccggcggtggaggaggcgacctaggtgtgaggaggagctgccggtgggtgtggcgcggtcttcggcgcacgaaggctagctggcgggggatgccggtgagggggtcccacatgtcggcaaagcttgtgtggtggtggagcatcggtgcgtcagccgtggtttcgcaggggcgatctcgtctgtgccctttgttggtctagtggcagtcggtcacgcttagcggcggccgatccggtggtagccttctcctgggcgtgtgtgttggcgatgtcggcgtgtgggtggtggtatttttttccttttcctagttatgactctctagggttataatcttgtaattttttactactctatcaatagaacctcgcaccgtctcgtgtgagtcgttccaaaaaaaatgtaagtggacttctacctatcgactctttcctattttcaactctcccgtctcttctctaggagctcgccgatgaggagagggacaacgaccgatgagtctgtcatgggagacggaagcggtagttggaggtcaacggcgaaggggtgtcggtggtccacagcggaggaggaaaaggagctgatgagctcgagcttggcagccgtttccttgaaagcgacggtagcggtgagcaactagagaggatgcgtttgtggctgtgtgaggcgacttccaccaccacgaccgcctcccaccggttggccatcgctagcacgaggccagctcctgcgtggagagcacctcaccgcgcctgcaggcgaggaagccaacgccaccatcatcaagctccatgcgcatcccatgctagcctgcctcgacagccacaacagatgcaaacgagcgtctccatggtgcctggagccctccacagggtgttgtggaggccacaacgccgaaagacttggaggtgacgctcgtcctccaccggagccgtcgcatcatgtggtgtggccacgatgactcccattgcgccctgcaccacacgtgtttggcctctaccttcgcctgatctccaacgctggacacccgggggcggggggcggggggtgtatggctcgtgcttgtgcagctattgccgctggtaggggagagggaagggcaagggaggaggaggatatggtcgtcgttgttgtgactgccgaggcgtcgaggccgacaatgtcaccaaggcccgagccatccgtttctgtcctacacgcagccaatgttgtgcttgggagacaggagccgtcgcatcgtgttttgcccaagcaccgccctcgatgctgcactccggtcgtgaggtgagaggagtgaggcgagtaggcgactgcttgagctctatgactccgttgccgctgccgccttgctccgttctcactagtagctgaccgtctccccccagcaagctcctatggaggagtggggagagccggagaggtggagatggggaagaaagaagagagcctctagaagcccacttacatgtagccccacattttttttttgactaggatttcacgtcaaccaaaataatcatctttattgctttaggatcttatttaatttggctttaaaatttgggggttcgatatttatgatattctggtttaagaatataattcaaacttaatatcaacatgagggacataaagtgaacttgatccggttttatctcaccctttgcgggtgttaccaaactggcaggcacggcctcttttttaacgagggaagtgtagcaggaacggtctttgccttcgcgtaaagagagaagagacaactagacaagagagagagaggcatatgtcaccttcccacgaagacttcagatttaacttgcagatcacccattcacccgttctgcacaaggtaaagagcgtaaacgcacgtatgcaacgagagcgataacctcaggctcaatggatccccggaccccgcctgtttacctgctagtgcacacgacaatattgataccaaattgagcgtctcggtaattcaccgatggtggatctgcgatcgggaagtgaccagaaaggtttgaagtaccgtgtcagaaacgggatttctcaaccaaaatgaggaagcggactgctggtagttgcctaccacatctacagagacgttcaacctatacagaggagctccgggtcctctgcggcagcttcatgaatcaatttcctccccccaaaaaaaaagagaaaacaatcaatttcctgtgatgtttgctatataagcttcattgtcagtagcttcgattcaacacaatggatgaggcagcgacatctgatgagtgatgatccctctcgtcgtccttgactgaaaggcactgtatgattcaagatatatagtttcagacaagtaatgctgttttaaactgttgcacttcacctaccattacaatagagatacacacaagctagtaccttttttttttaccgaaaccaaatcaaactcgacattcaaatatataaaatcgtgacctaaatgcaatgtttaaggaaacaatgtgtcaatgtattagtactacaggatgaaatcaacaagggatctttgttgagtcatgccgtctgcccaccataaaccgaacctctgtggctctctctccttgcgtcccacctaaacaaaaccaaacacaagctagagcctaagagccatgagaagcattggcgggaaggggacggttaggccaaccgtttttatcttcaccacaccacgacctccactcttggcgccaaagcaaagccgttagattgttggtcaccatctcaaacccaactcgatcgcctcctcccctcccacccattttatcccttgacgctcaaatcagccgcgcccccaatgcccctcccccttgaccggccaccacaatgcggccgccctcgtcgtcggcgacgcccgggacgggccgggtgtcggcgttcacgatgcgcgcggtggcgcgcatgtcgagggcgcggtggttcatcttcctgaggcgggtgtaccagtaccagaacggcccgaggtccgacctgggctccaaccccttcaactcgcccggctggctcgccctcgagctcggcgtgatcatggcgcagatggtcgtcaccaccgccgtcgtcgccacctcccccaaggagcgccccgcgtggccgctccgggtttgggtcgccgcctacaacgtgggcaacgtgctcagcctccccctcctctactggcgccaccggcattcctcctccggcgcccgcggcggcacgctctccgacgatcccgagatgcacggcgccaacgaccctctaaggttcataaaacggcattagctgattagctttcttaatttcttgatggaaattgaaattgtgtgtgtgggatgcaggaacaggtcgtatctgatgaacaaggcacgggcgttcctggagctgttcttcgcgatgtggttcgtgatgggcaacgtgtgggtgttcgacgcgcggctcgggtcgttccaccgcgcgccgaggctgtacgcgctctgcatcggcctcctcgcatggaacgccgtcgtctactcgctcccattcctcctcttcctcctgctctgctgcttcgtcccggccgtcggctacgcgctcgggtacaacatgaactccgcgtccgtcggccggggcgcctccgacgagcagctcgccgcgctgccgcagtggcggttcaaggagccggccgacgcgccgagagaccgcgaccacgacgatcaggtgagcgcacgttccgttgccgcgtacgttaatatcgtgggatatgttagttttgcatgcacagagatgattaggcagtagcaaagcagcgtgcatgtctctgcggggaggtaggaaagtttagcgatgcagagaggggaattaaggagaaactcgccaaacaaatgattggtgaactcggctattggccagaataggatatccaaaaagtgatgaaacgtgcgcaccaaactagaacaatcttcctttttgggcggatatactaagataagaactgctaaaaccttacttttccccatggttcggtgcttaggaacaactcagccaacatgagctagtgctaactagctaacataagaactgctaaaacctttacctttcccattggttcggtgcttgcttaggaacaacttaggcacttagccaacataaactagtgctaactagctatgatgtgttgatgttgtccagttttatacatctaagccaattagtttgctctctagctagcttattattgtttagagctcacaacttataggaaactaggaattgtccttgcttttacatacttactggaattaaatggcaggagtgctgcatatgcctggctcagtacaaggagaaggaggaggtgaggcagctgccgtgcacgcacatgttccacctgaaatgcgtggacaggtggctcaggatcatctcctcttgccctctctgcaagcaagagctcagctagaaaaacaagctgacatgaatacggagctactgataccgcgccttccgacgcatgcgtcgcacctcacggaagaagaaaaagaaaagaaaaaaaaaccctggcacgccaaccatgcgtgcactgacctagttcgatattgctgatgacggcacgatgaatatttatgcatacacttgcatgtgaaaaagatatgcttggattaattaggctaggtagacaagcgggaaatgtgtaaaagagtttttttgtgtgtgtgtgtgtgtgtgtgttgtttgcggtgttgttgcatctctcgaatgtggtcgatcgagatgcgcgtgtacgtagtttttttcagcagaaaccaaacgagaacatataccagggtttgcgctcgtgctccagcgaatgccaacccaaaggtattcggcccggtcgaaactactacagtactgtattctaggcctggctcagagtgggccaacattttcggcccagtttattgacctactgcccagcctataattatcaatcagcccacctcgtcgctgcgccctgcgggagacggcggctacgagcctagagaccgttgtacgaccggccggtgaaagcgagaccgtcgtgccgtttcttccacagacgcgatcacgagagggagaagccccaagacaaaacacacaagtgacacaactctatatacaaccaaaacacacacatgcgtctcgtgcgactcgctcgtgaaattaacgggcgtactacgtgctagcgtagggcctgcgccgtgcgccactcgatccgttggtcaagtacgtccctggtctggtcaagccacctagccacgtgatagttgagcacctgggcacaagccgccggccttcgcggacgacgatcggtgcctacctgcgtacgggcagccactttggtcactggtgacggcatacggtggtggggggattgggggaaaatcggtggaagagttctccggcccggagccccggaccccggagagcgacggagacgcaccgcgcggagatggcaccgtgcctcgagaccaagtagagccgcagccgtgcaactcgatcctatcgcctatcggtgtcacggtgtgggccgcggccacgtgtggatctactgtgctggcatgattgggaggatacacacgtggccggaggttacggcgccggtgcttgctcctcgttgacaggtgacaatccagtagtaagcccataagcccattggaattagcgagcagttcactggcactagtgcactacacactgtccaactactctactcctaaactccctgagggctttcttttggcatagcccggtgcttcctttctttcgtcacatgactcgcgtactcctagctcactgctcacgtgtttgcacagtcgcactcaacgtgttcggacggccgaatcagaaaatatataatgcatacgtgtagcatcatcatcttgattagtcccatataatcttaacaaagtggattgatcttacagaaaactaatgcaaatgctgacaggataatccattaagaatgacatataggctgagttccttcccctattttccaaactaatatctctctctctctcttttgacttagcatgtttttaaaaccactaaatggttctatacgaaagagtataaccgatcgtcgactattatttctttgactactggtttcttaccctatggagcaattcgtgtggtctcgttcgactttattcttttctgtttttatcttttgattttctttgaaaaaatagtacaaatgcaaaccctcgtaacatacgtacacacatattctatcgctatgagcacctctaaaaaaattagacgagtatatgcacactcatccctataaacacgaagacacacatcctatttctataaggacatccgaaatatttcccatgaacgtgtacacacacatcctatctctgagcacattcagaagactggaacatcatgtattgttattgacaggtacgttgcctgtcattaaaataataattagctataattgcgagtacctgtgtcaaatctaagacttgaatcaagtgggccggttccatcatatggaatctaactaattgagctacacttatttcgtgattttggatttttatttgcctgttttccaaacttataaacgttgtttttgtaaatttatttttgttgtaatatttttcgaaagcaaattttcaactctgtaatggttcatttatccgtatgtactttctaatagctataaaaaaatcagattatacattatcaatttcagttatccaaaatacagcctaaaagtactcatggcctccaataatcctctcattgcagttgattatattcatgttcttcgcttgctcggcctattactatcttccaagggagttgtaccaggagcttttttttcggttgcccacgacaacaaaaaaatccttacctcgtgcatatcgcgaatcaatcaatgttactttgtcgttcttacctgccaactactccgctaactgatatgcgagattctccatcgctaccatcgacccatcgtgccagtggagtgtggagtgctgacgttggcatggggagctaagtaataatggtattctataagcgtatataaaggagagagagaaaaaaatcaggtcctatgacttagttcttcacatacttaaatgtagatgcaccaaatataatagaggagaggaagcgagatgagaaaaaagagatacaccattgtagctcatctattatgtaccctctctgtcccaataaaaaaaccaatccttccaggctcgtagctagaaattctttttttttacgtagtagtatatattagttgtaaaatgcgcttataccggctcctgagctgccaccgacctcgttaagcttgcgagttgcaactcggcctcgtcgagcttcgacctgccacttcgagagtaccaccggcctcgtagagctccctcgctacaccccgatcacatcaaagctcctaacctgccacccaaagccatcaccggtctcatagagctagaggaagttgacgagggataggaaataagaagatactccctccgtctcatagtataagaagttttagagttggacacggttattaagaaatgtaggtagaagtgaatgatgaagcattgtgattggatgaatagtggaggtaggtgggaaaagtgaatgttggaggtttgtgattggttgggaggagaatgttggtagagaagttgttatattttgggacaaatcctaagagctaaaaattattatattttgggacaaatgaagtaataactagtatgagcatttttggtccatatagaaatacggtatgaaaaaaactggtttaacaacacctcaaacacatataatggcataattcaaatttttaaaaataccattgacacggagccggtacaataaataataatgtttttttttcattacggtaaatttgtataccatgaatccgatcaacccaaatatattttgttttctggattattacatgacatgaacatgcatcggtagattttactaatgaatactttaattgtagtggaaattctattgagttaccatgcatttgcagctaaaacaataacaataaatgtttgtatctaaacaaccaaattgcaaattaaacaaaatagtatgattttgcggagtactacccaaatcagtagccaagaccgcactgtcagtctgtcgccctccaatccgttactcgtttattcgtatctcctcccaattattctacacgtttctttcaaattaaaatctccctaaactctgtcaaattcacggtgttttctggaaagggtggaacgctagttccgcaaaccagccaagcaagcaaacgtgtgcctctcacggcgcccatctcccgtccttaaataaacgcgtgcgccgaagctgcttctccccacaaaattttgtgtgtcctcatcccccatctcctctccaatactcgccactaatttcttctctctttctctctctctccgcgccctcgcatcgcacgtgaggcagtcgagggatagcggcgcaatggcggcggcggtggtggcgaacggcgcgagcggcgactcctccaaggccgcgttcgcggagatatacagcaggctcaaggaggagatgctcgaggacccggccttcgagttcaccgacgagtcgctccagtggatcgaccgcgtaatgctctcttccccgtctcgatcctttatgctgggagggatacggatgttggtttttgatctggtttagcgagaggggagggagggggtggcgttgatgcctacgtgctcgcgtgacgcgtcaaaggcttttggaatttcgccgggttttctgggcttacgagtggcgcttggctggtggattcgctctgttattggtatatgtgtttcctgatggtagaatgttaggagtatggagtatgcgagcaatgactagggggtaacgaagtaagtttacgtctcacatacagatcgatatggtgtgttgaattgcatagtgggtctgaactctgagcaacagagcgagtaatctctctctcttatctgttaacaagagtaggtgaacaaggaaggcagggcttttctaggctacagtgattgatcgatcaacttgttaggaaaagccggacaggagtgtctttttttacctacagtcgctggtgaagtagatcatataaagtcaccttatgaactttaagcatacggatttcatttctgttgtacaacagatcctttaaaaaattagtaaagctagccttttggacaccatgttctcttttatttgtgtgtgtgttggaggaaggggggcacaaaattcttgttgagtattttgatctttgcctaagtacatcttttggaatatttagatcgataaggtgaaaatgctgtgggtttccttgacataaaagatgaactcaccgtatgttgagttgttctatattgcagcaaaaacgatctatcaaagctgcatctccttaaccgtggaaagttaaaaagagctagttgtttttactactttgcatgtcaatatttcagatccaagctgcatctccttaaccgtggaaagataaaaagagctagttgtttttactactttgcatgttaatatttcagatcccgttggttagacagtataaatattacagatgttccttcaaaaataaagagtaaatttcactttgggccaccttttattactgatgtttcgctttggacgatcctttgaccaatgttttcactttaaaccaggtaaatcttgcctttgtttcactttgggacaccccaactctcttctcaagcatatgaatgacctcgagtatgccggctcatactcgtcaataaactccctcggctatatgtagatcatttctttgacatatgaatgcagatggataaaggagttgagggtggcccaaagtgccacaaaggtaaattatccggtccaaagtgaaagcattggttaaagagttgtccaaagcgaaacaccggtaataaaatatatataggtgaaaagctggggagcacaatacattgttcaggtgtattctaaaagttttactactttttactgttaatgacacaacagtagtagctaagtgtaaatgattggttgctgatggtttgtttctgttgtttgatttttatcctctacctattaccatttccatttccatttaccattgttatttattgtgtattgatatcagaatcatacccacagaaattggacatacagtatatttgagtatgttaaagtagttgacattttttttttatccggagcagatgctggattacaatgtgctcggaggaaagtgcaaccgcgggatctctgtcattgatagtttcaagatgttgaagggcactgatgttctgaataaggaggagacatttcttgcctgcacccttggttggtgcattgaatgggtaatgttttctccaaatgctatcttgtaggatgtttgttagccaagtgaagttatatgctaagtgtggcaccactgatggttctgcataattttgcagcttcaagcttattttcttgtgcttgatgatattatggacaactctcaaacacgacgtggccagccttgctggtttagggtgcctcaggtcagtagcagaacaatcatcctttgtatgcatcaatttttttatatatattgtttttttataactgtatgaattataatccagaattgcacaggcattgaaaaaaaaaggtcatgcattaagtaactgattcatgttcccttttttcaatccttgtaaggagtgtgatcagattagcacaatgttgaattgctatctgttacctataaaactaaatttgtgtatttcattgttttgcaataggttgggctcattgctgtaaatgatggtattatccttcgcaaccatatttcacgaattcttcaacgccattttaaaggaaagctgtattatgttgatctcattgatttgttcaatgaggtaagttgtatcttctgacatgcacatattgttgggaaaaaaatactgtacgcttctccctgatgcccagttgtatgtttttgttttgttaggttgagtttaagactgcttcaggtcaattgttggatcttattactactcatgagggagaaaaggatctcacaaagtacaacttgacagtgtaagttcattttgcatttacgtgtttgtttctttctttctttgcatgatttcctgtccatttgtttctaaaaataaggttcaaacaaaacaaaggaacggaaaaaataacagatagttccttttctgtgttccatgtgtagtttctagaatgagttgtatttgcactatattttattttagcagttcagaattgggttatgatcttcatttaatggtgttcttttaactgacatattgtgcagtcaccgccgcattgttcagtacaagacagcttactactcattctatcttccggtaggatttaccattctcctatggattttttccatctttaaactctcacttcggtaatctgcgaatagttgtcatcactagcaataatatttttctttatccaaggttgcatgtgctttgctgctatctggtgagaatttggataacttcggtgatgttaagaacattcttgtggaaatggggacatacttccaagttcaggtaccttttcaccttgttggttgtgaatttatatattactggactaccgcactaatacgagttttctcacaggatgattatctagattgttatggtgatcctgagtttattggcaaggttagtgtgcccgttgtggttgtactaatcccaatgagtatggctactgccaatcggtccattgctgtccaggcttattttatctgtagcttatgatctgatcagtagaaatcttaatgcagattggaacggacattgaagactacaagtgctcatggttagttgtgcaagctctcgagcgtgctgacgagaaccaaaagcacattctatttgtaagtattattaactttgtagtttttatcaacccatgggcaccatctgaatcctttatgtctaattgacaggaaaattatgggaagccagatcctgaatgtgttgcaaaagtgaaggatctgtataaagaacttaatctggaggtttgtcttaaccgttctctgtatttatgttatgtgtatcatcatcacctgagtaaacatatgcagacatcatacgcaggtgtgaaaaagaataattaccatcccaactcgatgaggaacaaaacttagaactcagttgtttttttaagaataagaaggaactcatttgttgaagatgcttgaaacaataattcagaatttctcatttatccattgcaagacctgaggcactgcttttatctgttatactgcaggccgtatttcatgaatacgagagggagagttacaataagctgattgccgacatcgaagcacatccgaacaaagcagttcagaatgtattgaaatccttcctgcacaagatctacaagaggcagaagtagagctaagctcatggagaagctgtttcatgttt

SEQ ID NO: 31959 - DNA, 9121 bp, Oryza sativa
aaatagcagggcgcatttcaaagtaagccctgtttgagcatgcgaattttaagtaagggcagatctagaaagagatattatcgtatgaaaagaagcttcctgtcacataaggtgtagtgtcttttgaatctttcgtctcgaatggttctatacatgaattgaccggcaaaactttgtgcagcaggtttggagcctgtgactcttgcacctctaatcgtttgccctacaacttataacctgttgctatacttaatttagagatgatttgttttctttccatagtttatttgttagtattgactttttaaatcgctagacatatactccataaattatttatttatttatttatttttacccataaattacccttttgttgcagataagtcatacaacttataattaacattagcctaattcatggcacccgagagatcatgtatacgtactccctccgtacttgtaaaggaagtcgtttaggataatgtttaagtcaaaccttgggaatataaatcatgaataaaaattatatgaatagatttgtcttgaaaaatactttcataaaattatacatatatcagttttcaataaatatttttatagaaacaagaagtcaaaattgtattttggagaccgtgtcgctgtccaaaacgacttccttaacctttttaaatagatacatgcacgcaacactagaatagtaaatcgatggtctcattaaattcctattgagatttgagagtgtattcacacatatatgtgtaatatttttggacaccaaaatttgaaccatcgtacgtagagttatgtaaccacaaatttaatattgcaccaccggtgttctcttggtatgtttttagataatgagaagaatttcattgaaatgaaactacacttgacctccatcaattagggatgcacacatcctaaaaaggcaaacatgaacatattgccttgcagcaactcgccctacacataattaacacaaacacaaagtattatgcacctattccaaaacaacatcttcaactcttttgtacaattttctctccttattaatgaaaattaactgtggggtcttcaagaaggtcaagacctatatgtgttgcggtcataaaaaaaacatgggtggatttttatttgaaatgtaagacaacaccttcaacaacgagacaacaaataagaactgatgttgccgaatctagatgaactagatcatagtttctgccatgccatcatcattgcttatactccatgtcactgtctagctaaagcgaatatagtaggggtaacaattgcccatggtgactattgttcgtcaaaaacatccgaagggtccgctcatgactagtcatggttgctagaccaatttcaatagtcgtcaaccaatcttcccaatcaagacggagatcactacccacgtagcaaccccatttgatcgccaacggcaaagaccaggcatcaatatcaacgtacaaccacaaggacaaagctttggtctcctctatttgcctccatcgagcgaatgaaagaaacattttccatttggaacattgaagaaggaaatgtaaaaaatcgcatggcttcaaacgaagccaacccacctccatcgaccatggcaagcacaatcaaattgaatcgattttgctccactgacatgtagtcataaactgactcaaaaacaccacaaacatatccaagtcacaaaacaatatcatgagaatcacatgtggataatctgttcagcattatgctatttttcaacttgaataatctttctagcctaagtaccttaaaattatagcatgttggatagggtgtgaatgtgtgtatctttcatgtaatcgaaaatttccaatatttttaccttatgtactttggctgacgtttttgtcttggtttcggtttctccataatgatcctcatgatgttaagttccaattattccaataaatggatgtagccttttcattgccacttaggctaagttcttatcccaatttttccaactcacatctctcgttttccgcatggacgtttttcaaactgctaaacggtgtgttttttgcaaaaaaaaactatacgaaagttgttttaaaaatcaaattaatctattttttaaaaaaatagttaatacttaattaatcatccaataatacgtattttgttgtgcgtgccggggaggagctcccgaagacagccttagacttcatcatctccaacatgcccatgtcaagctgagatttgggctcattgtacccattggcaataccaaaattttgtaggacataattagaaaggatatgttcatttggtgacaaaataaggtgcatacaagatcaatagatgtgttttatcaaaattttgataggacagtgttttgatggagatggtttgcttggtgggatagcaaatcagacaaattgttggataaaaataagttatgtatattgtttcattgctggtacaaagaaaataaaccccacaaaattcaaaagaagccacagaaacctactccctccgtcctaaaaaaagacaaaccttggtttccgtgcccaacgtttgaccgtctatcttatttgaaaaaattatgaagaaaattaaaaagacaagtcacgcataaaatattaatcatgttttatcatctaacaacaataaaaatacgaattataaaaaaatttcatataagacggacagtcaaagttggacacggaaacccagggtttgccttttttgggacgaagggagtaacgatttttcatccaaacttttgtacttgcccaatccaatttgtttgatcgctgcaattcaggtggtgtttggatgcagggacttaactttagtctctatatttagacactaatttagagtattaaatatagactacttacaaaactaattacataaatgatagcgaaagggcctgtagcctagtggttacaagagcctcagtagcacctgaggtcctgggttcgactccccgtgggagcgaattttccaggatttaacggcgttgtgctttcagtggtaggcgacgtacccatcgacagcgaggcgcctgtggtgacttcgtcaatctctccaggatttgccggcccagtcttcgaagatgctcgtaggggtagggtttgcgtgcgcgtgcattgtgagtgtctgcattgtactgtgcctaattaatctataattagaggcgcctgtggtgacttcgtcaatctctccaggatttgccggcccagtcttcgaagatgctcgtaggggtagggtttgcgtgcgcgtgcattgtgagtgtctgcattgtactgtgcctaattaatctataattagagaatgtttactgtagcatcacataggtttttttaagcctaattaatctataattagagaatgtttactgtagcatcacataggttaatcatggattaattaggcttaatagagacacatgattaattacgctcaatagagacaatttttttaagcctaattaatctataattagataatgtttactgtagcatcacataggctaatcatggattaattaggctcaatagattcgtctcgtgaattagtccaagattatggatgagttttattaatagtatacgtttaatatttataattagtgtccaaagatctgatgtgatagggaaatttagtcccatctaaatatgttctcaatattatgagtttctgacaatcgggtccgagaacccagagagacatacctgggacccaccgtacagtgggacaggagagaaaacctccccggatcctgcccctcctcaccgtctccactcccgatctccccgctccccgcgtcccgtctccgatccacccaaacacccgcaccgccgcgctacgcgagcacggcaccgcggcgcggcgcgactccgcaggcgacaagccgaggagaatcccgcgcccgcccgcccgcatcaccgccggatggccgccggccgtcgccggtagggcgataggcgggtagatccagatccggcggggcgggatcatatacaccccgcgccgatggcgggcgcggtgtcggcgctgttccttctggacatcaagggccgcgtcctcgtctggcgcgactaccgcggcgacgtctccgccctccaggctgagcgcttcttcaccaagctcctcgacaaggaggtaagcgctcgcgcatcccggcctctctctatctcctcgtcctcgtaggatctatgtggctcgccggtggcgttgcgcgctaagctgatgtgaaccaacagggcgactcggaggcgcactcgccggtggtctacgacgatgccggggtcacctacatgttcatccagcacaacaacgtgttcctactaaccgcctcccgccagaactgcaacgccgccagcatcctcctcttcctccaccgcgtcgttgatgtacgtatacccaccctggatcctgggacgcagatgacatgttcagcgttcagtttgttcacgaagttggtttgtgcatgagtgcaggtgttcaagcactatttcgaagagttggaggaagagtcgctgagggataactttgtcgttgtggtaagtaatggtgcaagcagctaagcatcactctggtttgctgcacaatctactggatttgacacaagatggtgtttgatttgtgcctgcagtatgagttgcttgatgaaatgatggattttgggtacccacaatacacggaggcgaaaatcttaagtgaattcattaagacggatgcgtacaggatggaggtatcacagaggccacctatggcagtgacaaatgccgtgtcatggcggagtgagggtattcggtacaagaagaatgaagtaagatacaggctcactctgttattttgggtagttttgtgatggtgctttccaaattatctaaccgatgtgtttccaggtgttcttggatgttgtggagagtgttaacattcttgttaacagcaatgggcagattgtgagatcagatgttgttggggcactgaagatgcggacatatttgaggtgagcctacaatgttattgtggaactagtagtatgatatctggatctgtaattcaatagggatcacatttatatgagtgaacattcagggtaccttcaatcggatctcaccaatagatgaagtgtccaacctaattgcccatttagaagaccatttatcagaaaattgaactgtttaagtgatggcctaagcaaacttttttactttctttatttgtgaagtaaacgcgtcatcttacttgctggttcatatgctcatttttcctgtaatcatgcatttaatatgtatttgtattccaattgttccattcttatgtgtgtcaaactaagtattatactaccgcttcacttctgaaatttcatgattttatcatgtagccatagtgtttcattgaccttttgcctttgaaagttttcaggaagtcttattctagaaacctcttcgtctctaacagattactgcttgtagattcttctgttatgcaactagatctatcataaatcttggacaaagaaatgaaagcatgctgaatgtcttttgagctagatcaatttccatgcaatactatctgacgactttagaattggttcaaagttcaaacgtcaactattgttatatgaatttgatttgccaaggctatcacgtatttgtataaagaactgctattgccacacattaaatcatcaaggaatttgatcaaggtagaaattcactctgtaagcactacctgggagatgtgccgcaccgtttttttctaatttttaaaatgtctatgcatcttttatatcccatattcagaaagaatggtggtctctcatatgatcataaagtgacttgcagttgaaagatggacatacaatttatgacctgggaacatcgatactgcatttcaagtgtttgatgttggccatacccatcacaaaatgttagcaaatacctctaaatgtcaattatagcttcggagcctacaaattaagattattaggatataagcaatgagagtgctttgcagattaccagaatttgggagtattccgtttaatttgtttcagatgtctaccttttagcagacattctgaactgatcatctgatgatgctcatgcgccatgctccccatcgaattatgttttccatctatgtttcaaagttcaaattatttgtgttatgctgtcaccccaaccatttatgttttcctgcacatctctgacccccactaatactgaacaatattgtgaatcagtggaatgcctgagtgcaaacttggattgaacgatagggttcttttggaggctcaaggccgagctactaaaggaaaagcaatagatcttgatgatattaaatttcaccagtaagtaaacagtttagcatttttttcaagtcactttgacaatttgagcagggccatatatgacctctctcttctgttattactaggtgcgtgaggttggctagatttgagaatgatagaactatatccttcatacctcctgacggatctttcgatctaatgacatacagacttagcacccaggttttctctactgcttgtgatttacagctattggatgctttagatacctgaaatgcactgccttgctccgctattctcatgcctgtctttttttatatatccttaaggtaaaaccacttatctgggtggaagcacaaattgagaaacattcaagaagccgaatagaacttatggtgaaagcaagaagtcagtttaaggaaaggaggtgagcattttacaagagcaatgtttgctgttacactaatgcctcttggaaggtgacatatttcctattttcacctgcagcacagcaacaaatgttgaaattgaagtgcctgttccttcagatgctacgaaccctaatataagaacttcaatgggctctgctgcatatgcacctgagagagatgcaatggtctggaaagtaaaatcatttcctggtggcaaggtaagtttcaagccaagtcatctttgccttctacttcatgctacctagaagtgtgctaatatatgtgagtttttctgttaggattacatgtgcagagctgaatttagtcttccaagtataactgcagaagaagcagctcctgaaaagaaggcaccaatacgagtgaaatttgagataccatatttcactgtgtcgggtattcaggtaatcaaattactattgcaaatatgtacttgattgctcttatggtacttctttgctatcttcactcaaaatgtatgccatcttgtattttctgcaggttcgctatctgaagatcattgaaaagagtgggtaccaggcgcttccttgggttagatacattacaatggctggtgaatacgaactgagacttatatgagttatctctgatatggctgctcaaagattttgatgctaaatttcaactcccaagatacatgtttgatgctcgatatacaacatatagttggcattgggacgttgccatggaagtctttgaaaagctcaaccatgcaaggtttttctgtctcgttgttcatcttgttagtgttactttaccatggttactgtaagttacccatcaagtatagctttgaaaaaaactttttttttgttcacttgtatcattattgatttatttttgtgggtgtcgaactttcccccttttgtactacacaaaaatcttgagctgaattggtataaatgaaatacctgggcggtgcttttgaagtccagattaaaactgctgaacctgtagaactatttttaaggcatgctttctgttgtgtacctgcacagtgacggtttcctatagcagtgagaatcagctattcagagtttcagaccttacagggtgttgatcatcttgtcaatgctgtttccgttcgtgatccattgttgccacatgccaacattcttctttatataattatattccatggcttagaacaaatttcgtgtcgttaaggtttgcttttttggttttttgagatgtttatgacgttcaattttggtgattccaagtctttctgtactagctagactagctgggccttgtaaagaacccactttatccaatgacactatattcccaccttcgcagtagattgtttcgactcgttcaggtgtgtttacaacccaaacccgtttacctttccatcacgacctttttatagagggatgatttttgtgggattgattttggatcgtttcctagtactgcatgtaatccgttgaggtagttctggcctctgggtagttgacacctctgcggctctgccacatcgatctttgtctaacgttttctcaacatctcagtttactccgctgtggtttgcgtcgtctcgccggcctggccaagcgaatcgagggatcgtcgcatgcgactccctcgtggcatcgtcgcgaccctatcaatcgataattaaaggaaaaagtacataaaaggtccctctcaacttgttatcatcgagttattataaaatcatctccgactataaaactggatatatgatatccctcaatttataaaaccgttcactttagtttctttggtggttttgactataattttatgtaacatggcgactgagtcagcgtgagcccccatatcagtatgccatgtcatcaccctctctctcccttccccctctctctctctctctcacttttctcctctctgctggccggccgacgggtgggaggaggtcgctggggcgaggcgggagaggaggaggtccgacggccggcgacgcggcggtgggtgacgaggtggcggctgcgacgcgggagcaggccgctgcgcctgggtcggatgttcgaggagaagacgggcggcagctggaggagactggaggcgcacggcgcggccggtggccaacggacgcccgccgccatcgccgcgaccactggacgctcacactgacatggaagcggtccccgaggtcaccggcgtggaccccggcgacgacgaggtgagcgaggatgcgcggggtggtgggggcggacccgtgtgtggagaggcgacggaggcggcgggcgacagtcgacgtcgaccatatggaggcggaggcgcgctgtgccgctcctggatctcggccaccacgccgagcacctcgttgcggccatct

SEQ ID NO: 31960 - DNA, 4236 bp, Oryza sativa
  unsure (1)..(4236): unsure at all n locations
gatggcatgtgggtcccacatggacccatcatttttttttattttctagtgtaactggtacatgggccccactatttttattttttttcgacttgaattaccacgtaagcgtcacgtcaatacccatggaataaaggcctagtcaaagaagccacgtagacgccacgtcacccaaatccaaagacaataccaccgaaggacctagtttgcactggttttgtaagttgggggataagttgtatccggttttgtagttcaaggatgattttgtaattgggtgacaagatgagtgaccttcgatgtatttttccataattaaatacttaagggtgagtttgaggagaaggagatacgcaaaacgaggtgagcaattagtgcatgattaattgagcattaactattttaaatttcaaaaatagattaatatgattttttaaatcaacttttcctatagaaaatttttgaaaaaaacaccgtttagtagtttgggaagcgtgcgcgcggaaaacgaggtgttttctcaccagccttagtatgtactgtattggaccaataatattttttctaggtcagccactgcatgcgggcttgacggagctcgtggctcctcaccgggagaccgcacaggcccccctttgccggttcggccgggggcttagggtgaaatctcaagctctctcggtatgtggaaagatcgccagctaggaagaaacgcgagacacgggcgatgtatacaggttcgggccgctgggaagcgtaataccctactcctgtgttttggtggatttgtgtatgaacaagtaataaagtgtcaaccagcccccaatcgctctgggatcggatctggagaaggccttgtgtccaaaagtccccccctatctaagtgggcaaggtcctccttttatatctcaaggggataccacatgcccctctccctctccaaactggactgttcttctcttcataaatggacggagatcggtacggttgctctccgggtgcccttctgacgggacggcccatatctacccccacttccgccggaaacaggtgcgacgtgggattatggctgtctgttgatgacgcgaccagtgtcagaccggtcacagatcagtcatccttgtccaccacgtgtcagcttagcaacgtgcatgtttgcccttcttcatgtagcatcttgcctgtaatggttgggatgaagcctggtataaatctaaccagggctaacgtgccatctctaagagattacacgctagctccggcttgagacgagtgcctagaggctttcgtcttgacgggatggggcaaggcgtgcgtcagaccgccagtcgccacctaacccgtgatctgaccggtctgtgactggtcacagaccggataaaggaacgcgctgcactacgctgcatgcagcgtgacacgttcgaccagaccgcaataaatgtggttaggtgaggcttaccgtgttcacccaacccattcacgtggcgctaactccacaaggggtcggggcgcctcggccctcggggccggggcaggagtcacccgaccccccctcggggaaatcaggaggagggcggacacctcaccctcgggcccgacgtccccgaaggtgccaggccacgtgggcgattgtgtctgcctcaagcctctggtcacgatactcccggtcccatatcaccgacagtagcccccggcgttatgccagggcgatcgcccttctcaagggaagcggtcgggcgtgacgccactcctaaagcctggtgacaggtgggaccggtctccatggttgggcagaaacccaacggtctcaaaccatgcacatcggtaatggtgacttggctgtccataatgggcggtctcttcgagactgccacattacttgagcggcgtacgaatctgggtgagccgatttgcttcgcctggagatatggtaacgtcgcttcggtcggcgagcgtaattaacgcgcgcacgatacgatctatctcgactgccacaaccgcatatccacctcatgcgccgcaagcgggcgaatgggattagtggaagcgtgggcacgagaaacgagggagcgagatagtgagaaacgagggagcgagatagtgggcgcgagaaacgaggagccaggcacagcgatggcaagggtataaagacaccgaggaaaggatttgctcccttcctttcgccattattccccttgccttcgctgcttgagccctaactctttctctgctgcgcctttccttcgccacacgcgctcgttctcaatcatcccttcctccggcgccatggcacggggttccgctctgctcgacggaagcgtacttccgccttctcgcatcgtgagcgagaggcatgccgggctgccgcgccgctttatgccggaatctgccaccggccgggagatagtgatgctgggcgagggacgcccggcaccagactacccggggcggtccgtcttcttcctccccttcgcaatggcagggctggttccgccattttcttctttctttatggatgttctggatttctacgatctccagatggcgcacctcacccccaatgcagtgatgacattggccatcttcgcgcacctatgcgagatgttcattggggtgcgcccatctcttcggctgttccggtggttcttcaccgtgcagtcggtgtcgccgccgtcggtggttggtggctgctacttccagccgcgggggccggtgttgaaccgctacatcccctgcgccctccgcaagaagtgggacgactggaagagcgactggttctacacccccctcgccaacgaagcgcgcctccgacttccaagtcagcccccggcgcaggtctccagctggcgggcaccggtagatctgggggatgactatgacgccgtcctcgaccgcctggcgggcctgcgatcccaggggctcacaggggccatggtgtacggcgactacctccgtcgccggattgcgccgctccaacggcgcgcccggggcgcctgggagtacaccgggtccgaagactacatgcggacccaccagggagtcagatgggattgggctcccgaggacttcaagatcgtggtccaacgggtgctgaatctcagctccgtggaggcgtctctcattcctcaaggaatcctccccctctgcagcgatcccgaccgcgcctccattctgaccattatgatgggggtcggggcctcagaggaggaaactcctaagggccacgacggcgcgggcgagagccgccggggggaacaatctaccccaggagggggtcgtgcttctgggccccgcgccgggggctcggggagcagccgccctgccgacgcccaggggaagaggaagctgggaggaacacctcccccatctcctccccgagggggcggggcggtgcgtgccagcagtcggcacccggagggggccgcgccgacatcgcagcccgagggggagcgcaagaagaagcggctccgcaagatgggggagacggaaccatcccggggaaacctgatttcccctccaaggtggtcatttaaccgaccccctcgcaggttcgtcccactctcattgcgaccgtctttcttttatcccaaaagcaagttttctcttacccatcttgttcgtcttctggttttttcttttgcttcaacgatgtcccgtcacgttcctcccgccatcccaagtccggccagtccgaggccgaagatccggcggccgcagaggaacggaggcgagaatctgaccggcgagaggccgcagatcgccttcgggaagctgaagaggccgcccgggaggccgctcgggctcgccatgcagaggataccgctcgggaagaggccgcccgggctcgccaagccgaagaggctgctaaggaggaggccgcccgggctcgtcaggctgaggcgatggcgtcttccgaggcagctcacgacaaagctgcgggcgcgtcgcttgggcccactccctcgggcgacgctcaggcgacagcctccagggcggctcgcgacgaggccgcgggcggatcgcctgggatcggatctggagaaggccttgtgtccaaaagtccccccctatctaagtgggcaaggtcctccttttatatctcaagggcataccacatgcccctttctcagaagggcacccggagagcaaccntnccganccccgcccattcatgaagagaagaacagcccagcccggacagggaggctggcgagctttccacataccgagagagcc

SEQ ID NO: 31961 - DNA, 1324 bp, Oryza sativa
ccccccctcggggaaatcaggaggagggcggacacctcaccctcgggcccgacgtccccgaaggtgccaggccacgtgggcgattgtgtctgcctcaagcctctggtcacgatactcccggtcccatatcaccgacagggctcgtaagtcgtaatgcctacctttgtcagccctgctcagcccctgcacctaattacgatcggcccatatatgttgggtcagaacgggagcgtggtgtatgttaggcttatttatactcggaataggttcactttagatttctcatttgacatggagtttccgtttctaaattgaaatactagatataacctattccttaactaacaaaaccggattactgaaggtcccatgaaagcagtattccttattttgtctaacgtggcgagttgatcgtagtcaacaacgctaagtcgacgtgggacctacatggaactcgcgtgttatggcccttatctccccccctccgctctgttcccatctcaccagggcggtaggcggtgaggaggatggcggcgagcggtgagaaggtcggtggctggcggctggcggtgaggacaacggccggcgggaagaagctagctcagccatttcatcccccaacccgcgccaaagccagtgctgactcgacggccggatccactcggctgcaagctgctgctgcttcgggctctaggaacggctgctggtgcagggttagtcacacaacgtccgtcacgagcaggtacgacacgcgacgatgagatcgctgtggaggaactagctcgacggcgagaccattttactccctcacgacaacggctcgccctttttacccatcatttccttctcattggcatcaggtggggattagggagcagctcggcgtcggcaacgaattcctatgatgccaccaccccctcaagctcggctgcaaccggcaatatccttccagagaaatactctacccctcaccgcctgttcgcatcagcgcctcctcctcgcgccccttgccacccaaacgcctccctccttgctgatgcgctctactcggtgggccgtcggttgagcttggcccagcacttgagtgggaggataatgcgttggggtcgacttcgatatccctcgttggcaccctccacctcctgttgtcgtcccctgaccgcctcttgcatctacgcctctaggtgttgggcaacgctgtgctcgctgggaagcaccatcgcaccgttgtctaggaagcgtagggccacagcggagaggaaggagacacgaggaagcggtcgtcgcgagagcgtgctgctacgggcggagcacgacgcagagg

SEQ ID NO: 31962 - DNA, 683 bp, Oryza sativa
tcgagagctatcattcatttgaacccgcaagagctggaatgacaatatataccgtccataggccctggaaggtttagaactgatatttgggtccggcacatctgatgatctgaaggtttctgaagcaagcagattcaacattaatagtcaaactgtatgtcgtccgaagaacaccaatgcaaattttggaccatctcagcactagcagtaacatcgttcagacaatacaaattcgagcctgagatccaggaggcgacatacatacactgtacaggatgaacaaaaccgaggcaacgccaaatatatgtacaacgactaaggagcatttgtgcatccacgaacaccactactcatctcatctcaagagaaaataaaaaagaaaaagaaacgacacgcaacttccaagtgtcctatatccagatgcgacagtatttggtcaaatctggagtgaaggggcattcaacatctgtatgatgtattcctgtgttcaggtattagaatatcaacgagaaactcttgctttaacagtcaaagaatgggcgactttctttcaagaacacgatgtgaaacatgcccagtccaaagaatgagcgatgctttctgcgaccagaaacatacaataaacatgaggaccaaaacaacccaaccagaatcaatccaaaacttattctagaaattatgaa

SEQ ID NO: 31963 - DNA, 6078 bp, Oryza sativa
  unsure (1)..(6078): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatctagatccggtttcaattttcatttgtgtggtcgcatcctttaatttatatagcttcataagagtatactccgaagtacatgccgttttatgtatttttatgccttcatattctgattgtctaatggctctaaaacaacagacgtaaactacgatgtctgaagttttccatgttttcttccttatgaaaatgatatggagctgtggcaagctgctttggcaatccctgttgctgtccagagtaaagattttcatgtggcttgcgctaaagggcagatgcctcatggctgacaatctacagaaaagaggtggcctcatcaggcgaattgttccctatgcaacctgacatttcaagatgacacccaacctttttgttcaatgtgctttcacaaacaggatttggagattgctcaggagctaggtgaatgttggctttccgcttcccagtgacctcaatgtagacttggctgattggcggatggcttcaaggagaagcttcagagattatctcagaaaagttttcggtacactcttcttcagagattgtctcagcaagttgtatggttgtgcagctctttggtgacatcaaagaaatcacaatctggagggaggcaggcttcatggtaggcgaaaaacgattggcattattccttttgcagttttttctctcccactctttgtaaccggtttcgacaacttcgtgtggacgcttagtttgtaacaccatctcataatcttaatgaatttgcttagcctactcttgggccagtctggctaaaataaatgtaatcagagttatacttcatttgttggaaacataacttgtaaaataaaactaatcatttttatccttacaaaaggctgctcaatgctgcaataatttatgttgaaaaaggaagtggcaaaacagcatgtcttttgctactttgttctgtctgtttttcttgaagaattctctaattttattgtgattagtcttttgaaaagactatattaaagaaatttcttattttgttttggttatttctatatgcaaaaattaatagctctataaattcaatagttgaagagaagcaatgttcagaaaagttgaatatgcacttgatatatatgtgttaataaattacctttcaaagtatgtgtactttctaatttttaaatgtgactatatattttttatatatattatgacaaacgtgttttacatgtgcacgataactagcaatctctaaagtaaacgtatattgactaagaatctacgctgaatggctctattttgaaacgtggatatatgactatatgttacataggagttacaaggaaaacgaaagaaaaaaaaagacgcagcgttctagaaaagtgtcatcgagcccattggttttgtcgcaaaatcgtaaatgttattgccaaatgccaatcacatcgtggtccaaagcaaaacacacatttctgcgagtactttaatcggtgagcccttgagacgttaactacacgaaacacacatttctgccgcccgacacttgccatggaccagatgaccaaaaaaatgaagcggttagtgtggtgcaaacaaaacaagccgctttacatgtgtttcaagactaaaagaagaatagttttgtgcaagactgtttacgctttcaaataaagacagaagcagtgaaagtgctttgcttgcagagaattgaagaatgccctagcgcgaagcagcgcatgcggcatgcccccaccagaaaccggaggaagaagactagcaaagccggatcgagatcaactgcagtggtaatagcgactgcaactttaaccgttgttgcgtgactgtcagatcaaagaaaatggctcagattcggtcagggtacacagtcgtgtactgtaaagctgacagcctggttgtgtcgtggcgcagctctctatcgttcatcagcttaatttgatggttgtggatgatatgactgtttaacgtgcacccgacctggccgcgagcacacagctttcgctgcagtttccgtccgacctggccgagaccggccatcgaccgctcaggcttggataaaaaagggccggacttgagcatcagcggcggcagagcggcaaagcgcccacggaaacgatcagcccgtacgtgcaaattgtgcaaaatataaatcggtcatcgtccactcgtcctatcgagacggccggtccagggtggcgccctggcgggcggtcatgcctccatcaaataagcacagatgcctatcttgacagaccgtattagtatcgcgaaccatatgtgatcctcatactaccgcatatctgtatgcgtgcactggatcagtgagtggctctgtgtttataacttagggttgggaacccatctcatccgcacggaaaacggaacagttcattagggcgtgattaattaagcgttagtttttttaaaataaattaatttgatttttttgagcaacttttgtatataaattttttttaaaaaacatatcgtttagtagtttaaaaagagtgtgcacgaaaaacgagaaatttgagttaggagcaccgaacacacctagtaagttccacgccaaaaccggaggaacattcgtaccacgcgtatgatgctgaatcctcacgagataattttgccgtacgttttactcgcaagtgcagtgcttctagaacaaagtggtggctctcgtcttcccgacagcgacgcgcacagtgataggatcgtcaagcacacaatcaggcggccgcttgtactgaaaaccggacgctttgctgcgttagcatcgccattattcggaccccgcgcgccaaccatgtggtgtcgttcgatcaccggccactgtctccgcccacacggccggagagaatccctcgccgcttgaaaaaaatatctctattccccccggtattgatagctcgcgagccgcgactcgcaagtcgcaactgaccacaggaggagacaaacaagacgcagaccttatggaccttatgggtgatgatcttatctgattcgactagtcgactagtcgcactgattagactccccttctctggtcccatcgtcgcgttgtttggcggcatcagcagttacccgaaactaattattgcgaacacgacattattgtttttctaaaacaaaatcgagatcgcaagttcgcgacgaacgctgatagcttcagttcaggcgcgccggtgcaacgcgcaaggaaggataacccttgccgtcgcggtcgtgtgatcgtgtcgtgcgctgcactgcactgcactgatcaggtcgcgcagccgctgacgtttcgttgtgtcggctccacccgtttgggtggatcccttccgaattccgatcccattggtcattgaccaccgggctggttgcccgcactggtcttgcccttttaagcgccggcgcttccgtggttggctcgccattccagagctcgaggtggagatcgcggggagaggaagcgaaacaacgataggaggaagcgagacaacgagaggtggtttctcggttgcgggtgagtcgtgttgaagtgagctatggtggcgttggagatgtgtgcgggagtgggagttcggggtcacgagttgaagcatgggcggcagcggcacgaggaggtggggagtgaggtcgcgggagacggcgtggcgtcgctcggggagatggacctgtacggcgacgtgctcgagtcggtggtggagcgcgtgccggcggccgatctcgccgcatcggcgcgggtgtcgcgggagtggctccgcgcggtgcgcgccgcgctgcggcggcggccccggcggctgccctggctcgtggtccacctccatggccggcggcgccgcaccgcggcgtacgacccgcactcgggcgcgtgggtcaccgtgccagcagcgcgccacgacacgccgtcgcacgtccgcctggtgcggggcgcgggcggggaccgcgtctgcgcgctctccctctccgggctcgccgtgtccggggaccccctcgggaaggacgtgtgcgtcgcgctgaaggcccccggcgtgtggcgcgtcgacccggtgttcgccgcggtgggtgaccgcgtcgtcgccctcggcggcgcgtgccagttggcgctgggcgagggcgaggacgcctcggtggtggaggtacacgaaagcggcagctggacggcctgcggtccgatgccagccgagctgcgggagtccgcggcggcgacgtggctctcggtggccgcgacggatcagcgagtgtacctcacagacagatccaccgggtgggcaagctggttcgatccggcgaagcagcagtggggacccacctgccgcctccgccctgacgccaccgtctccacatggggcctcgcccccggccgcggcggcgccgagcggctcgtcctgttcggagcgaagcgctgcggtagagccgagcaagcgaagagcagagtcgtcatccaagcgtgggaagtggacggcgacggcctcgcgctgtcccgtggcgcggcgcacgacacgatgccgggggagatgtccgagaggctgttcccccgtgacgaggacggcgatgaggaggacgaagaggagatgtcgccgtcgatcggggtgtgcggcaacgccgccggagggtacgtgtacaatgcggccgacccgacaatcggagccgtgctctacgagctacgtgacggggtgggcagcgccgtggagcgatgggaatgggtgccgtgcgcgccctcggtcgaggccgagccgttgggacgcttcatcctcgcgtgttcgccggtggggctggacgagctcgcgcgtggtcaaccagccgcatgtacaaccgcacagtgaactcatgactgccgacgcccgtccaaagcaagttaacctcaaaggttgcttttgtaaataaagtcccgcgcagtagcacggctactcgctagcgtacataaaaaattatgttaaattttctttacacatgattttcttagaagttattaatagttatcccgttggcttataacattataaaaagtcaaatattggtttccaagtcaaaccagccaccatcttttactcttcttctcatgttacccttttatttactcgtgcgatttgtcacaacttttattgacttttcatgagaccattaaaaaccgtaccttataacttttaccgttcattgtatcgttaacgttaagttcccttttattgtttcgagaagtcccatcaaacgattacattatactcatttatggataacccgttatcttttttttattattatcattcagtttttaaaagttgaacatgtt

SEQ ID NO: 31964 - DNA, 8875 bp, Oryza sativa
ggataaaaaaaaataggcctacctatttttttttttggaggggggggtttatagtttttatatttccattattcgtcacgatactacttttacggcttgcccgctatcctctcccttactgacattttcccaccgttgtgttatatagatgaactactttgaatgttccttgttttcctttatttctacatgtatttctactttgaactctgaatttttttttctatttctagtttaggaatttattttttttatttaaaattttggttaatcatgtgttgtgttctatatggtatttttttcattatttattatttttatttcgaaattcagttatttgtaaattataattatacttgatgcttaattttattttttaaattttgaatttatcttattttctatttgaaattttaattaatcttgtgtcgtttctagatgatctctccttttaatgtttcctttttttatttctcattttagttatttataaagtgtatttttacttgaactcttattttttatttttctaatttcataatgtattttttttctgttttttaaattttagttaatctcgtgttgtgttctaaatggaatgttttttttcaatatttcttatttttatttataatttcagttatttttacattgcattcctatttaaactcttcctttttttccctaattttggaatttatttaatttttaattaatctcctattgggttttgtatgaattgttatttcaatatttcttatatttagattcgaatttcagttatttctgatttgtggttgtattggaacactctttttttctaaatttggattttatttaatttttattttgaattttaattaaaagttgccgggggttcttgaatggacagttctttcaatagtcctttttttttatttcaaattgtatcttacttgaactctcttcttttttttaaatttcagaatttattttattttttatttcaaatttaattaatcttatatgggtctatatgtactctttttccaatatcacttatttctaattctaaattttagttttttctaaataaattctacttaaacactcttttttctgcaattaatgtgataatttatagcgttcatggtgaacatggtgaaaatgtattttaataatataatagatgtcgttccattgtgaaaatgtattgctttgctgaaagttgctgcagtgttttgcatagtttcctcgaactcgaacctctctgccatttttttcctctcgttttttttttcatgttgaacattcgtatagtgacaaaggtgagggtgttcctttctgtaactttatttaagcaggaggtaaagcagtgaagtgacatatgcattatcttacacattattgctttcatgtgttgggcactaaaatctcggcttcaaagttaaagtcttggcaatagtgactaggggggaaacaatataatgataaagtttggaagactcgattaagacatatactaactcctcttttactgttatttcacagtggcatcgggacagatcgggtgcatagatccgatctttgaccagtgttttgtataggaagacaagtccattttaacaaaccacccacccaacccccaaatattactgttgtctaaaacactttcccaaactttaaaattggtcatccaatcttaactatcaaaatcattcaatttaacccatcttattccaaatcagccggttttcgcttgcgtagcatttgacatggcattcccacgatgataatggtctctgcaacaacgatgacttatgccatgtgggattggtgattttgggtttttttttcccatgaatgtggatttaggattttggggagattttgcaaatgaaaatacaaatttgggtgatgaaaatccttatcatatgcggtcaccttaatcaccctgctagtgaatttttttcattggtggacgtcataagctagccgcatgtgaagaatatatttcccaggcacagaggcatccgtcagcgagaagtttgtatttttcattgacctttggttatcggcggcaccgcggtcgctaacgaaaactcattttggacgtcagtgtaaacacattttgtagtagtgggaggcagaagaagaggtgtttgtcaccgatatatgggcctgtgattattatttttatttcttgactaggcagttacatcagctcacgtaggcaaaaatcggtgaaaaccgttttgagggtaaagtaaatggcattaaaagtttaggatgtcaaataaccggtttcaaagtttaggagagtaaaataccctatcgaaaaagaaattgcaatagccattgaaccggtatcaattccacatgtggtgctcgatgtccatgcaaagtgaaggctgttttatcgcgaatattagtgaatgacctaatatcacataattagaaggggtgaggcttcgaacccaggtcgtctagcccaccaccttgtggagctagccggaagacccctgtgcgtttctctaaaggttgttttatcattctcctgagtacctgtgtaacaaccacttacctgtagtgtttaattatttacagacttcacagcgcgtgttgtactgcacactggactctaaatttctcgcgcgcgcacagacagtatatataggatattcatatgggactccatggtgcccgggctccaaggtataaaacacacaaattctctcaaatttttaaaaattttcatatatatatatatatatatataatatgtgaactatcacactatcacactatgtgaactatcaatatgcctgcacattatcttattcgaatgtgtgtgtatatacactacgactaatggtaaataatactccgtatgcgactagctagagttggcgaaacaaaagatatattagaagcaagttactaccaactatctgacgagaaaagactgttggaacagacaacacaccatccttattctaaagagcaaaaattaagccaagcggttgctaacgattgactaatcggtcattatatctgcgacagtgccaccaggtcgtggcgtggaataagttcattacaggtcccttgacttgaaagcaagttcgattttcgtcttcgaaccataataccgaatacaacagatctttcatttgcaaagattggtgcaatattggtctcaaagagacggtttatatggcggtttcaactaacctagcgcccacgcaaacaatttaacttggtctttatctgatgtggcacatgaagcaaaatttaacaattcaaacattaaaacaaaaattgtaggcccatgtgccagtcaaacaataagattaaaaattaatattacccacatattagtgggcccatttcctccacctaatcccttcctcgacatgtatggccacgcctctgcgctccccattacctgacgcctaccgcgatgccaagtcctccctctatgcctccgcctcccctggcgacaacttcaagcacatggaggccaacacctagggcgccgctgccgacaaccattgaaaggagtcgtccgactactgtaccgccgtaccgaacccttcccccacgtcgacgacttcctctcctccccttgtcgacgcaccattagcagcgggcgcttccaatgtgtcgaaggactcaactaagaaatggtatggacttgtggtcggtgtggtaatcgttgcatcgcagcagggtggcgatctaccgtgccatcacttagctcctcaccggtcaagaaaggaagcggatcgagcgcttcaggatcgagctctgcgttccagatccaggccctatcaaactacgctcctccacttgctcggcctccgcctggccgctgggaacgatatccacaccctcatcactgatatggatgctgacgacaacgggaccatcgagttcgatgagcttgcctcctcccgccgcgggcttgtgctacacccaccactgcaatcgccgccgccacctcactcccactggttatgttgccgccaccgcaacagtcgtagccgatgcgctgctccccatgccgccacgcatcgaccgcgccacacggcaccctagggcgccgcttccgtgtcgtgtgccggaagcacacaaggacgccatggctgcctcctccgtcgctttggaggaggaggggagaagtagaaggggtggatatagagaagagagaggattatggtgagggagtgggcccactgacatgtggtctcactattttttaatcttattgtttcactaacacatattgttaggtccacaatttttgttttaatgtttaaatttttaaattttacttcatgtaccacgtcagatgaatgaagaccaagtcaaattagtcacatggacgacacgttagctgaaatcgcttgggacaaatatttcatttgttttgacggttaaaggacccgttgtatctgatattatggttctaggatgaaaattgaactccttgtcaagttaagagacctgaaacgaacttattccttatggcgctgccattgtgggtaataggcccagactaagccctttgtgtagtggggtgtgggccagtgcggcccattaacgttgaggacagggcccagcaaaagcaacttgcatttccttctttttttcaggcaagttgccgagttgggcgctgcccagggccaacctgcggacctgcttggaaccctagcgccgcaatgcaaagagcaaccgttgcctcagcctccctatataagcagagcacaagccgggggtcttcaccacatcccctctgcttggtcattttcagctatgggtggtagcattcatcttggtatcgtcctgcagttcttagtgagaaacaggtcaaagctctagatttgtggctcctggcttctattttacttgagtttgctctcctttcttgtggctcttctgttttgtttttcttttgatttttattaagctagatttatcatgatttttgctgtttcacggtgagatcttgttgtgcttgtgtattctggtgcaaaatcttccaatccggctgcgacaaatctcctttgggcagcccggccaccttttgcacagaaggatgggctacgtgtgttaaaacattagtggcaagtgctttgcctcatttccatcgtggaggattggagttcatctgtttccagtcctcccaatggagcaagcgcacatcttgtcttgcatcccttcaatttctgtctttcataggagtatcacttctgagatctgatgaaaaaagaaacctttctgccatcttttgagttttccctgcttttctcgtgaaggatggtttatctctactccttccgtccaaaaaaaaaaagtacttatctttatatctgaaattcagtcagaggtcaggaaaactggatctgaggtaatgttcgtacatcagtggaagtaaaactgtggcacagtgcagctttgacaaatgacatggtccctcgtctggaactattcaatcattcaaatactagtactaataaaaaaggaacatgtaattttgcgtgatactactaacttgctaataacatgtagcaagggtttgatgaccaaacttcataaggaaaaaaatttcatacgcttgcaaggagatattgatttgcataaactgctgttccgcagttgtcaatagggaagccagcatagcagccacatatttccaaatcgctttataagttacatacaactaatgaaaatcttgcttgcgtctaggctaattagatctatacaaagggtaccaaatccccgagtcccagagcaatagagcatattcgcgcagaatatgccttttcaatctctgtcccaagatccaaatcttcaatgaacctcccccactcgataaactaaaaacgtttgactctgtcagaataagcaaattgtgacaaaaaggcggctgcaccttggccgtgtttacatttaaattttcttcaaactttcaacttttccatcacatcgaatatttgaatacatacgtggagcattaaatatgaaaaaaaaattgcacagtttacatgtaaatcgcgagacgaatcttttgagcctaattacgtcatgatttgacaatgcaatgttacaataaatatttgctaatgacagattaattaggcttaatagattcgtctcgcagtttacaggcggaatctgtaatttattttgttattagtctacgtttaatacttcaaaaatatgtgtccatgtaattaaaaaaaattgacgcacgcaactaaacacagccgtaatcgagggctgtaaagtttacataaacaggaagttctccaaagagaaaggacagcaggaaaaggctacaacatgctgactgagcctatacttttctatttgcaccatttgctctgcacgtcctttggtggagcataaatgcattttcacaaaccaggccctatttagggcgtgtttagtttgggaaaagaaaatttttaaatgtcacatcagacgtttgaccggatgttggaagggattttcggacacgaataaaagaactaattttcagaactcgccggaaaactgcgagacgattcttttgagcctaattatgccatcattagcacatgtgggttactttagcacttatggctaatcatggactaattaggctcaaaagattcgtctcgctatttcctccataactatgcaattagtttttctttttatttatatttaatactcgatgcatgtgtctaaagattcgatgtgatgtttttgggaaaaacttattgggaactaaacgggcccttagattctaactttttttcttcaaatttctaacttttccaccacatccaactttcctacaaacacaaacttacaacttttccatcatatcgttctaatttcttcaaacttctaattttgacgtagaagtatacacagcctcaatctagtactcaaggtttaccaactggcttgtggaatcccagaatttgatccacaagaacacgttaacacgctagccctacgcccctacttgtacagtgcgggcagttcatctctcttgcagtttagtttcactgtagttcctaccagttagtttcactgtagttccccaaatgacgatgcacacggtttaatccctagaccaacagtaaactttgcagacattatcaactgggcaactggctccaggtaaattgatttacaatatggagactgtacacataattttaagtgctacctcagctgatagaagttaagggtctggaatgtctgaagagggaagaaacctcattaggaaactcgatagagaccatacgcagataaccccaagaatctggaggacagtcaataatgctcctaaggagttcatgatagccaaggtttggtttgttgcctctgttcctctaacagaaaaggtgagtgctgtcaccagctgagctgccctgttcagttggtgaagcctgtagatctgcaaagacgaggaaaagagtaaatgacatatgcttagaaatggagcagttcacgagacaaataacatcaacagatatctaattgttcattatctgcttttactgtgcctcttaagcgattcactcaggcatcttcaagacgctcgtgagacaaacaatatcaactgatatttaattaaccgtatagtgagcttcgttccagaaataatcacaaaaaatttctttaaaaattgtgaagcaacctcctggttcgtttgaatgaacaagagcaaaatagatggtctgcaactctgcatctggagatacaatggacaaaaaataaagctgatacaaataaaagagtgtcaattgtaacgtgtaaaaagatctgatgcctgcttctatatatgcctatgtaatcggattttttgtgatttaacacactgcaacatatagtttgggcagactgaaatcacaccagtgcacacttgattataaggaaagcacaatggattaagcttttgtttcaggatccaatagcaccaggataaatataagcaccaggttaccttaaagatgatagggataactggccaagaaggtgatttccgatgccgtgcatactgctcgaatgcgaattgtacaacaagaccaaccagataaggggcaagagtagctgaagctgctggtccagtccagggccagaccattcccatggtcaaaagcggtatcatcaagctcaaaaccatcgttgttactgaagaaatacggaaaaatctggattttgaccagatataactcttaggagctacttgctgcaaaggcctccagactttatcaatcaacaggacaaaaattgcgactcctccataaaatagagcctcggtaaagaatagtataagaaaatctgtaagcaattatgaaaaaccatcaggttatgctgccatgcttaggcttcatccaaatgtggaatgggaatcagggacatctagtgtcttaagatttaagagtattagtatatacataaaaatctttaactaaagaatgctgcacatagggttcagtttaaacaaaaaatggaactgttatgagatatgtttgaatagaaaaatataaatttaatgtagaataacctattgtcaatcaagcactaattagtcatattccttctctagagtagtgcaaatacagacacatgggatatgctagtgctaaccaacacaattatcttgtttccgtcaactattgaagtatcaaagaaagcatacctgtcaacaaggaatcctcaaacacagctgagagtactttgcgcaagtaaagcgatggaagaaccaagaaggccacaaggatagttggaccaacaaaccaaactaatctagacgcttccttgccaggatgtggcacactctccacacttttcatctgataactactgccttgaaatgagatgaaccctgatt

SEQ ID NO: 31965 - DNA, 7965 bp, Oryza sativa
gaagtaattgactcctgtgggtccatagcagcgaaggaagtaattcgcttgatatgaaaccttccatcgtggttgccgtatcttcttaaagcatgccctgtttagcatgtagaaaaactaagcacaaacacagcagctcaaattcaatagagttttatggaaagtagatggtccaaggggggaaaaccttttagggcgtccaagtgctgcattctacccccatttactctctgaattggcaatgaccttgcaaactgagagataatccgtgttactgctatgttactaaagctacatcagacaattcaccatctcttagtggtcacagcatacagaatagcagacgtatatggagtgatagtgatctttcaaaaccaaaagtatatggagtaggcactagttactgtgaccattcttagcaatttcaagtgcagtactgcagtatccctgaaattatctgccattaatgtattatgtatcccctctgtgggcgactcggatgacacagcctcactgcatgatgccaccacacgcagggtagatttttattatgcctttcttttcgaccgggatatacacaaccactcacgggaaattctaccggcggccaattaaaaccctgcctaatccccaacccaacccaggcaagcaagacaaccaccgcgtgaaattctataaattggctaggggacctacttgccttggaatacgagtaagcggaggagctgaggcggcagcgaggaggcgacggcgcggcggtccgggggcggggcctgagccggagggcggggctcgcgacggcggccatgggcgcgggctgtctctcccggcgtggcgttatctgtagcagcggccagtggccgggcgggcgggcggctggtgtggggagtcggggagggaggggaggccgggagggcagcgatggtggcctggggaggcggacgggcgcaacgcaacgcaggcacgggacaagtgcggtgtggccggttggtgcgcgaacgtcgtcgcggactcgactcgcggtttgctcgcctcgcttcgcttcccacacttgcgctcaccgcctcacacgcacacggcaggcacggcacacgcgcacggtggcatcgtgctcggtgtttctgggccaagtttgcaccgcgcgatggggtaggccgtgtggaacgcaaatggtggctgcgctacacttgggctgctattccatggtttggtgggctctgattatcggtctttcgcgtgtgtatgggccgtatggcagcttagaagagaccttcgtctctctctcaaaaatgagagagtgtgcgtactggagttttacaaattactccgtactgtactacaatagactgaaatacaaagaagaaaaataattgagtattggttgacggacatactatcctactaatctactattcccttgcacgttcatgtgaggtctatttgcacacgggtttgttttgataatgctcatattttgaaactggcacagatccgtagattctaaactttgtgtatatattcaaactttaccatggatttcatagatattcaaattttgtacgcggttttttgagcgacaacagttgcagggtgttgactgactactgagtagggcatgctatgtacgtcgagtgtgaggagggggattgtccgtcgccaaaatatcacctcaactatgccgcgagaatgaagtcgcgctagttattttatactactcaactaaatcaaatgcctctctaatggtcatttagatgacgttttgtccaatactttaatttggtataatgatagtcctattttgaccgaacaaaagctgaagcttgacactgttcttcagacttcgaaagaatctgcagctcataaagccggagcactttcacatttcgagccactgttcccagcgaatcaacgactttagcaatagaaacactgataccaacatatcacatcaaaaagttttgactgtttgagtatgagtatgattaccatcacaaaaaccacagggagcaaaccaccaacaagcgccgatccacagaagtaaatcaaacccgtatatatctggagtactagcgtatagtgcccccccaatcccaaggccaccgaggtgaccgcgcgcgccacgacacacgtacacccctcactgtactccactaagcccacgaggccacgacccacactgtgcgcgcgcgcggtcaaacgacacgtaccatcaatttgtacagttgtactacaaccgcgaccttattgtccgtggcattcttcacaccccggccggcgacgcgtcgacggggacggtgtgcctgggctgtccgccattggcgaagaccttccggccttggggaaggttgtttttcgggaaccggacggtggccggggtgaaaccccttctcgcgctcgtgatccgaccactcccggctgtagtactcctccgccggggcccccttcctcgggcctacgagcatgccgccccactgcgggaagtagatgagcatgacgggcagcgtgcacgcgatgatcatgagccccatgtacttgatcccggtctccgtcttgtactttgtgccgtggaagaagatgtactgcgtcagcacggcgcccacgttgcccccgccgccggtcatcccggagatgagccccagcgacctccgcgacacgaacggcacgatgccgaaggtgagcccgcacgcggcctggacgaagaaggagaagagcaccatcacggcgacggacgcggcgaaggagaagtcgacgattccgagcaccacgcagaggacgccgccgatggtctgcacagtccacagcccccacagcctgccgcgcatgccgtaccggctggagagccagtcggagagtagcccgccgccggggcgggagatgatgttggccatcccgaagctggcggcgatgagcccggcggtctggaggttgacgtcgaagcggtcgtagaagtactggtgcacgacgttgtcgatggtgagctcgacgccgaagctgtagccgtaggtgagcgccaggatccagccgcggtagttggtgagggcgtggcgcagcacgttgccgaagctgtccttgtgcatgtcgccagtcttgtggagcttcccgtagttgccgccgggcatgtcctgcccgaacgccagcacggcgatggccgagaacgtctgcatcaggcccgggatgaagaaggcgatgcgccacgccgtgaacggcgtgctaccgatcttgtggatggcctcgtacacgagcggcatgagcagctggacggcgccgccgccgaggttgccccagccgccggccacgccgttggccagccccactttgggggccgagaacatggagctcatccagaactgcgccgacacgaacgacgccagcgagatgcccgtgaagaagcgcacgaggaggtaccccgacggggactggatgatggaggagcagtacaccgccggtgtggtgaggaggatcagagacgcggaggccagcctgggcccgaccaggtcgcacgccgtgcccatggccagacgcgcgaacacggcgcccgacacggacgcgatcccggcgttgccgatgtccgtggccgtgagcccgagggtgtcgcggatgagcggcagcagcggcggcgcggcgaacgtggacacgaagcagcagaagaaggagaaccacgccatgtggaaggaggccatgtgtggcctcgcgaaggagaagagccagaactccgtcgccttgaggtcggagtccaccggcatcctgaaccgcggcttgccccccgccgcctcgaccccctccacctccatcgccaccggcttagcctccatctccaacacgtggtagcaaggctagcagcttagctagtgactgtgtgtacgtacatccgctgtgccctgcgcgtcagctcttatagcatagcggaaagcgcggctccggcagcgcggcgcggcgtggcgcgatggttgggtgcggcgagagggcaaccggtggagagaaaatgaataaagatttcgggcgtgatcttacgcgaccggtgggaggccggcgctgccgtctccgcgctcgcgtcgcgggtttttgttggcgagcgggtgacttggcggcgcagtagggtcaccaagccgcaagggtggtgggccatggctggaacgaagggagattccgacctctgactttggaggtcacgtaagttccttggcctgtggaactgcctccctcctcggcacacacgaatactgtattggcggagaggaattcgtcgcggatttggattgggttcccccggaatgccaccaagtctccaactattatggcaagttttatggcagagatgactatcacatctaatattgtccatatcatcaactaatttattaaggacagctcatataatagtctcaatgcaacataaatatttattttattcactctcatccaatcaacctcactcttttctccttcctccttaaagtttgtaaagaggttgtcccttgtatgagggatggctcatcctctctctcatctactctcttctccacatcatcatttaaaattagatggcatctaggagattgtgcttaaataactatagtacttgccgttagctcttctccttctccagtctagttgacaatagtgctacgacatgataacctctgattggcgagtactgtacggataactaaactatgcaacactaacatgttggtgactttgtggtcattttaattttggaacggtgagatcagctcacgtttaacacaattatactttgagacgagctgttttatgtgttcttgtatgcctagtgcagtgaacggcctgtatcttttcatatctatattaacagtatgcctagttgcctacttcctccatcccataaaaagaacactcctaacatctcaagataatttgagtgagaagtaaaaataatcaaaatccttattattattgaaaaagtagtaacggtgataagtaagtaaaaggtatttaagaaataaaacttctcgttttatgtgttgagagtaggtgggatggtagaagttggtttttttttacaaaatttaaactgcaaaagttgattttttttacatagggagtactgctcagtatttttttttataaaaaataggatacagtgtactacttgtccttgtttttctgaatgtcaaccagttatagccgctggtttgctagaaaacagctttgcgcatgcataggacatgttaaaaaagggatcagttgtgcaagtggaaggagaaggacatcacgatcgcaaacgatttgcatgccaatatattactgcatttgaaagcatcaaatctcacggtatatttgcaaacgaaaaataatttgtagataaaatttttacatatgtgtttttaatgatctaaaagtaaagactgaaaaataaacttcgatgaaaaaactccaaatcaactttaaatttaaagttgaaaattttaattttggcttataaatataagtataagcgaaaagatgaggctgaaagtgtggcatcatgcacatacctcagctaggattgcgcagccaaaggacacaatcatatgatttggaagagagaacagaataactaatattcctcaggaatttgttccacgcgaaaaatattcctctgtaatggctggagatcctgctttagtacggataggaaacaacgtttgtggttggaagaaacggccaacaactagaaacattcagaatttagctttcaaaactacttatgattatgctagtaggtaccaaggtgcaaccagacaagtaggtgatgaaaataaccagaaattgaacgctgcatttgtacacttgcgaaatgtttttcccctaccttaaccatggcttctcatgctctgaaaagggcaagattaatttcatcagagttgatgacaaattgaagatacatatgcatatttattttgagacaaattcatttttgaataagtatgaacatttcaatttggacgaaaagtttccttgagctggccggccggcctggccccaagcaattcctggcaacagagcgacacgataacatgtcaaaacttgtgcactctataaaatggtgaagatatagacacgaagcataagatgtatagtaagtagctagcaagaggatcgaaatgtaagagctaaccccagctagtgttttctttttctttttcttttttggaacccttgctcaatcactgttaattagtggacatctaccaaaaagcccaaacttaaattccgggttaccaagttaaccaaaattcttgtgacggcctataaagtttgcattctctggatgtggatggcattgacttgagcaatggagtttgctctggatatatgtgtgacgtctcagcttgaaagctgaattactgtaataaactttggtcggaagctcttgagctaaaggctgggaaacaagttgatcccacaaaacacgatatcatgtggctcttttaatcttctgtacgtgtagcaactaacaataaccaccattataatatacagatgcttgtgcaacccctccgcggactgcggctgttccgcagatcgttgcaagattcttcctctgactttggtatctcgcgtcatctcctcggctttttgctgctaccaaaagtctctgcatagttaaatgtgagatacatttggggtacttatatatttagagcacatccggatccatggtttgtacggaacacagacgatgcaagggattttctgaaatttgaaaacctgacaattagatcattcatgaagatgaaggacatggatgtcaggggcgatcgattcaatatccgggccagtatatgcatcttgtactagtagactactagtttcaacatttcacgctgatatgattaggatttgtgcaagaattgcagataagacggatatcccttcagttacgtttcgtgactagtatacattggactgaaattattggttccggccggacatttcctgcagctcgtatgaacttgctaagcaagatgccaacttgctatcccccaaattgtcaacctcgccgtaggttggcatccaattggcagttactttattgacctgatagggatggccgtgtccttcaactccagcttagcggtgaccccagcaggtgaatgtggcaactcggatatcccagccgcagctagagctcctctcaccaatcactagctctctgttgcatcatcattaagtcatggtgattagttaagataaaaatgacgtattgtgattagtttagcctgcgatctcatgctgtcccagcttgctctgaccaacaaagattcaagataccgtttctgcactattgaactaccagccatcggttgagacgacttagatttgatattattgattcatggcttggcttgagtttacttgggtatccaatgggcgcctctggcttgctggttcctgtaacttcgatatcttaaatatatataggtggctgtttacttacttaagtagcacatgtacgcctgtaatctcctcatcaaactttgaatgcgcagtgatagtcaggatcaattttgagctaaacaaaagtttgcattgccttggttaaattggtcgatggttaattggattgagtttggatgtagtggggacatacttctcgcaaatgtctgcgctacagtgctacctgttcattctccggtagccatttgtccgtagcacataaataaacaagataataccgaaattaattagggacataacttttttaggagaaaactgtaatgcttagcacaccactaaacacgccgaggccattttaaggccgtagagatccctacgatcatggctagccatccacgaccaaaccgcaaaaatttacgccatttttggatcgacggccgtcaagtcccgtacgtcttcttttaccaccaccatttgatctgtttccttctcagacaccaaaggaacttgttttttgtatttttcttttcggtagctactttc

SEQ ID NO: 31966 - DNA, 918 bp, Oryza sativa
tcatcgacatttgtacttgcaatgagctctgagcttctctctctgatggagttaattattgaacctgatgatataccataatgggccgcacttctgtcaccatcatgttccggcccaataaaaacaggctgtacagtcatcgatacggaccacaccgacggcctagcataaaagaataagttcagtccaggtctcgtctttacgcggagtttgaatcacgaccataaaccacaatactaaatataacatgtctcccaactatcaaaaccagtataaaaataattctcataggatttgaatggcaatttttgctgacgtgacgcctacatgactagtttgaattagttgttgtctaatatgccttgacgagtcactagaaggaagactaaaaaaaaaaagttgaaacaaaatatttaagctcatgtgtcaggaataaataaaaataaaaaagtagtaggacccacatgtcagtgggttctactctcctttctatctcccacgcgaagaccgggcgtgggtggggaggaaggcgaggatgtaacgtcggccgatgtgtcgctcgtattcgtttgatcgtttcgaagaagcattggaggtgaactgtgtgggaggagtcagaggcaagctaccattgccccctagtcatcggctttagcctgggtggccaacatccacctttgccctgtgcgcgcagaggtaccagtggcagagagcggtaggaagtggcatggggagagatgatgggaggaggcatcaacggcagggtggcaggtggcggcgcggtcgccgtctttcctcccatacgttggctagctcctcctgtcaagttcttcattagcccctcgtgtggctgaaatttttacattttggtcctttttaaaaacttattttacaaatagacccctgggaaaacttaaa

SEQ ID NO: 31967 - DNA, 444 bp, Oryza sativa
cactggcgccgtgcccgtgccaccgtggcactagggctgtcgtagaggtgctgactgggcagaatgggggcgccagccacactggcgctgcccctcctaccacggcgccagcatggctggcgcgcccctcctctgtgggccgaccccttaaaccccgtgggccccaccacctatctcctccccactcccattttcgcccaagcaccagcccgagctgagcagcagcagctctccccctcacctccccacctcaaatccactccatttgaactcgtttttcgcgagattttttgtggaaatcgaagagaaaggtagactctttcattcacccctctttttttttgtttttagtggttgaatttgtagatcggtgggtaaccctagaaccccttttttacccaaatttgtgatttttagcatttgttcttaggattggcttgttgt

SEQ ID NO: 31968 - DNA, 711 bp, Oryza sativa
ttcctgcagcccgacgagttcgtgcgtggttcgatgaacagtggtcaaaggcttctgtcacttgcaactttttaacggcagcttggtagtatatggagtacttagcttctctgaaatattgctagttgtatacttgtatctctctctgtgactttatctagctcggtctgtcagcgtagggacgggtgagtttactgataactcgctcgtacgtatgcacacgtaaggatgacgtcgttaatgtgttgccatttgattgtcatcgtcagggcttaaacggtgcggcaagagctgccgcctccggtggctcaactacctccgcccggcgatccggcacggcggcttcaccgacgaggaggacaacctcatcctgtcgctctacggcgaaatgggaagcaagtacgtgcatgcatgcgtgcgctctagtctacctgcattcacatgacctctacctctgtgcgagtatattgattatacttctgcgtgcgtcgccgtggatgtgcacaggtggtcggtgatcgcgtccaagctccccggccggacggacaacgacgtcaagaactactggaacaccaagctcaagaagaggtacttggccgcggccgcaacagaagcaaccactcctcctcctcctgccgccggcgacgatgacaacaacccaacgacacaagcctccagccaacccgcttctcctactcctccggcgcccct
